United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 9

SEQ ID NO: 24579 - DNA, 1557 bp, Triticum aestivum
  Clone ID: PAT_TA_24579
ccgaggaagctggtcgtctggtgcagcgccgacgcggccatttcgctggtggctggggctgcctgcgagctcagtgagatgaactggtgtttttagaaaaaaaaccataggcaggcagattgcgtagctaattcaacgagttcgagtatcaaacattacacgtagttaattatgctaccacatgcgtatcttaaaaactttgttaaccatggaacgacataagttaagaatacaaagtccagcaacgtgcagttacacgcttccacagactcaacaaggcggagaaagctcgggtcctcacttccacagcttccgcaaggacatgttcttctcattgtccttcttcatcaccttggccaccgccatctcgaagtcctcctgtgttacgtgcacccttctctcacggagagcaaacattccggcttcggtgcagaccgcctttagctcagctcctgaagcgccattcatctttccagcaatctttttcagatcaattccacgcatcaagttcatccttcttgaatgaatcttcaagatatcacctcgtgaatcctcattaggatttggaaattcaatcttcctgtctatgcggccaggcctcaaaagggcttgatccaagatgtctatccggtttgttgccatcagaaccttaattttgtttgatgcttcaaaaccatcaagttggtttagaagctcaagcatggtccgttgcacttcactatcgccattgccagttccagactccattctagcagatccaatggagtctatctcatccatgaatataatagatggtgcatgctccctagccataacaaagagttcacgaaccatccgggagccctcaccaatatacttctgaaccaactcagaaccagatacccttgatgaaggtacagtcggtgtgatgagcaactgcacgtgcccagtaatgttttgcctgtccctggcctcgtgccggattcggcacgaggcactccactcccatcacacacacggacacacctgcaagagcgagagcgtgagccatggcgggcatggggaagcagcaggtggtggcggcgctgatgctggcgctggtggtgctggcggcggcgccgggcggggcgcacgcggcgtgccaggcatcgcagctggcggtgtgcgcgtcggcgatcctgagcggggccaagccgagcggcgagtgctgcggcaacctgagggcgcagcaggggtgcttctgccagtacgccaaggaccccacctacgggcagtacatccgcagcccccacgcccgcgacaccctcacctcctgcggcctcgccgtcccccactgctaggcgccggcaggcccctggcgcatatggcaagctagctgcctcagtgaccatgagagcgtcagactatagctagccctagctgagtgcgtgttgcgtccatgaacgcatcttcctgtcaaccatgtggttcgactttgatgatgctggaataaaaatataaaatgttgggtgatgatctacggcagccatgttgcttcttggctgctgctggtaataaaatttgtgttacaactttgaa

SEQ ID NO: 24580 - DNA, 626 bp, Triticum aestivum
  Clone ID: PAT_TA_24580
acttccacacactaccagtagactccactcccatcacacacacggacacacctgcaagaggagcgagagcgtgaaccatggcgggcatgaggaagcagcaggtggtggcggcgctggtgctggcgctgatggtgctggcggcggcaccgggcggggcgcgcgcggcgtgccaggcgtcgcaactggcggtgtgcgcgtcggcgatcctcagcggggccaagcccagcggcgagtgctgcggcaacctgcgggcgcagcagccgtgcttctgccagtacgccaaggaccccacctacgggcagtacatccgcagcccccacgcgcgcgacaccctcacctcctgcggcctcgccgtcccgcactgctaggcgccggcaggcccctggcgcatatggctagctagctgccgccgtgagagtgtcagactatagctagcctagctgagtgcgtgttgcgtccatgaacgcatcttcctgttatgtggttcgactatgatgatgctggagtgaataaaatgttgggtacggtgatgatctacgccggccatgttgcttcttggctgctgctgctggtaataaaatttgtgttgcaactttgatggaaaaaaaaaaaaaaaaaggccccta

SEQ ID NO: 24581 - DNA, 737 bp, Triticum aestivum
  Clone ID: PAT_TA_24581
ccctattaaccctcactaaagggaacaaaagctggagctccaccgcggtggcggccgctctagaactagtggatcccccgggctgcaggaattcggcaccagccagtacactccactcccatcacacacacggacacacctgcaagagcgagagcgtgagccatggcgggcatggggaagcagcaggtggtggcggcgctgatgctggcgctggtggtgctggcggcggcgccgggcggggcgcacgcggcgtgccaggcatcgcagctggcggtgtgcgcgtcggcgatcctgagcggggccaagccgagcggtgagtgctgcggcaacctgagggcgcagcaggggtgcttctgccagtacgccaaggaccccacctacgggcagtacatccgcagcccccacgcgcgcgacaccctccagtcctgcggcctcgccgtcccccactgctaggcgccggcaggcccctggcgcatatggcaagctagctgcctcagtgaccatgagagcgtcagactatagctagccctagctgagtgcgtgttgcgtccatgaacgcatcttcctgtcaaccatgtggttcgactttgatgatgctggaataaaaatataaaatgttgggtgatgatctacggcggccatgttgcttcttggctgctgctgctggtaataaaatttgtgttgcaactttgatgaaaaaaaaaaaaaaaaaactcgagggggggcccggtacccaa

SEQ ID NO: 24582 - DNA, 1160 bp, Triticum aestivum
  Clone ID: PAT_TA_24582
cacccccacagccacagccacagacgcgcgaagcgatatcatcacgagtgagcgtctaggcgggcatccatggcacagtcgatgctcatgtccggcgtcaacggcgtggcctccggcaggagcctgctgcaggcggcccggccgtcgtcggcgtccacgcccttctcgcggctcgcgctctcctcctcctcgtcggcggcagcgtactacaagcacatgccgtccctctccgtccggaccatggccctgttcggcaagaagaccaaggccgcgccggccaagaaggtcgttgcccccaagcccaagaccgaggacggtatcttcggcacgtccggcgggatcggtttcaccaaggagaacgagctcttcgtcggccgtgttgccatgattggcttcgccgcatcgatcttgggagaggccatcaccggcaagggcatcctgtcccagctgaaccttgagaccggcatcccgatctacgaggcggagcccctcctcctcttcttcatcctctttaccctcctcggtgccatcggcgcgctcggagaccgcggcaggttcgtcgacgagcagcccaccaccggcctcgacaaggccgtcatcgcccccggcaaaggcttccgctccgccctcggtctcagcgagggagggccgctgttcgggttcaccaagtcgaacgagctgttcgtggggcggctggcgcagctggggatcgccttctccatcatcggggagatcatcacgggcaagggcgcgctggcgcagctcaacatcgagaccggggtgcccatcagcgagatcgagccgctcgtgctcttcaacgtcgtcttcttcttcatcgccgccatcaaccccggcaccggcaagttcatcagcggcgaggaggacgactagatcacgcgcgaatgctttttggccattaattgtacgtccgtccgtaccgtgctttgcttgtttgttgtgtacgtgagaccttggggtgtacttaggtgtaagaagttggtcgttgccttatgaaaaacaagagctagcagctaatttgccatgcataccgacagttgcaaatctatcgtctcggattctttgatcgttcccttctcccttaatgaaacgtgtacaatataattcttgaaatgaaaaataaacccaaatgatatttttat

SEQ ID NO: 24583 - DNA, 1116 bp, Triticum aestivum
  Clone ID: PAT_TA_24583
cgtccgcccatgcgtccgcccatgcgtccgtatagctccccacagccacagacgcgcgaagccatatcccgggactcacgagtacgtgcgtgagcgagtgagcgtctaggcggctatggcacagtcgatgctcatgtccggcgtcaacggcgtggcctccggcaggagcctgctgcaggcggcccggccgtcgacggcgtccacgcccttctcgcggctcgcgctctcctcctcgtcggcggcgtactacaagcacatgccgtccctctccgtccggaccatggctctgttcggcaagtccaagaccaaggccgcgccggccaagaaggtcgctgcgcccaagcccaagacggaggacggcatcttcggcacgtccggcgggatcggtttcaccaaggagaacgagctcttcgtcggccgtgttgccatgattggcttcgccgcatcgatcttgggagaggccatcaccggcaagggcatcctgtcccagctgaaccttgagaccggcatcccgatctacgaggcggagcccctcctcctcttcttcatcctcttcaccctcctcggcgccatcggcgctctcggagaccgtggcaggttcgtcgacgagcagcccaccactggcctcgacaaggccgtcatcgcccccggcaaaggcttccgctccgccctcggcctcagcgagggagggccgctgttcgggttcaccaagtcgaacgagctgttcgtggggcggctggcgcagctggggatcgccttctccatcatcggggagatcatcacgggcaagggcgcgctcgcgcagctcaacatcgagaccggggtgcccatcagcgagatcgagccgctcgtgctcttcaacgtcgtcttcttcttcatcgccgccatcaaccccggcaccggcaagttcatcagcggcgaggaggacgactagatcggcaccggcacgagcgaatgctttttggccattaattgtacgtccgttcgtgctttgcttgtttgttgtgtacgtgagaccttggggtgtacttaggtgtaagaagaagttggtcgttgccttatgaaaaacaagagctagcagctaatttgccatgcatgccgacggttgcagatcta

SEQ ID NO: 24584 - DNA, 832 bp, Triticum aestivum
  unsure (1)..(832): unsure at all n locations
  Clone ID: PAT_TA_24584
gccatgttgcttcttggctgctgtagatcatcacccaacattttatatttttattccaagcatcatcaaagtcgaaccacatggttgacaggaagatgctttcatggncactccactcccatcacacacacggacacacctgcgagagcgtgagccatggcgtccatggggaagaagcaggtggtggcggcgctgatgctggtgctggtggtgctggcggcggcgccgggcggggcgcacgcggcgtgccaggcgtcacagctggcggtgtgcgcttcggcgatcctgtccggggccaagccgagcggcgagtgctgcggcaacctgcgggcgcagcagccgtgcttctgccagtacgccaaggaccccacctacgggcagtacatccgcagcccccacgcgcgcgacaccctccagtcctgcggcctcgccgtcccgcactgctaggcgccggcaggcccctggcgcacatggcaagctagctgcctcagtgaccatgagagcgtcagactatagctagcctatctgagtgcctacgtgttgcgtccatgaaagcatcttcctgtcaaccatgtggttcgactttgatgatgctggaataaaaatataaaatgttgggtgatgatctacggcagccatgttgcttcttggctgctgctgctggtaataaaatttgtgttgcaacttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggc

SEQ ID NO: 24585 - DNA, 608 bp, Triticum aestivum
  Clone ID: PAT_TA_24585
accttcacacaactaccagtagactccattcccatcacacacacggacacacctgcaagagcgagagcgtgaaccatggcgggcatgatgaagaagcaggtcgtgacggcgctgatgttggcgctggtggtgctggcggcggcgccgggcggggcgcgcgcggcgtgccaggcgtcgcagctggcggtgtgcgcgtcggcgatcctctccggggccaagccgagcggcgagtgctgcggcaacctgcgggcgcagcaggggtgcttctgccagtacgccaaggaccccacctacgggcagtacatccgcagcccccacgcgcgcgacaccctcacctcctgcggcctcgccgtcccgcactgctaggcgccggcaggcccctggcgcatatggctagctagctgccgccgtgagagtgtcagactatagctagccctagctgagtgcgtacgtgttgcgtccatgaacgcatcttcctgctaaactactatgtggttcgactttgctggtactggaatgaataaaatgttgcgtgatgatctgcggcggccaggttgcttcctggctgctgctgctggtaataatatttgtgttgcaaccttgatgaa

SEQ ID NO: 24586 - DNA, 828 bp, Triticum aestivum
  Clone ID: PAT_TA_24586
gccggccgggttgggaaacacaagcaccacagtcacttcactgctcaagtagctggcaagagctttgaacgcgttgcaaccttgcatcccggtcgatcgatcgatggcgtccaaggtcgagctggtggtggaggtgaagtcgccggcggagaagctgtggacggcgatgcgcgagtcgacggagctgttccccaagatcttccccgagcagtacaagagcatcgagaccgtggagggcgacggcaagtccgccggcaccgtccgcctcatcaagtacaccgagggggttccgatggtgacgttcgccaaggagaaggtggaggtggcggacgacgagaagaaggtggtgtcgtacagcgtggtggacggcgagctggtgagcttctacaagaacttcagggtgacggtgcaggtgaccgacaagggcgccgacggcgccggcgcggtggtgaactggaccatggacttcgacaaggccagcgacgaggtgcccgagccggacgtcatcaaggagaccgccgccaagaccttccacgacctcgacgactacctcctcaagaactagcagctcttagctgcctcgtcgctggccgctgcggacgatcctccatccgtccgtccgtccatccatccatccatgaatactgtcgttgttgcctgttgtctgcggtgtccccgcaccaagcttactctcacgtaaacgaccgtgtgtacggccgtgtacgtgtgcatctgcctgcgatgggacggccgcgtgagtagtggaataataaatataacaataataaagtcgcagctttatgatcaaaaaaaaaaaaaaaaaaaaac

SEQ ID NO: 24587 - DNA, 2896 bp, Triticum aestivum
  unsure (1)..(2896): unsure at all n locations
  Clone ID: PAT_TA_24587
gactccaatttaaccctcactaaagggaacaaaagctggagctccaccgcggtggcggccgctctagaactagtggatcccccgggctgcaggaattcggcacgagatggcggcggcatcagcgggcggcgagccggtagagccgcagtcgttgaagaagctgagtctcaagtcgctgagacgctccctcgacctcttcgcgcccacccactccctccccttcgctcccgacgccgagagcaaacggattcgcgtcagctgcaaggtgaatgcggagtacggcgcggtcaagaacctgccgaccgaccaggaccgagcgcaggggaagggcgccgccgctccttccaatgcattggcgcttctaggcacacaagacacaaaagatgctcctagggaaggcactagtaatgccattatccctgcaccgcttatgcttcctaaagcacccgaatctgcagtgcctggcaaaaatacaaccgtattatcgatccctgggtcatctgatagattctcgacatctgcactgatggaaaggttgccaagtagatggcctaaacctgtatggcatgctccctggaagaactatcgggttatcagtggtcacttgggatgggtgcgatctatagcatttgatccaggcaatgaatggttctgtactggttctgctgatagaacaataaagatatgggacctggcatcaggaacgttgaagctgacactaactggtcatattgaacaagttcgcggacttgctgtcagtcagcggcacacatatctattttctgctggtgatgacaaacaagtaaaatgttgggatcttgaacaaaataaggttattcggtcttatcatgggcatctgagtggggtttactgcctagctccccatccaacaattgatgtcttgctgacaggtggtcgagattcagtttgcagggtgtgggatatccgaacaaaggctcatgtttctgctttaactggacatgataacacagtttgttcagtgtttgctcggccaacggatccacaagttgtcactggctcacatgatacaactatcaagttctgggatcttgtagctgggaaaactatgtgtactcttacacaccataagaagtctgttcgggccatggcactgcatccaaaagagaaatcatttgcatcagcatctgccgacaacataaaaaagtggagcctgcccaaaggcgaatttctgcacaacatgctgtcccagcaaaaaacgattctgaatgcaatggctgttaatgaggatggtgtcctggcaactgcaggggacaatggaagcatgtggttttgggattggaagagtggccataattttcagcaagaacagactattgtccagcctggatcattggagagtgaagcatgtatatatgccctttcttatgataatagtggatcaaggcttgtgacatgcgaggcagataaaacaataaagatgtggaaagaagatctaacagcaacaccagaaacccaccccgtcaacttcaagccaccaaaagacatccggagatattgattgccgcataagttacaagattgatttcgaccacccaaattctactctttggttgagtgttcacctcgttgagcctttatggtggtgttcaagccctgacgtccctgttgtataatacagattgtcttgtgctagtatttattactgaatctgaagcatgttttctaagttcaaatatattttgttctatgcattgggaatttttgtgatgtatcaaaattcccccaagatacagcaccctcacagccacagacgacgcgcgaagcgatatcacgagtgagagtctaggggccatggcacagtcgatgctcatgtccggcgtcaacggcgtggcctccggcaggagcctgctgcaggcggcgcggccgtcgtcggcgtccacgcccttctcgcggctcgcgctctcctcgtcgtcctcggcggcgtactacaagcacatgccgtccctctccgtccggaccatggccctgttcggcaagaagaccaaggccgcgccggccaagaaggtcgctgcccccaagcccaagacggaggacggcatcttcggcacgtccggcgggatcggtttcaccaaggagaacgagctcttcgtcggccgtgttgccatgattggcttcgccgcatcgatcttgggagaggccatcaccggcaagggcatcctgtcccagctgaaccttgagaccggcatcccgatctacgaggcggagcccctcctcctcttcttcatcctcttcaccctcctcggcgccatcggcgcgctcggagaccgcggcaggttcgtcgacgagcagcccaccggcctcgacaaggccgtcatcgcccccggcaaaggcttccgctccgccctcggcctcagcgagggagggccgctgttcgggttcaccaagtcgaacgagctgttcgtggggcggctggcgcagctggggatcgccttctccatcatcggggagattatcacgggcaagggcgcgctggcgcagctcaacatcgagaccggggtgcccatcagcgagatcgagccactcgtgctcttcaacgtcgtcttcttcttcatcgccgccatcaaccccggcaccggcaagttcatcagcggcgaggaggacgactagagatcacgcgcgaatgctttttggccattaattgtacgtccgtccgtccgtgctttgcttgtttgttgtgtacgtgagaccttggggtgtacttaggtgtaagaaagaagttggtcgttgccttatgaaaaacaagagctagcagctaatttgccatgcaaaaaaaaaaaaaaaaaaaaaaaaaaaaaaaaaaaaaaaaaaaaaactcgagggggggcccggtacccanttcgccctatagtggctg

SEQ ID NO: 24588 - DNA, 878 bp, Triticum aestivum
  Clone ID: PAT_TA_24588
tcgaggggccggccgggccggggactagcaccacagtcacttcactgatcaagtagctggcaagagctttgagcgcgttgcaactttgcatcccggtcgatcgatggcgtccaaggtcgagctggtggtggaggtgaagtcgccggcggagaagctgtggacggcgatgcgcgagtcgacggagctgttccccaagatcttccccgagcagtacaagagcatcgagaccgtggagggcgacggcaagtccgccggcaccgtccgcctcatcaagtacaccgagggggttccgatggtgacgttcgccaaggagaaggtggaggtggcggacgacgagaagaaggtggtgtcgtacagcgtggtggacggcgagctggtcagcttctacaagaacttcagggtgacggtgcaggtgaccgacaagggcgccgacggcggcggcgcggtggtgaactggaccatggacttcgacaaggccagcgacgaggtgcccgagccggacgtcatcaaggagaccgccgccaagaccctccacgaccttgacgactaccttctcaagaactagagtagcttttactagctgcctcgtcgctggccgccgcgtccgtcgtccgtccatccatccatccatgtctactgtcatcgttacttgctgtctgccgtgttcccccatctagcttactctcacgaaaacgaccgtgtgtaccatgtacgtgtgcatctgcctgcgctgggacggacgcgtgagtagtagtggactgataataaagtcccaactttatggtcacgtatacgtacgaatggtgttagatttgtgtgacttggtttgattcgatctgcaggaaaaatttagtatgttgtggcggaaaaaaaaaaaa

SEQ ID NO: 24589 - DNA, 856 bp, Triticum aestivum
  Clone ID: PAT_TA_24589
aatacgcgacggggcatatcccagccagccgtcaaagcacgacacatccaggtccaagcaaagcatccccagccgagccgagaccgcgtgcgctccacgcagcatccgccgcagcagccgcccagagaagtcgccgccggagaaggaggaggatgtcgtggcagacgtacgtcgacgaccacctgtgctgcgagatcgacggccagcacctcacctccgccgccatcctcggccacgacggcagcgtctgggcgcagtcccccaacttcccccagttcaagcccgaggagattgctggcatcattaaagactttgaggaacctggacatcttgcaccaactggtcttttccttggaggcacaaagtacatggtcatccaaggtgaacctggggttgtcatccgaggaaagaagggcaccggtggcatcactatcaagaagaccggcatggccctgattcttggtatctacgatgagcccatgactcctggccagtgcaatttggtcgtggagaggctcggcgactacctggtcgagcagggtttctaagcccgccctgatatgatgttattttggtcgtctgggactaagtttgctctactgtgggctttgcatccatctgcttggcgtaccgcatgatatatgcagtgaataattttagcttggggtttgtcggttggtgacgtgtcgaagggaaaaaaaggattttactatgttttctttttaatgtttggcatcgcgtcgtatcaaactcagccgctctttcgctgagtaatgtacatttgcctcgtcatggtaacttgtgggttctgctgctgctttattgaagatgattgcatttttactgaaaaaaaaaa

SEQ ID NO: 24590 - DNA, 935 bp, Triticum aestivum
  Clone ID: PAT_TA_24590
acgcctttcgaaattaaccctactaaagggaacaaaagctggagctccaccgcggtggcggccgctctagaactagtggatcccccgggctgcaggaattcggcacgagcagccgtcaaagcacgacacatccaggtccaagcaaagcatccccagccgagaccgcgtgcgctccacgcagcagccgccgagagaagtcgccgccggagaaggaggaggatgtcgtggcagacgtacgtcgacgaccacctgtgctgcgagatcgacggccagcacctcacctccgccgccatcctcggccacgacggcagcgtctgggcgcagtcccccaacttcccccagttcaagcctgaggagattgctggcatcattaaagactttgacgaacctggacaccttgcaccaactggtcttttccttggaggcacaaagtacatggtcatccaaggtgaacctggggttgtcatccgaggaaagaagggcaccggtggcatcactatcaagaagacgggcatggccctgattctcggtatctacgatgagcccatgactcctggccagtgcaatttggtcgtggagaggcttggcgactacctggtcgagcagggtttctaagcccgccctgatatgctgttattttggtcgtctgggactaagtttgctctactgtgggctttgcatccatctgcttggcgtaccgcatgatatatgcagtgaataattttagcttggggtttgtcggttgatgatgtgtcgaagggaaaaaatggatttactatgtttttctttttaatgtttggcatcgcgtcgtatcaaactcagccgctctttcgctgagtaatgtacatttgcctggtcgtggtaacttgtgggttctgctgctgctttattgaagatgattgcaattttaaaaaaaaaaaaaaaaaaggccccta

SEQ ID NO: 24591 - DNA, 1612 bp, Triticum aestivum
  Clone ID: PAT_TA_24591
aacaagcaccacagtcacttcactgatcaagtagctggcaagaggtttgaccgcagtacaaccttgcatcccggtcgatcgatggcgtccaaggtcgagctggtggtggaggtgaagtcgccggcggagaagctgtggacggcgatgcgcgagtcgacggagctgttccccaagatcttccccgagcagtacaagagcatcgagaccgtggagggcgacggcaagtccgccggcaccgtccgcctcatcaagtacaccgagggggttccgatggtgacgttcgccaaggagaaggtggaggtggcggacgacgagaagaaggtggtgtcgtacagcgtggtggacggcgagctggtgagcttctacaagaacttcagggtgacggtgcaggtgaccgacaagggcgccgacggcgccggcgcggtggtgaactggaccatggacttcgacaaggccagcgacggggtgcccgagccggacgtcatcaaggagaccgccgccaagaccttccacgacctcgacgactacctcctcaagaactagcagcttttagctgcctcgtcgccagggtggccgccgcggacgaccctccgtctgtccgtccgtccgtccgtccgtccatgaatactgtcgtcgttgcctgttctctgcggtgtccccgcaccaagcttactctcacgtaaacgaccgtgtgtacggccgtgtacgtgtgcgatgggacggccgcgtgagtagtggaataataataatgataataaagtcgcagctttatgatcacgtaaaaacaaaaaaaaatccaggtccaagcaaagcatccccagcccagccgagaccgcgtgcgctccacgcagcatccgccgcagcggccgcccagagaagtcgccgccggagaagggggaggatgtcgtggcagacgtacgtcgacgaccacctgtgctgcgagatcgacggccagcacctcacctccgccgccatcctcggccacgacggcagcgtctgggccgagtcccccaacttccccaagttcaagcctgaggagattgctggcatcgttaaagactttgaagaacctggacaccttgcaccaactggtcttttccttggaggcacaaagtacatggtcatccaaggtgaacctggggttgtcatccgaggaaagaagggcaccggtggcattactatcaagaagaccggcatggccctgattcttggtatctacgatgagcccatgactcctggccagtgcaatttggtcgtggagaggctcggcgactacctggtcgagcagggtttctaagcccgccctgatatgctgttattttggtcgtctgggactaagtttgctctactgtgggctttgcatccatctgcttggcgtaccgcatgatatatgcagtgaataattttagcttggggtttgtcggttggtgatgtgtcgaaggggaaaaatggatttactatgttttctttttaatgtttggcatcgcgtcgtatcaaactcagccgctctttcgctgagtaatgtacatttgcctggtcatggtaacttgtgggttctgctgctgctttattgaaagatgattgcaattttagtgaaaaaaaaaaaaaaaaa

SEQ ID NO: 24592 - DNA, 1621 bp, Triticum aestivum
  Clone ID: PAT_TA_24592
ttttttttttagctaattcaacgagttcgattatcaaacatttatacgtagttaattatgctaccacatgcgtatcttaaaaactttgttaaacatggaacgacataagttacaagtccagcaacgtgcagttacacgcttccacagcctcagcaaggcggagaaagctcccacagcttccgcaaggacattcttctcattgtccttgcttccacagcctcagcaaggcgaaaggtcgggtcctcacttccacagcttccgcaaggacatgttcttctcattgtccttcttcatcaccttggccaccgccatctcgaagtcctcctgcgttacgtgcacccttctctcacggagagcaaacattccggcttcggtgcagaccgcctttagctcagctccggaagcgccattcatctttcccgcaatctttttcagatcaattccacgcatcaagttcatccttcttgaatgaatcttcaagatatcacctcgtgaatcctcattaggatttggaaattcaatcttcctgtctatgcggccaggcctcaaaagggcttgatccaagatgtctatgcggtttgttgccatcagaaccttaattttgtttgatgcttcaaaaccatcaagttggtttagaagctcaagcatggtccgttgcacttcactatcaccattgccagttccagactccattctagcagatccaatggagtctatttcatccatgaatataatagatggtgcatgctccctagccataacaaagagttcacgaaccatccgggagccctcaccaatatacttctgaaccaactcagaaccagataccctgatgaaggtacagtcggtgtgatgagcaactgcacgtgccagtaatgttttgcctgtccctggaggcccgtaaaggaggacaccctttggttgggcaattccgagactctcaaacagctcaggatgcttgatgggaagctcaatgacctctttgatctctttaatttgctgatcaagaccaccaatcatatcatatgtagaatctgggaccttctcaactttcataagattgaccagtggatcaactttgcttggaaggataaggtgaagcatgtagctgtcgttccgaagagcaactcttgttgaaggggttatctttgtaatatcaatacttttatcaagatctacaacatatttgccttctggatgaaccttaactagaacctttgacttgcccataaccttcacaacctcgccaacatatgagcccggttcttgaaggagctgcaactcttcccggagcattctaactcgcgagttgaggtcgttgcgctgggcctcgaggcggttgaggttgtgcgtcttggtccggatctggagctgcaggtcgtggatgtgctgcaggtagtactggcgcaggccctccccgccgccacgcgcgcccttggccgacgccgccgacgggtcgtcgacgctcgccggcagcgccgagggcttcgcgatgtccatcgccaccgccgccatcgggattcccccctcgtctgctccgccgctctgggggtggctcgagtctgctcgggttcgaggggagcttcttttccggcacgtttggctcgctcccacgcgtccg

SEQ ID NO: 24593 - DNA, 1092 bp, Triticum aestivum
  unsure (1)..(1092): unsure at all n locations
  Clone ID: PAT_TA_24593
gnatnctngctcgaaattaaccctactaaagggaacaaaagctggagctccaccgcggtggcggccgctctagaactagtggatcccccgggctgcaggaattcggcacgaggcagacgtaaaattcccacaaattgagttcgtccgtagcggctcaacgacacctccccgctcctccctggcggcgatcagcctccggccacaggagatgggcaccgccgcaaagccccctcccttcgtctgcttcaagtggccttggggccctagccttaatgcgagccctagcgccagcccaagcccctgcggcgacctcgagcgcccctggctcttcaagtctatctccaccgtcgcgcaaggcctcgtcatcgccggtgacatcccctccgcttccactggaagcggaggtcatggggcgaggttgtggaagcgtcacccgggcaccgcgccggtggaggcggaccgcggggacgcggagcagcgggcgctggcggcggcgctggtgagcgcgagggcgaccacggtgctggagttctactcgccgcgctgccgcctctgctcatcgctgcagggcctcgtgcgcgagctcgaggacggtggcaatgcatctgcgagcttcgtgctcgctgacgccgaggacgaccggtggctcccggagcttctgcattatgatgtcagatatgttccttgttttgtgctcctggacaagaatggtagagccctagcgaaaaccggagttccaactagcaggcagcatgttatcgccggccttcatcatcttcttaacatgaagcaaccatctgggcaggacggaaagaagagtcgatcatgatgacaatttcttgcgcatgatctgtaatcatggatcgtatcagataacacattttttttgttaaccaagcatagacaatgttggaaaatatatttttagccaactcatatatggtcagaattctagaagttgatgtggtgtaattagaatgtgggagaatgtgctgcttttgtgtcctttttcctgatgaatagcggtgtatctgaatatacacgctggaatattcttctgaaataattcatcatgatttgtgatttgctgtt

SEQ ID NO: 24594 - DNA, 517 bp, Triticum aestivum
  Clone ID: PAT_TA_24594
cgcccgccatagtccatgtagatcgccacgatactgaaatcgaacatccgcaacatgtccgcaccacattttgccaactttattatcaagcggccctggcttctgcgtgtgtttgacccgttcgcgaagtggtacacaaacgctgccggataccgcaaattgggcttgagggccgatgaccttatcccagaagagtctgaggttgtccttcacgccttaaagcgcctacctcccaaagatgcgtatgatcgagtttttcgcataagacgagcagttcaagtgttccctctcgcaccaacttctccccaaggaagagcagaccaagcctgaagaggacgttgaatacctgggcccattgataagagaaatcgaggcagaagccagagaacgcgcagacttggagagtctagccattgaaaagcgtaaataaggatataaaaacaagaatattgtactagtgcactgcaagggtcaagagatgcaaaataacgtcaatgaatgtattatttaagaaaaa

SEQ ID NO: 24595 - DNA, 464 bp, Triticum aestivum
  unsure (1)..(464): unsure at all n locations
  Clone ID: PAT_TA_24595
ctcgtgccgcaaaaatgtcatttcctgcgccaattatcattcctgctgtgcgggaagcatacagcaacaagtcattgtcgctcatggtcttggtgactcgggcgatggctgggtctggctcgcagaaaattggcgtcgacgccacaagtttgagggagtgagattcatcttccctcacgcgccgaagatacccatctccatgaatatggggttatccatgcctggatgggtggattttcgctcctcacggaccggcaatccgcccctcatggaccgggcttcctacgctcattggcccagccgcttcggcccgcttaccccccgggcgcgggcgggtaacgagcgtttgctcgtgggaggtgccgatgcccattgtggcgcgtgggaccttcccccggcttaccttcccggcaaacttgggggcgttctggggttcctggtgccccttgctgnaagattcaacn

SEQ ID NO: 24596 - DNA, 340 bp, Triticum aestivum
  Clone ID: PAT_TA_24596
gattgaaaaggaaagggccaggtactgcaaacccattcaagcaggtgttaacttgtggcaagtaactagtggtgagcaaacacatgctgtcaatttggaagttgaaacctgtggttgcagaaagtgggacctcagtggcatcccatgtaaccatgccatctcagcaatcaacaaggcaaaaaggtttccagaggactttgtaagcaaattcttcaagaaaccatattatttggcagcatatgaaccaatgatatatcctgtccctggtgagcatgactggacaaagaccccaggtccagacatagaaccaccagcatttaaagtgaagaaaggaagaagg

SEQ ID NO: 24597 - DNA, 863 bp, Triticum aestivum
  Clone ID: PAT_TA_24597
gcacgatagcctcccagccccctctgcctcccgaaaaaacaaacaaacagagatcgcgcttccgatctagctctgcggctgtcgcgaggctccccatttccctccccgcagcgccgaagcaagcatgtgtcccggcggcaggtacgcgggccttgacctccccgccggcgccggcgcgggggacctgcggccggcgttcgacgtgctggacgcggaccacgacggccgcatcagccgcgacgacctcaagaccttctacgccaacgccggcgccaccgacgagcgcttcgacgacgacgacatcgaggccatgatcgccgccgccgacgccgacctcgacggcttcgtgcagtaccacgagttcgagggcctccttggccgcgcagctaaggcgggggcggacagcggctgccgctccgcgatggaggacgccttccggctaatggaccgcgacggggacggcaaggtcgggttcgaggacctcaaggcctacctcgggtgggccgggatgccggtcgccgacgacgagatccgcgccatgataagtatggctgctgacgacgacggcggcgtggggctcgaggcgctcgccagaatactcgccgtggactttgatgccatcgtctgaagaatctaaaataatccgactgtaaagcactagacttgattttttgggacttttcccccctaaaatttggttggtggggagagcaggctggcgtgagattgattgttgtaagtggttctcgttaaccgtgagttttgaatgtatcgtagctgttacccataaaatcgaatctttgagaaacataaaagataaaaaacaaaaaaaaaggcccctataaacaagtgctctaccctcc

SEQ ID NO: 24598 - DNA, 1069 bp, Triticum aestivum
  unsure (1)..(1069): unsure at all n locations
  Clone ID: PAT_TA_24598
gagggcgacatggcgctccagccgctgctccggctcctcctccgcccagccccaaccccacctccgcctacgcgccggactccacacctcccagcccctttctccacccgccgcggcaccgccgccgcgctcctcctgctcgccgtcgccgcgccccctccgcggcccgcccgcgccgagcccgacggcgaggacgacgtcgacgagccccacgtcgtccgcctcttcgaggaggcgacgccgtcggtggtgttcatcaaggacctcctagtcgccccgccgccgcggacgcggggacgtgacggcgggggagcgcagccggtggatgacgaggaggggggcgccacggtggaggggaccggctctggcttcgtgtgggactccctgggccacattgtgacaaattaccatgtggttgcaaaattagctggggatggatctgagtctcatcgatgcaaggtgttcttggaggattcaactggcaccagttactcaaaggaagggaggctaataggatatgatccaacatatgatcttgctgttctgaaggttgatgttgatggtgataggttgaggcctgctctgcttggcacgtcacagggtttacgagttgggcagagctgctttgccattgggaaccctttaggatatgaacacaccttaactactgggtatcctataggtggttagtggactggggagggagataccatctcccaatgggagggtgattcgtggggccatacagacagatgctgctataaatgccggtaactcaggaggcccactaattgactcttatggccatgtaattggagttaatacagctacgttcacacgtaaaggatctggaatttcatctggggtgaactttgccatccctatcgacactgttgtacggtcggtaccgaatctcatagtgtatggaactgatgtgagcaacaggttttattaaacatttaattagctccgatgtatattctctgttcaatcaatgcaagttgtctctttgccacattctttactcccatctgctcaatgatgtttctcnaagaggttctggtaatat

SEQ ID NO: 24599 - DNA, 629 bp, Triticum aestivum
  Clone ID: PAT_TA_24599
aagcattgtctggtctccaacaatgataagtttgtttgcaggatacggcattgcaggatttatgttctacaccattactccttttgtcctcgagatgagtggagcaacattgcttaacctctcgctcttaacatctgacatgtgggcagtcgccattcgagtatttttctatcagcaacagataaactggttgtactatctagcattcgcagttgtggccattggattgatcatctactcactgaatgagagttcttcagctgatgcaacagctacaagtacagaagcagcagctcactatgaacaacttccaggtgaggataactcaacaggaagtggttctattttggacagaaaagaaaggaagcagcaagaagctcacatctgttaagggagccatacggtctgattgagcctgtgctgccacatccttgcaagtaagggcagctgctcagcagaagcaacatagatttcatgctatgccatttgcgtgttcataaaagaagtgtctatgtcttggtcgactgagaattaactaattctcatttgattttacaaatttatgcatacaaatctaatacaatgtttaccatgatataacaatttatgcatctagtgcaaaaaaaaaa

SEQ ID NO: 24600 - DNA, 486 bp, Triticum aestivum
  unsure (1)..(486): unsure at all n locations
  Clone ID: PAT_TA_24600
acgaattgaatagtctaccttccaactcgggtacaatgattaccaatacccgtcgattaataggtctaaagcccgctaagcagttgatgagatatagctcgtacaagagtccccatggnccgaaatacgccgtgcagcccaatatcggtggnttcactttaaaacaagccaaaacacttggcataactcttggtggatttggtggagtagctggcttctttgcattattcttcctaggggatgtaccaagagtgcgggaagatatactcgaaaaagtaccgttcatcgggagtcattttaagaagggaataccancaagtgataatccattttaaggcaataggtcggttgcggttggcaagagagctaaaacacgtatatctatcaattaaagagataacataggttacaaactactgtacagttgactccggggggccgcccggagaccntgnnagtttaggttgcnaatcaaagtaacccctg

SEQ ID NO: 24601 - DNA, 476 bp, Triticum aestivum
  unsure (1)..(476): unsure at all n locations
  Clone ID: PAT_TA_24601
ctcgtgccgaattcggcaccagcgtgattccatgccctccgacgacctcaatgactgaggggtcattgtttccttaatagataccataatttccaacatatcttgggtttagcgccaagactaactaatattacagaaaatagatgtggcgcagtattaaatgatacgaataacggaaacgaaaacgaaaacgagaaagtacatgactagtgtaattgatgcaggactgttataattacaacaacctctaccctgccgatggaaatctacctgaaacaaggagggtccaacacgccggactattgtaaaagcctgcctgttcaagatacgatattgtcggcatgcaggaagattaaacaatccccaactggaaggcaagacgcacgggctgtcacggggaccttggatattgcggagtggggtcaaacatgtcacgatatanagaccaaagaacaacagaaagcgggtgggaangt

SEQ ID NO: 24602 - DNA, 545 bp, Triticum aestivum
  unsure (1)..(545): unsure at all n locations
  Clone ID: PAT_TA_24602
ctcgtgccgaattcggcacgagtttggatagtgagaaatgcatagaatgtggcaacaactacgagatgcagtctcccgaaactcgtgcacgtccagaaaatccaaacccaaaatggccaagtcccgaaggatctaattgaactgcagccttcatataagcaggatgactgggatccaagattggnagtcaacgactagcagcaaagttgcttacttgatcgacaagttgagaagtttgcgagaggcccgcatgcggcacgtgcactcgactaacataaccattggtgctggtcctgctactacatcgtcttctcaagatgatgataacctgcagaccaggttaccacagacattgccctgacaaagtaattatattctctcagtttctggagcatattcatgttattgggcagcagcctgactattgctgggataacatacgctgggatgtacagtcccctgccctttggcactaagagaagtgcattgacgaagtttaaagaggatccaacatgcatggctttactgatggatggcactgcagc

SEQ ID NO: 24603 - DNA, 570 bp, Triticum aestivum
  Clone ID: PAT_TA_24603
ttttttttttttttattcctcggggaggtcaagagcattcgttcattaatcagcggggtcgcggccgcggtacgcaagcagtttacaagataatccagttcttgttccataaccacaaacttgttttgcacaaagatgcagcagccacctgactgagcagttattgctctagttttggttgagaaattccagctgcgctgcctcgcagagcatccacaactctgccgattctgttcacttttctgggagatctacggtctacgaaaggcaatacatatagtgcgatgcgtgcgggaattatatccagctaggtagcgaagattacataccaaattaatctcagagcctgcaaaccattaatctaatagttccgctgagcaactgattgttgataatagcgactgcccacacaagaatctgggaaactcaatttgtgccactaaaaacagaagggcgatttgggggggcctataaggcctccttgaacgcggccacggcatcattggaggccccaagcactcggatcttctggaggtgtaacaggtgcacctgcccgggcggccgctcgaa

SEQ ID NO: 24604 - DNA, 715 bp, Triticum aestivum
  Clone ID: PAT_TA_24604
cagctcaagctccgcagcgccggcgtcggccacgacgacgaggatagcgatgcgcggtcggaggccgggtcggcgcgcatgcaggccaaggcggacgcggcgctggcgcgggagaacgaggcactgcggtcggagctggcccggatgcgggcgcacatgtcgtccggcgtgcagcagagcaaggggagcggctcgaggacggcggcgacggcgccggtggcggggaagaaagcgagcttcttcgggtcgatgtcgcgcacgctgagccggctgaacccgttcagggccggcggcgggtggtccaaggacacgtcgagcatccgtgagagtaggggcggcgccatgaatgtggtcaagcccaagaggaggaggtcctccataagctaagactcaatatatatcatgcatgatgcgataggtgcatgtaattcggtctcatttcattcgtatgatcgctggtgtgtactgtgcgtgtagaggaagatcatgatcgtggttgctacttctcatgattcttccctttttcagttagtttgtgccatctattgtactactaatccaccatgtactgtatgatgtatgttgggcattgtatattagaaagaagtgttcaattcaactataaaaaaaaaaactcgaaaataagaccccgccccgccccaggttagccctcggccaatcccggccgcgaccacgctaatcacttagtgaattc

SEQ ID NO: 24605 - DNA, 734 bp, Triticum aestivum
  Clone ID: PAT_TA_24605
ctgctcctcgtgccggatccggcccgggctcggcaaaaagtaataccacacagaaatcggcctactccaatctcacccatctttactcaattatcatggcccaagcacctgtcaccccgtcgtttaaactcgttttggtcggtgatggaggaaccggaaagaccacttttgttaaacgccacacaactggagaattcgagaaaaagtatatagcaactcttggtgtggaagttcatcctctaaaatttaacacgaatcttggagaaatacagttcgatgtttgggacaccgcagggcaagagaagtttggaggtttacgagatggatactacattaatggaaaatgtggtatcatcatgtttgatgttacttctcgaatcacctacaagaacgttcccaactggcaccgtgacctagtgcgagtatgcgaaaatatccccatagttcttaccgggaaacaaaagttgatgttaaagaaagaaaagtaaaggctaagacaattaccttttcacccgaaggaaaacctgcaatattacgacatctctgctaagtcaaattacaactttgagaagccgttcctatggctagcacgaaagcttgtcggtaacccggctttggaattcgttgcagctccagcactcgcccctcctactgccactgtcgatcacgcactcctcgcacaatatgagaaagagatgcatgaagcagctcaaatgcctcctccgggcgaaagg

SEQ ID NO: 24606 - DNA, 515 bp, Triticum aestivum
  unsure (1)..(515): unsure at all n locations
  Clone ID: PAT_TA_24606
gcggacgagaaggntagtgaagaaaaacgcgaagccgccaaggnattaaaaagctcaaaagatattgaaaaaattgagatactaaagcgatctacgacaggagatcctgctggcggagacggtgtgaatgaagctaatcctgataatgttgtaaagacaaaggaacctggtcgagagaacaaacccaagccatctgactcaggtgcttggaggcgtgcctctcacacagttccttcatctcgggatgatatccctcgaggacccagaggtgctcgcggtggccctgttggcggttcacgcggtcggggagatggtccaaaacaatacgatgatcgagtaaatcggaaaatcatgaacggtgaatcctcacctgtcgctatcgtgctagaaggcaaacctgaagcggtcgctcaagtggcggaagaagatggatggagcacagtgtcgaaagccaagaaaaacaaccgatctgggaaacanagtgcacggggctgtaacgtccttgatgtaggnag

SEQ ID NO: 24607 - DNA, 857 bp, Triticum aestivum
  Clone ID: PAT_TA_24607
ttcagcgcaccgaagctcctcccccgcatctctctccttttgcccccaccttcctcctcccccgcatctctcctttcgcccccacccctctccggcgcacggctccgacgcgatggccgccccactccggcgggtcttcccctccctcggccgggccctgctctcgcctacgccggcgcggatgctctccgcggaggcctccgatgccctcgtggagatcaagcccggggagatcggcatggtctccgggatccccgaggagcacctccgccgcaaggttctaatctattcaccagctaggactgcatctcagcaaggttctggcaaagtcgggaggtggaaaatcaatttcgtgtcaacccaaaagtgggagaacccattgatgggatggacatcgactggtgatccgtatgctaatgttggtgaagctggacttacgtttgacagtgccgactcagcgaaggccatttgctgaaaaacacggatgggaatatgtggttaggaagcgccatacacctcttctgaagcccaaaacgtaggcagagaacttcaagtggaagggccccccgaagacggaggaagcagcctgagctgtggatttgtatgttgtctggagattttccataagatgttgttttcctctgccgctcgtgctgatttaactttgttcaatacctgtcgtgcaatatgagctagaacatgtcttcatcaaacgtgtaataagcacgcattgcaactgaacttgtcgctcatctcatcaaaatgtttgttaaccccttttttacacgggtatacttggctactaatactatatttgtcaacttagtgcacgcaaaaaaaaaaaaaaaaaactcgag

SEQ ID NO: 24608 - DNA, 876 bp, Triticum aestivum
  Clone ID: PAT_TA_24608
cgggtcgccgagagggcgatgagacgacgaaccccagcgaccagcagagcagcgcaaagtgagccatgctagcctcgccggcgctcgccggcgccacccactccttcccggccttcgtgtcgggcagccgcggcgtccacctcccgtccgtctccgcgccctcgcactcgccggcgcggcgggccgccctggtcgtcctcgccaaggccaaggtgtccacgcccaatgccgaccgcatcgcccgccacgaccgtctccgcaagaaggtgagtggcaccacagagaggccaagactgagcgttttccgctcaaacaagcatttgtatgctcaggtgatcgacgatacaaagtcgtgcactctggcttctgcctcaacaatgcacaaagctctttcaaaggagcttgagtactctgctgggccaacaactgaagtggcacaaaagattggtgaagtgattgccaagtcctgcttggagaaaggaatcaccaaagtggtctttgaccgagggggtttcctctaccatggccgcatcaaagctctagccgatgctgctagagagaatgggcttgagttctgaattttcctgttgatatttccagggtcgcatgtaatattctctcttttttcccgtctattgaaccaacttctttctgtagtcattggagttgctctgcagacatggcccctctttaatgttatctgatctttgtatcaacattgaatcagcgttgcacaatggaaagattcattttctgtctatttctggcactttggcttctgcccatgcaaccttgtaaaccaacacttggaaattggagtattcaggtctgcgagcttgggcaagataaaaacaactccgaggggggccgtaccaa

SEQ ID NO: 24609 - DNA, 541 bp, Triticum aestivum
  unsure (1)..(541): unsure at all n locations
  Clone ID: PAT_TA_24609
ctcgtgncgaattcggcacgagacacaaccaatttcgcacccgccgcttttaaatatcctccgctcaatttataagcatacaacatggccgacgcgcaaagagctggtgccggagcggctcgcggaggaggattcggatcgcgaggtgaccgtggaggtgatcgtgggcgtggacgcggaaggcgagggcctcgtcgtggcgctaacaagaatgaagagaaggagtggnagcccgtcacaaaacttggacgacttgtcaaggaaggaaaaattaagtccatgggaagaaatctacctacattcgctccccatcaaggaataccaagattgtggactacttcttgccaaagctaaaggatgaggtcatgaagattaaacctgtgcaaaaagcaaactcgtgctgggtcaaccgaaccccgattcaangggcatcngtcataaatncnggtggactcccgaacgccatgtccggcctgggcataaaaacttccaaaggaagtagccactgcgtttccggcaagctataatcanttgcaaagtt

SEQ ID NO: 24610 - DNA, 552 bp, Triticum aestivum
  unsure (1)..(552): unsure at all n locations
  Clone ID: PAT_TA_24610
ctttgcctacaccgtcaaatacaacttgcttatttataccaagcacccatagccaccttcgagtcgagatagacgtcgcacacatagtcttttcttttcctgtcacccttcaaacatttcacagccggagaaattacaggctagactgattggaaaagcaccttgtcatctggcaaaatagaatctgtatcctaccagaaatgaagatccaaaatctcgagtggcttgtagcactattaggtatatcaaaattggcatgtgctgatattgttttttactgtgatggtgttgctataacagaagatcacataaagacagcctatggaaactctcaatcagcacctataagcggatatcctatgggtatggaaattccatactatggtgaaccttgccttttatacttcttatcccattttactggaacgggcgaaactatcaaaacaaagtcctccgtgggtcactaatttcttaagtcctgggaaaaagtgctggttaattgggggatggtatcaagcaaatcaaaagcnttcaaggcaactcaaaccctgt

SEQ ID NO: 24611 - DNA, 472 bp, Triticum aestivum
  unsure (1)..(472): unsure at all n locations
  Clone ID: PAT_TA_24611
cacgatcattcaagcangaaaacacttgttggccatcacactctaaatctaacgccttgatatataaacgcaacagatcacaccctttctatttctccatcttcctgaaagatgtccgaaattcccaaagaaaagcaataactccactgcaccaacaccgcaaaatacacctgctaacaatgccccaatctcgtcacacgcgcagcagcccggtgttggtacgataaaagaagaacgaattagatcgtccgggcatcggcgtcaatctttgcgcacaacccaaaactagtccaaattgatacaaggtaaaactacgttcactcggttgggaagatcatcaggctacgtatgaatctccttcccacaagacgttcgccggtccgtgttcgcggggccttaaaggcataccagaaaggatcacctctaactttgagggacaagtttccagcgggaggttctaagaggttggaga

SEQ ID NO: 24612 - DNA, 527 bp, Triticum aestivum
  unsure (1)..(527): unsure at all n locations
  Clone ID: PAT_TA_24612
ctcgtgccgaattcggcacgagcctcacacaagtactcccagcaagatctctgcaatgacggaacaactcatactgaagggcaccctcgaaggccatagtggctgggtcacttcacttgccacgtctctcgagaacccagacatgctcctgtcggcctctcgcgacaaaactctgattatttgggatctcacccgaaacgagactgcttatggcttacccaaaagatcacttcatggccactcacacattgtatcaagactgtgtcatttcctctgatggtgcttacgctctctcggcttcttgggataagactcttcgattatgggagcttgccaccggaacaactactaaaagattcgttgggcacaccaatgatgttctctctgtatctttttcaagctgacaacaaacaaatccgtctcgggctctcgcgaaccggaacaataaagctatgggatactctcggggactggcaattttccaatttacaagaaaagggacaaaaaagactgggacntcatgttgt

SEQ ID NO: 24613 - DNA, 437 bp, Triticum aestivum
  Clone ID: PAT_TA_24613
ggagcggaaaaggaaacccgggcgaccaacaaatagcagagataagcttccgtatgatgaccggggtgcaaaaagcaaaaggatgaagcaacgcacagctgctgaagatgtcgataggtgtggcacgagcaaacgcactcgcttctgcagcatatgccgagaacctggtcacaagagcacaacttgtccgcaacgaggaggtcctccaccgaaggaaaggaacgaggctaaatgctctatatgtggtgtcggtggccacagaagaaacacctgcaacaagccaaaggttgttctatatgttgctgggacaactaacgtggacacgaatgcactcaccagtctgatttgagatcgtctgttcaatctgtgtaataaacctgttcttgagggctccgcagccgataattgataaatctttgtaataacatgctgcgtcg

SEQ ID NO: 24614 - DNA, 594 bp, Triticum aestivum
  unsure (1)..(594): unsure at all n locations
  Clone ID: PAT_TA_24614
gcgtagcggggccgcgccccccnccttgcccgtattccgctcgagctttttttttgtcctatggaaaagatctgcacggttgcataaatatcatgcctatcgagagcaactgacacatttttatgaagagagctccttaagataaatgaagatgaactagtgcatcaccaacatacacaccatgccccgccatgaaaggcacattgacaaagacaaatatcggcataactgcacagatctggaaaacatcacttccactgcgacgcatacaactttggactttggaggctacgatcctagaaggaaatttatcactctagctagcttgttaacttcagattcatgagacgcaaccaccggcccgcgcggccggtcgaacgaccccggcggcggggccggcgcgccgcccgccgctcctcgcggacgccggcggcgccccgtgccgtagtccgcccgaccaagcgtcatttggcgtcgcgggctgcgggccgggaagcanggtccccggcggttggactccacggcgctgttcgggagggggcnatncancgggagctggccacngccgccggcggggcggcgggcccccggtgg

SEQ ID NO: 24615 - DNA, 688 bp, Triticum aestivum
  unsure (1)..(688): unsure at all n locations
  Clone ID: PAT_TA_24615
tttttttnntttttttttcgtgccgtttttaaccaaaaaaacgggttggacccaggctcgcagtcagtggcaagttcattgaacttctaccaatgtctattaaatagacctgactggatccgccggtaactttccgccactgttaaacagtgacggtgtcagttaccattacggtctgaccggacaacccagacacctgtgaaccgagttgggaacttctgtagtggatcccatatccactcaggagcatccccctcattgaacagcaccatgtcttcaaacatcattgctccttggtcttcgatgacgtggggttctatgtttaacatagacccctgggcggccgcgcttagcgcggtcgcctcttcgacacgaccaaataagtagaaacaaggtcgaaggcagatgacttcaaaatcctctctctcataatgagagacaaggattctgtagatctctgcccccaacttcaagtctctacttatgagcatgactaagtttggaatagtcctcttctttctcgtgccggtgtcggctcccgtaattattgagtctgactcaacaaataagtttaatctctcccgaactacagttggtagatcaacatcgtggatcattgctttaagcatgtccccnccatattggtcgnccaaagaggnggaagattngattagtatccngagcgatc

SEQ ID NO: 24616 - DNA, 721 bp, Triticum aestivum
  Clone ID: PAT_TA_24616
ctcgtgccgaattcggcacgagctggagttcttctacagcgaggcgccggagtcgatgaagagcatgtgcacgtccttcgcgctgctcaccgtggcgctgggcagctacgcgagctcgctgatctacgccgtcgtgaacgcgctcacggccaccggcggccggcccgggtggatatcggacgacctcaacgaggggcacctcgattacttcttctggaccatggcggcgctgtgcacgctcaacttcgtcgtttacagcgccttcgccaggaactaccaggtgaagacggtcgtgtcgtgatcgtgatcgttccttacccgccggcgtacataaagagagcatcagatttcgcattgcaacgcgcagtgcggtggtacaaaagatttgttttgttcttgtttcagaattcaaaaagttctttctttaggtagaactttataaaagaatttagaactagtttggtatgatgcaattacggcaacacgcaacagcaattgggtttgtgatactgtgtagctgtcttcgttttgtttggtaagacgatttaggcagttcaaattaaactgcaaaaaacatctttcattagtgtttggcaggttaaaacttgatctgcaaaaatattttacactaattggtacagaggtggtattcatttttgcaagctagcttaaaacaagggactcgggaccagggctctcctcgtgccgaattcggcacgag

SEQ ID NO: 24617 - DNA, 741 bp, Triticum aestivum
  unsure (1)..(741): unsure at all n locations
  Clone ID: PAT_TA_24617
gggctgcangctcgtgccgaattcggcacgagggggggtcttcatcattctcgttgccagtaccaagtggggccaatgcagcccctgggcctgtgtcagcacaagtgcaggttcaacctcgggtgcaacaagccctcctcaagctgcgccctcaaaagtgtcaaatgcttcaatcaagtcacgaaatagctctaagaagcaaactgcacaagcaaatcctacaaatgctccttcgtctatacaagctgcagctattgctgccggtggacgaatcgccacaagcaagcatcgccaccaatttattgtaagctgcacaatccccgcaagctgtgcacataagatctcgaggaaaagggtcttcaaaaacttctacaagctctaaagcatccaccatggctggcgagcctggaacacagactggcagtgctcaacacccagaacttctaaactgcagtgcccctacaccatctcctacggttttgataacacagtcaaccgagcaagttaatgttgtgccagaagttgcaggagttaatcccccggaacaatctgctagtgcacatttgttggaacctgatagaacattgagcaccacaccagtgcctggcccatgcgacaatatggagattgacgacgactcaacattttgtgtagtcacgatggaggacttgtttcctgaagacgtgaagcagccagagacggtgagtcagccagagatggtgaggcagccagagacagtga

SEQ ID NO: 24618 - DNA, 630 bp, Triticum aestivum
  unsure (1)..(630): unsure at all n locations
  Clone ID: PAT_TA_24618
gggatgctgcacaccttcgcctccccggccccgcacctgggcaacattgcgcccgtcgccatggccccagcgcagcacttcagcttatcagccggcggcggcgattcgcagacggagatgccgcacttctccttctcgcacgaccactacatgcccgtccatgcggcgccagcgtcggctccggcagtagactacagtctcaacttctccatgtcctcgggtcttgtgggtgtcaacaacactagggggacccttcagtccaattcgcagccgcacctctccggccaccaccaccaccaccaccagcagctccagaggctgtctactccactggatgctccgcacatacccttcttgttcaagcccaagccgtccgcgggtggcctcccccaacacaagcgggggaagccacttcggcgcggcgggccgcattgcagctctgggaggggttcggcactccgacatgaaggagaagggcaagaactgatcaatggctgtgcgcttctttggatgctggaagtgaagacgggcaatcatctccctattttcctgtgagctccattcatgcaaaggggggatgantccctgcgctcttagaagcaagaccatcatttggncaatctaccaagg

SEQ ID NO: 24619 - DNA, 383 bp, Triticum aestivum
  Clone ID: PAT_TA_24619
atcgcgtccaccccctttctctccccccttctgcggcctgcgggtatggatcgggagcacacttaaaaatccagcacgtccacccacctcatgcgccggccgtaggcgcctcgtgcctaggctctaccaaccttggattcttcctgggcctctcgccgcttcccgtgatcggccgcattgtgttctggccggggtgtccttggagtggcccgcggccgcgtgagtggtttctacttcgagaaagttgccttttttccgtgcgggcgcaatggcgaacgacggcgagctgtcggcggtagccgccgccgccgccgagcctgacttggagcggggccgcgtcggcggcggaggaaagcggccaggcggggagagctccccggggg

SEQ ID NO: 24620 - DNA, 690 bp, Triticum aestivum
  unsure (1)..(690): unsure at all n locations
  Clone ID: PAT_TA_24620
cgccctaatgaaaccaattgctaacttaatagacaggtagatcttattcaaggatatcanatatgactttttgataaaattaaatgcattttccgcccgcacgttccatcggatagtatattcctctttggcaccgcctcgaccagattttcccgcggcttccattgcttttcttgtcattgaacctggccagctcctccttgaaggctactttaagagccctgggaggcgctttgaaagggcgcttcaattctcccaaccgctggttttccaaataagtgaattgcaacntctgagccttctaatgcacccttcaagggaataattgattggaattatcagaggattagtggtatttgaaatagagatgcataactgccatcataccgacacccataagttgagctttatataaaagcctccatttgagttacatcgtaaagcatgggggggtgtcgtgattaattttggttcttccgcagatcccatgggaggcgtatcaatgtacttgagggtggttaagtcctttttctttgtaatctggaaatgaacataggcatagatgctaataattacaaggtttgaaattacatagcccacgcgtatcatatttaaaacatttggatcttccattgggatcttttttgacacttgcatcatccccaggatgatgaccaagttggtgatttg

SEQ ID NO: 24621 - DNA, 497 bp, Triticum aestivum
  unsure (1)..(497): unsure at all n locations
  Clone ID: PAT_TA_24621
ttttttttttttttttttttccggtttaaagaatcaagttagagcaaatcgtcgctgtacgaatcgtcacgaactcatcgggatttgactaaaaactagagcctactatgttgcgtatcccccaaaaatggaattacattacgaagatcccctccaattaaagtctcttttttttcaccattctcgatagctataaacgttggcatggctttgattccaaattcagtagataggtcctgagcatggtccacatcggcagaaatgaaggttgtatttttaaactcatcggatttcttttgaaatcttggataagcaaccttacagggaccacaccattccgctgtgaacatgattataatactctgattatctttggcgattttgcggtattcatcgagactcgtaactttttgaatggccatctttctacctgagatgcgtgtattctatgtgacggcatgctggatccgcctcgtgtntaaaaacgggcgctttca

SEQ ID NO: 24622 - DNA, 617 bp, Triticum aestivum
  unsure (1)..(617): unsure at all n locations
  Clone ID: PAT_TA_24622
ncttcnatngaatntcngaggcggncgnttggangagggcccgggggagcttttgggcgcgntgcagcgccggcgtgcctgcggagggacgatgtggcccgggacgctcgcgcggcccgccgccggcaccggggccgggcggcgcagcgacgatgagatcaccgtgttcaagtccgttggcacggccgtggtcgtctcttggcggcacaattggcctacgagaactacactgcaaccaagaacgcgtgaggtcgatcgatgcatggaactcatggattgcgagaaggctcttcttcttgcaggcagattgcacaggctgttccttccacagagtcatcatcagcgaaatacaaataaataaactgatcagattagcacttgtgcttctgatcatcagctgtggcatattcacttgttgttaggccgattcgaataagaatgtgttgtcgtctcatgggactaccttgtctctgtatccgattctaataacatggtgtgggtatttatcaaggagaattacangtgttaaaaaaaaaaaaaaaaaaaaaaaccccaagggggggcccggtacccaattcgccctatagtgaggcccgtantacgcncgcctcaactgg

SEQ ID NO: 24623 - DNA, 742 bp, Triticum aestivum
  unsure (1)..(742): unsure at all n locations
  Clone ID: PAT_TA_24623
ctcgtgccgctcgtgccgaattcggcacgaggcaacgccatctaccaccatcatccacacaaaaaatgtcaagccctcaggaaatatggaggcagctccaaatgaaggctgcggaagcaggtagatctggtggtcgtatgcccaaaggtgtcggtggtgccggtacagctgctgttctgattggaggagctgcttgggttctaagtcattctatattcaatgttgatggtggtcacagggccataaagtatacgagaataggcggagtagccaaagatatctactctgaaggcacacacatcaaaatcccatgggttcgagactcctattgattatgatgttacgagcaaagccgccgtaatgtagcatctcttacgggtacgaaagatttacagatgggcaatattacgtgtcgtgtactctcgagaccaagaatccgatgctctaccccaaatctaccgaaacctcggtaccggttacgacgaaagaattctaccctctattgtcaacgaggtgctcaaaaagtgtcgtggcacaatttaatgcaagtcaactaatcacacagcgctgnagaatgttgcaangactanntcgggaagaaacttaagtaanagcggtgcagcaattttcaaataatcatgctgggaatgaacgttttcattgancggcacccntgcaattttcacccttgaanttttaacccggcagcaagntaggaaaggcccaangcaangtttgtcgg

SEQ ID NO: 24624 - DNA, 672 bp, Triticum aestivum
  unsure (1)..(672): unsure at all n locations
  Clone ID: PAT_TA_24624
ttccaatataactcgaaaaaaactacttcagactcctacatagctcctattattcctctcttcttaaggcccgataagtctgagcgatcaaaaatatcgacaatctaatcactcccgcaaaatataagaaatatttatcatacaacacagccgcagtatgaaaatcttcagcgtcgtgtcattgacggctattctgagtcatctgacaccttcaattgaagctgtttcttcgaattataagtgtgatcgcttggtccttggtggggatatcatagatcgtcaaattgaaaaaacatttcctatctttccagcaagtgttcgtccatgaatacgagccccatcatgtattttccacaagtaaatttcttcgtttattacaacttccggcaaagtccaattcgcagtagaattctcggtccaaaagaaacctcctttcgggttaaagttaaatttaaatgggaacgagtaatacttgtgaaccaacaactgaggaagcagatgttcatcagggcatgacttagcattctatgagcgtgaattgtcgagacgcaatatcagataatccaaatgtgtcaagattagagnggaatagagttgangtagaaaaaatgagatagggtagctcagagtcgaaatgaactttgccactttaggcgctgaaanttttttttg

SEQ ID NO: 24625 - DNA, 551 bp, Triticum aestivum
  Clone ID: PAT_TA_24625
cccccgccgccgaccgatcggcgatggatccggtgggggagtcgccgacggtggtgatgggcttgtacggcggcccggcgcgccgcgtggagagcggggcgtccgacacgatgctgccggcggcgcggccccggccggccgccctccccccccccccgcgcgcgcgcgcggccgggctcgccggccccccccacccgcgcgggcgccccccccccctccccccgccaccagccctcctcccgcgggggccccccggggctcccggcccccggcgtctgggacagcgccgtcgtgctcgccaagttcctcgagcacgcggccgaccccgggcgccgctccccacgccgggcgcgcgccgcggcccgcgccgccggcgccggggctccgggccccccgtcgcccgcgcggcctggggcgcgcgggtcggtggccaccacacctgcctcgacccgcgtccggctgctgcgcaaggaccccgccgagaacgtccctgtcgggggtggcgcgggcgggtcggcgagggtggcggagctggtgtggggcgaggagta

SEQ ID NO: 24626 - DNA, 664 bp, Triticum aestivum
  unsure (1)..(664): unsure at all n locations
  Clone ID: PAT_TA_24626
ttttttttttgatgtccttttttcagttggacttgtggcattttcgcagtcgtaaataaacaagaatttaacatttttgcttgtttttcacctagtagtattatgtaaacagttctcttatcacagcacatgtactatgaggcaatagcctacattgaagctactggtatccttgcactatgaaatatactacagtatgaacgaacgtccaaaactaattaacaaaccagccccatgtaacttcagacgatcaggtgtcccatatcataacgacggcgatgacgccgacgccgagcacgacggcgagccagcggccgaggggcgtgtcggctttgacgggccgctggggcttgtaccccttggagaggaggtggttgacggagacgtagatgaagatgccggtggcgaggcccatggagacggcgaagacccagtcggccacgtcgccctgcgtggtggcgtcgatggcgatgccgacgccgctggaacgngaagngaaggcttagcaacaagaacaacngcgtttgnaacatccggacaacggatccaaggcacgcgcgaanactgtgcagngatgtcanangcctcagcgtcgcctctccgggaaccatgnatccccanacgatgacaaccgnatacattcgtcccagnntgnttccaaacn

SEQ ID NO: 24627 - DNA, 684 bp, Triticum aestivum
  unsure (1)..(684): unsure at all n locations
  Clone ID: PAT_TA_24627
gatgtccatcttctgtcaccaagacagaaccaaaggggcatatttctcagagttttacaccaaatccatcattcaatcagtaatgaacacttccaaagttccaaaattatgaacatccacctcgttgctgtcgtctgttttcttccttctctaaacggccatgaatctggtattgttcatcangtagaattgaggttatacacacctacgcacacctccagaattctcttctagtcactcactgctcactcagctttcaccggcgccttgccgggcacaggcangcngtcgtaagcatcgccgagngccgggggatacanntcctcnaagggggctacgaacttctccaagaaacttctcttccgtcgggngccaccacggttnaaaaaaagcacccgggtcttcctcngatcaagcccgcaatctgcttgatgggagcttcaccaacnaagattgccgggggcattgaagcctcctctcggaaggctgttncatggaagcaancacccgaccgggccgcgccgaatgttantgcgggntccaagcccgaacctcctttgnatcaaagaaactccgngcgttgcnggcgcnagcctcctcctcggggagggnggaaccaaggnatccggcgggngnccttgctgatgggccaagggctcanactccctcctttgaaccaacccg

SEQ ID NO: 24628 - DNA, 941 bp, Triticum aestivum
  unsure (1)..(941): unsure at all n locations
  Clone ID: PAT_TA_24628
aagctcntgccgaatcggcacnagctcgtgccgaattcggcacgaggaaccatgaaaacattcgtctcgcatgatttcataaatgggaggtataggcctcctcatttactcctggttgagaccataaaggatctcatcagggaagagaagcaattccgttctcctacgagaggattgctgatggaagttctagtcgaggactacgaactttcacatgaggaactcgtggaagagtacctcgtccagaaggggacaatggtcccacttctcgaagtcatttattcgggtcaccgcataaatgaacatgctcatgcagcacgcctagcggcagcaaaagcattcctcgccgggctggacgcccaaggacgaggaagaaagggccgagaggccctaaggctcaagaccgggacggaaagatcgaacccctaagggctcgaatcctccaagtgacttcagaagaggtcacaaagggtacaagttacccctcgggtacagtacctttcccacaaagtcatgtatatgactatgctgggcctacagcacaggggtctaacccctctgcagtccaaaataactttgggctattcagccaatgttacttataatacaaacctggcctagccaagagttgtagttgtccaaggtgcgtaccccctatggggacggcacctcctcagtactcgtacaatagtatgaatactggaaccacgtttgggtcaaaccaatacgttggtatcctccacatgtcgggacaaagnttccacatgcagggaatcccattccgccttacggtaatgggataccttctccacgaaattcgtctagaaggttctatccttaaatgatcacatcattgaaaggatcaatccaacttggtctaaccaaggatggattcgtacgcaaggctccttttggagcggcattacgttaaaaaaaaaaaa

SEQ ID NO: 24629 - DNA, 675 bp, Triticum aestivum
  Clone ID: PAT_TA_24629
ataaccaccaccaatccattccccaccagcaccttccggcgaaacacagcacctctccccggcgaagcagcagcgtccaatggcccccaaggcggagaagaagccggctgccgcggagaagaccccggcggccgagaagaccacggccgggaagaagcccaaggccgagaagcggcccccgaagtccaaggagggcggcgctgacaagaagaagaagaaggccaagaagagcgtggagacgtacaagatctacatcttcaaggtgctgaagcaggtgcacccggacatcggcatctcctccaaggccatgtccatcatgaactccttcatcaacgacatcttcgagaagctcgccggcgagtccgccaagctcgcccgctacaacaagaagccaaccatcacgtccagggagatccagacctccgtacgcctcgtcctccccggcgagctcgccaagcacgcagtgtccgagggcaccaaggccgtcaccaagttcacctcctcctagaccacgatggttctctgtaacagtcacctgtttagaccatgtcgtcttgtaacttgcgttggttctgtgggaacacactgtttcattacctcatgaaatggtaatggtgcttctttgatctgtgtcatggttatgtatcatgttcagttcttgtccccgtcgcttcc

SEQ ID NO: 24630 - DNA, 1036 bp, Triticum aestivum
  Clone ID: PAT_TA_24630
cgaccggatcgagcgagcgagaaatccccaatccccaccaaaccctaacccaaaccctaaccctgattgaaacgaccaggagaggagaggagaggagcggatccggcgatggccgtcgagaagatgcacttgtccatgccgttgcccgccggcttggagggtttccccttcaccacgttccaggcggagctggaggccttcaccgtcaagttgagggcggaggcgaagaaggccaaggccaagccggaggtcaaggaggccaaggccaaggaggagaaggccaagccggaggtcaaggccaaggtgaagaaggccaaggcgaaggaggccaagccggaggtcgaggccaaggcaaaggaggccaaggcaaaggaggccaaggcgaaggaggccaagccggaggtcgaggccaagtcaaaggaggtcaaggccaaggtggagttgaggaccctcaccaaggaggaggaggaggcgctcatcaagttcgtggcgctgctggagaaggaggaggacttcctcgacgccaaggcggaggcggagaaggaggcggagaagtgtggctccaagaggaaggtggagttggagcgggatgaggagggggcagcgttcctggcgtggatcgagtccaccaagccaccgacggaccaagtggattactcggatggggatgtgtcggacggctaccactcgcaggacgacgccatcggcagcgacggcagggtcatgtcgcggtatgagcgccgcgttcaggccaacaacgctcgctggcctttcttggtgggggcctaatcccatccatgacggtgctcttgctcttgtggtctgagaagctgacgaggagcttcgccaatcctatcccatctagtaccaaccatgtatctatcttatctatctatatatttctagttgatcctgtggacatatatatatgtgggattgatccgcctaccctgatgctattgttgcgcaccgatgaagcaatgtcatgctgtgagactgataatctatcgagtactagtagtatctagtatatgtt

SEQ ID NO: 24631 - DNA, 1416 bp, Triticum aestivum
  Clone ID: PAT_TA_24631
aggactcgtgggcccacgcgtccgagaagatcgagcgagcgagaaatccccaatccccaccaaaccctaacccaaaccctaaccctgattgaaacgaccaggataggagaggagaggagcggatccggcgatggccgtcgagaagatgcacttgtccatgccgttgcccgccggcttggagggtttccccttcaccacgttccaggcggagctggaggccttcaccgtcaagttgagggcggaggcgaagaaggccaaggccaagccggaggtcaaggaggccaaggccaaggaggagaagggcacgcccgagcaagggaacgcccgccagcaccttccggcgaaacaccaacccaattccccaccagccccctcgcaccttccggcgaatcaccgcacctctccccggcgaagcagcagcgtccgatggcccccaaggcggagaagaagccggctgccgcggagaagactccggcggccgagaagaccaccgcgggcaagaagcccaaggccgagaagcggccgcccaagtccaaggagggcggcgccgacaagaagaagaagaaggccaagaagagcgtggagacgtacaagatctacatcttcaaggtgctgaagcaggtgcacccggacatcggtatctcctccaaggccatgtccatcatgaactccttcatcaacgacatcttcgagaagctcgccggcgagtccgccaagctcgcccgctacaacaagaagcccaccatcacctccagggagatccagacctccgtccgcctcgtcctcccgggcgagctcgccaagcacgccgtctctgagggcaccaaggccgtcaccaagttcacatcctcttagataggctgttctctgtcttcgtggttgatcgatggttctctgtaatgctcgttagctgttcggaccatgtcgctgtgtaacttgtgctggtgttgtggcaacacactgtttcatcatctcgtgaatcagtaactttgcttggatgtgtcggacggctaccactcgcaggacgacaacatcggcagcgacggcagggtcatgtcgcggtatgagcgccatgttcaggccaacaacgctcgctgtcctttcttggtgggggcctaatcccatccacgacggtgctcttgctcttgtggtctgagaagctgacgaggagcttcgccattgctatcccatctagtaccaaccatgtatctatcttatctatctatatttctagttgatcctgtggacatatatatgtgggattgatccgcctaccctgatgctattgttgcgcaccgatgaagcaatgtcattgtgagactgataatctatcgagtactagtagtatctagtatatgttaaatctactagtgttatgcccttcgtatgtgatgatgcaatgtctctgatgatgcc

SEQ ID NO: 24632 - DNA, 480 bp, Triticum aestivum
  unsure (1)..(480): unsure at all n locations
  Clone ID: PAT_TA_24632
ctcgtgccgaattcggcccgagaagactacttcacacctctcactaagctcctactattcctgacttccgggaagccgattaatctgcaagatcaaaattaccaaaaaatccagtcactccaccagagtttaagcaataattgtcacataaaacagctgcaacatgaaaatcttcagtcttatttcactcgccgctattttaaatcatctgacgcctgtacttgccgctccggattatgattgtggtccagcgcgtattcctgggagtcgcatacaaagcgctcatgatgaggcccacaagtccgagacttcaagctgccactcgtacttacgaaccccgtgaactttttactgtagcaacttacgaacaccaacatcgggaagatactgaaactgtagagttcatagtcaagggggggaggtacatttgaaacggaaattctgtgcgtaaaagcctttgctaagaggggaatgggnngg

SEQ ID NO: 24633 - DNA, 494 bp, Triticum aestivum
  unsure (1)..(494): unsure at all n locations
  Clone ID: PAT_TA_24633
ctcgtgccgaattccgcccgtgccttcatacagctggctgttgttaagccagcaaaatggccgctgcttttatggcagagtggctcacgaaaaaactaaatacaagcaagacattttaaaacaagatgcatcgctaaacagtctgctgttggaatagtcgcattgcgttagaatccgcctgttgctcatcctgtcctgctgactcatgccatgagctacggctcccatgccgtcatttcccctgtaacccccacggaccgagtcgaatcagacgcgctcacactcacttccctgtaagaggggttccttanagaagtggatattccgagacaaccaatctgggaactgtgaaattccaaacagccatgtatgaagacacttttaaatgaggtccgcaacattcatcggcatctcttcaatctgggtgctggtagaaattgctcaatctcacgcatcaattcgcacatcatccgacccgtaacaaagtttataag

SEQ ID NO: 24634 - DNA, 701 bp, Triticum aestivum
  Clone ID: PAT_TA_24634
tcttattgacctgccacagtgaactgtactacatgcgttgccctacaaaatgaccacccaagcaccattccagcccttttcgaaaaaaaaaagcgccattccagcggatggagcgtcccgtatacgtcccgcctctcagccggcaacaagcagactgcttcgccggccacggcctgcttaccagctatcgacaggccgacaacctacctacagacgtttcatgcacaatgtacaacatactcaggactactatactacagcagagcaacttcgtcagtctgaacttcacccggatttcgcttagaaagacgcggtccacttagccttttcgctctccccgcatttgttgtgcactccctggatgttctccacggtgttgcatatgccgctgcatctccagtcgaatgatgccgcgcaggtgttccccgcctgggctttccactcacaatcgggtggggtaccgcagcacaggcgacggtcatcaatatgctcaacatctatccctatgaaccaagcccccaaagaaacatcctccccccaaagcttgtgcaacacatgcttatttagggagatgtaggttgccaaatcttttgaaatagcataaagctgaccggtggcatgtcggaaatatttatccccgaatttccagtgctcgggttcataatatgtgccttccttgtcggattctgacttccttgtcg

SEQ ID NO: 24635 - DNA, 542 bp, Triticum aestivum
  unsure (1)..(542): unsure at all n locations
  Clone ID: PAT_TA_24635
ctcgtgccgaattcggcacgaagctcgtgccgaattcggcacganataacatttatcgttcttcgacggatcataagatatcacacaagcgcacgatgtctgacgtagaagaaccaacctcacccgttgcggaagccgaggaagttgaggtgtctgcagatgctacccccaagggacagatgactgttctagacgctctgaagggtgccttaccaacagctctcatgcacgatggcctcgccagaggtctgcgggaagcatcaaaggctctcgacaggcgtgaagcgcacatgtgtgtcttaaacgaagcatgtgaggaagaggcgtacaaaaaactcattggtcgcactttgctctgaacataagatccccctcatcaagggtaccccgatggaaaagcagctgggcgaagtgggctggcttatgtgttttgggttcgtgaggggaaatgcaccccagggtgtcaactgttcaagtgttgtcngtcaagaantggggggagggaatcttctgaacgcatgatgcttctcaaactaattcca

SEQ ID NO: 24636 - DNA, 840 bp, Triticum aestivum
  Clone ID: PAT_TA_24636
ggcacgaggtaattttggtctatccttcccatccaagtatggaaataaagaaaaatgcatatagattttaaaagtgatgcgttggtcttatcaaaagctgcttatttgtctcatctcttgctgagaattgcggtgttgaaaatattaagcaaggatgtccatatgctactaatcatacacctcctcttcatacttgctttcatttttttattgtgaagttgactttacaaattcaaacccatttgagaaatgttagcctttccaataatcgttgatcacttctctttgccaaaatgggcgtacttccggcgcgcccaggcctgcgttgcgtgggcggcgcggctcgcgccccgggccccctcggaggtgctgtttccaggttcaggatcgtgccattttagtccgtcgttcatccagtgggcagttttccaaccaatgaggtcggatgtagactggaaaagaagtacaaggttttgtgaccttataaggcatctaccggcgagcctatatatcttttcatattcatataaagcacaacgcccatattgctgatgagcttggaagcactgcaccttttgtgtgctcgctttgatataactaagctttcaagcttccatgtaacactggcaaaatcggttcctctggactcattacttgtcaggggaaaatatatgtgatgcctgtttcacatgtttaagcacaggcacaatggatattaccatgggagggataatctctgtgccaatcgatggcccttgcttaaaaaaaaaaatgtaaactactccctccgtcccaaaataagtatccttgattcagtacctgcccgggcggccgctcgaa

SEQ ID NO: 24637 - DNA, 1059 bp, Triticum aestivum
  Clone ID: PAT_TA_24637
cggacgcgtgggtttggattggattggactgccggcgtgctaaatgaacaaccccactactagtgctcgatgatgaagtacataaatggacgcatagtagtgcactacaagcacagagggagaagaagaagggatggcgcctatgaaggtgtacggctgggcggtgtcgccatggatggcgcgggtcctcgtctgcctggaggaggccggcgccgagtacgagctcgtgcccatgagccgcaacggcggcgaccaccgccgcccggagcacctcgccagaaaccccttcggcgagatcccggtgctggaggacgggcgatctgacgctctaccaatcccgtgccatcgcaaggcatattctgcgcaaatgcaagcccgagtttctaggagcgggcagcctcaaggagtcggcgatggtgggacgtatgggtcgacgtggatgcccaccagcttgagcccgtactcaagcccatcgtgtttaactgcatcatcaacccgttcgtcgggagggacgtcgaccagggcctcgtcgatgagagcgtcgagaagctcaagaagctgctggaggtgtacgaggcgaggctgtcaagcaacaagtacttggccggtgatttcgtcagcttcgccgacctcacccatttctccttcatgcgctatttcatggcgacggagcatgcggttgtgctcgatgcgtatccgcacgtaaaggcatggtgggaggcgctgctggcaaggccgtcggtcaagaaggtgatagctggcatgcctccggattttggattcgggagcgggaacataccatgataaggcatatgctttgtgtgcttgagatgctctaatcatctctacccaacccacgagaaataaagtaagcaaagcgtgggtgtggatatgaaataacttgtttcggtgaattgttttctaataccaattagaattgattctcaaaaaagtaagttcaatgtatatgccctctatttctgttagcagtaccatggttttcacaccaatgttgttgcaaagtctctacttatttaaaaagaacgtaaagttccgttt

SEQ ID NO: 24638 - DNA, 624 bp, Triticum aestivum
  Clone ID: PAT_TA_24638
cctcctcgtccttcttcagtcttccttcttcctctgatatcctcatctgcattttcctccgacgccattctttgtctgtcaaaatctcacgaactttaattattagctgcttctgaaattcgtccgatctttcaaactgctcttcatactttccctcatctacttgggattttatcttggatgcactgtctttcctcaactcttttttcctttttgccctcagttcttcttttgcagaagtaacttgatcaagaatgtaccctctttcctgtggatcaagtaggagctgctgtgcttttgccagggctccgaaagcttcttgtgcttgtggatgcttgcacttgtcaggatggaccaacagtgacaacttcctatattgcttcttcacctcatccacagaagaatcaaaagacagcttaagatgctcaaaagggtttaacttgaagcaaccaagtatcctgaggacttcgttgtcgcgctcggcctcgctgacctcggccaggaagctcttgaggagctggtcgtcgtcggcctccgacgaccccatgggtgtaccgggaggaggagacaggggtcgcggctggggtgggctccggctctgggagcaagacgagagcgagttgc

SEQ ID NO: 24639 - DNA, 942 bp, Triticum aestivum
  Clone ID: PAT_TA_24639
ataccactgcctacctactacttcctaaatgttgcatcggactgccagataaactggtacataaacacagtgctgcaattgcaaacacagctcacgtacgaagggagctacaaggggtggcgcccatgaaggtgtacgggtgggcggtgtcgccatggatggcccgggtcctcgtctgcttggaggaggccggcgccgagtacgagatcgtgcccatgagcaggagcggcggcgatcaccggcagccggaccacctcgccagaaaccccttcggtgagatcccggtgttggaggatggcgacttgacgctttaccaatctcgtggcgtcgcaaggtacattcttcgtaagtgcaaacccgagcttctgcgagcaggcaacctcgccgagtcggcgatggtggatgtatggctcgacgtggaagccctccagctcgagcctatagtgcggccaattgtggctaactgcatcctctacccgctcgaagggcgcgactgcgaccaaaaaatcattgacgaaaaaatcgaaaagttgaagaagctgttggaggtctacgagtcaaggttatcctgcagcaagtatttggccggggatttcatcagcctcgctgaccttagccatttctccttcatgcgctacttcatggcgacggagcatgcagaccagctcaacacttacccacacgtcaaggcatggtgggccgtgttgctggcaaggccttcggtcaagaaggtgatggctggcatgcctcccgattttgggtttgggagtgggaacataccataataaggccttcttgtgtgtaagagtatattattgcaatgattatttgtttagataaaaatatgggcataatttcaaatcacttatacaataaatttgtcatatacatcagcaaagtgcttacagtaatcacatccaatcctaaaaaaacatatccagt

SEQ ID NO: 24640 - DNA, 882 bp, Triticum aestivum
  Clone ID: PAT_TA_24640
gtcactacaagcacagagggagaagaagaagaagggatggcgcctatgaaggtgtacggctgggcggtgtcgccatggatggcgcgggtcctcgtctccctggaggaggccggcgccgagtacgagctcgtgcccatgagccgcaacggcggcgaccaccggcggccggagcacctcgccagaaaccccttcggtgagatcccggtgctcgaagacggcggtctgacgctttaccgtaagccttcttcatgttttctgttttatttttgattcagtaggcatattgtttttctaccaattattaagcaatttggtgggcgtgataaaaaaacgaggggtactgatttctctccgcaatttattttcttgagaatcccgcgccattgcaaggcatattctccgcaaacacaagcccgggcttctaggagcaggcagcctcgaggagtcggcgatggtggatgtatgggtcgacgtggatgcccaccagctggagcccgtactcaagcccatcgtgtggaactgcatcatcaacccgttcgtcgggagggacgtcgaccagggcctcgtcgatgagagcgtcgagaagctcaagaagctgttggaggtgtacgaggcgagactgtcaagcaacaagtacttggccggggatttcgtcagcttcgccgacctcacccatttctccttcatgcgctacttcatggcgacggagcatgcggttgtgctcgatgcgtatccgcatgtgaaggcatggcgctgctgcaatcgtcagaagatagctgctgccggatttcggagcggaccatgataaagcatgcttgttgcgctacttcatggcgacagagcatgcgggtatgctcgatgcgtatccgcatgtgaaggcat

SEQ ID NO: 24641 - DNA, 2083 bp, Triticum aestivum
  Clone ID: PAT_TA_24641
tatattgcttcagaagaagattcgcagattcccggcgagcattgtgtaaattagcggataattgtggaaaaagatatgatggagcgaatgaaactgtacggctgggcggtatggccatggagcgcgcgcgtccttgtccctttggatgacgccggcgcacagtacgcgttagggcccctgcgccgggacggtgtcgccacagatgccgcgggtccacgtctgcctggaaaatggctggcgagaattaccagttctcgaccgagagcggcaccggcggtgaacaacgtcgccctgagctcgtcaccaagatgccccttagacaggatgccggggctgcaggaccggggcccggacgtcctggaaatcccgctgctagtgggatgggcttatttcgacgtgatggaccccccagttgctacccggcacgcagcgcccatcagtctggagactgcaggccgtcagccccgttccgcggggagaggcccatccacccgggcagtccccgtattcagagccatcagatgtctcaactgcagcttgctcgggtcctgtacgcagggcaagatctgccaagggcctcagtcaattaggagccggtcgagtttctgtccaggcttttggaggggaactcgccccatcttccaattcacatgcacttcttcgattatctccggagcttgcgcgatgtgcctcattttgccttcacccgatatttcatggtggtggagaatgcgctgctggtcgatgcgtaggtcaacgtaggtgatagctggcatgcctcctggattttggactgcgggaccgggaggtgttccatgataaagcatgcttgtttgtctattatgctcgtgattatctatcacgaaacagacgtaagatttatgagcttggattgctataagtgtctctgcccatacccactaggacataaaatgagcaaacaatagttgtagcttattaaataacttcttcacggtaaacacagaagaatcaaaagataaagaaagattctcaaaagggtttaacttgaagcaaccaagtatcctgaggacttcgttgtcgcgctcggcctcgctgacctcggccaggaagcttttgaggagctggtcgtcgtcggcctccgacgaccccatgggtgtacggggaggaggagagggaggtcgcggctcgggtgggcagagggagaagaagaagaagggatggagcctatgaaggtgtacggctgggcggtgtcgccatggatggcgcgggtcctcgtctccctggaggaggccggcgccgagtacgagctcgtgcccatgagccgcaacggcggcgaccaccggcggccggagcacctcgccagaaaccccttcggtgagatcccggtgctcgaagacggcggtctgacgctttaccaatcccgcgccattgcaaggcatattctccgcaaacacaagcccgggcttctaggagcaggcagcctcgaggagtcggcgatggtggatgtatgggtcgacgtggatgcccaccagctggagcccgtactcaagcccatcgtgtggaactgcatcatcaacccgttcgtcgggagggacgtcgaccagggcctcgtcgatgagagcgtcgagaagctcaagaagctgctggaggtgtacgaggcgagactgtcaagcaacaagtacttggccggggatttcgtcagcttcgccgacctcacccatttctccttcatgcgctacttcatggcgacggagcatgcggttgtgctcgatgcgtatccgcatgtgaaggcatggtgggaggcgctgctggcaaggccatcggtcaagaaggtgatagctggcatgcctccggattttggattcgggagcgggagaataccatgataaagcatgcttgtttgtctatgatgctctgattatctttactgaaccaacggaaaataaagtaagcaagatatttatgtgtagggcgtggatatcaaatggcttgttacacgaaacagagtttcccccgctttctatgtaaagtaaacatcaccgaacaatccgatgcaaactcaaaaaaaaaaaaaaaaaaaaaaaaaaaaaaaaaactcgac

SEQ ID NO: 24642 - DNA, 575 bp, Triticum aestivum
  unsure (1)..(575): unsure at all n locations
  Clone ID: PAT_TA_24642
anctnnttggatttggaaagcggggggacaaancatgtgtgaccttgatggtggtgctgngagcanccggtttcgagctcccggggcgaaagcctaggtcngaccccgagtggtcatccctggcaatggcgatgttttttttanatngtgaccttgttggcgcctgccctcggatacgttcagactgtttcttcagggtgaaaactttgattctagcctttttggttggatccggcgacggcggcgcttgagtgtcgcttccttcttgaaggcgttgttgttgaagatcctcgtcgtcaatgtggtgtcaatggttggtgcggatatggtcgcagttctagtttgtcgttcactgatctgatcgctttggggcttttttatttcttttttccttttcacacctattcatagcttttggtcttatgactttgctagtccgttggtgtgttttagcgtttgtgttgggttggctgtgtgcatcctaagttatgcagaggccggggtgtatgttcattatattgtatcctcttgntggcttcttttgagccaataaaaatcaccctttgtcgngggag

SEQ ID NO: 24643 - DNA, 503 bp, Triticum aestivum
  unsure (1)..(503): unsure at all n locations
  Clone ID: PAT_TA_24643
cgccgtcctacagggcgtacctggtcgcgctctggctcgtcggcttcgtgctcgtcttcctgtggcagaacacctccatgggccgcctgcggctctacaaccggccgcccatgcccaagcgcgcgccgtctgccgcagcctcgatgggccagtgggtggcctcgccgccggtgtacgacttgagggagtttgggggcgtcggggacgggcggacggtcaacacagcggccttccaggccgcggtggcggccatctcggagaggggcggcgggaggctcaccgtgcctgccggccggtggctcaccgcgccgtttaacctcaccaagccacaatgacgctcttcctcgctgcaggcgctgagattctcggggtccanatactggccattgatgtccccattaccgtcaatatggataacgggagaagagcataagggacctcgatattgggaagcctaatacaatggtcaagaacttgaaaggatgtggttttttaaccggtcn

SEQ ID NO: 24644 - DNA, 768 bp, Triticum aestivum
  unsure (1)..(768): unsure at all n locations
  Clone ID: PAT_TA_24644
cccccanttggaaaatggnaaaacgttcaaaggccaattcataatgggatattgttccacgggcttgggaccggggacaaacnatcatccaggcagnccggagttgggcccattgtcgggagctcatgaggaaccccttgaggtgatggcccaaggcacaggctgaggtgcggccgaacattcgacgataagaacccacaagatcatgaggaacacgttgcggagctacactacacgaagatggtaatcaaggaggccatgaggctatatccaagtggtgccaatgttaatcccccatgtctgccgagagacctgcgaccttggcgggtttgaggtcaccaagggtacaagggttatggtcaatacctgggctttcggtaggaaccccgagtactggcatgaagcctgaggagttcaagccagagaggttcgaggacggcaccgcctcctgccgaggtccgcgcgtgggctacttgccattcaggagcgggaggaggaaactgccccggtngataactttggtttggcagtgctgcacctcatggtggcacggcttctatactattttgactggagcctccctgctggtgtgaagccccactgagctggacatggaaatgaggggtggcatgacctttaaggggaaagaaccaactgcacctagtggcgacaccatataaggcatgcagttgatatttgaaccaaacttatgcaccttgtggagaataataatagtggagttgtacctgnnnnggcgnncgatagaat

SEQ ID NO: 24645 - DNA, 638 bp, Triticum aestivum
  unsure (1)..(638): unsure at all n locations
  Clone ID: PAT_TA_24645
tcgagttttttttttttttttttttacctccaaatgcaatatttattaatggtaaatgtaatcttctcaacgttgaccattacaatatgagaaggccacaactatttcctccattagaatgttataaggacaatgatggctcaataagagacaattcatcaagcggcaggtgaatgcaatatttttcaatggaaacaccgaaaacaacacaataagcagtattcctcctataaccaactaaaacacgatccttatgcaatgagaaaccagctcccaccaaaatgagagccttcgcctagctatatactgctaatcacatacgccaaaatgtctagtcccagaagcatttgatttggaagtattgcattactaactcaattgctctacaggcccggggatttaaattagtgctagaaatggcattgnacgaatcaactatcatttgggtcaaaatcacgaatatagcgcgcaaagctttaccacgctggacacataccatcttggttcctgggagctaacttgttggggcagtacattgttggactatgggttcagcttacatactgtcctggctcgaccaatggagtcaatggcctgcaaagtgcaatcagttgctacgttgaggggggtgatcatgg

SEQ ID NO: 24646 - DNA, 530 bp, Triticum aestivum
  unsure (1)..(530): unsure at all n locations
  Clone ID: PAT_TA_24646
ctcgtgccgaattcggcaccagccactacctcctcatctctccctcgttgacgaagctactacatcttcctcctctcgacctgcaatccactcagctctcgtcagaaagttaccacgacacgcgcgtccccaatattcagactcggctccggcctcgccgcactactacagaatgaagatcttctcgagcctcatcggcttctgcgccggcgctgccgccattagcgtctcctttgattccggctacgatgagcgtgatcgcggcctcgacaccgtcagctgcagcgacggcagccacggccttcttacgcgcggctacacaacccagagctccctcccatccttcccggcttatcggcgggcacttccctttantcaacggggtgggacaagttgcaangctggcgggctccctgcctggancccttactttacaaggggtnagctccatcaancgtacgtggctnatggatcaacgccaaccggacgggtnttcaataattgcgcgcgccgcccgcctggaaacttgg

SEQ ID NO: 24647 - DNA, 536 bp, Triticum aestivum
  unsure (1)..(536): unsure at all n locations
  Clone ID: PAT_TA_24647
ctcgtgccgaattcggcacgagttgtgccgtagccttctgcttgccaaacgcactctccaaattttatatcgattgtgcctgaagaattagcaataatggccacggcgcaaggtagaaacgctccccagcagtcagtttatcctcgtagccacgtcggcttcgatagcatcacttctcaaattgagcgtaagctcttaaaacgcggtttccaagttcaacatcatttgtgttggtcaaactgggttgggaaagtcgacattaatcaatactatctttgcttcacacttgatcgattctaaaggaagacttaccccggacgaaccaagtaagatcgactaccggagattcaaactgtctctcatatcatcgaagagaatggtgtcccgcttacggctcaacaattgtgggatacgccccggctacggagaaccaaagtaaataaatggataagatgcgggggatcccatggtcaaatatattaaaggaccaanaccctggcaatatncttncgcnaaagaaactcaacgggnttcaa

SEQ ID NO: 24648 - DNA, 867 bp, Triticum aestivum
  unsure (1)..(867): unsure at all n locations
  Clone ID: PAT_TA_24648
ctcgtgccgaattcggcacgagcatttacgagataccctaaacaagaaaaattaactctaccctactcaagtcaaggttacatatcacaaccttttacaaccctgatgtcaccttccccagaaatcagcgaattcttaagcactaccatggatcccgcgcagaaaggtcctgtcggcaaagttggacaatcaacgtccttaaccgatgagcgttcgaaagctcatcaagccgcgcacgggaagactcctgcccgcccaatcatcagatctgctggcaacctgttcaagcgatacaaaccatcaggtgtcgcagtgtcttacgccgacaacaaaataggcatcatgcctgatctggagggctgtctgggaacaagatagctatcgcagccgaaatcgactaacccgacgactcgatgatgtcaagattcttggaagctttggtggttgacgtatacgtcaacccttactcccgacaaaacgagacttctcctggcgaagattaaccccggggggcgccccatccagtcacagcagactcgcgacgtgtcgaggacccgcgtgggcacgaagtatcgacgatacgctagagccatgtcttacgtagtagtagaattgctatcagcgaacactagtcaattcgaagaaatattacaaagacgtgctctagagctcaatttgtcgtcatcatacgaagcgatacgacactttgatggcgccgatgcgttaatttatgtggatcgagattctgcacgacgagctgcagaggcaaagaagttggctcttacctaccgggaaaactggtaaagagtacactcnagacaattcgattgtgtcagtagacacaacacatggtctcactccgaatca

SEQ ID NO: 24649 - DNA, 449 bp, Triticum aestivum
  unsure (1)..(449): unsure at all n locations
  Clone ID: PAT_TA_24649
ctcgtgccgaattcggcacgagccgccccgacccttaaatcccaggagcagccctccctcccacggcgcccaaacccgccaatctcctccgtgactcgccttgtctcctccgcgattcatccatggcagcgacgcatcgggtctccgccgtgatcttcgacctcgacggcaccctcttggacacagagagggcaacaagggacgtcctgaaagagttcctggggacctacgggaaggtcccagatgcggccaaggaggagaagcgattggggcatgatgcacagggaagtccacaaccgggatcatcgcagactatggggttgccgatcaccgtcgaggagtattcaagaggcaatatacccgcctgttatatcaaaagggggcgtagcgcggcgccgcttccaggggttaacaggcttctcaaagcacctccacaaggaacnggagtn

SEQ ID NO: 24650 - DNA, 441 bp, Triticum aestivum
  unsure (1)..(441): unsure at all n locations
  Clone ID: PAT_TA_24650
cgagtatatagatcagatccaccgaattgggatacaatgtactacagttgatgccagtcagttattgaattagctatctcaatgatttgtatcaaaccaagattcggtgcggatactcttccattgcttttttcggatggaatagaaatgagtactccctctggaacttttcctgataacaatactctcctttaccgcttcaaggtgctgatctaaaagcgaccttctacccgtcttttactaccagctatgttgaattttttggcattgctgttattagtcgccaatgaatagcagtcttaagttttgaaacggatcaaacccctagcaaatagaatgtgngtattttggttccgttgttacatgagctattttactttttgaatacctaaaaaaaaggggggggcccgggtaacccaattcgcccctatagtgaggtcc

SEQ ID NO: 24651 - DNA, 964 bp, Triticum aestivum
  Clone ID: PAT_TA_24651
tcgtaaaggtatactaccgaaggacaagacaacggtgctgaccaaggcggcggggtacctaaagacgttggaggcgcaggtctctgagctggaggagaagaacaataagctggagaagcacatcccgacctacgactgcgaggaggacgtgccgcaccagcagaggcggcaagagggccaaggtccagatcaccaaggcggcgtcggacgaggtggtgaacctgacggtgatggtgatggtggagtgtgacgtggtggagctggtgctacgcatcctggagtgcctccggtggatggagcaggtcagcgtcatgtccgtcgacgctgacacctactccccgcaggtgttgctcaaggccatagccagcatcaagctccggatcgtggaccacgactggaacgaggccttgttccacgaggccatggccaaggctgttaacgacgcaaccgtgtttcgtcctcctctcgtgctcaccgcgtagtatgcaggaagaggaaggatatatgtgtcctaatcctgaggagcaattcatagccatacggtcatatagccgtccaaaggttaggttagatggttggatgtaacgtagaagcggtaatctgtttgcaatagtcggatgggtgcccctgatgagtcactctgcaccaacaagatcaaagacgagaaagaagtcttcagtgcgagaagctagaaatgtttgtatcggatgcctggaagatcggaaccaaactaccgacgagggactatagctataaagggcagtaccaacctccgccaaggggtagaagatatgtctgagctcattcccataccttagattggtagataggaaaacgacattgtaaatctcaatgctcatcaataaggataggtaggcataatgcagacaaattacccgttcggtggcgtgaacctggataaaatcattgtatcaccttcagcactgatgaaatcccttcgggc

SEQ ID NO: 24652 - DNA, 682 bp, Triticum aestivum
  unsure (1)..(682): unsure at all n locations
  Clone ID: PAT_TA_24652
ccatccatccgtcaagagagaaacaacaaacgcccagagccgaaaccaagaacaagcaagccccaatggtcaacatggcggccgcaggccgcagccgccgcctcctcctgctcctcctcggcctgaacctcctcactacccccgccgcaacggcgccctacgaccctcccaccgtgccggagctgatggatcggttcggcctcctgcgcgctctcctccccgaaaaccgcccggcggtacctcctccactccgacggctccttccgagctcttcctcgacgacgggctgcgaagatcgaaggccggggggctaccgcgtcctgtacgacatcaagtccccgccccgggggccccgggccgcccccgggggcggggcccccgcggccccgtgcgggccgccccgcccggccccggtgctggttcgccgcggggtccccccgtcccccgncccgtccgaaagcggccggcgccggggcgggcggccgccgtcacccctcaagccgtcgggtccccggtcaaaagaaagtcgttcccctgcccggttgggcttcaaagggccaaagtccggctttgcaagttaaccgggccgccggccggttcgctgggaatgttagccttaagttttgtacctaactnaagaagcaagttaagttttgtttgcaaatttcttaaggggcccaac

SEQ ID NO: 24653 - DNA, 693 bp, Triticum aestivum
  Clone ID: PAT_TA_24653
ttttgttttttttttaatcctccaaaacccccaccaattcatccgggaaaaaactttatggttccagtgacttgcctggataaggcgatttagggcggctagaaattgttctcaagacagagtaggcaaaacatgatggcttgtacttgacaaaggaagtgctgcaactatgttgttgaccgctactatgacagacggacgacaggaaatggtcttattataactagcctatcagtgacgcttgcacagcggataatgcaaacctcccctatttcaacgtagacaggatctcctcggaaggaatctcaagcgtagccccggcatgtgccttctcaggcttcacaacgaaggatccggagggtgagcgcttagcctggacgatcatgttggcgatgaagtccgcggcctcgcgggcctcggagagggcgcggacggcgtcctccgatcccggggcgaggccgcggtgatcctcgaagcggcgccggatctctaccgccgactccgtcagcatcagctggtcgcctgagaacgtccgccgcgccgcccgcaacacagcccggtacgccgccagcccctccgccgccgccgccatttttagagacgaagaggggcgcaaggactcgaggctgttgcgttgtagtggcacaagagtctgcaagcgctttggcagttgttcgtctttcataaatccaa

SEQ ID NO: 24654 - DNA, 489 bp, Triticum aestivum
  unsure (1)..(489): unsure at all n locations
  Clone ID: PAT_TA_24654
cttgtctgtgcgaccaaattttttgagactgtattctccgcccattatgatgctatcaaaagctgtcagacctgccctcaaggcaagctctgccgcctacactcgttcaattccaaaagctgcaacatatgcaacacttcgagaaattgaagaccgcctaaaatccatcaggaatatcgaaaagattaccaacaccatgaagattgtggcctcgaccaagttaacccgtgcccagcgtgcaatgactgaatctcgtcaatacggtcaaacttccaacgctgtttttgaccaagccggaactaagccacttgaaaaagataaccaaaaatatttgattgttgtagccaagttcggataaagggctatgtggtgggcatccactcaggacttagtaaacgcggttaggaagatgcttattgaaaaatcccaatgccggcattgtagttcttggggaaaaagctaangnacaattgagtcgatcaagtggga

SEQ ID NO: 24655 - DNA, 540 bp, Triticum aestivum
  unsure (1)..(540): unsure at all n locations
  Clone ID: PAT_TA_24655
agaaaagctcacgaagagagacangaagagatggcatctcgctctaagggatgaatgaatcaaggcgacaaaaaatgatttgcgtccgcgggataatctactttgaaaaaatttgttgtaggccgactgggttaagctatgctggggaatcaaaanaaaagatgatactcangacgactacaaagnatcaagtaggccaagctcatatcacaaggcagntctcaggaatctcatgtttttcacacagcacaagaaaataanagcnnctccgaggggggggggggcccnggttaccccaaattcggccctaataagtggaggtcgttattaacgccgccggctcaacngggcccgntcgtttttacaaaccgttccgtggacttngggnaaaaaanccctggggcggttaaccccaaaantttaaatncggccttttgccangcaanaatcccccccctttttcgtccaagacctggggngggtnaattagcgcaaagaaagggcnccgncaacccggatttggccccttttccccaaaca

SEQ ID NO: 24656 - DNA, 963 bp, Triticum aestivum
  Clone ID: PAT_TA_24656
ccccgcccccgcggcccccggcccccccgtcccgctcccgtgccgtattcggcccacccccacccactctggcgccgcacccacgcacgcacgcacccgagccccacattccgcatcccccactccactagccaccaagaaccatggcgcggcggagcggcatgctcctcctcctcgccgcggccgccctgcttgccgtcggcgcgggcgccgccgtgccgccgtcgtgcgagcgcatcgagtgcccggcctacgacgtggtggacagcgccaacgggttcgagatccggcggtacaaggacgcgatgtgggtctccaccgcgcccatcgcggacactctccctgcgtccgaacgccacccgctccggcttcctcccgcttttcatgtacatccagggggaagaacgcgtacaacgacacgatcgagatgacggcgccggtgctgacgcgggtggcgcccagcgacgggcccttctgcgtctcctccttcgtggtcagcttctacgtgccggccaagaaccaggcggacccgccgccggccgagggcctgcgcgtgcagaggtgggccggggcgaggtacgcggccgtgcgccggttcggcggcttcgtagccgacgccgacgtcggcaagcaggccgcgctgctcgaggccagcctgcaggggaccaggtgggccgcgcccgtgtccgacggccgcaaggccgacccggcgtccgagtacaccgtggcgcagtacaactcgccgttcgagttcagcggcagggtgaacgagatatggatgctcttcgacaccatggccgcgtccgacatgtaactgtgcaagctagccgcttgttagactaaaccagtgagctcgtatatataagagtgtcttgtcttttaagcttctatgtaagccgacgaataatggtagcgtataaacttgcgagcaataaagtgccctttcttggtgcaaaaaaaaaa

SEQ ID NO: 24657 - DNA, 537 bp, Triticum aestivum
  Clone ID: PAT_TA_24657
ggaggaggaaggaggaggagcgccgcctcgccgccgagaaggaggccgcgagagccaaagccaagacgcttaagatggaagattatatgctcttcgagcaaatgataagggagattctcgaggaggggaacgaaggtgacaagggcatcaacgacaacagaatgatggtggcagcttccagcagggtcgccgaattacggattgggatcaagcactggtggaagaaaagcacctatgcttatctgaatgagccggcagtgacggcatcgatggatgacaagggaagaaacagacgcgccgtcacttatattccgcaggacagatgcctcaaagcccgctcgtcgattcctgcttcatttgtcatcttttaggtgctctgtattcattcatgacggaacaagctgaggcatatctatatgtatatatgcatcagctgttgtgacaaggacggaataatttatgttgtgtataagtttgtctgaatgctgtacttatatcaaattattaagtggaagaccgtgttgcttggtgcaaaaa

SEQ ID NO: 24658 - DNA, 803 bp, Triticum aestivum
  unsure (1)..(803): unsure at all n locations
  Clone ID: PAT_TA_24658
ctcaagacgacgcagagcaaggagactggggggacgctaccaaatcggcgatccagggaagatggcgttcagcatcaccaggaaagagatcgaggggttctggaggaggaaggaggaggagcgccgcctcgccgccgagaaggaggccgccagagccaaggccaagactctcaagatggaggattatatgctcttcgagcaaatgataagggagattctggaggaggggaacgagggagacaagggcatcaccaagaaccgaatgacggtgacaccttccagcagggtcgccgagctacggattgggatcaagcactggtggaagaaaagcacctatgcttatctgaatgagccggcagtgacggcatcgatggatgacaagggaagaagcggacgcgccgtcacctatattccgcaagacagatgcctcaaagtccgctcgtcaattcctgcttcatttgtcatcttttaggtactctgtattttcatgacaaaacaagctgaggcatatctatatgtatgtatgcatcagctgttgtgacaaggacggaataatttatgctgtgtataagtttgtctgaaccctgcattactttcaacaaaacaggaagcccaagttcctctcggcgattcctgcttcatttgtcatcttttagctactctgtatgtatgcatgacaaaacaagctgaggcatatctatatgtgtgtatgcatcagctgttgtgacaaggacggaataatttatgtagtgtataagtttgtcnaatgctgacttatatcaaattatcaagggaagaccgtg

SEQ ID NO: 24659 - DNA, 535 bp, Triticum aestivum
  Clone ID: PAT_TA_24659
ctcgtgccgctcgtgccgaattcggcacgagggaatatctatatcaaagagatgcactttgcgatgagtcgccagaagttgaccggatggggatataatccttgctagtgttgtagtattttttgcgtggacacttcaagttcagggattgatcccggcgactatgtaacagcaagttaatttgcgcaagcgcgctttaattcacgccagctcggactttgaatcttctttggtctgaagggagaggaggaaggctctctgcatatttagggaagaaatcacagccataggggctattgaagcattccggcaagaactatgatgtttgcacctttcttggcagcttgcacggctttgtcccaggcattctgaagggttttgagtcttatcggggccactggctaactggatcaaggccagctttactcgacgcttgaagcaagttgctcatgtttgcgggctgaagcttgaagattgcctacttgtgagccgtgaatgtgctgttcctgttctgcagcacgcgtttctaagcgac

SEQ ID NO: 24660 - DNA, 346 bp, Triticum aestivum
  Clone ID: PAT_TA_24660
atctttcctgctgtactaatcttcgcaagttggagcggaaatgtagagatcaaatgtctgtcagaacaatctgaagatcaggcaaagatgcgagctgctcatagtaaattgccaagggtgtttttatgtgttgacatagatggtagatagaggtacggcccttgcattttgagcttaagttttggctataaactacaacgaaaacgtgcagatgctcgctgtttgagtgtgcggcattctgatacttttttgcctggcagcgtgtcgctgtgatgcaacatacatttactgccagttcttttcctgacaaatattggttagcatgttgtgctgttattgtagtatt

SEQ ID NO: 24661 - DNA, 752 bp, Triticum aestivum
  Clone ID: PAT_TA_24661
caaaccgggcgatttaaagcttttgggggttcaccggcccccggtgtttttttcccccgggtccaccggaccgtttgtttaaaacaacgggcccaggcccagattgcccaaaggcgtttgcaatttgcccttgccagggtcagccctcttggcggcccggccctccggggctacccctgccctcgggcgtgtcccgtgtgcctggaccggcgccccatgtaagcaattgctttagatcctcagtattcccggagcaacaatagatttgctacaggtggcttagcaggtcaagtacttgtgctgacaaagaagagttgggtatcaggttataacaaaaagggttctgcgtgagggtgaaggaccgatccattctatgaagtggaggacagatctgctcttcgcctggggctaaatggatgcaaggggtgacacgtgcatggcccgttgaccgaccgggcaagtgcggcctttcgcattcccatggccgtcccgcgggcggggctccttccgcctctcctgggcggcctgcgccccgccgctgcccttgcggggtggggttccggtctcgccccggctccaattcgggtcccatccagcccctgggctcgggggtgcccaagagagctctcccgcagcctgtgcggcggaggacctcctcgggttttgaatgaaatttgctgcttgtaactccttacctccggcggttttttaccttttgatctttgtggcgctaacctattcgcgagggcatt

SEQ ID NO: 24662 - DNA, 697 bp, Triticum aestivum
  Clone ID: PAT_TA_24662
ccccgcgtccgtcagtacattctgatccatatgctgccgacgaggctgacatttccagtaggagttatttggacaggcatcagcaatcacatacgatgatgaactggagtcaactctctcagtcattgtgagttcagttgcacggtaacctattttcaaagaaaaaaatgcattgtcataaactgaaaatttggagcttatagcaaaaggtagacagtagttgtctaaagccattgttaatgtggcaccaaaaattagctgacaacttgaatttgatgtgtagtagctgagtagaacattccaaatgcccactaatgatccctttttttcacaaatctctcaatgcagtacaacaggatgggaagtggataattagtgctgtgtgaccggatttaattggttaggagttcggcagagagaattatattatacatatgtaaattatcacattttgttcgtctatatagccttggtgtgcatgcaagtcattgaacatgcagcttcttggatgcaataattgttgtgaacctagttgtgtagaaccttgtggtttaggttgctcggtgcccccaagatatgtattattcgtcagataagagttttctagcatcaggttcattttgtatttggttattgtcatattgcagtttttggtgatgggatagtcaacacaggtgtatttctcagtttgatagcc

SEQ ID NO: 24663 - DNA, 1009 bp, Triticum aestivum
  Clone ID: PAT_TA_24663
gcgcgcgcccgggcaggtactccggagaactcctccaacatctaggagccccactccatttggaacagctaagtatctgtttgacaagatcccgaatgacgcttcaagcaaggtccggatcaaccgggacctagataccccagaaagggtccttggagcaccacccccgttgcccgatttctcgttggcactaccacctgaagactatgatcttcctccattagacccactttggaacaaagaagacggccaccagtaggtgtatattcagcattcagcaggagtgtcttctgatgggaaggctctggccgctactgagaaatcaacgaccaggattctgccatgcggaggccgagacacgacgcaaacgaagtgtacaaagatatgatccgacaaaaaaaatttgatgtcggcaaattggaagcaaattttagaaaggcctgaagatatctgaagagcatttttacagttaaatcttctctgacaatggaaacacattgtcaaaagcttgctttccaacaattcctgtaaaaattatatttccaatgagcgccatggttcctttttcttaacatttgctgaacatggcttacctttggggcaattcctgagccactaagatggcacgtagcgggacccgtaaacgcagcagaatggttgcttctggcaagaaattggctctggagagaaaggaaggaccaagatccaccatgtcaaagtcgaacatggtaacaaatgaagtgtacaaaatattttcaaacaaaattacatgtcaacaaaattaagcaaggcctgaagataatctgaagagctttgtacaggcgattcttcttctgacatgggaaatgctatgtcaaagggttcattgatcattttcgatcctgattcctgatgcttgcattttgtcaacaacggattttcagcatttcatatggaactggaaccagcctctggtcgaaagtggcaaccttcaatttttttagtcataaaaaaaaaaaaaaaaaaaaaa

SEQ ID NO: 24664 - DNA, 530 bp, Triticum aestivum
  unsure (1)..(530): unsure at all n locations
  Clone ID: PAT_TA_24664
ttctgtcaagtaacagccacaggtcattcgacaatgaagctcttcaccaccagcggcattgccacgctcttcaacgtcttagcgcctgtgatagccatgtcaattgctaatgctagaacgcgaatatcagtgccagcgccaggcagcaatttctcatttttgtgtgagaatgggcgcagataccaaaaaaattatctccaaggagcagttcaggaggcgagatctattatgagtaaccaattttcacatattggttatccattatcattaaatcaccttgattacgacatccctggaaatgtgtggtatcatcctctcaatttacataacgcagatgattttgtcgtctttagcccgaggctctcaaatagcgggccgtcgcccacctgcgggacgcatcctgatgggcaactaaccttcaagcccctgttcaatcatttaggactttaaatgaancaacaaggnccgagggccaaaaggcnttcaactgggaagtcacgtggcgacgaagggcgnaaaacaatcctgcn

SEQ ID NO: 24665 - DNA, 810 bp, Triticum aestivum
  Clone ID: PAT_TA_24665
ccgtgcgtccgcgccgccaatggcaacgaccgccgcggccatggcacccccctccacctccgcctcctcggtcctcctccttcgccgcctcccttccccgacctccgcggcccccggctgctgccgcctcggcccgccgccccgcctggaagggcccgggcatcaccgccaacttccccttcaaggtcgagtttcatgctcaccggcggaacaggaccccgagcacgcgcccaatttcggcaggcgcgtgcgcgtcacggcgcccctccgcgtctaccacgtcgtcaaggcgcccgacctggacatccagggcatggagggcgtcatcaagcagtacgtcggcgtctggaagggcaagcgcatcaccgccaacttccccttcaaggtcgagttccagctcaccgtcgacacgcagcccaagccggtcaagctctttgtccacctacgcgaggacgagttcgagtacatcggcgacgaatgagaccactgtacctacctctctgtaacaactgtacatggccaagtaagccgaccgccttcctcatatacaataataatggccgcagcgtaggcgtgtgtatattgttccggtggatgtgtgtgtgagtggtgagagggatgaaggctgaagagggttggaattaggaacgcatgaccaggaagttgattgcttgcttgctgtcgttcccttgttcctcctctaattcaacatctattttttctcagatgtgcggaattgtttggatcataatcgatagttctaaaataacaccgataattttgctcttccttgcaaaaaaaaaaaactcg

SEQ ID NO: 24666 - DNA, 698 bp, Triticum aestivum
  Clone ID: PAT_TA_24666
ctccagcgtgatgcgggacgacgaagaagcggcagctaacggcatcaaaataattcaacataaatcgaccacgccaaggacaagatgaaggacggcgcgggcgcggccaaggcgaaggcgtccatcacgcaggccaaggtggctgagaaggccgaggcggcgacggcgaggtcgcacgacgagcgggagctggcgcacgagcgcggcgccgccgacggtcgccgccgccgaggcgcagctgcaccaggacaaggccgcgcaccgcgaggatgccatgtcgcaccacatccacaagcacggcggccacaagcacggccacagccactgatacgatgcgcgggctgacgggcggcgccgtcggtgaccattgatacacacgcggcgcttgcctgcacgtgcgaacgtcgtgtgtgatctggcttgcctgccatgcatccatgaggatgtgattttccctgttcttttcactgccgtacgtgctgcgtgcgcgtggcgttcgtgtttgtgttgtgtcgatttcgcacgtaagtacgtctggcttaattatctcggagattataagacacaagagctagctgcttgcacggatgcatgtgtgtgttcctttcctctatttatgtgtgtatccaattccaaaccccctcaattcagagggacataattctgaaaatttgaaataaaggacttttgttcttgat

SEQ ID NO: 24667 - DNA, 518 bp, Triticum aestivum
  unsure (1)..(518): unsure at all n locations
  Clone ID: PAT_TA_24667
ctcgtgccgaattcggcacgagccgcaagcagccgccgccagcagctgcgcaaagggtcgacaaaccctaaccctagtccatagctagcttagcttccttcctctcgatctagctagagccatggngccgaccaagggcgaggggccggncatcggcatcgacctcggnaccacctactcgtgcgtcggngtgtggcagcacgaccgcgtcgagatnatcgccaacgaccaggggaancgcaccacgccctcgtacgtcgccttcanccgactcggagcggcctcatcggcgatgcccgccaagaaacaaggtccgccatgaancccatcaaacaacgtcttccgatggcgaagcgtcttattgggcanaaaggtttgctggattgcccctgtccanaggtgatatttaaagatgtggggcggttcaaagggttatttccctgggcccccccaggcaaagncctaatgantgggtagtggcaagttacaaaagggggggggggggaaattcnagtttt

SEQ ID NO: 24668 - DNA, 541 bp, Triticum aestivum
  unsure (1)..(541): unsure at all n locations
  Clone ID: PAT_TA_24668
gttcaagtatccaggaatgcaggttttgtgtcccaaanaactactgtgtagcattgcattcataagcataaccatatctcaatagctcagcgctcgtgaaattcgcaactctgcacttattttgaggcgcctttagtaactatttacttacaagatgcttctgccaacacagatctccactataatcttaagggtcgaccttgattgccaccagtgctacaaaaaggtccgcaagattctttgcagccttcaagatcaagagaggattaggacgatctccttcgacaccaacaataacgcagtacatcatcgacgggccgttcgatccacacaagctatcatgcaggatcagatgcaaaggaggcaaggtgatcaagggcgtccaaatcatgggcgacggcaagccggaagagatggccgggccaccgccgagcaacagtcgcaaaaagaaatcataatcaaatgggaaggggaaggggtcaccggcgccgcccgctgagcagccacaagaatattattctccgccggccaacgagcagcc

SEQ ID NO: 24669 - DNA, 771 bp, Triticum aestivum
  unsure (1)..(771): unsure at all n locations
  Clone ID: PAT_TA_24669
cggncaagggcaacccggaggngggggncatggtanaccgcatgctgcgggtgctancctcncacganatnttgtcntgcgtggtaaaggagggcaaggacggcaacctctcccgtcgctatggcgccgcgccggtgtgcaagtggctcacccccaacgaggagggngtctccatggncgcctgggccatcatcgcccaggacctcgtccccatggccgcccggggctacttgaaggatgccgtccttgagggtggcagcccgttcaagaaggcgctcgggatgtcatggttcgactacgccggcaccgacatgcgcttcaaccacctctacaacgaggccatgaagcaccactccggcatcatcaccaagaagctcctcccagctgtacacgggctttgatgggctcggcaccctcatggacgtcggcggcggcatcggcaccaccatccacgccatcacctccaagtacccgagcatcaaggggatcaactacgacctcccccatgtcatctccgaggcgccgccataccctggcgtgcaggtgcagcacgtgggcggcgacatgttcgaagcaggtgccctccggcaaccgatgccatcctcatgaaagtgggtnctcaactggttcaagcgaccaacantgncgccgacgctnctcaagaaatgctantgaacgcgcttgccggggcaacggcaanggtgatcaannatcgaggtgcatcatgccgggttaanccgggacccgacncctanacgcgcntngggcttg

SEQ ID NO: 24670 - DNA, 549 bp, Triticum aestivum
  Clone ID: PAT_TA_24670
ctcgtgccgaattcggcacgagctcgtgctgctcgcgccaagagctaaccatcgcaaaacagcatactctccaaaatgacaaaaataaactcctctcttcattcatcgcggagaaaatcgcgtcatgcttatttcaatgctccgtccagtgtgcgaagaaccatgatgagtgctccgcttagcaaagagctccgtgagaagtacaacgttcgatcaattcccatccgaaaagatgacgaagtcttaatcgtaaaagggtctaataaggggcgtgaaggcaagataacctctgtataccgtctaaaatacgttgtacacatcgaacgtgtcgtaaaggaaaaatcttctagtcaatctgtgccccttggaattcatccttctaaggttgtcataacaaagttgaaaatcgacaaagaccgagaacaaattcttgaacgcatcaagggtggccgagaaaataaaaaggaagcaaaaaagaagcagctcttaaaggcgtaagatgacccactcgaatccatttgatgtagcgcacaagctctgacatcacaa

SEQ ID NO: 24671 - DNA, 897 bp, Triticum aestivum
  unsure (1)..(897): unsure at all n locations
  Clone ID: PAT_TA_24671
nttttagtnaaccgtgancnttttccttcattttcccacattatatgtttacacccaatatagttcaatccattacatacccgcacaatacactgttcttcttgctaaacacatcggtcctacacgcgtagagactacccttgtttcggcccgggcggccccgggcgcagccgggagcgccgggcgcggcgctgcccgccccgccttcgtctcgcgcgcacggacgggggcacacgccacacacccgagggagtagtggatggggcgaacttccctctcatcatcatcatcagcaggtcacctttgccggctggctaggacacaattcttccatcgatcgagaccacctaaatgctccagagactgacagcagtgtggtatggtaggcatcggtttctagtagtaaggtggcggcgggctgggggtgtgagacaccggcggcgtcggagtgtaggtgggcggcttggtggccggcggcttcggtgtgggagtgtacgtcggtggggtcggcttgggcgtgggaggcttggtagccggtggcttggggcttggagtgtacgtcggtggggtcggcttgggtgtcggaggcttgggggaaggcgtgtacgtcggcggggtcggcttaggtgtcggaggctttggggaaggggtgtacgtcggtggggtcggcttgggcgtcgggtgtgtgggaggcttggggcttggagtgtacgtcggcggggtcggcttgggcgtcggaggcttgggggaaggggtgtacgtcggcggggtcggcttgggtgtcggaggcttgggagaaggggtgtacgtcggcggggtcggcttgggcgtgggaggcttggtagccggtggcttggggcttggagtgtacgtaggcggggtcggcttaggtgtcgg

SEQ ID NO: 24672 - DNA, 458 bp, Triticum aestivum
  unsure (1)..(458): unsure at all n locations
  Clone ID: PAT_TA_24672
gttgcatcaaggcagaatccaacccgtgtggaactccgatagtctttacgtgcatcaaatccttatcgattcctccgccaccaacttcttactcgcacaatttggcaaggagaattgatgaacagaatgtttcgaatttctctaatgtcaagggtaactacccggtctattctcaagagatcatcaactctttcagtaataaccacgcctccatcagtatatatcaactcaactaggggatttgctaagtcatgcagaggaaaaagatttangtcataattggaggcggtgtcgcgggatacgttgctgctatcaaggctgggcagggaaggactcaanggtcacctgcattgaagaaaacgtggcaactttaggtgggacctgccttaaaacgtaaggatgcattccatccgaaaggctccttttaaacaactcgcatccttttatcatcaagattc

SEQ ID NO: 24673 - DNA, 682 bp, Triticum aestivum
  Clone ID: PAT_TA_24673
gccggccgggcggataggggtcagtagaagcaagtcgagcgagcgagcaggcagcaggaaggaaggaaggaaggaaggaagcaaggaagggaggtggagatggcgcccatcaagctgtacgggatgatgctgtcgcccaacgtgacccgcgtggccacgctgctcaacgagctcggcctcgacttcgacttcgtcgacgtcgacctccgcaccggcgcccacaagcagcccgacttcctcaagctcaaccctttcgggcagatcccggcgctccaggacggggacgaagttgtcttcgagtcgcgcgccatcaaccggtacatcgcgaccaagtacggggcggccctgcttccgacgccgtcggccaagctggaggcgtggctggaggtggagtcgcaccacttctacccgccggcgcggacgctggtgtacgagctgctcatcaagcccatgctgggcgccccaaccgacgcggccgaggtggacaagaacgccgccgacctcgccaagctgctcgacgtctacgaggcccacctcgccgccggcaacaagtacctggccggcgacgccttcacgctcgccgacgccaaccacatgtcctacctcttcatgctcaccaagagcccaaggcggacctggtggcctcccgcccgcacgtcaaggcctggtgggatgagatctc

SEQ ID NO: 24674 - DNA, 916 bp, Triticum aestivum
  Clone ID: PAT_TA_24674
ataagaagtcgagcgagcggcaggcagcagtcgagcaggaagaaagagatggcgcccatcaagctgtacgggatgatgctgtcgcccaacgtgacccgcgtggccacgctgctcaacgagctcggcctcgacttcgacttcgtcgacgtcgacctccgcaccggcgcccacaagcaccccgacttcctcaagctcaaccctttcgggcagatcccggcgctgcaggacggggacgaagttgtcttcgagtcgcgcgccatcaaccggtacatcgcgaccaagtacggggcggccctgctgccgacgccgtcggccaagctggaggcgtggctggaggtggagtcgcaccacttctacccgccggcgcgggcactggtgtacgagctggtcatcaagcccatactgggcgcccccaccgacgcggccgaggtggacaagaacgccgccgacctcgccaagctgctcgacgtctacgaggcccacctcgccgccgggaacaagtacctggccggcgacgccttcacgctcgccgacgccaaccacatgtcctacctcttcatgctcaccaagagccccaaggcgggcctggtggcctcccgcccccacgtcaaggcctggtgggaggagatctccgcccgccccgcctgggccaagaccgtcgcctccatcccgctcccgcccggcgtctgaggcctcgccgacgccgccgtgggttcgatttgcttgcttgcttattagctgccgcgagaatggaataaaatcgcgatgatggaataaacaacattttagagaggaagcttggaattcttggcgtcgttgatgatgttgaatgttggatcttggtgttgaatgtttatggcgcatctatttatccggtttttggcttgaaatttgttggtagttcggcccttaaaaa

SEQ ID NO: 24675 - DNA, 997 bp, Triticum aestivum
  Clone ID: PAT_TA_24675
gggcggaagcggaagcgggagcagagcagaagcagaagcaggcaacaggcgagcaggaaggaagcaagagaggtggagatggcgcccatcaaaggctgtacgggatgatgctgtcggtccaacgtgacccgcgtgaccacgctgctcaacgacggcctcggcctccgaggcttcgcctcgcgtttcgacagtccacctcccggccccgccgcccacaaaccccccgcgttcctcacaagctcccctctcggcggcggaccccggcgctgcaggacggggacgaagttgtcttcgagtcgccccgccaccaacgggtacatcgcgaccaaggtcgggggcgcccttgctcccggccgccgtcggccaagtcggggcaggcgtggctgggaaggtgggagtcgcaccccttcctaccccgaccgggcgtgcgggacgctcggatcgtaccaagcttggtcactccaacgcccactgctgggggggcccccaccgacccccgaccgaggtaggacactggaacgccgccgacctcgcccaacgctgctcgaacgtctacgaggcccacctcgccgcccgggaacaagtacctaggccggcgacgccttcacgctgcgccgacgccaaccacatgtcctacctcttcatgctccaccaagagccccaaggcggacctggtggcctcccgcccgcacgtcaaggcctggtggggtaggaagatctccgcccgccccgtgcctgggccaagaccgtcgcctccatccccctcccgcccgacgtctgaggcgatgtgttgcttgtttggctgcggcgagaatggaataaaatcgcgatgatggaataaacaactttttagagaggaagcttggaattcttggtgttgctgctgttgaatgttgaatcttggtgttgaatgtttacggcacatctaatttatccagtttttttggcgtgaaaattaaaaaaaaaagggcggagagaagaacgaaagcctcgtgcc

SEQ ID NO: 24676 - DNA, 507 bp, Triticum aestivum
  unsure (1)..(507): unsure at all n locations
  Clone ID: PAT_TA_24676
ctcgtgccgaatcccgcgccggatcccgcacgagttatttcatcatgctgttagctactaggttatatgggcagaaagcctccattggagcgtctttaaatatcccccaccttgctcgccgggcatcaacatgggctaatgtcccgcaaggacctgctgatgctattctgggcatcaccgaatgcatttaagatcggacaattcaaaagaggaaaataaacctcgggtgtcggcgcgtaccgtgatggatcatggaanagccattcgtacttaanttccgtacgangcagcagaaaaatctcattgtgtcctctggcccctctaaggaatcctcaggactcacgggtctccccggggtctcccacgcatctgcccctttgccttctggcgctctttcggccgttccggtgcctacagtctcatcgctgcccatcgcgcgtacgggtgccccctcaactggggccgaatctcccgcgcgaacgggnaagccccctcangaaattgggg

SEQ ID NO: 24677 - DNA, 706 bp, Triticum aestivum
  unsure (1)..(706): unsure at all n locations
  Clone ID: PAT_TA_24677
ctcgtgccgccgaacttcccatttcangggtctctgcctccgcctccgcgtgcgccgtcggcttcgcctttctaggtttccgccgccggttatggagacaccggcgggaggttccgccgatcgccgggtaaccgggtctggcgcctccgccggtgctgcggcttctggcctcagccgctacggtctcaatttctccgcctccagccttctccaggctccgctcgccgcgctcctcgagtactcaggcgttgtcccctccgggcccgtcccgcagacggtgcagcaggcggtaccctcctcctcatcgtcgtctgaggctgacgggctactttctgccgccgctgctggggatggagaggtctcgattcggatccagggtggccccggcgaccctgacacggcgagcgcgacggctgcaggggcctcgcccgcanggactcaattgaggtggccgcctcctccaactttgaccaggcctccgtggcgcggaggggaggcggtgctgatgcggaggcaagcggcggtggcagtggcggtgctacgnnnaatggggctggggaccgcccatatcagcgttacgacgtgcaccacgttgctcggtggatcgagcagatactaccattctcgctgctgttgctcgtcgtcttcattcggcagcatcnnnnnnnnntcnttgtcacnnnnnnnattgnngctgtaangnnna

SEQ ID NO: 24678 - DNA, 630 bp, Triticum aestivum
  Clone ID: PAT_TA_24678
ctttttttttttttttttttgaaccggtaacactgcagggttcatcccttttcatataatttcacacgggatggagaatatactgatcaaaatgtgttttttttagtacgcacatgagactataagcttcagatgatggaatgttggtcacgaaaattttctaataatctatgaagaagctaataaatgaaaaacaggggaaaaacactctgaatgtactaaacaaatactgcacatcctgaaccttaatccacattcattctgaacttcaccaataccctgcaaaattgcatgagttggtttctcatcgtggcatgggagcaggacatgccggcagttctactactccatgagacagagttcaatcatctaagaggggagttggaagcaacaggaggaggaaggtcagtacatgtttggagagaaggtcacctgtggacatgaacatggcaggtggacgacgggggagatgtggtgtgctgctgtggacggaaccaagcggaggcagggattccgcctcggggcggcgtctctgtcgctgctcctagtctccaccaagcgaacatcgaggacgggtgcttgcgggggtggccgtcaggcctggttggctcgcacggggaagacggcggg

SEQ ID NO: 24679 - DNA, 675 bp, Triticum aestivum
  unsure (1)..(675): unsure at all n locations
  Clone ID: PAT_TA_24679
gcccagtcactgagagcgaaattttctggttaacaaaggagtgtctgctccgatacttgagagcatcaaagtgggatactgccaaatctgctaagcgtatccaaggaactttaacatggcgacgtgactttggtgttgaggaaattaccggcgatggtatctcgtccgaaaatgctcctgccgagctcggcccgcgcggatatgatctattcacaagaccttgtggctacatgtatgcgggtcgtcaagaattcggaagctggtccacgacaggtccaatttgttgtgtttatgctggaaaggatgatcgattttactgaggcaggtcaaagatacattgactccaatcataaaccctgagaacaaaagcaactgcaattcccagtcctggccaagccaaggggatcttggntattatccaaaacccattaccctgagcgtttggggaaaggcatttttaggctcntcntggatggnagatggcttcttcaggcttctaacaccatttattgatccccanacccgtgaaaagttantgtttaatggngatgcaaaagaaatantgccaagttgagcaactttgtanggnttttcaaggaggnctagaattcnagtatgancaaaaaatctactgggctgcacttctcaaactcctgcgcanaaaaaaaaaaattt

SEQ ID NO: 24680 - DNA, 832 bp, Triticum aestivum
  Clone ID: PAT_TA_24680
atggaacattttcactttttcaatcaacctgcccgctacacatctgtaatgttacaagaatttttttgaggtgcaatccttttaattaatgcctgaacaactgaatccagtaagaatgagagagcctaccattaccaaccaatcaatcaataataaaccaaaggaaaaggaagaagaagaaaacacaggtgtacaacacgacgccccacaaaattgaggacaggattccacttggcacatttcttagacatcgtacttcttgggctggtgccattgcgctaggcttatggacaggtaaccgagcagcgactttccagcagggtatgtcttcttgccatacagatgcttcccgccgagatcggtgtactttgaactattctccctttcaatcttgcttattttcccatctctcaagtagtacctgataccagaccaattgattgattgggagaagtgagaccggatggcagatatcgggtagaggaaattatctactaacacagcgacgaacacaagcccccagttatatgaacgaagggagtcttgtggaccttctggagacaacatgttgcagagttggatctcaactctcgtcaaattccacattgaaacaagttcagtgagagtgcatattaacaagaagctcactagttcagaccacaagatgagccagctgcttcctttacaattgcgctgtatggtgctctaagagtagtcgcaatatgtaccaaagccataacatagggacaaacaaatccccatgacaaatagaaatgcacaccaaatagtgcacggttcattatccagttgacctttgatacatatgattcaa

SEQ ID NO: 24681 - DNA, 487 bp, Triticum aestivum
  unsure (1)..(487): unsure at all n locations
  Clone ID: PAT_TA_24681
gattgattaaccatctttcacaatgaaaatatcttcgatcatgcgagcaggtggagacgtggaggttgggaaacatggaaaatacattggtaattggggaaattttggtcttcagaaacaaaagggggtagcctcatacgcccttagtgctaatagacagcggccctttgctggtgctctccatgcagcaatttttaacacctggtgacggtttagtgggcaagttctatacgttgcgcctcctctaattgcagcatattgtactatgcaatgggctatcgagagaaacgaatatctaaattccaaggaagggcgtaaagagtttgctcaaaaagagtgtagggagggtcaatctttattcaacttatttgtgcctcacgagaacctagaaatctacttgtcgggggtcagcctaaatctttagtttatatgaaaaaccttctctgtgcaacagccaatcagatgcgtgcggcgcgccgagaaacan

SEQ ID NO: 24682 - DNA, 502 bp, Triticum aestivum
  unsure (1)..(502): unsure at all n locations
  Clone ID: PAT_TA_24682
gacaaactacagcctctcgacaagatgccaggtggaatatccgtccgcgatgtcaatgcgcaaaagtttattgactcctactctgcatttttgaagaggcaaggtaaacttgcaattcccggatgggttgacacagtcaaaactggtcctgctaaagaactcccacctcaatccattgattggttttatatccgagctgcatcgattgctcgtcatgtatacatgcgaaagactgttggagttggtcgccctgagaaaagtacacggctcgacccgcaatcgtggatctncgaccatcacaccatgtcgacccaacgtgggaagtgtccaacccgaaaaangttatgcaaagctttaacagaaaaatttggtgtcctgggaaacaaagattgaaagaaaaagggagggttcggtcgcataaccacaaaagtgggccagcctgtgtttttccggggccgcgcaatctgccgtcaagcgtgtggtccgaggggaagatnaatgg

SEQ ID NO: 24683 - DNA, 1860 bp, Triticum aestivum
  Clone ID: PAT_TA_24683
tttcgtgtcattttatttgatattaaatacacacgagttcccgcaaacaagtcacacacatgttgataaatacacatgagtttattcaagaagagcgaataaaccataaatacaaaggaatattgtttacatctatgattgcctcttgggcatatatatgtttctaacaacactatatgccgctgtactacaaataataataataacatgtggcgtggagcacaaaactatgctcaaggggaagaaggtcacaagacagaacaatagttccttgttctttcccaggtcgcaacaatattactacatcaatgcttcgtgctgcccctagcaaagtgtggtccgaaggtgcacataagaccgatgacggtggccgcgttaagcatgaaaaacacaaggtggtcgcctggaagaaatgaagcagtttggcgcctttgagcccatgaaaatataacacctgcaacagccggagcgacagctttgaagatggacattagtgttacagaaagtccattggccgatgctctcaggtcttgactcacagcatcattcatcaaaatattgcacaccgtgatggtagttacttggaaggaattcttcagagaagatgcacaatttactaccaactgaagattgaaccctgataatgtagtcatgaatggatagcttgcaagaagtggtaatgtcaagatcgcagttgcacggactaatgtgataggttctatagcttttgcaaccgatggataaatcaaaatctggtatattaggaggaagagacctgagagtgcaaggacactgcccacatctgtagaagtaaagcttaatccaccatatttcctgtcactaacagcccaaagagagaatacctctgcataagccacatcctgaagagagaaaaggcaatatacggtgatagcggacatcaatggccagtttgtgaacaaactccaatatccaccactactttcttcagcattagagccggaaagagattcttccatggcttcaatcgaattatttgaatatgtcgcttcattgtgtttatgtaaagtttccggaagccagatgcaagaaattaaagcagcaacggcgaggattgatatacacaggcatgggagaaaatatggaaacctcccgaatatagattcctgagagaacatgcctgggtatttatctgctggctgtgcaagataaccaccaatggctggaccaacaatgaggcctatggcacgtgaggaagaaataagtgataatgccaggtgactgtgttctttccggcatacttctgtagcataagccttaattggccccaacataccagacaacaacccaagcaaacctcttgtggttaatgccatccaataactagagctgagtccaaatagtgtattcaaggtaattactgcaataagggtaactacgagaacaggtttcctcccatgcttatcggccacaattccccataatgtagaggtgagtgctctaccaagcatatatgaagcgccaacaaaaccagcataaaatccaatatcttctacttgcttagcaatgtgcaggtcccttatcataaaatacaagaagggaaacaaggattgaatcggcaaggtggagcagacggtgacgagccacatgcaggcgaactctgtgtagggcacgcccctccgcgtctcgttcctcttctccagcctgcacccggggcagttgccgtggtagtacgtccgcttcagcagcggcacctccagcccgtcgccgccgccgccatctttgcccatctccctcggcgggcagaggaagcggccggggcggtgcaatgccgcacaggacagagatggccttttgcctcggcccgctttcctcgctgcc

SEQ ID NO: 24684 - DNA, 1215 bp, Triticum aestivum
  unsure (1)..(1215): unsure at all n locations
  Clone ID: PAT_TA_24684
tcaaatttgatcgagccatggagctaagcgcagccaccctcctggtcctatccttcgtctcactgatgattctcgtgtctttgcttagccgcaaaaccacagcaagttccaaggggaggaagcctcccggcccacggtgcctccccttcatcggaagcctcctccacctcctgacagcgacgccccagatcgctctccgggacctggccaagaaacacggcccagtgatgtacctgcggttgggccaggtggacgccgtggtgatctcctcgccggcagccgcacaggtggtgctccgggatagctccctcaccttcgcgtcaaggccgaacccgcgccccgcgcggctcgtgggctacgggagcgtcgacatagccttcgcgccatacggcgcgtactgggaggaccctgcgcaagctctgcatggtggagctcctgagcgcgcgaaaggtgaggcagtttgcgcccatcaggaacagcgtgagcatgtccctcgttagggatgtccgcgccgccgccggcgagnccggcaatctcgggaagctgctcatgtcgtgcacgaacacgattactgcaaaggcgacgttcggcgacgagttcgacgccgagctccaagagcggttcctggctgggatggatgtgctgctcaagatagttggggcattctccttcggggacctcttcccttcgctgtggggtcctggancgtcngtcactgggctgaggcgctcggtctggcgggcgcgccgcccggccgacgccatccccgtcctgttctccgccggctgcgcgccgcgacgcgcggaggccgagccggccacggccggagacgatgaccttctgggcgtcatgcttaggattaaggatgaggcgcagcatgagttccccatcggtatcacaaacatcaaggcaattatagtggacttgttcacggcaggcacggagacgacgtcgtcactccttgagtggatcatgtcagagctcataaggaacccagaggtgatggcaaaggttcaggaggaggtgcgacaaacattgtacaacaagaatcctggagaccatgaagtccacatggacaagctgcgctacatgaagatggtgatcaaggagggattgaggttgtaccctgccgtaccgctcttgcttccccgtgtctgcagcaagacttgctatgatagtggttttgagatcacaaaggtcttcaaggacatgttt

SEQ ID NO: 24685 - DNA, 488 bp, Triticum aestivum
  unsure (1)..(488): unsure at all n locations
  Clone ID: PAT_TA_24685
ctcgtgccgaattcggcacgagagacagtcccgcgaggtcgagctgatcaaccaagaatctatagctaggtagcgcgtccaggtctcggcagaggcaggcgatggagaggaagccgaagaagcacgcgaggaccaggagcggcgcgctggcgtccttcctcaggtccacggcggcctccttctcctcctccacggccaccaccttcggctcccgccccgccggcggcggcaaggcgtccttcaatcaccgcaacgccttctccggccccatggtctccatcgtgccgcccgaggcgcgcggcggcggccggcacgaggcggggcggtagtaaacaagggggcggcaacgggtaccggacgcccgaggcctcgtcccccaaggtgtcgtgcatcgggcagattaagcggggcaaagtcaatgaccaacaaaggcaggaaaggcgggaaaaaaactcccccccgcngacggccggggggnatggaccggg

SEQ ID NO: 24686 - DNA, 805 bp, Triticum aestivum
  Clone ID: PAT_TA_24686
gaacaaattccgccaacaaaaccccttcctgcacgttccacttatgctacgagggcgtcagttctgaagccaaaggtagaacagggtatggtaaaagcagctcacatggttggtacaaactacaggctagcacctgcacagaaagagaagttgaatcaaaaggtcaatccccaagagccaactaagaaggaaccagttaaaataatcatcggttcagataatgacagtaaatggtgcactacccgtgcgattctcaacatggaaccagctgacctgatgaaggaagtcggcagcgagtctggcccaccgcttgtgtggggtgcgaggaagaggaggacgagaagcgagacactgcccattgatgccgccaccttgctgccaggagaaggagagaagaggatgcggggacctggaccagatgcacaggaggacgaggctgttcaagcggttgaagccgctccagcaaagcgggctcaccggttcaaccccaagtacgatgcgaccctgtggatcacctgctgaggcggtctgagaagccacatcggcgccgggcacactgacaaaacaatggttgttcgactttggcaacatcaatgcacatagtatcgtttcacctatgacccccacaactcaaacacagtatcgtttcaactcacacatgtacatcatagatgtgagtttcatttcaactgttgtttacacatgaggaactgacagcagaattgcaaatgaggcactacagctagcacttgcaatatagtaccccggtgaaaaaaaaaaaaaaaaaaaaaaaaaaaaaaaaaaa

SEQ ID NO: 24687 - DNA, 817 bp, Triticum aestivum
  Clone ID: PAT_TA_24687
caggggcagagagcgaccgacgggacgccaccaccacagccgagccggcggcgggggcagcttggtgggcgtcacgccacgcccgcgatgggggcgggaggatcctggcgctgggccgtgggcgcggtctgcggcgggctggtctactaccactgcgcggtgcggcgggcgagcgcggtgtccctcgccgccggcgtgctcctcgtcctcctctgctccctctccatcctcggcctcctcttccgccacctgcacatctcggtgcctgtggatcctcttgagtggcacgatttctcaagagatggcaaatagtatagttgcgtccttggctaacacaattggagctgcggagtctgtattgagggtggctgcaactggacatgacaagaaactcttgttcaaggtggttcttactctgtatttcctagcagctttgggaagggttgtcatcatggcgctgctattgcatatgctgctctgtgcatcttctccctcttacatgttcgtgcaaagcaccgaccagtttgatcagctcccttgggttcctttaggaagagactcgctgggcggcgcccaggataccacatgatttcttcatgtacatgtcttgccgctgccgatccttttgtttcttcagtgctcgatttaactgcatatggccatgggaggccaatagcttggaaccgtccccagtggttgttttgaagatgaacactggctgcgccacgtgtgcaaccatgtgcgttcccttttttcaaaggggagatgaatgtgacattaataaaaaagaagagggcattccacacaaaagtgacca

SEQ ID NO: 24688 - DNA, 779 bp, Triticum aestivum
  unsure (1)..(779): unsure at all n locations
  Clone ID: PAT_TA_24688
ctcgtgccgaattcggcacgagctcgtgccgaattcggcacgagatcagctatgtcgggaaacacggncgccaccgggtcgaccctgccatccaacctctgccgccacttcattttcgccgagcttcagaccgccaccaagaatttcgaccaggccttcctgctcggcaaaggtgggttcgggaacgtgtacctcggggagatcgacagcggcaccaaggtggcgatcaagcgtgtgcaacccgatgtcggagcagggcgtccatgagttccagacggagatcgagatgctgtccaagctccggcaccgccacctcgtgtccctcatcggctactgcgaggacaagagcgagatgatcctgggcgtacgactacatggcccacggcacgctccgggaagcacctctacaacaccaagtaaccccgccgctgtcggtgggaagcaaacggccgccgagcggcggccccgccgcccccggcctctccctcctgctcaccggcgtgaagcacaccatcatccaccgcgactcangacacaaacatctgctggacgacaagtgggtcncaaagtctccgacttcnggctgtcaanacgggcccaacatggacgccaccactnaacacgtcgtcaagggaanttcggtactcaaccggagtanttcgccggaanagtctcgganaatccgagtcnatccttcgggtctgcctccagngtctcgcggccncgcnanccaagcngcaagngaattacctgcnacggcctcctcaaacagntgtcgc

SEQ ID NO: 24689 - DNA, 482 bp, Triticum aestivum
  unsure (1)..(482): unsure at all n locations
  Clone ID: PAT_TA_24689
gagatagtgttattttagtatttgataggntacacattataatttgtcttcaaacaaccagcagagagcaacttagttaaattgtcccattacgaggacaaaaaaggaaccttccnaagttcttcctaccttttgtattgcctgcatttatagcacanacttaacttttgcaatcaagatttgagtttccaattaatatgatgtgttgcagattttgtagagtgaagggtgaatttgcctcctattaccttccaaaccgtttgctttgcatggtacacagtcgctatatggncggnatccnatgagaaaataaaaaaaagggcagcccggngcatgtagctcccgcntgcccanggtccgggaagggnccgancactttgggtctatagnacncancccttccctaaaatttcngtaaaanggtgtttccaggactttgaacccntngcctcaagggncacanagggancaaactttnacaa

SEQ ID NO: 24690 - DNA, 775 bp, Triticum aestivum
  Clone ID: PAT_TA_24690
gattcggacgagacaccctctttcttctccctcgtcttcctctccttttcctcatctcctcttaatatctttcctcgtctcctccccttggcgaggaacaacagcagcaacagcgtacaggaggaggagaagcaaggaagcagcggcagcagcagctctggccgccgttgcgacgggaggagcacgaaaaacggcagccccgactgccgttgcaagcttcggccatgacgcggtggcgcggcgcggtgcagcagcttggatgcgtcgttagctccccgccgacgtcgacggcctgcaaacttctggtccaggtgtagaggttggtcctcgagctgcgtggtaaggtagtgctcgccaacgcggtcagtgcggcactacggcgaccagcacgggtgcatggcggggcgcacgagatgggagcgccggcgactggatttgaccacgattggatctgggacgggtcgggcggcgcaacttttttttgtttttattcactccttttatcgagtggtgctctcggcaaaccatcggtgccacgtggatacggtgcagtttacgcgtttcgtctgatcacctttgtttgccgagtgacagtgtttggctctcggtaaagtctttgccgagtgtccgataaatggctcttggcaaaaatctgtttgccagagagatgtatgccgggtagtctttgctgagaacaattctcggcaaaggatttgctgagtgtatttgaccctttgctgagttttctcgcactcggtaaacaagtggattcgtt

SEQ ID NO: 24691 - DNA, 888 bp, Triticum aestivum
  Clone ID: PAT_TA_24691
gcacgaggcccacacacccacccaccagcagcaatccatccatccctcgcagctccggcggcgatgccggcgggccagcagccaccggcgcgcgagcccgacggcggcgactccaaccaccacccccacccgccgccccccacgcccgcgctcccgtccgaggtggtgccggcctacccgccgccggagtcggaggacgacgagtcctgggtgtggacgcagatcaaggcggaggcccggcgcgacgccgacgccgagccggcgctcgcctccttcctctacgccacggtgctctcccacccctccctgccccgctccctctccttccacctcgccaacaagctctgctcctccaccctcctctccacgctcctctacgacctcttcctcgcctccctcaccgcgcacccctccctccgcgccgccgtcgtcgccgacctcctcgccgcgcgcgcccgcgaccccgcctgcgtcggcttctcccactgcctcctcaactacaagggcttcctcgccatccaggcgcaccgcgtcgcgcacgtgctctgggcgcagaaccgccgccccctcgcgctcgccctccagtcccgcgtcgccgacgtcttcgccgtcgacatccaccccgccgccgtcgtcggcaaggccatcctcctcgaccacgccaccggcgtcgtcatcggggagaccgccgtcgtcggcgacaacgtctccatcctccaccacgtcaccctgggcgggaccggcaaggcggtcggcgaccgccaccccaagattggggacggggtgctcataggcgccggcgccaccatcctcggcaacgtcatgattggagcccgggccaaacgtaggggctggcttcgcggtgctgataaaagggccggcgaggga

SEQ ID NO: 24692 - DNA, 556 bp, Triticum aestivum
  unsure (1)..(556): unsure at all n locations
  Clone ID: PAT_TA_24692
ctcgtgcccgaattcggcacgagggtcggataagacagtaactaggcttagctaagcaatttcaacaatggagggggcgggagcagcactactgtgcacccaggtgggctcgccgctggcgtcgttcccggcgatgctgttcacggtggcggccatggcggccggcgcgttcgccgtgtacttctacgcgccgtcgtggcgcctgcgcagggtcccgggccccctcgcctacggccctcggtcgggccacctgccgnctgcctgggacaaagcatggctcgcaaggccttcggcgtcctcgcnaaaggaaaatacggggccctctccagcttgggcttgggccggcggcccctgggcgtgcccgcccggccccgtggctccgccctggccccgccgggcttctngcaaggggcgggcacgcctccctcggcaaggtgcggtgccgcgtctccttccggccagcggagcccttgccagcgtcaaccaggccgcctccgcctccgccccggccctantancaanagaagccctccctctttcaaccaaagggggctct

SEQ ID NO: 24693 - DNA, 947 bp, Triticum aestivum
  Clone ID: PAT_TA_24693
tagctggactgacatgagccccccccggccgccgcctcctcctcctcccggctccggccccggcaacggctccctcctcctcctctgctcctccggccacaaccaggagagcactgctcttgtccacctcagccctcacgctcgccgccgtcgttcctgcagtggcccaggcagccgccaaccccttctccacgccctactcccagtcccggacgctgcagctcggcctcgacaccaacgggaagattcggacatgcccctccaccaatcccgggtgcgtctgcacgaatcccaccgccgccccccccccccccgcccccccccccccctcctccccggcgccccccccccccgccccgccccttcacatgttgcggcaagccatcctcaagacgcagaagaatgtcagcttcaacgttgatcagcgaactccccacggcacgcactccgatttaaattagttgcaactttcttgaccggtcagctagctggaaccaaattacatagtactgaattccattacagacgacttagctcaagaatgaagatgcgattctgaatgcatctccgagaatgtacatatgtgtgtgtatatgcaggccagtacatccaggccgaggtggacggcggcttcggccgggacgtgatggagttcctcgtcagggctgtcgcgcaggatgtggcctaccgctgccccgccacaagatccaccttcgtctaccccttcaccaccgccatcggtgactcgcggggccaggaactgtgagtcgccgccgtcgcgcaaacggtcggctggtacgcgcctggtatatgtatgtagatcgatcgcgttgctacataattaagctatgttcagcgcatttgtcgtccaatatttcccgcgcgaagtgtactcatgcatgtgtttggtatatgtatgtagatcgatcgatcatggttttgaaaaa

SEQ ID NO: 24694 - DNA, 1913 bp, Triticum aestivum
  Clone ID: PAT_TA_24694
gccggccctgggcttttcgcggaccgagtggtgcaaatgagtcggttgcccgtatcaacgcaaaaccgtcctactcaccattccccgatggggcttgccgcacgtcgcgcaagttcgcttgcgcagctgccacagtgctcagcagagagtagagtccccctgctgttgagctcgcggccgaggggtgccgggtggaccatcccgtgcagtccgaggcgtgggtggccgcgctcttcctcaccgcgcgggagcgctggcccggggacgggtacccgccgtcgctccgccgccggagcggggccctctatttggcccacttcctgggggacaacgtggtttgggcctgagactgccttgacgcaaggaaactaaccccgttggagccgttgctgcctggcacttagctagataggttccaatctgtttatccccgccctgctgttgactatttgctttcccagttcaaggatctgggtttcccttccctgctcgcagacatggacgctacttacgtcctgctccctgtcgatcagcgagctgttgattcgaattctgcgtttgaggggaggactagaaatgtgatggtgcttttggtgctcagcaccttaaaatggaggatgcaagctgttactgcttgctcatttattgactacttcctgcgcaaattcaatgatcatgacgcaccctccatgctcgcattctcccgctcgaccgacctcatcctgagcactgctaaaggagctgattttttggtgttcagaccttcagagattgctgcaagtgttgcacttgccgcatttggggagcgcaatacttcagtagtcgagcgggctacaactacctgcaagtacataaacaaggagcgagtgttaagatgctacgaactgattcaagacaagatagcaatgggaaccattgtcctaaagtcagctggatcatcaatgttctctgtgccgcaaagcccgataggcgtgttggatgctgctgcatgtctcagccaacagagtgatgatactgctgttggatctccagcaacatgctaccaagcctcttcggcaagcaaaaggaggagaattggcagatgaccggtctcatgtcgtgctgtgcttcaggtgtgttgctcaccgttttggccgttttgttgtttcaaacatctcaattcagtttggtcactcgagaactatagtgtggtcaagtagttgctggaaggaacaaaaacaccatagtcaatacttgacccataaaaacaaacagttcgccgcgagcctgttcatgcaatcgacatatgtaaggggcatgctaagctgttagtgtcctgagatgcatgctagtgtaggcagagatggagcaaggaatttgcatgttgtagaagatgagagctctattgccctgttttgtatttcggttccatattcagtttccaatgaactttgggcaagggctgctctgatcattgaggcgggtaataaaaataatccaaaaagggatcggctgagatacagaacagtttatatttgttctgatgagttataaattttgtcgacattaaaaaactcgtccctctcgattctccgttgagcgacgtcgcaacttgttctccaactctgcggatgtagagagagagagagcatcgtgactgccatggcttgaactattttgttgagatcctggaaaaattgaatggtataattctgttaattgggaaccttggaattgattttcacctgaaaaggttgatcgagggtcggataatggacgtaaccagctgctagagaagatattataatatggaaaatagcatttgaggaggaagctgaagttggtagatcaattgagcatgagttccagacccaggttacaccatgaacaagtgcctcaaatattcattatccagcagcggaaggatcactccc

SEQ ID NO: 24695 - DNA, 612 bp, Triticum aestivum
  Clone ID: PAT_TA_24695
ctcgtgccgacttcggcccgtgtctagatacggtaaaatttcacaatgggtcgtctcacggaataccaggttattggccgacacttgcctacagaaacagccccaactccaaaattatatcggatgagaatattcgctccaaactctgtagtggctaagtctcggttttggtacttcttgaagaagcttcgcaaagtaaagaaagcaaacggtgagatagtcagcctgaacgtgatcaacgaaaaacgtcctctcaaagtcaaaaatttcggtatttggatccgctatgactctcgctctggtacccacaacatgtacaaagaataccgtgagatgtcccgaactgatgcagttgaggctttgtatcaagatatggctgcgaggcatcgatctcgcttcaggtcaattcatatcctaaaagttgtcgagattgagaagacagatgatgttaagcgaccctacatcaaacaactacttactaaagatctcaaattcccccttccccaccgaattgccaagtcaagctagctccaagatatttgccaacaagcgaccatcaactttctattagggctgggcaaggaatgttatgttgtttgggacttccgggta

SEQ ID NO: 24696 - DNA, 449 bp, Triticum aestivum
  unsure (1)..(449): unsure at all n locations
  Clone ID: PAT_TA_24696
ctcgtgccgaattcggcacgagaaattaaataactgaaggttaaccgattacaaaatcaatactcaagatgggaggagtagatagggccggcggcaaggccaagccactgaaagctccaaagaaggcagccaaagcaagaattagacgacgaagataaagcgtttctacagaagcagaaagacgatgcaaaagcaaaagcggacatggctgcagtcgctaagaaatcgaaaggccctctaaataccggcgcacagggtataaagaangagcgcaaaaaaatagagttgctccacacatataggtctgtcaacatgtagaggaaattttatatgatgtggcgttgagggacgacaagctaatttatgtatttcaagtcataaattggagtttagggggatcagtaatcatggggaaagaagtggtttaactacgctcactttttttcctt

SEQ ID NO: 24697 - DNA, 766 bp, Triticum aestivum
  Clone ID: PAT_TA_24697
ttttgcttatgccgccctttttttttttttttgacacaactccaagctttgacttatttcccaatttcaacccaactgaacacattacattttacattcccctagcttttgaccgactgtttggttcccagagtatgcacaccaaagaatttgtagcagtatcagacattttgatgatgacggacgcagaagaagaagaagaagaagaagaagacgaaaaagaggaaaaaactttggacacctctctctgacatgatgatgaactaggacttggcggcagtatgatgagctaatcaggacatggatgatgatccgattcaatcatcgtctcgccgagcaattcttggcgcgcgagatggcatatgtttgcattttgattctctggtccggattgcggtgttggtggtgatccgggctagagcatccagtcgagccggttggtgggcggcgggggcgcgccggcggaggacgcggtggagctgtcggtggtggtggaggaggaggaggacgtggtcggcagcgacgacagcaggtcgaacatctcccaccgcgtcgtctgcgccgggggctgcggaggctgctgctggcgttggcgctgcgactgcggctgcggctgccgctcctgccgctgcctcgccggcgttggctgtggcgccgcctgctgcggctgcttcttcgcgctggcgggcttgcgcgcgatggcggcgttcttggccatgaccgcgtcgagcgtctccacgtacttctgcacccgcttcacctgcac

SEQ ID NO: 24698 - DNA, 568 bp, Triticum aestivum
  unsure (1)..(568): unsure at all n locations
  Clone ID: PAT_TA_24698
atcggctctccatcaattttcatcaaaacacacaccaacccgcatcaaatcaacaccaaatggctcgaaccaagcaaaccgcgcgcaagtccactggtggaaaagcaccccgaaaacagttggcttctaaggctgctcgtaaaagcgcaccctctaccggaggtgtaaagaagcctcacagatacaagcccggtactgttgccctccgagaaatccgtcggtaccaaaaagtccaccgaactcttgatccgaaaacttccattccaacgtcttggtcgtgaaattgcgcaagatttcaaatcccgacctacgatttcagtcggtctgcaaatcgggtgcgtttacaagggaatcggttgggggcgccctcccccccccccccctcctcccggacgtatgcgctaccctcgcgcgccgcgccctccgctcaagccggcggtttctctgcctggcgcgtcgccttctcgggggtgcgcccggtaggcctttcgggggggttaccgtcaaaatttcttgcaaagaaagcaaanttttaaagctccgggacatgggaataagttggngggng

SEQ ID NO: 24699 - DNA, 873 bp, Triticum aestivum
  Clone ID: PAT_TA_24699
tagcgtcgtcgcggccgaggtatgtcgcgagatttcttgactcagctcagtggagtctaccggcatatgtgctagtgaccagctagttattggtgtctgtagagagtgcttcccaaactggtcgggtggtttggaagatcctcgtgttcatctgcatgttggcgattctgtttcgttccttagaaatgatcctgaaggaacctttcatgggatcattgttgattgctcaggccctatagggcctgctcccgaacttggcgagaggcctttttctgagtcaaatgctagagctttgaggcctggctcctggctttgttaaaacgctgtgagtaagtgggtacatgctcatctgattcaggacatgctctggatctgcagtacgaatttgaagagttctgtcctctttgcttgggcatgtgtccaaacatatcctagtggtgcaattgggtttttgctaggtgcccaaaaagggtagaccagtcaagtacctggcacccattaaatccaattgaaaaaataaaaggcgctatgacagcagggagggacatcagattttataatactgagatgcatagggcagcgtttgttcttccaacctttgcaaaggaagacaaataagcatatagttgctcccactataggggcacaacaagaggaaaaatcagcagaaccagcgaaggttgccgtcgcgccacacagtgaaattcttaccgcttagacgagggctccgggacttgttcaacagtccgtgtgctggacatcaagtacttactggtatattagcaacataatttgtgtgggatatggcccctcccttcgggcgtttgacatgatggtatgacaagatttgttggattgaaaaaaaaaaaaaaa

SEQ ID NO: 24700 - DNA, 579 bp, Triticum aestivum
  unsure (1)..(579): unsure at all n locations
  Clone ID: PAT_TA_24700
tcggcacgaggtctcaccgtgcacgccggncgctgccagccatggacaccttcttcctctcgcacggntcgccggcgatctgcatcgacgagaggatcccggcgcacggcttcttcaagtcgtggctgccagcggcggtggcgggcgcgcaggcgccgcgcgccgtcctggtggtgtccgcgcactgggagaccgacgctccggccgtcaacgtcgtccgcgggaccaacgacaccgtccacgacctgccgggcctccccgacgagttgtacaagctgaggtacccggcgccgggcgcgccgggcctggccaggaggaccaaggagctcctggagggcgccgggttcgggccggtgagcgaggagcacggccgcgggctcgaccaccgcgcctgggtgccgctgatgctcatgttcccggaggccgacgtcccgggcgtgccagctctccctgcaggccgggcgcgacggggcctaccactnaccccctcggtccgggcgctggcgcccctcaaggggacgaagggctcccgccctccgctcccgcccggcangnaaaaactcaaagaggttgggcctc

SEQ ID NO: 24701 - DNA, 505 bp, Triticum aestivum
  unsure (1)..(505): unsure at all n locations
  Clone ID: PAT_TA_24701
ctcgtgccgaattcggcacgagcccctactccccccgtggtatcattcttacctcgcccgccgacggtacaagcgctcgcatttatcgttcattgaaatcattagaccctctgatcaaagcattcgttacacatcttaataaaaattgacttatatcaacactgctttagtaaaagtcatgttagaccgaccacaaaatattggaattaaggccattgaaatctattttcctaagtcaatgtgttgaacagtcagaactagaaatatttgatggtgttagccaaggaaaatatactatcggtctcggtcagaccaaaatgagcttttgtgacgacccgagaagatatttattcctttgcgctgaccgcatgctccaacctcttggagttagtacaacataaacacacattccattgggtccgtttggaggggtggtacaagagacgccccctggggtaagtcanaatcantcaaagtccggnacctatggcaacctattttgggg

SEQ ID NO: 24702 - DNA, 1636 bp, Triticum aestivum
  unsure (1)..(1636): unsure at all n locations
  Clone ID: PAT_TA_24702
ccggccgcggcggcgagtggccaggcccgtagcaccgcgtcccagcatcgggggccgcctgcggtcttcggagggaaatgggcgctcggcccgctgatcgcatccgctcgcccgtcattgcggcgccggggtcgcggcggggctcgcgggcgctctgctccgttggggacgtggtttcatcatgggaccactgtttttggagctcggcatccctccccaggtttcaagtgctacagccacgtttgcgatgatgttttctgcttctatgtccgtcgtggaatactacctcctgaaccggtctccggcccctcacgccgcttcctgccttggctaatgctcgggattagcatcggtgttattttcaatgttatattccctgactggctggtcacagttctcttgataatccttttcctaggcacatcaactaaagctttcctgaagggtgttgagacatggaaaaaggagacaataatcaaaagggaagctgagaaacgattggagcaaaccagcgaggaaccagagtatgcaccactctctacaggaccaggtgccgcagctgatgtaaaaccccattcagatgaagcgccatcacttatgaagaacatttactggaaggagtttggtcttctcacattcgtgtggctagcattccttgctattcagataacaaagaattatgctcctacttgctccacgtggtactgggtcttgaactttctccagatcccggtctctgtaggagtgactatgtacgaagcactgggtctgatgaacgggaagagggtgctatcatcaaagggaaatgagcaaactaccctgaaatttcatcagctctgcatatactgcttcttcggtgtcactgcagggctcgttggcggtctgctaggtttgggaggtggtttcatcatgggaccactgtttttggagctcggcatccctccccaggtttcaagtgctaccgccacgtttgcgatgatgttctctgcttctatgtccgtcgtggaatactacctcttgaaccggtttccagttccttatgctgcttactttgttgctgtggcgttcgttgctgccattatcgggcaacatgtagtcaggaggttgatcagttggttagggcgggcatcactcatcatcttcatactggctttcatgatcttcatcagcgcaatttctctcggtggggtcggtatctcgaacatgattcacaagatggagcaacatgagtacatggggtttgagaacctctgcaagtatgatgcatagtatgcaagcaggcttaatgttcatgtgcagtcattcgagcaaggaaccggaattaaattggagattcgattcataggtggttcaggtttcaaatctttagccatgtaaccagaatgtaatctagcgcgcaaaaaactggaggtcaccgcttggggttagaactggagtaaatgttgggagcgcactttttttctggaactgatttctgaattttcagtttaaagccaattcaccgtgcctatctcattgtaccaatcttgtactagatttagtgaacttgttcttatgccctgcagaaatatcaccctagatgtgtattttgttgtcaaaaaaaaaaaaaaaagggactagtntagtcgcgacgccg

SEQ ID NO: 24703 - DNA, 496 bp, Triticum aestivum
  unsure (1)..(496): unsure at all n locations
  Clone ID: PAT_TA_24703
gagagaactaaaaacaatatcaaaccccgcgcccgtcgcggctcgagcacagatgatgcaaccgatctgattcctgaatggctgagctttgtcaaaggtgtcgttgactctgaggacttacctctaaatctttctcgcgaaactctccaacagaacaagatcatgaaggtcatcaagaaaaatattgtcaagaaggtactccaactattccaagagatatccgaagataaagaacagtttgacaagttttactcagcatttaagcaagaatatcaaactcggtattcacgaagattctcaaaacagggntgctctagctaaactcctgcgatttaactcaactaaatctgctgacgaccaaacttctctaactgactacatcacccgcatgccaagagcaccaagaagaatgtggttctacatcactggggggggctctctggaggggtcggcaaaatcctcccgttncctaagacctcaactggnngggaggaag

SEQ ID NO: 24704 - DNA, 280 bp, Triticum aestivum
  Clone ID: PAT_TA_24704
tggaacgatgaactaatcatatttacaaaaacaagagaggtcgagttcatatcagcttttctcatctcagccagtccatcatatatcgttaaaattgcctttcacttgcatgaccgaacgatgcggataataataatagtgcacatgcattggactaagctggaatctgtaagcattcaataaacaggagaagacaaggcaatatgggttctttttgggttttctcctatcgacccctaaaaaaaaaaaaaaaaaaggacaaaaaaaaaaaagcggccgc

SEQ ID NO: 24705 - DNA, 291 bp, Triticum aestivum
  Clone ID: PAT_TA_24705
tgtcgtgatcctggagcagtacttttacatatagttgcacctgtaatgtctgctgattaaactgccgccagtgttatgcatactctagcgatttgtggaacgcttctgtacaacctggagacgttttaagctgaactagttcatcgcacatttctacttggacgagacattgcaagctgtagttttactagatgacccgttgcgccaatggcgcaaaggccgaatgtaagccaggtattgtaagagtgtgcattaacatattgttgttcgaaaagcataactcatgatact

SEQ ID NO: 24706 - DNA, 1262 bp, Triticum aestivum
  Clone ID: PAT_TA_24706
gaggcgaggaagcgggcgagaggggacaggagggcgtggcggggagagcaggcaaggggaggcgaggaggggaggcgaggggaggcaagggtgaggggcggcggcggcgggatgatggacgacggcggggttgagcacgcgcagatcccgaacagcttcggccacgagctccgcgcatgcctccgctgccgcctcgtcaagacctacgaccagttcagggagaatggctgcgagaattgccccttcctggacatggacaaagatcgcgacaacgtggtcagctgcaccaccgccaacttcactggaataatatcgctgatggatcccaataggagttgggctgctcgttggttgagaattgggaggttcattccagggtgctatactctggctgtctcagaggaacttccagaggagtatcaggggatgtgccaagacaacaacgtgcagtatttccctccgaagcgcccctgagcaggcttgaagttgatgcagtcgtgatcctggggccgtgcttttacatatagttgcacctgtaatgtctgctgattaaactgccgcccgtgttatgcatcctcaagcgattcgtcgaacgcttttgtacaacctggagacattgtaagctgaactagttcatcgcacatttctacttcgacgagacattgcaagctgtgctagttcagttttatgcaatacaatcgccctgctatgttatattatcttgcgatatgtttgggaaatatatgggtttcaaaccattcaatgttgcctccgagtgtagaccaggtggaaggcttgaagcatcactggattatgttcagagggagtttagacatgtcaagcatgatggttcaaatggtggctgggtgatggatggtctgattgctagacccttgcctgtaagaatacgtgttggcgatgttccttgataggaatcctcgactcattttgcccacagctgcgcttattagaattgtacagcctcttattctttgataaactccgggacccggggtatctcaaagccgattggttcttccattgtatggggcaagttcatgaactagcagtcgtcagtctgagtggccaaaataagctgcaaagttcattatctggttgttatcataaggctgtagctggtatatctttggtcttatttcttccgagatttttgttctccttttgttatttgttgacttttgaagcttgtagtggctggtcagaaaaataagaacacttctctggcaattataaaaaaaaaa

SEQ ID NO: 24707 - DNA, 510 bp, Triticum aestivum
  unsure (1)..(510): unsure at all n locations
  Clone ID: PAT_TA_24707
cngagtgacgaaggaagtcggatgagntngttggaaaggcattgaaccgtttccaagtgggaganatccaatnacacttgaccttagtgcgcacaancctcgcgaattagccagtgaacaaaataatggtaggcaaagcatcntgataaatttctctcgactcgtgccggattcggctccagcgacctgcttcctggtggttcgacgtacttgggaggcgttggacggataattggcgcaaaaatatttagacctaacctttatggaagaacttatgaagttcatgaatttgctgggctcacatctatgatgttataacacaaaattcctaaaatgttaggtctggcaggggcgcctttaactaaacaactattcgagggcagcagccactgttggtccaatttggacctgtgccacggtaatatttgtggtgccgaccatcacttcagtcgtcattagaccacctgggtagtatgtagattatttttccacaccaaaaaaaaacaagac

SEQ ID NO: 24708 - DNA, 528 bp, Triticum aestivum
  Clone ID: PAT_TA_24708
ggagaagcccagagctgggcaacccttgtactcagctctagatgatctgttctcaaaaatggtttgctagttctagccgcggtactttcagcattcagtggtgtacatatatatgtctaaaatatgctaggaacagtccttgggagaaaatatcccagaaaaaaatgtacagcttttattgggtgtgttcactgcaagtatgtgtccacgcatgtaaatattgtcaggatatcagtatgttatttgtactcgtggctcgatgatctgttcgtgaaaatggtttgctagttctatgccattgtagtctcaagcattcagcggtgtacatatatctaaaatatgctaggaacagtccttgggagaaaatatcccataaaaaaatgtacagcttttattgggtgggttcactgcaagtatgtgtccacgcatgtaaatattgtcaggagatcactatgttatccgtcgtcgtggcttgattattgcaagtgtgatgctgttaaaataaaaaaaaattttaaaaaggggggg

SEQ ID NO: 24709 - DNA, 639 bp, Triticum aestivum
  unsure (1)..(639): unsure at all n locations
  Clone ID: PAT_TA_24709
ctcgtgccgaattcggcacgagcccacacagaattctttatccacaatcaattatctcaattttactacgcattcatcttttacctcaccgtactaacacatttattacattaataatgggtaaaaccaagtcatctaaagctgatggcaagagcaaatcggagtcaaagtccaaagcactctcagtgaaaaacgcatccatagccaaaccttctcagactactgtcgcgaaatctaaagaaaatagcgaaggatgtcgcgtccaaggtcaacaacaagacaagcaaaaagagtaagacaacagtcacaacaaaagatactacaacatcctctaccgatagtggatagcgattccgattcaagactctaaagtcaagtctaaaaagagtaacctgaaagttaaaagtaaatcaaagaacaagggtacttctgacaagcaaggacagttcgggagtccttcctgattctgaaggataactctgattctgaggntgaggtaaaccccaaaaaagcagccttgnccagtaaaacaaaacctaatggtactgtnaaaaagaatgaagactccggatctgnttctgaatcctcaaactcaaaatccgnaccganaactaaaaaaactaaatgacaaaagatgca

SEQ ID NO: 24710 - DNA, 620 bp, Triticum aestivum
  unsure (1)..(620): unsure at all n locations
  Clone ID: PAT_TA_24710
ctcgtgccgaattcggcacgagtatcactcgaagaaggctactttacaccccctcccggctccggctcgtcctgacttcttggaagccgataaatctgaaagatcaaaattgtcaacaaatccagtcactccaccaaaatataagcaataattgcttcacaaaacaactgcaacatgaaaatcctcagtcttatttcaattgcagctgttttaaataatcttacgcctgtacatgccgctgatacgtggaattatcaatgtggtccagcagttattcatggaagttacgtacaagattgtgttaactcctaccacaaatatataatgccaagtgtgactagagattacgggcccaacgaatattttaaaacggccactttcccgggtaaatatttccataacggggcatatatgggtggtcagggttcaagcaagattttacaattcctaagggaattactaaaggttaaagcttccgggctctcgggcaagagaattgaatgtcatccaacaaaagaaggggcctggaatttgggaaccccaacataaaccccccccgggcctggnggggttgnggatgtggccaacaaaaatgggccgggggtcccccaaccgcaana

SEQ ID NO: 24711 - DNA, 448 bp, Triticum aestivum
  Clone ID: PAT_TA_24711
ctcgggaaaacatgagtaatccgggaaaagagtaaagtgcaaccaaatttttttttttttacaaaattattcgttcatcaatcatctgctatcagtatccgagcatggttgctcagctgaagaaacaattggtcatacacactagactacagttgatgttcatccacaagcgaacaataccaaaacaaaatcactatgtatttggtagcacaacacggttactgatacagaggatgagtaatagaccttgcacaatggctcccctcagatggtgtagtcggaccactgccgtatgaaggaggtgtgatccatggactctccgggcatgtcctcgtccttgtcggactcgcccttcctccctccaatcagcctggcagggttgcccaccgcggtgctcctcgccggcacatctatcagcaccacggagccagccccaatcttggccccg

SEQ ID NO: 24712 - DNA, 553 bp, Triticum aestivum
  unsure (1)..(553): unsure at all n locations
  Clone ID: PAT_TA_24712
ctcgtgccgaattcggcacgagcggcacgcgccctgcccgcgctcggcgcgtgggaacccaatcctcagaatgtctaccaattccagcgccacaccatcaaagttcattttcgcaccggctaacgagaagaacaacgcgcaagccgaacaattcgtcaagggtagtcttgaaagaacgcagcttaaagaatgtcccctgaagcaatttgcggagtggtttgcgcacgcacaaagtcatagtgtacaccatccggagacggtttgcctttcaacaagcgagccttccgtcggggtcgcgtttcaagctcgggatgggtcctaatcctgaaggaggctcgaccccagtggcttttgtaatnctacaagtaactttgggcaaccagcaaaaaagtcccaagggtttagcctttgcaacaaatgggcaaagtcctacgttctggggggccccaacttgtnggacaagtaaggagtnnagggtacggtgggnacgattaacntancgaatganaagtcaggnatattttganaacccgcnttanagggatctcgccan

SEQ ID NO: 24713 - DNA, 503 bp, Triticum aestivum
  Clone ID: PAT_TA_24713
ctcgtgccgaattcggcacgagttttttttttttcggttaaacaaagtctaagcatcatcgagaattcagagacagatggtttaccacccattcaggagaggatttctttgcatattagagcatgataaagtagtacggagtactattagatatatgcctcgccattctttccatctttccagcccaggccaggtgaactgcctggtcgccgccgaggtaccgcagataagggatactaatccctgcccaccaccggcacatcagtttcagtgccatctgatcggctgacccgtagcataaggcggagatggccggaacgcggtaatcagaaatatgagttcaatcttgcgatagccacgaagggaatgcggaaatttgcagaacgcaagctgcaatatgtcaatctacaaagttctgggtagcctccccgtgcatacactttacaaaggtctcaagctctgagaagcacctgcccgcgcggccgctcggaatgggagttccg

SEQ ID NO: 24714 - DNA, 1158 bp, Triticum aestivum
  unsure (1)..(1158): unsure at all n locations
  Clone ID: PAT_TA_24714
ctgtacgctctgaattgatctcttcaaaaatgctttcgcttcctctcgcagacaaatagaagatcaagcggttcagttgcaggaacaagtacaggaactcgaggaccaaagggtattactgatgtcttacacccatgatttggaggctgctcaactggagattcaagggaagacacaggagctcaattatgcacagtctcgttgtcatgaacttgaatcacagttacttaaggaaatggagaaggtcgagtctctagaagccgaattaacgaaagaaaaacagagcttagaacatagaactgaagaagtaggctttcttcagaaggagcttgttcagaaagaaaatgagtgcaccaaatcacaagaacttgttaaagtaaaagagtttgagctgttagaagccagacaggaagtccaagatatgaagttaaaggtagagtctattcaattggctgttcaagaaaaggattcagagctttctgatacacagagcagactaactgaagtcagcagtgaaattgttgagcttcagcagttgctaaatagcaagaaggatcaactggttcaggctagaactgaattacatgataaagaacaacatatagaaacactggagagtgagttggatagcatacggctcagatgctcgcaagctgaatccatggttcaaaggatggctgagctcactggcgatcttgctagttccgtaaaagccggagaaatgggacatctatacattactggggtgatgaaatttcaagcacaagtacaccctcgatccaatttacataagcataatcaactgggaggctgacatagagatgttaagagaatgcttgcggataangacatggagttgagactgcccatgaacacttgatgccaaagatcaagactgaaggagtactaaaaaatgggatgtgaagganaggaacactnagttggaagatancggatccagtgcacaaanaactgctggtttcagtgagacacagaggcggtantgtagaaaatgactgcaanctcaattatgtgcgagccaacattcgcacacgntgagacctcgtatacagggttctcacctnagcgatncgatacttgtctnangcaanctaagnntcaangatacaaannggttctacgaaaaatggccncnta

SEQ ID NO: 24715 - DNA, 313 bp, Triticum aestivum
  Clone ID: PAT_TA_24715
ctcctgccgtactcgccacctaccatatccatgttcaactattttcgagacaataccaagctgaccaccctcaatgtacagaaatatctacttgttgaggtgtgatggctctgagccaatagcgatgtcgaaacctggaggaataaaaacggcatcatcccatttcgaggaggagctatccttcattgatgtgatgatatcctccaaagaagaaacctgtgtgtcaccaatcctaacagcagggataggcttttgctggtcactaagatgctcggtgcagtgacttgtctaaagtcctcctttctaaaaaaaa

SEQ ID NO: 24716 - DNA, 625 bp, Triticum aestivum
  unsure (1)..(625): unsure at all n locations
  Clone ID: PAT_TA_24716
ttagcatcacaaatagtgcagaacatgagattaattttgtcatttcgactgttaattacactgttcgatattactcagtaatatcgcactgcggtttttacagttgttcagagcaagaaagccagttcagagaactcttcagagcagaaacaaaacaaattcctacctccagaacattatcangaataaaattaatcttttgtaaaacaaactccagatcgaaacttcatcgatttgtaagctttgtatagctactgggattaatctgtggtgaacaatctcaagagagctactagttcagctcctttggggaccgtcggttccggagccatgagctccctcctggcgccccaggctgccgttgcccgctcgcggcagacgcctcgcgcgccctccgcgaccgcaacagcatggcgagcatggccggcgtcgcgtacggcagcgtcgcggcttgctgcgaccccggctgcgcgcccgcccgcgcccccaccgcgccgcctcgcgacgcactcaccgccggcatgccgcacctgcgtcgcccancgggacatgagccgccggacnctatctncggtcaaccgcaccatgtcgagtcnttcagcacatatggtccgtgctncctcga

SEQ ID NO: 24717 - DNA, 463 bp, Triticum aestivum
  unsure (1)..(463): unsure at all n locations
  Clone ID: PAT_TA_24717
cgctgcgactagcatggcgcattttctagcgcggggtcagttttaaatggttacccactgcagccccgtcgttttacacaccgtcgccaactcgcccttaaacnnccccgcttgttatttcgaatttttaattccctccttgttnntccacatccacgtcctttttcggcttttgctgccgtcaagcttagcganagtcgggggccgtcccttttatgcggttgcttgatctnnacagttgcgtacggcctttccatggcnaccctggacgccgcgccctgtagcggcggcgcatttaagagcgcggnncgggtgggtggtggttaccgcgcccagcgtgacccccgctacactttgccccagcgcccttagngcgcccgctttcctttcgctttnntcttccctttccnttttctcgccacnngttcgccggctttttcccccgnntcaagctctttaaatc

SEQ ID NO: 24718 - DNA, 526 bp, Triticum aestivum
  Clone ID: PAT_TA_24718
ggtagaataggcaacagcatgagttggaattatttgtttactgctcatgtctctgatatgcactgatgcatcatcaatataataagttgttgaaatgaaagaggaccatgccccatgaaacaactgcaccaccaaggcaagcgcgcaaaggactgcacaggaggcgtgccaagggcgtgccccagccactagttatatccaacaggagcggtcggggatggccggcacgtggaggatccgcggcgtggacgaggcgcacgcggccaccgagctcctatgagcagtaggaaggagaagtggcttggtgggctaggctatgcacttgttcatagtgggcctaagtgcacagttctgcttttcttttggtttttccctcttttgtctattttcagctactgtttactttttatttctttaatagtttatagttttacaaaaagtaaacccactcctaaaatagagttgtaaatccaactgctgtcacaaaaaatttgggacaaaaataaagtaccttgtattctttgtt

SEQ ID NO: 24719 - DNA, 570 bp, Triticum aestivum
  unsure (1)..(570): unsure at all n locations
  Clone ID: PAT_TA_24719
ctcgtgccgaattcggcacgagaaaacgtgtagacatcgacaactccaaagtctcgcccccaacgccgcccccgggctacttaagtcccaaatcttacgaccatgggtatctctcgcgactctagacacaagcgttcagcctctggcgctaaaagatcttattaccggaagaagcgcgctttcgaagccggccgtcaagagtccaacacccgtataggaaacaagagaatccatctagttcgtacacgtggtggaaaccgtaaattccgtgcacttcgtctagattcaggtaacttttcttgggcctctgaaggtgtcgcacgcaaggttcgcgttatcgttgtcgttttccatcccctccaacaaacgaactttgtcccgaacaaancaccctcaaccaaaatctgcaattgttcaaagtttgatgcaagcaacctttcaggcggtggggcaccgctcgctccggtcangggtcaagggaactaaaggtccgggaaaccntccacaagaaagactgggaacaaggaagttacaaaaggcctacnnaaaaaanancaaatntgnttgaaa

SEQ ID NO: 24720 - DNA, 1419 bp, Triticum aestivum
  Clone ID: PAT_TA_24720
tcgcgctcgccagcgagggcaccgacgtgcgcgcgctcttcgagctcacgctcgtcgaccagagcggcaagggccagcacgaggtgcacacccacttcgggaggtcgctcgagggcgggccctacacgctcaagtaccggggcagcatgtggggttacaaacggttcttcaaacgctctggcctggaaacatcagattatctcaaagatgattgccttctggtaaactgcaccgttggtgttgttcagtcacatactgaagggccaaagatatacaggataccagtgccacaatctgacatgtctcagcatattgggcatttgttgaccagtgggaagagaaccgacataacatttgaagttgatgaagagatgtttcctgctcacaaggtggttcttgcagcccgatcaccagtttttagggcacaactctttggtcccatgaaggataaaaacatgaagtgcataaagattgaagacatggaggctccagtgttcaaggccttgctccattttatgtactgggatgagttgcccaatatagaagagcttactggtctaaatacgacttgggtttccactttgatggctcagcatttgcttgcagctgctgaccggtatgcattggagagactaaagctgctctctgaactcaagctatgcgaagacgttgcaataaacacagttgcaaatactttggcgctggctgaacagcaccattgccaccagctaaaaactgtttgcttgaaattcgtggcctcgccggaaaatttgaaagctgtcatgcaaaccgaaggattcgattatttgcagcaaagctgcccttctctcctgaccgagcttctggagtatgttgcgaaggtaggagaccacgccgtgcccccctgcttatattccaacgaagtgctggatggtggcgatgccaatggaagacgtgtgaaaccaagactttaactgctccccaggtcagcctagaaggagttccatggctgttgtgctgtaaagtgttcctataacagcatgcatgtggcatgctgtagtgtgtatcggtgtttgtcttgtgattctgatcttcatcttcatcctcagccgtgatgctagtctggagctcgttgttgctgatatatattcaactgactggcctacaattgcatttgctgcgaagctctgttactttgcagcctgtggtcataagtgcacacacacacaggtggcgcggcgaaggttgactgacctgaccggtacaaggtttgatcaagcagaaataaaagcgcaggatgtgttcacagttggtttgtgctaggtcagccttgtcgattcctagtcgtctgcatgactacttgtattgagttgaaacgatgtaatccaatgagatctatttgaattgaatgccaatgtttaaagttcttgtgtttgcttt

SEQ ID NO: 24721 - DNA, 770 bp, Triticum aestivum
  unsure (1)..(770): unsure at all n locations
  Clone ID: PAT_TA_24721
cctacatgcttccgctctganggaagggcgccgggagctattcttaaagatggttctgttgttgaagctgatacagatattgttggtataggagcaaaaccatctgtcagccccttcgaagctgtgggagttaacatcgaagttggtggaatagaggttgattccatgtttagaacaagtatacctagcatctttgctattggagatgtggcagcttttccgctcaagatgtatgatagaatagctcgagtggagcatgtggatcatgccagaaagtctgcacaacattgtatagaaacactgttaacatcccaggcaaaagcgtatgactaccttccgtatttctattctcgagtttttgagtatgaaggaagctccaggaaaatttggtggcaattctacggagataacgttggtgaaacaattgaagtagggaactttgatcctaaaattgctaccttctggatcgactctgatagtcgattgaagggtgttttccttgagagtggaaccccagaggaattctcgcttcttccaaagctcgcgagatcacagcccattgtcgacaaagctaagctcaagagtgcgacttcagtcgaagatgcattagagatcgcgagaagctctctttagtctggctctttgtttaactagttgtcaacacatatggcctcttctgtttgggactgcagcttattttgaaaagtcaggactacgatgacaataatgcggccatagtatccgttctatgcggggtttgtaattttcct

SEQ ID NO: 24722 - DNA, 2082 bp, Triticum aestivum
  unsure (1)..(2082): unsure at all n locations
  Clone ID: PAT_TA_24722
gagagcccccggccgcagcgcccctcgatcccagggttgttcccttgcgccgcccgtcggtgagttttttccatggaggtggctctagctctccggcaaaaggcggcgcatatcgcctccccggcggcggcagcggcggcggcgatggggtcctactcgcgctcgacctgggcgctgcggctcctgagccatgggggctgcccagtcgctcccgcggccctccgcaggctgaactgctccgtcgcggccgccgtcgccgacaacctttgccgctgctgcgtgtttgggggcgtcaggaccgcggtggccttcacgccgccaacgttcgtcgtccatgcgggggccgtcggccgcctcggcgccccctccccgccagctgctcccccggccgagcctccggccccccccttgaggggtcgaggaacatatgatggaatgacagcacgccctcctggattccatacctgtgttggatctggtggccagaggcagactgctgaatggtacaaggagaatggcatagaggtgctgtatgaggatccagttgaagcatttgatggcaaaacacagaccttgaaaacttcatcagggaaaattctgaagtatgggtcacttatcatttctactggttgtgcagctgcaagactacctgagaaaattggaggagacttacctggagttcactatatacgtgatgttgctgatgctgattctctagtatcttcattgggaaaagcaaagaaaattgttgttattggtgggggctatattggcatggaggtggctgccgcagcttgtggctggaatcttgacacaactataatattcccagaagatcacataatgccaagattgtttacgccttcccttgctaagaagtatgaggaactgtatgagcaaaatggcgtcaaattcgtaaagggagctcttattgacaaacttgatgctggctctgatggaagggtgtcttcagctatacttaaagatggttctgttgttgaagctgatacagttattgttggtataggagcaaaaccatctgtcagccccttcgaagctgtgnggagttaacatccaagtttggggggatagaaggttgatctccatgtttaagaacaagtatacctaacacctttgctatttggagaatgtggcaagctttttccccgctcaangatggtttgatnagaatacccccgagggggcgggcccgggtacccaaattctccccccatcagtgtggccgaccccgattcagctccccggcttgcctcgtgtctccccatccatccccctggcttggcgtgttaccccataaaggaagctggatgtaaatttgttgtcaattcgactgagatcacgttggtgaaccaattgaagtagggaactttgatcctaaaattgctaccttctggatcgactctgatagtcgattgaagggtgttttccttgagagtggaaccccagaggaattctcgcttcttccaaagctcgcgagatcacagcccattgtcgacaaagctaagctcaagagtgcgacttcagtcgaagatgcattagagatcgcgagaagctctctttagtctggctctttgtttaactagttgtcaacacatatggcctcttctgtttgggactgcagcttattttgaaaagtcaggactacgatgacaataatgcggccatagtatccgttctatgcggggtttgtaattttcctagatgcccctcagtcgccattttctagcttggcataaactttgaccacccttttgaggggttgaggaagatatgatggaatgggaatattttcttttgcaggtttgaacattgggtggtataaactataggcacattaataaaacttatgatcatccgccattttctagcttgaaataaactttgaccatccattgaggggttgaggaggataatgatggtatggaaacatttattttgcagtttgaagtttgaacaatggattccatatgctaaaaaaacgagtagttggtgcagatggactgtgatcttgtcgtttcagacttcatcttatttactgagcctaccttgatcaaaaaaaaa

SEQ ID NO: 24723 - DNA, 1267 bp, Triticum aestivum
  unsure (1)..(1267): unsure at all n locations
  Clone ID: PAT_TA_24723
gcctcgcgcctcttctcgccgcacctcccactcccccccccacccccgctcccctgcgcgtcccgtcccgcccgacggccgatccggcgcccctcgccgcccgcctccctgcgccagcaatttcaccaccgcttctcctgccgcgcccgctaccgccttcagacacgcccactccccggtcccatcgtggcaccaagtgcgggcgtgctctctataggcagaagtccagggaccatggcgagcggcaagctcgtttcccgccgcacgtccggccgcgctgtgaacggccttggcatgctccggctcgcagcacgccacgggggcccccggagggggccccagtcccccacggtagcaatcttcgggcggacaattctccgacgtcgtcgatagcgtccccgctggagaaaacctggctgttttaggtcgggtcgacctttctggcatctcgctgcgagatgctagccccacaatacgtaggagggaaaagcacaagttccagcacctgcccagctggttgtttcgccatgcaatattgagttatcgtcgctggttcctcctgttggattgccaagagcaaccttcttgtttcctaacggggaagtttcagttaaggagaagaagttggatgagggtgagaaaattttgtcagtaaatggtatagtgaagtctcatgttctgaatggagtttgcactgcattgtacaatgataatatgatgaatatcaagtatcgctataaggatgatgagctatcatttattcccagcctcactttaccatcaaattcactatcatttgcatttaaacgccagttaactccttcagacaagttcagttaccggtaccattttgacacaaactactggagtgctgtctataaacaaaaggccagtaagcatgtcaaatggaaagcaggttatgggtcggacgaaaggcttggctgggcatctgtttgggttggcgacgcaggcggcaagacaaaggaagcccccctgaagacaaaagtccaactcatgataaaagtccctcagaacaatatacagaattcaactctagtgttccgggtgaagaaaagatgggatttttagtttggatatttattgcgcagagaaggtgagcaacaataagaaatatgaatgcattgcatgtgcatacactttgtgtggaaattgaaaggactagtatgttacgtcctgtcgccagttgaagttaaactgaagcgtttgatanaaaaaaaaaaaaataactcgaggggggggccgtaca

SEQ ID NO: 24724 - DNA, 612 bp, Triticum aestivum
  Clone ID: PAT_TA_24724
gggtgtgctgcccctgcccccctagccgccactggccgggggggcaccctccgattctcttggctcccaccagcacgcgcctcgcccaccaaggactccctcgcacagtcagggatgcagccaccaaaagcacctgcctctcccaggatgcatctcattcatgctctctacggtcccgacgagcagaccgtcacatctggagtaaaaattgcgctgctgccgtaatgcatgtgtgccgtggctatcagcgctgtaggagatacagagtctggagtaatctgcaggatcattttgcctccttggtgcttggaaaaccgtgaagcagatcgtgtcagattggctgtcagatcactcatcaataatccggtgaccatcccggctgtagtaagtacgtacatagttgtgaattgtgatgtcacacagagaatgatgttcataaaataagccagtcgaaataaggtgtttgtgcttcaatggccttgagatgatcgaacggctattctgttcaaacactttgatccccctatgcctattatcacgggcggcgctaggggtattcttgggtcttcatgtgaatacccatgatttttacaaaacagtgttgattttggc

SEQ ID NO: 24725 - DNA, 844 bp, Triticum aestivum
  Clone ID: PAT_TA_24725
gcataaccaagtcaatcttcccccacccaaccccccgcgcagcctcgccgtcggcatgggcgaggagaggacggaggcgtggtggggccggcgcgcgtgggcgctgctgtcggccgtccgcgcgcgggcgccgctggtgcagtgcatcaccaacctcgtctccatggacatcgccgccaacgccctcaccgccgccggcgcctcccccgccatgctccactgcatccgcgagatccccgacttcaccccgcgctgccacgccgtctacatcaacgtcggcaccctctccgaggactggctcccctccatgcgcgccgccgcctccgccggccgcccctgggtgctcgaccccgtcgccgccgccgcctcccaattccggatggaggcctgcctcgagctcctcgcgctcccccccgccgtcgtcagggggaacgcgtccgagatcctcgccctcgccgcccgctcagacagctcccccaccttcaagggtgtggacagttcacatgactcaggggaggccctacaagctgcgaaagcattggcatggtccagcggggcagtcattgcggtatctggagcagttgatttcatcacggatggtgagcaggtcctcagtgctagcaatggtgtggcaatgatgcagaagatcacggcgacagggtgtgctgtgactgctcttatagcggcttttgttggggcggatccttccgatgctctagccgcagcggcatgtgcgctcgccatcgatgagatgcatcctgagagaggcaggtcccttcgctgactccatccctatctctccagcaagtccaaagatggactagttctagatcgcgggcgcgcc

SEQ ID NO: 24726 - DNA, 451 bp, Triticum aestivum
  Clone ID: PAT_TA_24726
ctggtatggctggaatattttttgaaattgatattcaaaacttctccaccaatgatcacttgggacaaatataaccagtggaaggaagataacgggatatttctttggcggctgctacaaatcatccgacttatttccagtgaaaatcagtcgggtgtgtatccgtccgatctgccccgtgaagccgttagatgggtcaacacacaatcgctttcttctcttccacattcagcagaacgcaaacatcatgcacacaagccgccgtagcaccgtcgttccgtcgcagcaaccggctcggcaccgaccgatttgttgctcctgcctgcatcatcaccctgccgcgcagcaccgccaaactcgccaccgtcgagtgctgcgttgaagcaagggtggccaccggcgactgttgtgttgcagcacgggcggccgtcgtcgagtgctgcgttgaagc

SEQ ID NO: 24727 - DNA, 533 bp, Triticum aestivum
  unsure (1)..(533): unsure at all n locations
  Clone ID: PAT_TA_24727
ctcgtgccgaattccgcacgcgggcacacctcaccacccggccggcagctaaaccatggaaggaagcaagccgccgtttcttgcgatccggccaagcaaagatccgggaggcaatcttacatgtgccagtcaacccgcaaggctcacctccatccttacgctactctcgttgctgctcctttcttgcggagtcggcagcatccgctgctcctcctcaacgacggcaatccatgataacagcacgggacatgatgtcgctgctaagattttcaaggcgggccatcaccacacgtcccgccttcagagcccgggaccttggtggccccctcggccgtccccccggcgccgtcgggagccgcctgtacctcccggggcgagtcatcangctgaaccttgngaacctatcttngcnaggcatgatttacnatccctcgggaatctatcattccttaggagantggactgtcaattaatgggttnaccggcgaganactcctctaacggtcncaaaagattgggggacttccttggga

SEQ ID NO: 24728 - DNA, 448 bp, Triticum aestivum
  unsure (1)..(448): unsure at all n locations
  Clone ID: PAT_TA_24728
agacttcgccaacccgacaacagcatcgcaagcatggcagatcgcgaggctccagtaacgttgcggactaggaaattcattcgaaaccctctcctgggacgaaaacaaatggtagtagacatattacatccaaaccgtgccaacatctcgaaagatgaacttcgtgggaagcttgccgaaatgtacaaggccaacaaagaccaagttaatgtattcggtcttcaaactcagttcggtggcggaaagacaactggttttgcactcgtatacgactcgcccgaagcatttgaagaaactcgaagcctcgtcatagactcgtccgtgtagggttcgcaaccaagattgagaaacctagcagacaacagcgcaagcaaacgtaagaataaggcaaaaggactctcccgaggaacgggcaaaggtcaatggtgcaaagaaagaaagaanggaa

SEQ ID NO: 24729 - DNA, 983 bp, Triticum aestivum
  unsure (1)..(983): unsure at all n locations
  Clone ID: PAT_TA_24729
gcaggccgggcgcccaaaaagccttgttttaaattcctaggatctggctagcggagagcggaaggggaagccgacggcgaccgcgcccccgtgagatgggaatggaggagtcggcggggggctgccgcgaggcaggccaaggagtcgctggagctggcgttccagatgtcccagatcctggacaccggcctcgaccgccacaccctctcgctgctcatggcgctctgcgaccgcggcgccaacccggaggccctcgccgccctcctccgccagctcccctccgcccccccgccgtctgccgccgccaccgcacccggctccaacaccagagcggccccgcccaccccctcgttgttcccctccggctttcgccacctctaggctactaggcacccacccaaaacttcacgcctttgaagatcttgcattgaagtcggcccatatttgatacttggcttgctggaagagacggattagctttggtcaggagagatgaaaacttagtcttcgatgcacttgtgatgttgtttcccccagaaaaagttgtagctcattgagttcctgtaaaatatcatcgttctttgcctggcttgcaaaatactgtagtaatcatgatcgccactgcgactgcgtcacaaacaaaaaaaaaaacgccgcctttgtccgtgaggctctccttcggcgttccgtcgattatcctctctttgacgatagtgtcgtacttatctgaaaggcacacgccacggcctggtgcccatgaatcgaggccccgtttcgggatcacactcaaaaagctatgacacgattatggcacggagggagtagatctcactcatcgctttttagaagtcactgtaatgaattagtttttcntagtattgtattgttccacattcagccccactcaccccctggaagactaagccacaattcattcatatgcacattttgctgctcattttcagaagataatattctcaccc

SEQ ID NO: 24730 - DNA, 554 bp, Triticum aestivum
  unsure (1)..(554): unsure at all n locations
  Clone ID: PAT_TA_24730
tccggatggaggtggccaccatcagcagcacgcaccacctcaacctggtccgcctcatcggcttctgctccgagggccggcaccgcctgctcgtctacgagttcatgaagaacggctcgctggactccttcctcttcggcgccggcagcagcagcgacagcggcaaggcgatgtcgtgggcgacgcggttcgcggtggccgtgggcacggcgcgcggcatcacgtacctgcacgaggagtgccgcgacaccatcgtgcactgcgacatcaagccggagaacatcctgctcgacgaagcagcacaacgccaaggtgtccgacttcggcctcgccaagctcatcaaccccaaggaccaaccggcaccggacgctcaccagcgtgcgcggcaccagggggtacctctcgcgccggagtgggtcgccaaacctggccaatcaccgttaaagttcggacctgttcactctacgggctggggcgcctcctcgacggttagcggggcnaccggaactttccantnctcgggngganaacaaaccggaanaanttctccggg

SEQ ID NO: 24731 - DNA, 734 bp, Triticum aestivum
  unsure (1)..(734): unsure at all n locations
  Clone ID: PAT_TA_24731
ngggaggcaactttagtatctcaaccttttcgagatttnaattaaatctttatttgtacacatctcaatgttnccggtaattgtcgcatgtgtggttgttcacttaagggaggntagtgtaccgcacttgaggacaggaagtgcgactaggacgagtgggcgtggatcgttagttcatcggaagtagtagttttcttcactggtacgttaaataaagagttttgtttcgtacttacacaatttaaaatgattgttatggagagaataagaaaaccactccactatatattagtcgtatacacgagtactatatggacacagcttcattgacttagtgcacctgcctttgggtgtatgacaggtgggcccaaaatgtggctggcccacctgtcatacaaccaaaggcaggtgcagttaaggtaccggagctcagtccgtaatacactatatatgcagtacactatataagatggagcctcagcgcttgttcgctagggtttgcactctccacactctcaccgcactacacacgcaggaggcctcggggtcccgccgcaccgggaaggggaggaggtgcagcgttcactctatcgccttcggcaagggaggcaatccactgccggctccgctattctcttccacccagcgcctgtgcgggagggccaccgaccccttcttccacgctgccgtacgtagtgtgggcagatccggcctcccgccgcacgcctgccacc

SEQ ID NO: 24732 - DNA, 422 bp, Triticum aestivum
  Clone ID: PAT_TA_24732
tttccgggtcgacgggataaggaagttgaagacaaaggctgacctgcttgaagttttgagatcggatgtgtcatgtaaaagcatgacagaagcacaattttttaaaaaagaccaatgttcggattggcacaaaaatcttgatttagttcgcacgtcaagattttacttaagttttttggcttttcgagcttatggcactttttagctatttgtatgtttttgtttcaggaagcgggtcaccttcatgaccgagatgcccagcattataattcagctcggaagatctcttccgacccacaactcgatatctttcccacctaactacacctcggcgttaacaatacacacgccacatcgggagttcgggactagttcctgagcagtgtaatgccagacgcatttaaagcattggcaacattaac

SEQ ID NO: 24733 - DNA, 648 bp, Triticum aestivum
  unsure (1)..(648): unsure at all n locations
  Clone ID: PAT_TA_24733
ttgcaaataaaatcacttcatctgggtgacataaaatcattcctactaaaggctgtagagcccccaaaagaagaagctatctcctctgcaattgacttgttatttaaggttggagcctttgaaggacatgaagagttatcacctcttggctatcatttagcaaaactacctgttgatgtgctcgtgggcaagatgatgctctatggggctatctttggctgcttatcaccagttctttcctgttgctgcttttctgaagttataaatcccctttcatctctccaaaagatgagaaccaaaatgtagagaaagcaaaggctgcattgttgaatgaaaatcttgatgggtctacttctataatagattacaaaacaatcaagatcatttgttaattggttatttgcaatacaaacaaagtgggcccggcatacctgcaaagagcatggggcccgatctgcccggcacttctgccgttcggccttcttgtacagtacagtgatgtatatgatcagggacatgcgtctacagtatggctcattattagcagacattggacttgtggatcttcctaaagataatctgaatcaaatgaatgggaatagaaaaagcaatcttgagagttggtttgccaatatatctcttccgttn

SEQ ID NO: 24734 - DNA, 635 bp, Triticum aestivum
  unsure (1)..(635): unsure at all n locations
  Clone ID: PAT_TA_24734
ctcgtgccgctcgcgccgcctgcgccgcgaggaagcttcacttttcaaagttaataacactaatcttttgtctcattggcccatcagcagccgtttggagatatgaatgcagaagacactggttctcagaacgcgctgtagaaggtttggttgataaatatacacggaatgggggatatatggagccagtctcaaatttgcgtggacaacttcgatacaggatctttcttaatctgattcatgatgattctggttcccgtgcttacgcaataataacaccaaacaactataaagttactcaagtgcaggtttttgatgaggacaatgaattggatatatgcggttatggatggacctttgctactgggcttagcccaaagttgggtggggcataacataccaagggggcaacaaggcccctcaagggtatgccggggggagaagttccaagtcggagggccccggcgtgcgctgcgcggggccatttagtgttggtttgcagattgatatataattaanggcaggatggtaattcattgaagacggggaagcgtttgatttncaacncccaactatgaaaagtgtgttgttattgttggaaatccaaacncagttaaattaatcaattttaattg

SEQ ID NO: 24735 - DNA, 385 bp, Triticum aestivum
  Clone ID: PAT_TA_24735
gatctacaataggcaataatccatgtgcagaaaaatacatgggatttaagctaactttcattgaacctggtgaatcatctatttgtctaagatagtgtcttttacatgtaatatgcaatgaacagttggaaagttggaagtttcatttttctcaaatgacacacatattacgtgttgcctgcttctccccatagtactatttcttaggctcactacagattactaaataacatcagctgtaaaatgtgggaagtagattagaattacaggagctcatcaaatgccttatcaaataactatttgatttgtagcatgcttgtatccaattcaaccggaccattgaacacatcaagcaatttatccgtggagaagggagcgatggtcc

SEQ ID NO: 24736 - DNA, 501 bp, Triticum aestivum
  unsure (1)..(501): unsure at all n locations
  Clone ID: PAT_TA_24736
gttaactacctcgtgccgaattcggctcgagtcgatcctctcacccttcactagatttttgtgaagaatgtcacctccttcgtcgcttgccattgccacaggtgccttacagcgcttgattaaggaagaggcttcatatcatgatgaactgaaggcccaggaggcacgtcttcagaagctgacgaacagttctgatgaagacggaaaccacgattggaatattagacaagagcgtacggctattgaacagactcgcgcagtatttccgtctctgaagcaagagaattttagaagcgcaggaaaatgtaaaagcgccagctagagggaaggtgaaaattctgggtgccgaccaagatacaaanttaaaaagagcaaacgggagctgctcngaaaaatatgggaaataaaaaggggcgccccccgctccaccccgttttttggatgccaanacatcccacnccccnggacnaaagcntttnaagtgnnccnatgggnttaatg

SEQ ID NO: 24737 - DNA, 584 bp, Triticum aestivum
  unsure (1)..(584): unsure at all n locations
  Clone ID: PAT_TA_24737
ttggcaattttncccactgatagttccattctttatgtatgcaatcatttcggaaagctccagaggtgttaatttactttcatcaatagaaagcttttcatccttcagataagcagtaatatcacccatgatccagttggcagctagctttgcatcagcaccatgctcaagtgtagaatcaaagaaatgagcaaccttatcgtcattagcaaggaaaataacatcttgcatgctgagtcccatgttctcatagcgcctacgctttgcctctggaagctcgggcattaaattgcgaatttcatcaatgtactcactagtgagaacaacttcaggaagatcaggctcgggaaaatatctatagtcggcgagtccctcttttttctcattgtaaaagttttctgagaggactcatcccaaagacgggtttcttgtacaatttgatcagcctggcttcctttgtgaagaagaaattcatggatttaccacgacctcggttgtgactgtgactgtgactccatagataaaaatgggaaatttctttcttcgaggaccagaaaaaggggggccggcggacgcggcgacga

SEQ ID NO: 24738 - DNA, 1424 bp, Triticum aestivum
  Clone ID: PAT_TA_24738
accaccgacctgccatatccttcattgtatcttctgaactggattgcttttccaaaatccactctctagtgaaaagagagcgaaatgtaatcaacacttcatactccaagtaaacctcaccgcttcgaatcagcggttacatttctataaaaacagcattatttcttttcttacaaaatccgtgctctaaacaaggggggcaactagatccatcccaaattcattgcaagaaccacgccttcaaaaactagaatcggagatattttcgctccccaaaatgtagttccggctgcaggattttgctttcgtccgatgctccagtcatcaaggaccacttgctgcgcttgctttacccctcgacgccttcccctccgcttctcccccaggattttgttcattagtacagggcttgctttaccctttgatgctttcatcacctggccagcaaaatatccctgcaacttggttttcccagcccgatactgctcaagttgcttcggattgtcagcgagtacttggtctaccatggccccaattgctgctggatctgcaatctgatctccttgccaatcttcccactgatagttccattctttatgtatgcaatcagttcagaaagctcaagaggtgttaatttaccccctcattggtccgctcttcatgcttccgatcagcccggatggctcccgtggtcctatttgcctttcatcaatagaaagcttttcatccttcagataagcagtaatatcacccatgatccagttggcagctagctttgcatcagcgccatgctcgagtgtggaatcaaagaaatgagcaaccttatcgtcattagctaggaaaataacatcttgcatgctgagtcccatgttctcatagcgcctacgctttgcctcaggaagctcgggcatcaaattacgaatttcatcaatgtactcactagtgagaacaacttcaagaagatcaggctcgggaaaatatctatagtcggcgagtccctccttttttcgcattgtaaaagttttctgagaggactcatcccaaagacgggtttcttgtacaatttgatcagcctggcttcctttgtgaagaagaatctgccgggagatctcatagtctattgccctacttattgcagaaaatgagttcatattctttatttcaacctttgtaccaaattctgattgtccaattggtcgaacagaaacattcacatcacagcgaagggaaccttcatccatgttaccattgcccactcccaggtacctaacaagcctttgtatctcagcaccatactcggcagcctctatccctgacctcatatctggctctgagacaatctcaagcaaaggtacaccggctctatttaagtcaacctgagagtaacttccggattcagagtgaagcagcttgccagcatcttc

SEQ ID NO: 24739 - DNA, 578 bp, Triticum aestivum
  unsure (1)..(578): unsure at all n locations
  Clone ID: PAT_TA_24739
ctcgtgccgaattcggcacgagtccagatatcctcatcacatttaatagcaatttacatcatcattaataattgtatttcgtgtattaaattatctctatcatcatgcagaccttcagagcagttttcgtggcagcacttatctccctctctgaggcagttcgccttacaaacacagccgatcaatatagtgatgtcaaggctggagagccatacaagataacttgggagaacgcatcaggacctgttactatattgttgaagaatgggaccctctactcaccttcaagaccgtttctaccatcgcctccgggcaaaactgggaaaattcttacgaatgggactccaaccttccaaccttaaagacaagattaatacgctttccgagaatactngacttccgggagaaggccaaactaactcctgttcaattcaacaacaaccggtnattgacacctccaagaccctaatgaactcaacctcaaacaatttcgggcaaactgggaaccgggaaccggggcaanccaagctccctcctgggatngagttgcttcacctcaaaggattttctanggnacn

SEQ ID NO: 24740 - DNA, 478 bp, Triticum aestivum
  unsure (1)..(478): unsure at all n locations
  Clone ID: PAT_TA_24740
cttcaaacctatcaattcatctccagtagcaaaccctacattcacaatcaccatcattaactcaacttaactcgaaaatgacaggacgtggaaaaggaggcaaagggctcggaaagggtggtgcgaaaagacatagaaaaatcctacgggacaatattcaaggaataactaaacctgccatacgccgtctggcacgcagaggaggcgtcaagcgtatttcagctatgatatatgaagaaacccgtggagtcctcaaaactttcctcgagggggttattagagatgctgtgacttacactgagcatgccaagaggaaagacagtcacaagtttaagatgttgtccacngcgctaaagaggcaaggggagaaccctatacgggtttgggggttaacttaagttgggaagaccaaaacacacccgtgcgaatgtgaaatgagggagggagttattagggcgagggagngggtanccaaatt

SEQ ID NO: 24741 - DNA, 1938 bp, Triticum aestivum
  Clone ID: PAT_TA_24741
ccggcacaacgacacggagctccacctcgccgcgcagcgcggggacctcgacgccgtgcgccagatcatcgtcgaaatcgacgcgcagatgaccgggactggcgaggagttcgacagcgaggtggcggagatccgcgccgccgtgctcaacgagcccaacgaggtcggggagaccgcgctgctcatcgcagctgagaaagggttcatcgacgtcgtcctcgagctgctcaatcactctgacaaggagagccttgcgaggaagaacaaatcaggattcgatgctctgcatgtcgctgcaaaggaagatgaccgagatattgtgaaggtactcctggaccatgatccatcccttgggaagacgtttggccaatcaaatgtgactcctctgataactgcggcgattagaggccacctcgaggtagtgaaccttctgctggagcgagtttctgggttggttgaactatcgaaggcaaacggaaagaatgcattgcatttcgctgcccgtcaggggcatgttgaaatagttaagtctttgctagtcagcgaagctcagcttgctcggaagactgataagaaaggacagaccgctttgcatatggcggttaaaggaacaagcgctgcggttgttagagcactcgtgaatgctgatccggccatagttatgctacctgacaaaaatggcaacttagctttgcatgttgccaccaggaagaaaagatcagagcttgtgaatgagcttctgcttcttccggacatgaacgtgaatgcactgactagggatcgcaagactgcattcgacatagcagagggtcttccattatcagaggagtctgcggatatagaggattgtttatcccgtgctggtgcagtgagagcaaatgatctgaaccagcctcgggatgagctgagaaaaacagtgactgagatcaagaaggacgtacacactcaacttgagcaagccagaaaaaccaacaaaaatgtgcatggcatagcaaaggagctgaggaagctccacagggagggcatcaacaatgcaacaaactctgtcacagttgtggctgtgctcttcgccacagttgcatttgctgcgatattcacggtgccaggcggcaacgacgaccatggtgtagcaattgttgtgcatgcggtatccttcaaggtgttcttcatcttcaatgccatcgccttgttcacatcattagcagtagtggtggtccagataacacttgttaggggcgaaaccaaagcagagaggcgagttgtggaggtgatcaacaagttgatgtggctggcttctgtatgcaccacggtggcattcatatcctcctcttacatagtggtgggtcggcacttcaagtgggcggcgctgctggtgaccctcatcggcggggtgatcatggccagtgtgctcggcacgatgacatactatgtggtgaagtccaagcgcacgcggtcgattaggaagaaggtgaagtcaacaaggcggagcggctcaaactcatggaaccacaactcggagtcagattccgagatagaccggatatacgccatatgagggtgatctccggtcttctatggatcctcagtgttttcggcggcgccacacgacacggatgtaaaaagaaaggtgggatggcactcaatatgaacagctttcaccctccaggtgccaagggttttaccgtatacattccaataagctggtgttcctggatcgttaggaggagccaggacgcgacggtcgtgttgtatacatcttctacagatagattgtgatcatcagaatatgcatgcagcctgtgctgtgctccctatgcatggctggctggctggccttcataaaatttctctcagcctttttctgtaccttttgttaatatgctgtggtagcagaatggtcggtatgtgtacttagcactttgtaccttgtatttcatc

SEQ ID NO: 24742 - DNA, 504 bp, Triticum aestivum
  unsure (1)..(504): unsure at all n locations
  Clone ID: PAT_TA_24742
ctcgtgccgaattcggcacgagggcggctggaggtcggccgcccggccgcggcgcggttgagcaaagaggcggcgctcgagttaacgcggaggagcacaaggcaacccctgcagtccgtttctccctcagaaatcaccagcatctggcagtccgtttctccctcaaaaatccaagttaacacggaagagcacaaggcagcctctgcagtccgtttctcccccaggaatcagcatctggcagtccatttatccgaaaaaatccaagatcagtagtcacaatgccgcgatcaaatgaaatcttacctggcctactagctgcgaaagctattgcagcacgccatcagatccgtgaggtcattgatggcgtagcacagtttgtgaccgaagtcgggcttcggcaatgtgccattcgagaatacaacgcccatcacatcaccggcgacgaatctggttactggatggctgagcttgagtgggcgtacctcggccgcgaccacgctannn

SEQ ID NO: 24743 - DNA, 477 bp, Triticum aestivum
  unsure (1)..(477): unsure at all n locations
  Clone ID: PAT_TA_24743
cggcacgagctctcgttcgtccgagtacctagcggctcctgctgagcatagctcgcaaaacgtatcggctggccattatattgctcgcgagttcttgaacaacgttggcgatcgatctagctagcggggcgcccgggcgtacgtgcgtgcatggctgtgctgtcgtctgcgaagcgcctcctcccgtggggccgcgcctcggccggcggggtcagcggcggcctccgagctctactcgggacggtccgtgcccgcgcccgtcccctgctcccagcccggggcggccgccgctcccgccgcccgtcccggcggaaatcgtcgcagccgcanctggaccccgtcgacagtccnaagaaggaanggcgggggcgacatcgaactgggaacaacctccgctttnggctcaaccccgacggaataaaatgtactttatgcngtggctcccaagaaggaagggcgggttttcccnccgggnag

SEQ ID NO: 24744 - DNA, 943 bp, Triticum aestivum
  unsure (1)..(943): unsure at all n locations
  Clone ID: PAT_TA_24744
gaggcccccaaanatggtttctanccaanatgtntncnctacaaaaactgcagggccccggtgttgaggcccaaattttaagtgaccttgttacaatntgtcttgaaacggccttncagntcaagagcttgggcatattgatcttcaggcgccgccatggggttccaagtanaagtcgcctttnccatcggggtacccatatgaagataaggtccatagacacgttttcattcagatatgacatcggggtccacctgtgatgcatcttcataggcattcgaggtactgtcctgattggggatgttgggagccactgtttggtaagcgctgggggcactggcctgattggggatgttgaggggcactgcttcataagcatttgaagcacccgcttgattggtggccttgagagctggatatgcattcgcattggtgtccttttgactagcctttgtcttgctcctagcaccccgcttgttgtccaccggactgtttgcgctaagcttgaccatttgctgctggatttcgttgagtgaactgctgcccagttttgatttaacactccttttaggatcagaagccttgaactcaagccggtacaaggctagagtgttagaatcattgatctcatattcgaaaaggtgccactcatagttgctggatggttgcgggtccatgtaataggatttcttcaggcccccaaagtccttcatcacttgcttccttgattcatgccatccacggccgttgtaatctggcaacgacctttgcttgcggttgccgctctcaaatgcccttcttggtctgtcaaagaataaccattccctaagagatccccccccaagaagagaaagatcaaaaagttcatgtgcattccaaggtgattttgacgttgcagccccttcacagacaggaataccaacattttttccttggacttttg

SEQ ID NO: 24745 - DNA, 425 bp, Triticum aestivum
  unsure (1)..(425): unsure at all n locations
  Clone ID: PAT_TA_24745
ctagaattctgagatgatgtgggaagaaagatcaccgagctatttcagatcctgtaaattgaaggttgtttcatatcctgacaggaaggtcagggaactgtaccaccaagccccatgccagtatagtttctagcatctccgactctttccccgtggatattggaaaagctccgacatcaaaaattaaaataacatcaaaaaaatattttttaccaggcttggactcccatggatccaagaaaacctaaaacatttataagataagtgtagcacatgtgctccctgggggaatacaaagacacaagattttgccaggaaagaaatgcagagctacaaatttggcacctggaatgaactttcccaaccgctcccgtgncacatggcctcatatcancatgatgggattattgngctgggggggggnc

SEQ ID NO: 24746 - DNA, 585 bp, Triticum aestivum
  unsure (1)..(585): unsure at all n locations
  Clone ID: PAT_TA_24746
atgccggagggccgattgtntgacgtgccggacagggtnctccgccgtgccggacccgtgcatnccatcttggnccttcctcgncacgcgtttggncttntgaacgcgttcttnnaacctaatgtggagccattgggcccgtgaacgggaaccggtgntccaatctttcgtcttatccgccgccgcccattttcgttgggcggggaccagttgttgntccaaattgcttccagtccnttagtcctcccgctgccgcccagtgcaggtgccggttgagcacaccatgttattccaatacctattcacgcgctgcccagtgcccggagatgacggcacnggacacccacaccgcaagacactgcagcatgttgttaagaacatcggttaattacgcgtgaaacactgtcgctctatatttattatgcgttatctgttacgtatatcaatgatggtgctagttaattgaggtactaataaaattatgacatcgcctcgatgtaatcttataaattctggtgtgaagtgtgattcaattttctgtgaaatatatatggcatcccggtaattccatccaaaaaaaaaaaa

SEQ ID NO: 24747 - DNA, 753 bp, Triticum aestivum
  unsure (1)..(753): unsure at all n locations
  Clone ID: PAT_TA_24747
caagcctcagcccccacctgnaggtcgcctccctgatgctaccaaggttctgaccacctaaggcaagtctttggcaagcagatgggcttgagtgatcaggatattgttgccctctctggtggccacaccctggttagtttgcatatttgctcaatctgctttcatgttatatacctggatcgttgtatgcatgcattgacattgttctcttgcgtttctctttttctatagggaaggtgccacaaggagaggtctggctttgagggaccctggacaaggaaccctttgaagtttgacaactcttacttcacggagcttctgagtggtgacaaagaggggcttcttcagcttccaagtgacaaaaccctgctgactgaccctgtctttcgccctcttgtggagaaatatgctgcggacgagaaggctttctttgaggactacaaggaggcacacctcaggctctccgaactggggtacgctgaagcataagaggcgtgtctactactgctgctactatgtgcgatcagagtgatcttgttctgcgtctagactaggggtcagtatggaccagcagactgctaagtaatcttctccgtaataatgtccgttggcttgaggccataccttgtacgctgtcagtggtttggtgtgccgttgcactcggttgccttatgccacagatctatcgtatgaaatgcagtagtgactttgaatggtaccttgcgcatgatctttatgtgcattttatttttg

SEQ ID NO: 24748 - DNA, 581 bp, Triticum aestivum
  Clone ID: PAT_TA_24748
gtccacagccgaggcataggactaggcgattccaaccggcggcggcgagatgaagctcaccgtgatgaccgccgacgagcagtttctcaacctcgacgtcgaccccgacgaatccgtggagaatttgaaggcgcttcttgaggtggagactcaagtgccgttgcagcagcagctgcttcatttcaatggcaaggagatgaacaatgctgagaagctcagcgccatcggagtccatgatggtgatcttgtgatgatggttgcctccaataataggacatctcaggatattatgaggttaaatcctgatggatcggcagtaaatcctcaagctttccaacaacatattcgtggcgattcacaacttatggcgcaactccttcagaatgacccttcattagctcaagccatccttggagatgacaccactgagttgcaaaacatcttgcggtcacaccaccaacaaagactacaactgaaacgcatacaggaagaagagcttgccttattgtatgctgatccatttgatgtcgaggctcagaagaaaattgaagcctgcattcggcagaaaggcattgatgaaa

SEQ ID NO: 24749 - DNA, 1291 bp, Triticum aestivum
  Clone ID: PAT_TA_24749
ccttcccctccccgcctgcatgcccccccccgtcccctcgctgtcttcttcttcttcagttccgccttcccctccccgcctgatcggagtctcagccgcggcagccattggcgaagacctaccccgtcgtcagcgccgagtaccaggaggccgtcgagaaggccaggcagaagctccgcgccctcatcgccgagaagaattgctccccgctcatgctccgcctcgcgtggcactcggccgggaccttcgacgtgtcgtccaagacaggcggcccgttcgggacgatgaagaagccggcggagcaggcgcacgccgccaacgcgggcctggacatcgccgtgcggatgctcgagcccatgaaggaggagatccccaccatctcctacgccgatctctaccagcttgcgggagttgtcgccgtggaggtctccggtgggcccgtgatccccttcccacccagggagggaggacaagcctcagcccccaccctgagggtcgcctccctgatgctaccaaaggggttctgaccaccttaaggcaagtcttcggcaagcagatgggcttgagtgaatcaggatattgttgccctctctggtggccacacccctggggaaggtgccacaaggaaaggtgtctggctttgagggggaccctgggacaaggaaaccctttgaagtttgacaactcttacttcacggagcttctgagtgggtgataaagagggacttcttcagcttccaagtgacaaaaccctgctgactgaccctgtcttccgccctcttgtggagaaatatgctgcggatgagaaggctttctttgaggactacaaggaggcacacctcaggctctccggaactggggtacgccgaagcgtaagagggtgtctactactgctgctactatgtgtgtgccagggtgatcttgttctgcttcatagactaggggtcatgatgttgaccagcagtcttttaagtaatcttcgtcatgtaataatgtccagttggcttaaaagccataccttgtacgctgtcagtggttgtgttgtgccgtatatcctgatctacctgtatatatgagctgtgacttatcttgcactcggttgccttatgccacagatctatcgtatgaaatgcagtagtgactttgaatggtgacttgcgcactacagttatgatttgtggccaccggggtcttcttctgcttctagactaggggtcagtgtgaaccagcagacttttaagtaatcatctctgtaataatgtccgtggcttaaggccataccttgtacgct

SEQ ID NO: 24750 - DNA, 1919 bp, Triticum aestivum
  Clone ID: PAT_TA_24750
gggtcgaccgcaggtatgatcaaggtctctgctgggtgtcctaccttcgatgggacggactacccctactggaagaacaagatgcgaatgcatcttgaagcaattgataacgatctctggtatgttgtggaaaatggtgttccctcagtcacaccttcactgaacgctactgatgtgaagagattcaagcaactcgactctcaagcgaagaatatcatatgtggccatctgagcaaaggacagtatggaagagtgagtgctttggaaactgctaagcttatctgggataggttgtccaaagtgaatgaaggagtctcaactcagcgtgactctcgagttgatgttcttcgcaatctcttcaactgcttcaaaagactcgacaatgaaaatgttcaacaaacctttgatcgcctcactgacatctcaaatgagcttcaagcacttggtgccactgacatcaccgaccatgaggtggtgaagtaattgctgagatcgcttgattcctcatttgatactctggcactgatgatacaagaacgtggagattataagtcacttgaccccgctgatatccttgagaggctaaatactcatgagttccagcttgatgagaagagagatatctatggttcgagctatggcagatcatgtgccctgaaggccaaggaagtttctgaatctgaaggtgaagattctgggagtagccttggtgatcctgaagaactgagccaggagctagaactgctcgcgaagaaattccagaagttctcaagacgtggtcactttggaaaatccttaaggagcaatgattcctcatccagtgactacaagaagaggctatgccacaaatgcaagaaacctggtcactacattcaagattgtcctcagtgggaaaaggaatcaaagacgaaatacaaggattacagttctgatgacgcgaagaagaagaaatcttcaaagtattcatcatcaaaatcctcaaagtcttcatctcacaagaagagcagctccaagaaggctcgggcattcattggcaaggaaatggactctaaagctgaggaacatgaggacgaggaggaatctgaggagtccgagtctggtgtggcgagcctagctctcgctactgcattcatcagcaagtccatcttcaactctgaagaaaatggcttcaccaacaaggctgatgaaggcaatgatgactacactcccacctattgcttcatggcaaagggtgccaaggtactcaaatacccctcctctgaatcaagtgaggatgaatctgatgaaaacctcaagcctagctactctaaacttgctaagattgctgtgaaataacaaaaggcttttgaaaaggttcaaaacatgctagacaaaagtgatgacatgttgggtgaagaaatggatcgcactaaaaccttgactgaaaaacttcagagacttcagtccaagtttgacaaccttcaaaatcatcataacactctcttatctgatcatgagaagctcttttatgaatttcttcaaagaaagcaagatcttgaaaagctaagggtgagttatgaagatcttcagaaggagcgcgattcattacttgctcaacaaatcagcgctgctcaggaagaatttgttcctccatgtttgaagtgcattgaacgtgaatctgctaattcttcacctgaatgttcaaatgcttcgattgctacaaattcttcacctgtctctgctatcactaattcctcatctgaggacattgctagtatcactgacgatgcagggcttaaggaattgtacatgacaggcatgtacaaaagcctcaaagggcatcagcccgaccctttgtgatgtgctcaaaaagcagaccctcaacagaaaccctaggaaagagggtattgcctttgagaggaaactcaatgctgatggaa

SEQ ID NO: 24751 - DNA, 767 bp, Triticum aestivum
  unsure (1)..(767): unsure at all n locations
  Clone ID: PAT_TA_24751
ttttttttttttttttttatatttaaaaacggaggaagtatttatttctcctttctggacgggtggatacagtatggagtatttgtgtgtgcctgtgggggcgttcttgatctagattcccagtcagagcttggatggcgtccctctgggatggtgcacaacgatgaggccgtacgcgtccagcgtgaggaagtcgtccagctccggcgcgacgcactgccggatgaagatcctgccagcctccgcgtagcgcccccgccggaacctcgccgcgccgacctccgcttggaccctcgccatctccttctccacgacgcgcgcgagcagctccggcgtggctcggaccgccacgccgccggcgtccagcaccgcgccgtgccgcagccactgccagttctgcacgcggctgatctccgcggtggccgcgtcctccatcaggttgtacagcggcacggagccggacccgcccagccacgccgcgaggtactgcacgccgacgcgggtgttgagccgcagcccctccaccgtgcgcggcccccgcggcggctggatcgggtcctcctccgtgatggcgtcggcgggcgctgccgcgtcgatctggttaggcttcccgccgaggtggccctcgaagacctcccgtatcgccgggatgagccccgggtgcgccgcccacgtgccgtcgtgccccgcgcgcacctccctcagcttgtccctgcgcaccagctccagcnccgcctcgttcgccaccgcgtcgtccttgatcggaa

SEQ ID NO: 24752 - DNA, 452 bp, Triticum aestivum
  unsure (1)..(452): unsure at all n locations
  Clone ID: PAT_TA_24752
gggtcgacgacctcaacgggaccagcaccactgctaactcaatgatggttgctatctctcacaatatatatattacttttatatgtgtcaactttaaggtttatatgtttgggctgtgcttttgtgatattttggactgtcagtgctttgactgatttttaccatctcaatgtttggcattcatgtaggttttagcattacttctgcgctcgtggtatgttaccttgccatgtcgcatcattagtttgtcttgtatgtggtgtttgtccatctgctgagttgtatacttattactcgttttgtctgcgccttttcttcattgagtttacttattgatgctgttctgttgccctctatgctgttgtttgtttgctctgctggttcaatacacctgttgcccctaaatanatcaattatatatgcaatttgagtctgccacttttttgtttcct

SEQ ID NO: 24753 - DNA, 744 bp, Triticum aestivum
  unsure (1)..(744): unsure at all n locations
  Clone ID: PAT_TA_24753
gccccaatgagctcataccccctatatttatgatcaatgatcttggttcttgcttagaatggaatgaagctatgcaaaagattactggtataaagagggaagatgcaatagataagttgctgatcggggagcttttcactcttcatgattatggatgcagggtaaaagatcaagctactctaaccaaacttagcatactgatgaacacggtgatctctggtcaagaacccgagaagcttgcttttggtttcttcaacacagatggcaagtacatggaatcactgctgacagcaaacaagaggacagatgctgagggtaagatcaccggcgctctttgctttttgcatgtggccaagcccccgagcttcagcatgctcttcaggtgcaagaaaatgtctgaacaagctgctacacacagctttaaggaattgacatatattcgtcaagaattaaagaaccaccaatggcatgcaatttacccgtaattgttggaacatctgactngacagaggagcacagnaacttttgcatcaaagttctcngtcaagaacattganaaagatttacatgacaatgtctanaagnatngacatgctacatgggagatgaacccgtgggatcaacctgaanaacctgaatacgtcctatgcaagnattcctgagcaaagaaanaattcctgtctgatggccgtaaatacacaagtctntanggatantaggtcacatcanaaatactgagcnctt

SEQ ID NO: 24754 - DNA, 452 bp, Triticum aestivum
  Clone ID: PAT_TA_24754
cgggtcgaccgggccttcaaatacatccgggaggtgctcaagtgggaggaggacaaggacgagaactactaccaggaggagtccttctacagcaccaccgagatgagctcctcccccttcatccgagccgaatgagaccgcgtcccctgcccccgccgaaggccggttcctatactaatgatgcgccgtttcgttttcgccgccagtcgattccgttttgcgccgtacaaaaaatcattcattgattgttggtctgtaaaaagttaatctgcaggtttttgttcttctgatggatgggatgtttttcatgtttgtgtctcttggtccttgagatagagatgaagcatgattgatctgttggtgtgtatttagtgagtggtactagcagttttcttctagtcagtgcacagattgacctgttggcaccaaaattgattaatttcgttctgctg

SEQ ID NO: 24755 - DNA, 1151 bp, Triticum aestivum
  unsure (1)..(1151): unsure at all n locations
  Clone ID: PAT_TA_24755
aagcaaacagacttttagcagaccatgtattttcgcaattagtgtttctaaatacagttccgtgttcttttactgcctatcaaacacatatagcgattctctaaatcatgtccttaataaataacacttggagaaaaactaacatgtacagagtcaagataatgaaacagtctatttcaagaatgaaaaataatgacaatttggtgatactataaaagggattcattcaccttaaggggccattccaaaatatactagtatagcacactgatcttgcagtcacaggatgatattcgtttgttcaaaaattccgcgacatgatctacactttgttgttacaaaataacatatgaaaacacaagttcaaaaggcgattcgcagacacccggcttgagcagcgtcgatggatggactgcaaccaatggatgattctctagacaagttcgatgtaagccataggtgcattatctccccgccttgggaatgtcgggatgatccttgtgtagcccccatttctttccccatacctgtctggaacctcagcaaacaatgcatggactatgtgcttctcataaatataccccagggcctgcctcctcttgtgaagagatccatccttcgccatcgtgatcatcttgtcaacccacttcctcatcgcctttgcccttggcttggtagtctttatcctcccgtgcttcagcagctgtgtggtcagcccacgcaggagtgctttccgctgatctgcaggcctgttgagcctaggaatgcgcttcccgtgcctcatcgccaatatccttccacggacatcagtgccaaacatgcggtgggcaaagctcgattcccacggagaacgagaaggtgtagcagaaggcgagcgaccccgaggccgcggaggacatgggggcgggggagacggaggacgaggagggggacgtggagacgaaggagctccggaggaacggggcgncggaggccgcctgcctgcgaggccggacggccgccgacggggaggggcggacgccgggagcgcggcgcggagggagtccatgcgccaggccgaggcggagatcgccggcgagggggaggtggaggcgaaggccgccatgggggaggggaaggagagcgagcgagcggagcggaggaggggtgtg

SEQ ID NO: 24756 - DNA, 454 bp, Triticum aestivum
  Clone ID: PAT_TA_24756
gtttttttttttttttttttgaaagagcaaagctatgtataatcttggggtgtgatgtgcatcacaagtgatataagaagacatgtatctattcctttgttcctctccttattctcaactatacttgccacaagagcaagagcactgtattatagagtatgcaataactagaaaactagtttattatggagagcagtgagcgctggtgtctgtcatccactcatagctgctaccactactacttcttgatccggcgcaccttcttggcgccccagacctccatcctgcccttggcgcagccgcagggggagcggaagatgagcacggagcggccgttggggggcgccatcttcctgagctccgcctcgagctcccggtgctcctcgccgagctcgacgaggcgcgcggcggagccgccggccgcgaggagtgtcttggcgtggccgccgggcgg

SEQ ID NO: 24757 - DNA, 669 bp, Triticum aestivum
  unsure (1)..(669): unsure at all n locations
  Clone ID: PAT_TA_24757
caccattgctccgcctccgccacctaaatctccggcgagcgccgaagctccagtgaccgtcctcctcaccctctcccggccgccgctatgaggcgctttctcacccatctccaccaccactcccaccgcctccgcccatccccacccccctctcgtatccccacaaccaagaacaacctccctttccttgtctcccgtcgcctcctctccgacgacgcctctcccccggccgccgcgccgtcgcctccccctccctcggccgccacgccaccgcctccccctcctccgtccgccatcgacgtcccaaacgaagagttgaagcggaggttggaaacttactataaggtggaggatgagtcggagctaccgtctgtcgctgtggctgttctcgagcggaatcttgcagatgcacacagtgacaccgatgatgaacttatcgaggagctgcgcgacaggccgcttcctcaggtccatgatcgggactttgaggctgactttgacgagatgtatgagactgatgaggagcttactgacctgtacaacgcgaggcaatatgtttgagaaaaagatgaaaggacgataatcatctaataacatgaatgaaaccaagtgggatgaggaagattncaagaaagcagcagagaaanggcagcttgattacattaagga

SEQ ID NO: 24758 - DNA, 602 bp, Triticum aestivum
  unsure (1)..(602): unsure at all n locations
  Clone ID: PAT_TA_24758
gtcgccaggcaaatcgggttcgaccacgccagcgagtgcccccacctgtgcacgctggcctacgactacctgcgcaagaacaagggctacgaggacaacatattcgccttcttccacaacacccccgaccccggccccctcatcgtccgcttcatcgaggagctcgacaagtgcattctcggctacttctccttccactggaaatgctccacctacatgatcacccagtgtgatctccacaggttctgacggtggaaggcgcgcccaaaaggaagctccggaacatggtattggaggccactaggagtcagagattcgaaagggtcacaagaaacttgaaggtaactaggctattctccacactggtggaagagctcaaggccataggactttctccccaaggcccggcacagtgcagcgatgtgatggtcccagtagcacattgtgatcgcagcccagtcctactcctgatgggtggtggaatgggagctggcaagagcactgtacttaaagatatactaaaggaatcattttggtctggggcagcagcaaatgcagtggtggtggaggcagatgcattcaaggaaacagatgttatatnn

SEQ ID NO: 24759 - DNA, 715 bp, Triticum aestivum
  unsure (1)..(715): unsure at all n locations
  Clone ID: PAT_TA_24759
tttttttaggataaatttcccttgaacaacaattttgatatatactactcattcttttgtggacaatagcagagcaatagcagctgaattcagttttttttttttgagtgctagctgaattcagttgaacgctgcacagttgtggcgtatgttcccctgggacgcatcggtctttactcccacgcggcccagctttgttatggccgccacgaaggcccggtcgaacgcggcaccgctccgggcccacgcgtcggcgccgggcccccccctcggggcggtgaacagtagctggtccgagctcagtaggcccattcccccttgaagattcttgaagtactggttgtcaaatgcccgcggcgtcactgtgtccatgggcacggcggtccgtgggtccacgttgggtgggcaccacgcctgcagctgtgctgcgaaccgcgggctcagcgtcgggtcggttgtcggccgcagccgcccggcgaacgtgcggcagtgagccagccccaccgtgtgccctccggagaggccgatctcgtcggtctgcccgtgcccgttggtcccgtactgcgccgtgacccgggcgcggctgcacgttcgcgcccccagcttgccggggccgctgctcgccgtcgggcccaccccgtccggccgcccctgctccttggcagaaccgttcgactgacgtcaggncctgctaacntaacttcganaagngatg

SEQ ID NO: 24760 - DNA, 621 bp, Triticum aestivum
  Clone ID: PAT_TA_24760
tttttttaaagacacaataaatcagcactgttactatttctccagatcatgaaacagtttgtgtaggacacacagccagcacttaagttgcaagatgacagagtacgaacagctaactaactacagagcagcatcgatcagccaccatgacagggaacagcccatctaggaggaggtgaacttggtgacggccttggtgccctcggagacggcgtgcttggcgagctcgccggggaggacgaggcggacggacgtctggatctccctggacgtgatggtgggcttcttgttgtagcgggcgagcttggcggactcgccggcgagcttctcgaagatgtcgttgatgaaggagttcatgatggacatggccttggaggagatgccgatgtccgggtgcacctgcttcagcaccttgaagatgtagatcttgtacgtctccacgctcttcttggacttcttcttccccttcttctcgccgccctccttggacgccggcggtcgcttctcggccttggtcttcttcgccgccgtggtcttctcggccttctccgccaccggcttcttctccgcttgggggccatggatgccgctgctgctacttggccggggagatgtgcggtg

SEQ ID NO: 24761 - DNA, 1032 bp, Triticum aestivum
  Clone ID: PAT_TA_24761
gaaataaacacattttaaagattcataagatgaacaaatgtatgttagtgacattgccatagtttagataaactgaactgagcatttgccatagttcagataaactgaacgccgaaacagagcacacctatggccatgctcgcagtcaccgaaagcagccaccgcacttgagcccttcttggccaagcaagcggctggatccatcaacggcacacaagcttggccgcctcctcgcagcggcggacgagctgggttcccgtgcgcgcagagcgtccaggaggaacacgcaggcagcgccccagcgaccgcgggcaaattctccccagcgccgcctccgagtcgacgtgggcacctggaggacgcggccgccggagttagaaacaagatgtcatcctgctttatatataaagtaaacatttttttagaggaaatatgtaaagtaaatatcgaatcatgtacatggacgaatgatacaaagttacgggtagctctcatacaatgacgatcttagactacccgtatcatgcaggataggactaggctactaaaataaagcatagaagcatcttgagtacaattgtcacacaacgcccttaaaacaattaagcttcacgacaacatccacgggagggataacggcgctaatggtcgtcactgtcgagagcagacggacaaaggttttcacccgaaacctttgcaagcaccacgacatcctcgcgcgatttctccgagtcagaacaaatccgacgcaaagatcccagccaggaggaagccagaggaaggagcgactgcgggcaagggcagctgcatcccagccaggcggaggaagccagaggaaggagcgactgcgggcaagggcagctgcagccatggtggcgactacgaaaggagtgacattggaggctccagccatagcgaggaaggcgggagcagcagcaagctttcgtagggtcggctacagggtcggaggagctggccatggtgaaccgatggccggcgttccggtcaacgcgcgagaagaaaagagcaacc

SEQ ID NO: 24762 - DNA, 403 bp, Triticum aestivum
  Clone ID: PAT_TA_24762
cgggtcgacgggggaagtaatgggccatacgggaaaggatagaggggcctcaaggagtggccacgcgcaccccaagggctggtccgaattggactaggagggggtggcgccccccaccttccttctcccctcttcctccttccctccttctcctactaggaataggaaagaggaggggaatcctacttggactggggagtcctagtaggattccccacacctggcgtgccccccttgggccggccacctcttccctcccctcctttatatacgtggccagggggcaccccatagacacacaagttaatccttagccgtgtgcagtgcccccttccatatttttccacctcggtcatatcatcctagtgcttacgcgaatccccgcgccggtaacttcatcatc

SEQ ID NO: 24763 - DNA, 650 bp, Triticum aestivum
  unsure (1)..(650): unsure at all n locations
  Clone ID: PAT_TA_24763
cagggggggactgctctctctccctatcttctggccatgcggcaccggccccatcttccgctccgccgccatgtccgtgacgcacgcgttctcgtcaacgaagcggctactggatccgcgccgccgccgaagacaaagcccccaccttgtttagaatttccttcatttgccgtgttccacccatgaaggagggggcgtcggcggagaaggtcctcatgcagccgtgtggtcgaccactacgacgcgaccatgtggtgggtaccctcggacgccacactgccgggccggagggagtccagatccagtccctcaccaatttcgccgcagcacggtgagtccccccccctcgggcctcccgtttcgcccgtcttctcccccccctcgccccggggccgattgccgtaccctagttgtgccgctcctcgtccccaagttccctgctctcgattctccattgtgcgactccgcttagtctgtcaccancccttcttctctgaatccgcggtttagccgcaaaaaatggatccttgtnggttcttttttcgggggggggggggacccgngggaacttcgggggttgttcaatttaaactaaagggtttaaagctaggggcagngggtttttccttttttncnnnanaaaaaaaaaa

SEQ ID NO: 24764 - DNA, 544 bp, Triticum aestivum
  Clone ID: PAT_TA_24764
ggcggggggggggggggtcaaaaaagtccctctcagctcattagaaaactagataagcatatacacataaccgaatgtttacctatccaacactccattcttgcacaaggcgaaattttaattacatccggcggatcaacactaatgtttaaacataatacaagtgcaacacatccggtcttcatcctgtccttggggcgccacttggagacgagcccgctggtcgatggcccggccacggcagcggcggcctcatcgaacccctcgtgccgctgctcgcacagcacaaccacctgcggcaggcacggcactagcaccacggccctcccctcctcatcctcctcgccggcgtcctccctccgaagctccggcccgttcgcgacagggagctcaccatccacgcggtccgtctggtggttcaccgccgccgaggagggggtgggcaacgaggacgaggacgacgatgaggacgagtgcacgagcctggacgccatgagatctcccaatgccatctacgcttgggcgctccctctactactctccc

SEQ ID NO: 24765 - DNA, 1301 bp, Triticum aestivum
  unsure (1)..(1301): unsure at all n locations
  Clone ID: PAT_TA_24765
gcagagcagcagcagctctttttttttatatatgcgaggtgcaccggccgggctgtatattagcctccccgccctccccctttgcgtcgctcttccctttcagaaggcgattgcacagggcgaccaagaactgctgctgcgcccgaccggacaagggaaaaaaatatagagatagtcactcacaccagagagagagagagagagagagagagagagagagggagataaagagatttcgacgagggagggagacaagcggagacgcacgtggagaggaggtctctcggaggcaagcctttcactccctcgacatgataacgatgtgctcctcctcatcttangtcgctgcgggagatcgaaggggatttttcttggcgccggcgaccaccatgatgacagtggcgccgccggtatggggttaccgcgccccccgtctcgccacccccccccccggcaggcgcgcccagccacgagccgtgcgccgagccgccgcccccggccggcctccccgtcctctatgtcccactcccagggattccaccagggcagcagcggcgtctacggcttctcctcggatggcttcnaccgcccgggatccagccaggaccacgaccagcagcaanagcagcannagcaccacgtggcgcagcanagccgacgcgacaagatgagggtccagggcttntnacccggncgccgccgctgcccacgggctgctccctatcgacggcgatgagcacgtngagcccggagccatgtacgancactccgcggtcggcggcgcctncaacatgctcnccgagatgttcaacnttctccgcccagacgccgtcggtgcatacngcancgagctgctggncagcagatgaacngccaactaccgnttcnggtttcccggcagncangcgccgtnaagccgtagtaagcccggnctttgccccnggtgaacgnncggnttgngttcgggccncgnncgggacctggncccggatccttggtcntanngtcccttcggncngggngcttaactttaacttanactcangnacgtaccttttantcccaannccaanaaagncctatccggncatnggtccggncccctaagcccatcccggaacccnggnnccgttcngnaggattgcatgtttctttcnttgggatgaaaacccctttagncntgctnnnctntctctgttcccacagggtncnntnnttccacgnctcgntatatntcttttccgntccgtnnnggnaccccgcccctcatntttcnggtnttttntttcagatnaacctcc

SEQ ID NO: 24766 - DNA, 527 bp, Triticum aestivum
  unsure (1)..(527): unsure at all n locations
  Clone ID: PAT_TA_24766
ttttnttttnggaaaagggggtttgtnccacccggcattacgatgttctaagtttggttagcgngccttcncctttagnacttagagatatcccaggagcttgtttttttttgtttttcgaaaaaggggttgtttcnaccggccattaggatgttctagttggttagcgtgcttctccttagactttagagagatcccggcgcgcgttttttttgttttcgaaaagggggttgttcaccggcattacgatgttctagttggttagcgtgcttctccttagacttagagatattccagagctgtttttttgttttcgaaaagggggttgttcaccggcattaggatgttctagttggttagcgtgcttctccttagacttagagatattccagagctgttttttttgttttcgagaagggggttgttcaccggcattaggatgttctagttggttagcgtccttctccttagacttagagatattccagagctgttttttttttgttttcgaaaagggggggggtcac

SEQ ID NO: 24767 - DNA, 558 bp, Triticum aestivum
  Clone ID: PAT_TA_24767
cgcgtccaatccaatcgacctgggcgaacagccctaccgacaggcgacagcgccgccgccggcgaatcccttcatcctctgcctcgatcgctccctttatcctctgcctcgatcgctccctcccatgttgcctccttgtcccgctgttctatgccagccgacgaattcctccagcgcatgcacacgggaaagagatcacttgggggtggacctccccccttctaggattggcgcgggaggggggcggctcacgcgtgttggtggtcccgtggtgctccgcgtggccacgctgcacgcgctcccgcctcttggcgcggcgtcattgccgttcgctccccccagctcatcccgggttcgattggcctggcgcgctcgaccgagcctccgtgccccattcgcgcacggtggcgcccccccgagcacctcgccgcgcctacgcccccgtgtgccttcggcggggccgccctgggccccccgattgcaacccttccaaggtttcaaggtgagaacataattctcgaaacggaggaggttcaattggtgttcctggagatgaca

SEQ ID NO: 24768 - DNA, 342 bp, Triticum aestivum
  Clone ID: PAT_TA_24768
ctgaagaagaggctaagctcatcgggtccttcggcagcccggccgtgcaccgcgtcgaggtggccctgcggctcaagggcgtcccctacgagttcatccaggaggacctcaacagcaagagcgacctgctgcaggagcacaaccccgtccaccacaaggtgccggtgctcctccacggcggccgccggccggccctctgcgagtcgctcgtcatcgtcgagtacgtggacgaggccttcccccgtggccccccgccccgcccgccccccccactcgaccgcgccgccgcccgcttctgggcccgcttcatcgacgacaagtgcggggtgtgcacgtggtggg

SEQ ID NO: 24769 - DNA, 1083 bp, Triticum aestivum
  unsure (1)..(1083): unsure at all n locations
  Clone ID: PAT_TA_24769
cggncgcgtgggtccccctgctcctcaccgtcctggcgatggcctcctccaccaccgcctccgtcgccgcggcgtccctccgcgcgctcgccggcgcctccccggcccgctcgccccgctcgcctcctccgactcctttttcgaaacctccgcggccgtcgacgtagccgagccggaggacgaggctctggaggccgccgcggaggaggagccggccgtggtggaggaggatgaggaggatgtggcagcggaggaggaggtggtcggggagtacgtggagccgccggaggaggccaaggtgtacgtcggcaacctgccctacgacgtcgacagcgagcgcctcgcgcagctcttcgagcaggccggcgtcgtcgaggtctccgaggtcatttacaacagggnaaacagaccagagccgtggatttgggtttgtcaccatgagtaccattgaagaggctgagaaggccgtggagatgttccatcgctatgacgtgaatgggcggctgtgtgggcgtaaacgtgggcgctccgcgtggggcccgggtggaaaggcctccccgtgattccggctcttcattcaggatctatgtgggcaacctgccatggcaagtggacgactctaggttggtggagctgttcagcgagcatggcaaagtggtcgatgctagggtcgtctacgacagagacactgggcgctcacggggatttggtttcgtgacaatggcgtcgcaggaggagctggatgatgccatcgctgccctcgatggacagagcttggaggggcgtgccctaagggtgaacgtcgcagaggagcggccacctaggaggttctaatgaaggtgtatttggcggtggactacgacaagattgctgcgtaagagacacgatagcacgcctgataccggcttagaccccccatcatcctcccatccatccttgtgtcatgtcttgtctactctctccagtgtttttctcttttgctatctgcctcttgcttccacgttctcaatctgtcgatgcaattcaaaagttttgtctgacatactacgtatatttaaagccccatgggtgtggtgttacccc

SEQ ID NO: 24770 - DNA, 2260 bp, Triticum aestivum
  Clone ID: PAT_TA_24770
caagttccattggtcaaaggcaacaatttcttccgtgacatccaccaactcctccgcctcaatctccttgtactccgcctcttcttccttgtcgctctcctccccgcctctcagctccatcctgtatgatcgctcctcctcgtgcagctgcttccacttggccacccatccttgccattcctcttgaagctgcgtccgtctcttgcgctcttgctcacccacctggttggacacgtccagatcctcttgttcatacttcttgctgtaccgcttgaggttctttgagatgtcctcctccttctcaggagtaagtagagatggtggccttgggcgccattggaactgatagaagtgatcctttgaaatcttgtaaattagcttcccattgaaggaccaaatttggaaaccattttccatctcatgaaccgacgtaactgcagttgcgagaaatcttccagtaggatcccacatgatgtcagtcgccataaaatgttctcctgtcgccatggtctcaagatcatcaacgttgaagaactccagctggccattgaaacccttcagccctgccagaacaatgaaacgcccagcaggagaccagaacaatgcattggcctgcttgcccttgagtgtggtgagcttggacacacgactaacattattgttgactgctttcatggtgtagaaacttatatcaggcttaggcccatcaccatgaataacagcaaagcggtgacctttaggctcccatgcaaaggcaattatcttgtcattcttgttttccaattcaaagacctcaattgggatgtcccgttccttgattctgaacagctcgaacccagtgtaaatgctcttctttgttttggtgtacctgtctacctggacagccagatattctccattgttctgccagtacattttgcagtcgctaacactgaaaaggtttttctgccgaatctcctctttgcccggaatttgcacaagactcaccctggcaggctggtttccaccacctaattcaggcacaaagagtgatatgataggatcagtaggagaccaactgaagtcaaccacattttctacctttagggacttcttatcaataagagagaacgtatcagtctcatagacagatataacattctttccaagcctagcaaaatacttatcatctcttccaccaccccacctgaagataggccatgaaacaccagagacacccatatttccaccagtagtgaaatcatcagcacttcccttgaagtcccgcatcacttttccagtgcgtacatcaaagatatttagtacgaccctatgtgtgtccctagggttgctgggctcctggctgctgtaagtgatcaaatatttctcaccaggagagaaatcaatgagtttcacctgtggatgagcaaagcgcattagacgaacaaacttatcatcaccaccccacacctgcgcgccctgcctatgcacggtagccaagtgtgttccaagaggggaccattggatataactatccgtccagtactgcttttggtacacaagctcaggcattgcccgtctggcgtcgttccagtacacttcagtgaacgttccagcacggatcacaaactgatctctggccttatcatcagttagccacttcagaagattttctccaggagtgtatggcttgatttcagccggcgcccattcatcaggaactttcatgtacttctcaaagtcatcaaacatattaacagcaaatatgtgagatttgtccagtttgtagccatttgttttttccctagcaagctcagcttcctgcggagtgttatattcaatgaagcagtagccgtaggtcttcttggtctctgggtgtgtaggcatccaaagcccaccttctttgatgacaccaatttgactgtatatcttgcgtacaacgttctccagcttctcatacttttctgggggaacaaccggcagattgtccaccacaataatgtttgaaaagcccatctcaagctctggaatgtcttcattctgaagtaaatcctcatcatcactgaggatgtcgaagtcctcgccgggcgggagggtgatggagtcgacgtcgacggagtcgagatcgatccccagctcccgcgcgcgcgcatctatggcttccatcgagatcgctagcgccatcttcgttcctcatcgcgagtgggtgggtttggggggcgcccgcgggcgcgggcgggggggtggctgctgacctcgtcctaggacgccgcacgcgtgg

SEQ ID NO: 24771 - DNA, 2098 bp, Triticum aestivum
  unsure (1)..(2098): unsure at all n locations
  Clone ID: PAT_TA_24771
cccanaaatcccttatcccctctccccgctgctcctcgactgtccatggcgatggcctcctccaccaccgcctccgtcgccgcggcgtccctccgcgcgctcgccggcgcctccccggccccgcccccgaagccgttcctcgtgctgctctccccggcgcccccgcgccgcctcggcctcggcctccgcgccgcccgcccgcgcggcccgctcgccccgctcgcctcctccgactcctttttcgagacctccgcggccgtcgacgtcgccgagccggaggacgaggctctcgtcgcggaggaggagccggccgtggtcgaggaggaggaggatgtggcagcggaggaggaggtggggaggtcggggagtacgtggagccgccggaggaggccaaggtgtacgtcggcaacctgccctacgacgtggacagcgagcgcctcgcgcagctcttcgagcaggccggcgtcgtcgaggtctccgaggtcatttacaacagggaaacagaccagagccgtggatttgggtttgtcaccatgagtaccattgaggaggctgagaaggccgtggagatgttccatcgctatgacgtgaacgggaggctgtctccgcggtttttctcttttactcctttatctccttcacttgacaaacaacttgatttgcactcgaccacaaagtttgatctccttagaaatggacgggtggagtataggtcaagtgatcattgcaactagcacaaaccacaaaataaggtctccctagacatgaacggggcattcatgcaaaatgtaatcgctgtacacgaacgacagaaaatccactttcaggtaccatgcaacacgacagcgctttactcgtcattcaactcctgatcactctccaggacagcgacttctaccggcgcctcgtgcgattcctctccctctctcgccctgtggcacccctttcctctgtggcagcaatcctctccgccgcttcagtttccttgtgcttcgcctcttcttcctttgcgcccgcttccccgcctctcccctccatccgccttcctcgttcctccgcgtccggctgcttccctctggccagccctcctcgtcatacccgttgaggccccgttggtcacgtgtgctcgatctaacccccttggattgttaggtctataccctcgtgtctatagatcatgctgagaaggtggcggtgctttgcgatggcttctgccgtctcggggcgacggagggatgtaaacaaggtacctcctagaggcgcccgggtggaaagcctttcccatgatgtgaggtcgtcatccaggaaatacgtgggcaagctgccattggaagtggacatctctaggttcgaagagctgtgcagcgaggacggcaaagttgtcgatgccagggttgtctacgacagagacactgggcgctcacggggatttggtttcgtgacaatggcatcgcagccggaacttgatgatgccatcgctgccctcagatggacagaggcttggaggggcgtgctctgcgggtgaacgtctgcggaggagcggccaccgcggaggttctaatgaaggtgtatttgatggtggaactacgacaagattgctgcgtaagagacacgatagctctcccagtgacgtatctgagcctcctttcattcctgtgtcatgtctgtcttctcttctctcttcagtgtttttctctcttgctatctgcctgttgattccttgttttctttctgtcgatgcaattcaaaacttcttctatcatacttcgttcttccagcaccctttacagtcagcaacgctgaaaggtttttctgccgaatctcctctatgcacgcccaataccggcttagaccccccatccatccttgtgccatgtctgcctcctctctctccagtgtttttctcttttgctatctgcctgttgcttccacgttctcaatctgtcgatgcaattcaaaagttttgtctgacatactacatatgtttaagccccccatatggggtgtgttgccccgagattcgtgctcgcctgatatgcgtaccattgaagaggctgagaaggccgtggagatgttccatcgcttatgacgtggaatg

SEQ ID NO: 24772 - DNA, 536 bp, Triticum aestivum
  Clone ID: PAT_TA_24772
ttttttttttttatttatgtcagcatttcccaagaaaggttcatattgagaggaaggcgccttcccaattggtacatatagttagatgtaaatattttgccaacatgttacacaacctgaaatatacaataacatcatcttacaatagttttatcagatcaaattcccaaagagtgcctataaataaaaattcaaagagaacaaaagacaacaacctttctgcattatgtgtatctgtgtgcttcttgatatataacttaaagtgttagggcaagcataactatagcgccgagcacggtatcaacgaaatatgagttcacaggtccaaagtaggtcctgtgtacaggtctcttctaataacaaagctgtcacagggctggtattcttccagccagacaaattcagactcccttgttcggtcccataaaatgcccgatggggctgattttcggcgtctccggaagtaggagcaatgccttccatcctttgatgagtaaggaggcgacaagatgtccaagatagcacagggagtgatg

SEQ ID NO: 24773 - DNA, 497 bp, Triticum aestivum
  Clone ID: PAT_TA_24773
tttttttttttttttaaggcaatgaatactactttttacatgtccgtctgaaaaccttacaagaagcctgcataaccccagtacaatgcttttgtacagagtgactacaatgcgtagccgaagcctgagctaatactcaacacaaccggatactactacaaatgctacgtagtacattacgtgataacttcatgctcgatcatacggagcttgatggctcctgtctcgagcaatcatcagctaggacgcaaattattcattcttcaggacggcaggcaagccgcacaaggcacatgccccccaagtattattcttgacgcctttgcccaatcattggcaacagcaacaacccaccacgagctagctatcctcgatcaatcatcctcggcgtccgtgcacctggggcccgcggccaccttgcgcccctgcggcgcggcgggggacgccggcggcgagtcgaggcagcgccggagcaggcgcgagacggcggccacgag

SEQ ID NO: 24774 - DNA, 720 bp, Triticum aestivum
  Clone ID: PAT_TA_24774
tttttttttacatacaattttgcagtacatcttttctgagaaaaaacccaaaccaaccaagacaatcttatgttaacgaatatcatcaaagcctagccttaattacaacctaagaagacaaacaagaacgaaactatacaatatcatacccactatgacactttagttacattgcatctgcagaaattcctttttacctcgttttctctttgtaatctagttacaccaaacaatgcaccagctgatggatggtatgaagccaagaagacggcaaagggatgttcgctacagctcgacggacatgtaggtggccgagtagtccggcatccggtgcaggctccggagcacgctctcggcgacctgcttgggtggcggtgtcgcccttgtggaaggcgcccaccagcgcgctgggcagggcacggtcagaagtagacctccctgacgcaccggtcaccgccgttctcgaggaagctctccagggcccagaagcaccgccgcagcaccgcgccgctgccctgctcgtcgttgcggtgctgccgcaccagccgcagaatgtgccgcggagcgttgtgctcggtgagcacggccacgccgcccaccacgtccacgccttcgtccatgagcgtgcagagcgcgcccagtgcggcctcgaccacgtgactgttctcgttgctctataggacgccgaggaggcactcgacggccgccctccaccaggca

SEQ ID NO: 24775 - DNA, 1984 bp, Triticum aestivum
  unsure (1)..(1984): unsure at all n locations
  Clone ID: PAT_TA_24775
ccagngcgattgactttgagagctcgagcgatntgcgcccgggaagcccggggaatttgtctttggggaggtcgaagagttccgggtgatacgnggccccgnggagtccctcttaaaaangggttgttggcttgggggacaaagattgtttaaatnccaaaaggagtgacggttttttcattcttcaaggacttatatcttgccgaaatttcatccttaaggtacttgacttagtcctctggggggggtccccactcacagaaattacaggggtcgactaggcggactggtccgagtgaagagaaaaaaaagccatacggaactcaaaatattttccggagatattcattttcctgaagaggcggataagatattaggtggctgtttgataccgccagaaagacaaaaaaaagattctaaggaatcaaaaaaaaggaaaaattgggtctatgttcaacggaaaaaaattctcaagagcaaggaaaagtattttgtttccgttcgccctacagtggcatatgaaatggacgaaggaagaaatttagcaacacttttcccgcaggatctcttgcaagaagaaaataatctccaaattcgacttgtcaattttatttctcatgaaaatagcaagttaactcaaagaatttatcacacaaatagtcaatttgttagaacttgcttagtagtgaattgggaacaagaagaaaaagaaaaggctggtgcttcccttgttgaggtaagagcaaatgatcttattcgcgatttcctaagaattgagttagtcaagtccactatttcgtatacacgaaaaaggtatgataggacaagtgcaggaccgattccccataataggttagatcgcgccaatatcaattctttttattccaaggcgaagattgaatcacttagccaacatccagaagctattggcactttgttgaatcgaaataaagaataccactctttgatgattttgtcggcatccaactgttctcgaattggtttattcaagaattcaaaacatcccaatgcgataaaagaatggaatcctagaattcctattcgagaaatttttgggcccttaggcgctattgtagctagtatatcgcatttttcttcatcttactatttactaacgcataataaaatcctgttaaaaaaatatttgttcgttgacaatttaaaacaaaccttccaagtacttcaagaacttaaatactctttaatagatgaaaataaaaggatttctaatttcgatagtaacataatgttggatccattccttttgaattgtcactttgtccatcatgattcttggggaagagacattggcaataattcaccttggacaatttatttggtgaaaatgtatgtctatttaaatcgcacataaaaaaatccgggtcaaattttcattgtaaatatgaattcctttgttataagagcagctaaaccttatttggccactacaggagcaactgttaatggtcattatggagaaatcctttacaaagggagatatggttaagttaccgttacatatgaaaaatccgagatctagtgacataacgcaagggccttccaaaagtggaacaaaccctgtgggcgcgtgcggttcatcccttggcccccggatctccgaaaggagaattgaggattggaattgagcgtataccaagattccttggggccccttggggatcccttgattggngctgagctaaccataccaaaancctacncctttngttaataaatccaaagtttaccattccaagggtacaattccataataacatatagaattattatacnccaattacatcaaagtgcggttcnccaaaatggatncnaanttttccccctggggnataaacccgcattccaaccggacaacaggcgaacttggtgaacnatcataccggcaatctaatgggaaaacaaggcttcctaataccaaagttcatactgaacagtttcagaa

SEQ ID NO: 24776 - DNA, 504 bp, Triticum aestivum
  unsure (1)..(504): unsure at all n locations
  Clone ID: PAT_TA_24776
acaagaggccaagcaagggagggacggcatgaccacgaccgcggatctgctccgccgctagcctgctacctcgccgccccggccggcgccctcgccgccggccgatccccccaccgtcctccaccgcgccgccccctcctccatggcgtgatccgatgatagcaacgagagcgcgccttcccctgctctccctgacggcgtccgcgcgcggcgggcgcacggcggaggggggcagccgccgggagcggccgccatgtcccccaacctggagggcacgctcaagagcaaggtgccggcgctgctcctccggcgcctcttctngcgcccggggcccccgggataaaggcggcagcaagcagcaacacggccgccaggcgccttcgccttcgccgcctgcgccggcggggaagcggcgggtgttcgtgcanacggagccnggtgcctgctgggcatggacctggacgcggcgacaaccgganacgtcaacgccggcngaagcnggcn

SEQ ID NO: 24777 - DNA, 609 bp, Triticum aestivum
  unsure (1)..(609): unsure at all n locations
  Clone ID: PAT_TA_24777
aatcagggcttctatttcccgtgggtcatattctacttcctctgtcgggaattgtactagatccccattcaaacaattttgggagatgtgtccctcttctccacatgaatagcaagacttagtgcagggtttactcgggccttctttaggcgtgtcctccatctcttccttcatcacaacttcttctaaaacttccaggagggctcctttcattacttctttcttctgctgggatggttcgttgtaccatggggtaaatgtgacactgagcaggatagtgggtagtcccttcacacaagaaacaagtaatctgcctaattgggcattcctcagactaggtgacttccttcacaattagggcattcatccttgggtcctttagggttgtgtcccatttctccacaaagcttgcatgcacatgttcctccatcccctctccagatcgcctctgggtctgggccacattgctgagcctctgctcacccagctggtaccctgcccagcgggttcgcctccccctccattgaccgtttggcaatcctccgctcagtatcacaagctccttcgattcagtgaaacatgctggcctagccttgcaactatgcggnc

SEQ ID NO: 24778 - DNA, 432 bp, Triticum aestivum
  unsure (1)..(432): unsure at all n locations
  Clone ID: PAT_TA_24778
cgggtcgacggggagtcttttgtggactaagttgacaaagcccttcgtacatgtcaacctagtagacccacaagtcagcctccaaatctgtcccaaacagcacacaacccgaaatttctggccagattcaaattaactttaaaactaaacataccttaatttaaatccaatgaaattttacccgcacaaaaacaatgaaatttaaaatatcaaaatccgaaagaaaaaaagtattttggaacaaatgtcatgtttgctatatttttcattttacaacccatttattattacttatagcccatttcttattacttatagcccattttctgggaaaaatgcatccctcctcgtcttgaaagatttccggcccagcagggcatagaaaagcaagtaagcctacgttggttattctgcanaaaaatagctgggcta

SEQ ID NO: 24779 - DNA, 504 bp, Triticum aestivum
  unsure (1)..(504): unsure at all n locations
  Clone ID: PAT_TA_24779
agatagagctacagccttccagcaagaaaaacccaagacacaaaaatcaagaggtgaggtccagccatggagggggcgatggtggagtggtggccatggttcggatcggcggtggcgagcaccatcttcctatggtccatggtgcagaaccacatcccggacgccctccgcctcaacctcgccgctttggccgccaagctcaccgcctacttcaaacccttacctccagttcaccatctccggagaacggcgcccagcgctggaagcgaagcgaactcttcctcgccgtcgaggcctacctgagcgacgcatgtgcccgtcgcgcgcgcaggctcaaagctgagctcggcaaggacagcaagaacatccaaggtctccatcgacgaccacgagggagtcaccgatgacttctccggcgncacgctctggtggcacgcctccaagcaagcgacccaaggncaatgtcatcagtttgtaccctggcgagggacgagaaagcgcttt

SEQ ID NO: 24780 - DNA, 401 bp, Triticum aestivum
  Clone ID: PAT_TA_24780
ccatgagcctcactatgcgctatcctggtgaaactgttgggtgcaacggtgatgggcaagacgagcatgtagaaagagaccacaacagcagcaggataagacatagttgttgaagacttgaaatacacatgaatgtgctggtgtcggtctgctcgccccggactcgggttggccctccccgcccaggcacggtcgggctgctttctggcgctgctctgtggcttcatgtcttgtcatggcggggttgttgccatttactgcacactgagagtgggcgctggctgcccagcgggggggagttattgtaaaaaagaaagtgggtcatgtttctcttattgctctattctgcataaatttataatgcttgtcggtcaaacactagagtagaattttgactttct

SEQ ID NO: 24781 - DNA, 554 bp, Triticum aestivum
  Clone ID: PAT_TA_24781
accaaaataatcaccctacagcaggatgatctgcatatttgcatccaccccccacaggaggacaagcacatattatccgaagtacagcacgtggcagtcgtgacaactacctaaagcaatagtattaatctaactaaactgcatctactacacttccagactaaccaaaggagattcagtacttcatcgccatcgtcctcctccgaaccccacacaaaccccgtcttcaacatgaatgccatccggagcgtcaatccaggcgacaccagcaggatcatgctcgcctgaaccctcgacaccacctgactccggttctatggccgacccttctgtgtcttgaggtacatcacctacataatcagtagccgccaccgagcccatctggatgggcgacctccgctcaaaggattcactcgacagctctgattctgcactgccggccgaatgcgtagctgagaactggttcacactcgccgcaaaagcaacaccttcttcaatgaacctgaaaaccatctggatgggcgacctccgctcaaaggattcactcgacagct

SEQ ID NO: 24782 - DNA, 443 bp, Triticum aestivum
  Clone ID: PAT_TA_24782
gggtcgaccggtatcttaaagtgaccaggcggtggggctctgggccttcttgctatagtgctgcggtgagctgggatggcccgaaccgcttttcccccttcatctcgaatcatctccaaatcctggataaatcaaaccacaaaagaatgtatagcatggggactttggaatataccctcatgtatggcctttctcttagccgcccagattgcccatagcgtgacggatagcttgatgaacagctcatgagataatgactgcatatgtgtaaataaccattgtttcgcattgggttctgaggtggctgcgatttgctgtccaagctcttcatcaaccagcgcccatgtacacctcgacatggtgcaatctactagagagtgcttccatgagtcgggcgccccacatattccacatgcacttgagtcaaacatgtgcctgtgtga

SEQ ID NO: 24783 - DNA, 749 bp, Triticum aestivum
  unsure (1)..(749): unsure at all n locations
  Clone ID: PAT_TA_24783
gccatggtacccctgttggacatcgtatgctcaatataatctctgttttggtttacatgagatgatctcaaacgcatcaaaaatcccgcggagatgatacaggcggatccttccagagaaatcgaaacatcaccaacaagtcccatttctatggccaaaacaaaagttcaggaaagtgtgcatcatctacttgctcctcgtcaccagccacacaaccgagagagatgagcaccggcggcgcggacaagtccggcagcggcggcggaagagctggtgggccggtgaagacgccgtcagacttcctcaagtcgatcaggggccgacccgtcgtcgttaaactcaactcaagcgtcgactaccgaggtattctggcttgtctggatggctatatgaacattgcgatggagcaaaccgaagagtacgtgaacggccaactgaagaacaagtatggtgacgccttcataagaggcaacaacgtcctatacatcagcacgtcgaagcggtccctcaccgacggagcatagcccgagtggagcattcacatcatcatgatgtaatttcaaggtcgttaacccgattattggttgtgatctgactggtgnctgcctttttcaatcttgtacctgttgtctgctgtattgcctgctgacagagacttatctggaaccatttcgatttgatgttatctgcgtttttagcttggaaaaaaaaaaaaaaaaaaaagggcgcgctcgcgatctagaactagt

SEQ ID NO: 24784 - DNA, 759 bp, Triticum aestivum
  Clone ID: PAT_TA_24784
gggccccaggccaaaccctcgcaacctcccagtcccacccacacaaccgagagagatgagcaccggcggcgcggacaagtccggcaccggcggcggcggagctggtgggccggtgaagacgccgtcagacttcctcaagtcgatcaggggccgccccgtcgtcgttaaactcaactcaggcgtcgactaccgaggtattctggcttgtctggatggctatatgaacatcgcgatggagcaaaccgaagagtacgtgaacggccaactggacgaacaaatatggcgacgccttcataagaggcaacaacgtcctatacatcagcacgtcgaagcggcccctcaccgacggagcataggccgagtggagcattcacatcatcatgatgtaatttcaaggtcgttaacccgattattggttgtggtgatctgactggtgctgcctttttcaatcttgtacctgttgtctgctgtattgcctgctgacagagacttatcctggaacctttcgattcgatgttatcttgcgtttttagcttggagatgtttgtggccaagattctgcgatcaggaatatagataagatttgtgtttccatggtcgtgtgctgcttagaacagatattacgtatcttataagacacacccattgtgctaccatcggtgcgtatgtttttgttggcgctttgctagacaaacctacactatgtgtcagccacgacgatattatctcttgcatgcgttttggcataaaaaaaaaaaa

SEQ ID NO: 24785 - DNA, 510 bp, Triticum aestivum
  unsure (1)..(510): unsure at all n locations
  Clone ID: PAT_TA_24785
ctccctaggacgcagccgcccaccgaatcaaatcccgtcgccgggctcgtctgcctcgccgtggccgatgaatgcgtcggctgcggccacgccccctctccaaacggcggcgatgctggagggagcagctcacgctgccaggctcccgaccgaacgcgtcgggtcatctctcctcggggccaacccctcctattcaccgcatctctccctgactccgtctcctccacgagatgtagcaccaccccacgccatggacgcccttgccggctgcatctctccaatgcgccgccactcctatgacaccgccgcccggcagtctccaccaagcaccacgacgggcgtggctctgcacgcgccgtcacctcccctctagatncggcgtcgtcgagggcatatccatccagcaatgcgccgtcactcccctccagattcagccgtcgtcaaggcgtatccatccagcagcgcgcgtcatcccaatcataacgtcaacggcgtcatcgcccaagccaa

SEQ ID NO: 24786 - DNA, 437 bp, Triticum aestivum
  Clone ID: PAT_TA_24786
gatcaattcactgatagtccaccgagatggctaagcggttagtcctctttgtggcggtagtcgtcgccctcgtggctctcaccgtcgctgaaggtgaggccctctgagcaactacagtgtgagcgcgagctccaggagctccaggagcgcgagctcaaggcatgccagcaaggtcatggaccaggcagcttccgagacattagcccccgagtgccacccccgtcgtcggtcagcccggtcgcgggacaatacgagcagcaaatcgtggtgccgcccaagggcggatctttctaccccggcgagaccacgccaccgcagcaaacttcaacaacgtatatttttggggaaatacctgcactactaaaaaggtattacccaagtgtaacttctccgcagcaggttttatactatccaaggccaagcttctcccgcaaccg

SEQ ID NO: 24787 - DNA, 499 bp, Triticum aestivum
  unsure (1)..(499): unsure at all n locations
  Clone ID: PAT_TA_24787
ctcgtgccgaattcggcacgagccgccgcaagccgtccgcctcgctcttctcccgagcctggtcctcatcctctcgcctctctccccccacacagatttagcaatctaggtttagcgcctccgtccatctcgtagctgctgcgatggcgatcaagaggaccaaggccgagaagaagatcgcgtacgaccagaagctctgccagctgctccgaggagtacaccaaggtgctcacgccgttcgcccgacaatgtcggctccaagcagtccaggagatnccgcaagggctccgcggtgactccatccgtgctcatggggcaagaacacctcatccgccgctggcatcaaggtcactccggagaaagaccgggaacaagattccttntantcaacaactcctcgtcngtaagttggctcatcttaacaaggtgactcaaggagtcgccaagaagccgcaanacaggttngtgtcctgtcctgttgggtaattcactgttagtg

SEQ ID NO: 24788 - DNA, 674 bp, Triticum aestivum
  Clone ID: PAT_TA_24788
cccaaacccaacaggcggcgcagcagcatcgccaccaccgtccaaagatggtgaagttcctcaagcccggcaaggccgttatcctcctccagggccggttcgccggccggaaggccgtgatcgtgcgcgttttcgaggagggcacccgtgatcgtccctacgggcactgcctcgtcgcgggcctcgccaagtaccccaagaagtgatccgcaaaggactccgccaaagaagacggccaaagagtcgcgcgtcaagtgcttcatcaagctcgtcaacttcactcacctcatgcccacccgctacaccctcgacgtcgatttcaaggatgtcgccaccggtgggcccgacgcactctctacccacgacaagaaggtcgccgcctgcaagacggccaaagcgcgccttgaggagaggttcaagaccggcaagaacaggtggttctttaccaagctccgcttctagatgctcggcctcccgaatagtcctgctttagctgtcgatttgttgtatccggacacactccatctctgttttccgtattaccatgaatatttcgtgtttagtcctggggctctcagagataaatttgctaagatatgccgttgttgtgttacatgttttcgtgataggtctggttaaaattttgttctgttttaaaaaaaaaaaaaaaaaac

SEQ ID NO: 24789 - DNA, 865 bp, Triticum aestivum
  unsure (1)..(865): unsure at all n locations
  Clone ID: PAT_TA_24789
gaatagagataattcactgacagtccactgaaatggctaagcggttggtcctctttgcgacagtagtcattggcctcgtgtctctcaccgtcgctgaaggtgaggcctctaagcaactacagtgcgagcgcgagctccaggagagttcgcttgaggcatgccggctggtcgtggaccaacagttggccggccggctgccatggagcacggggctccagatgcggtgctgccagcagctccgagatattagtgccaagtgtcgccccgtcgccctcagccaagtcgcaagacaatatgggcaaaccgcggtgccgcccaagggcggatccttctaccatcgcgagaccacgcaactgcagcaactccaacaaggaatatttgggggaacatcttcacaaacagtacaagggtattacccaagtgtaatatctcctcagcaggggtcatattatccaggccaagcttctccacaacagccaggaaaatggcaagaactaggacaagggcaacaatggtactatccaacttctctgcagcagccaggacaagggcaacaagggtactaccgaacttctctgcagcagccaggacaaaggcaacaagggtactaccgaacttctcggcagcagccaggacaagagcaacagataggacaatggcaacaagggtactacccaacttctccacagcacccaggacaagggcaacaaccaggacaagtgcaaaaaaataggacaagggcaacaccaggacaaggggcacaaccaggacaaggggcacaaccagnacaagggcaacaagggtactaccccaacttctctgcaacaggcaggacagggggcacaaccgggacaatgacaacaac

SEQ ID NO: 24790 - DNA, 611 bp, Triticum aestivum
  unsure (1)..(611): unsure at all n locations
  Clone ID: PAT_TA_24790
ccgccgcaagccgtccgcctcgctcttctcccgagcctggtcctcatcctctcgcctctcctccccaacacagatttaacaatctagagttagcgcctccgtccgtctcgtagctgctcagatggcgatcaagaggaccaaggccgagaagaagatcgcgtacgaccagaagctctgccagctgctcgaggagtacaccaaggtgctcatcgccgtcgccgacaatgtcggctccaagcagctccaggagatccgcaagggtctccgcggtgactccatcgtgctcatgggcaagaacaccctcatccgccgctgcatcaaggtgcactccggagaagaccggcaacaaggactccttggagctcaacaactcctcgtcggtaacgttgggctcatctcaacaaagggtgacctcaaaggaggtcgcgaggaggtcgccaagtacaagttggtgtcctgctcgtgttgggctaattgcactgttgatgtggtggtccccctgggaacatggtctggttcctcccaagaagtccttcttcaagtgctaacattccaacaaagataacaagggtacgtggaaattacaaccagtgantaatcagaaaggngaa

SEQ ID NO: 24791 - DNA, 539 bp, Triticum aestivum
  Clone ID: PAT_TA_24791
gccggccgggccgggacccatctaccatagaacccagctccaaggctttcacattctaccatacaatcctcttcatccttcacaaggaaccgccatgggtctgtccgcgaaggtcttcgtggtcctcctgctgcttctcgtcgccacggaggagcaggggggatcggtgcaggtggctctggcgagggattgcgagtcggatagccacaagttccatggggcgtgcttcagcgacaccaactgtgcgaacgtctgccagaccgagggcttcaccgccggcaagtgcgtcggcgtccagcgccactgccactgcaccaaggactgctagatgccttgcctagatggccctggctactttgttctcgcgtactggatgcatgattccctgtgtgtgatattagctgaacgatagtagatctatatatctatgtgtgtatgcgtgtgttgatttgcgagcgctagtcgtcagagatttcatgaatgaataaagggaatcgcatcatcttatgagtgaaaaaaaaaaaaaaaaaaggccccta

SEQ ID NO: 24792 - DNA, 520 bp, Triticum aestivum
  Clone ID: PAT_TA_24792
aggctcagctcctcacattctaccatacaatcctcttcatccttcacaaggaaccgccatgggtctgtccgcgaaggtcttcgtggtcctcctgctgctgctcgtcgccacggaggagcaggggggatcggtgcaggtggctctggcgagggattgcaagtcggatagccacaagttccatggggcgtgcttcagcgacaccaactgcgcgaacgtctgccagaccgagggcttcacccgcggcaagtgcgacggcatccactgccactgcatcaaggactgctagatgcctagatagccctggctagtttgttctcgcgtactagatgcatgattccatgtgatattagctgaacgatggtagatctattatatgtctatgtgcgtatgcgtgcgttgatctgcgagtgctggtcctcggagattgcatgaatgaataaggggaattgcatcatcttgtgagtgagctctgttccatgctttgtgagatcatcgatcaataatttttaaaaaaaaaaaa

SEQ ID NO: 24793 - DNA, 597 bp, Triticum aestivum
  unsure (1)..(597): unsure at all n locations
  Clone ID: PAT_TA_24793
gaattcactaagtgattagcgtggtcgcggccgaggtccgccgcaagccgtccgcctcgctcttctcccgagcctggtcctcatcctctcgcctctctccccccacacaggcttagcaatctagcgttagcgcctccgtccatctcgtagctgcttcgatggcgatcaagaggaccaaggccgagaagaagatcgcgtacgaccaagaagctctgccagctggctcgaggagtacaccaaggtgctcatcgccgtcgccgacaatgtcggctccaagcaagctccaaggaagattccgcaaggggtctccgcggcgactccatcgtgctcatggggcaagaacaccctcatccggccgctgcatcaaggtgcaactccggagaaagaccggcaacaaaggacttccttgaggctcagcaacctcctcgtcggtaacgtttggcctcatcttcacaaagggtgacctcaaggagttcgcgaggaggtcgccaagtacaagttggcgctcctgctcgtgttgggtaattcaccgttgattggtggtccccctggcaacctggctggttctccaaanttcttctcaagtgctaaatccaa

SEQ ID NO: 24794 - DNA, 1570 bp, Triticum aestivum
  Clone ID: PAT_TA_24794
gagatggctaagcggctggtcctctttgcggcagtagtcatcgccctcgtggctctcaccaccgctgaaggtgaggcctctaggcaactacagtgtgagcgcgagctccaggagagctcgcttgaggcatgccggcaggtcgtggaccaacagttggccggtcggctgccatggagcacggggctccagatgcgatgctgccagcagctccgagatgttagcgccaagtgccgctctgtcgccgtcagccaagtcgcaagacaatatgagcaaactgtggtgccgcccaagggcggatccttctaccctggtgagaccacgccactgcagcaactccaacaaggaatattttggggaacatcttcacaaacagtacaagggtattacccaagcgtaacttctcctcggcaggggtcatattatccaggccaagcttctccacaacagccaggacaagggcaacagcctggcaaatggcaagaaccaggacaagggcaacaatggtactacccaacttctctgcagcagccaggacaagggcaacagataggaaaagggaaacaagggtactacccaacttctctgcagcaaccatgacaagggcaacaaggatactatccaacttctctgcagcagccaggacaaggacaacagcaaggacaagggcaacaagggtactacccaacttctctccagcagccaggacaagggcaacaagggcactacccagcttctctgcagcagccaggacaaggacagccaggacaaaggcaacaaccaggacaagggcaacaagggtactatccaacttctccacagcagccaggacaagggcaacaactaggacaagggcaacaagggtactacccaacttctccgcagcagccaggacaagggcaacaaccaggacaagggcaacaagggcactgcccaatgtccccgcagcagacaggacaagcgcaacaactaggacaaggccaacaaataggacaagtgcaacaaccaggacaagggcaacaagggtactacccaacttctctgcagcagcctggacaagggcaacagtcaggacaagggcaacagtcaggacaaggacaccaaccaggacaagggcagcaatcaggacaagagaaacaaggctacgacagcccataccatgttagcgcagagcagcaagcggccagcccaatggtggcaaaggcgcagcagcccgcgacacagctgccgacagtgtgtcggatggaggggggcgacgcattgtcggctagccagtgatagaactctctgcagcttgcatggtgcttgggcatgcatgcaccttatctatccaataaacgtgatgcgtgttcacagtttttcatgtaactagagtaaaacccaataataatgcaaaatgaaaagcttctccagctaaaaaagaacaaaatgggtgttgtatagtatgggttgcatgtctcagctcattgtgttgatgcatattgatgacccacaagtataggggatcaattgtagtcctttcgataagtaagagtgttgaatgcaacaaggagcagaaggaaatgataaaccc

SEQ ID NO: 24795 - DNA, 768 bp, Triticum aestivum
  Clone ID: PAT_TA_24795
gactccacgtccgtccgtatcccacatacccctcccccccaacccacaaccaccggcggcggcgcagcgcagctcgaggaaggaggcgaagatggtgaagttcctgaagcccggcaaggcggtgatcctgctgcagggcaggtacgccgggaagaaggcggtgatcgtgcgcgtgttcgaggagggcacccgcgaccgcccctacgggcactgcctcgtcgccggcctggccaagtacccgaagaaggtgatccgcaaggactcggccaagaagacggccaagaagtcgcgcgtcaaggtgttcctcaagctcgtcaacttcacccacctcatgcccacccgctacaccctcgacgtcgacctcaaggaggtggcctccggggcgcccgactccctcacctccaaggacaagaaggtgggcgccgccaaggccgccaaggccaagctcgaggagaggttcaagaccggcaagaacaggtggttcttcaccaagctccgcttctaggcctgcaggccgaccgcgcagggcgtttctctgccgttactacctgaacccgtttacatttttagctgcttgctcttggtatccgtccctgttttggtaattgcccatgaagactctgtgtttagcgtggatcttatgagatatgatggtgtttcatgtgttgaatcatgtgaagaatagatcttgttggaattttgttctgcgttattacttcgtgatatatggtgtctgttgtgtcctaaaaaaaaaaaaaaaaaaaaaaa

SEQ ID NO: 24796 - DNA, 852 bp, Triticum aestivum
  Clone ID: PAT_TA_24796
ccaagctcgaaattaaccctactaaagggaacaaaagctggagctccaccgcggtggcggccgctctagaactagtggatcccccgggctgcaggaattcggcacgaggcacaaactagagatcaattcaccgacagtccaccgagatgactaagcggttggttctttttgcggcggtagtcgtcgcccttgtggctctcaccgctgctgaaggtgaggcctctgggcaactacagtgtgagcgcgagctccaggagcactcgcttaaggcatgccgacaggtcgtagaccagcagctccgagacgttagccccgagtgccaacccgtcggcggcggcccggtcgcgagacaatatgagcagcaaagtcgtgggtgccgcccaagggtggatctttctaccccggcgagaccacgccaccacagcaactccaacaaagtatactttggggaatacctgcactactaagaaggtattacctaagtgtaacttctccgcaacaggtttcatactatccaggccaagcttcttcgcaacggccaggacaaggacaacaagaatactacctaacttctccgcaacagtcaggacaatggcaacaaccgggacaagggcaatcagggtactacccaacttctccgcagcagtcaggacaaaagcaaccagggtactatccaacttctccatggcagccagaacaattgcaacaaccaacacaagggcaacaaagacagcaaccaggacaagggcagcaactaagacaaggacaacaaggtcagcagtcaggacaagggcaaccaagatactatccaacttcttcgcagcagccaggacaattgcaacaactagcaca

SEQ ID NO: 24797 - DNA, 552 bp, Triticum aestivum
  Clone ID: PAT_TA_24797
cccagctcgaagccgaaggctttcacattctaccatacaatcctcttcatccttcacaagcaaccgccatgggtctgtccgcaaaggtcttcgtggtcctcctgctgctgctcgttgccacggaggagcaggggggttccgtgcaggtggctctggcgagggattgcaagtcggatagccacaagttccatggggcgtgcttcagcgacaccaactgcgcgaacgtctgccagaccgagggcttcaccggcggcaagtgcgacggcatccactgccactgcaccaaggactgctagatgcctagatggccttggctagtttgttctcgcgtactagatgcatgattccatgtgatgttagctgaacgatggtagatctattatatgtctatgtatgtgcgcgcgttgatctgcgagtgctggtcctcggagattgcatgaatgaataaggggaatcacatcatcttgtgagtgagatctgttccctgctttgtgagatcaaaaaaaaaaaaaaaaaaaaaaaaaaaaaaaaaaaaaaaaaaaaaaaaaaaaa

SEQ ID NO: 24798 - DNA, 758 bp, Triticum aestivum
  unsure (1)..(758): unsure at all n locations
  Clone ID: PAT_TA_24798
ggccgggatttcccaggccgcccaatcccacgcatcccactcggcggcggcggcggcggcggagcacgcgaagatggtgaagttcctgaagaccggcaaggcggtgatccttctccagggccggttcgccggccggaaggcggtcattgtgcgcgttttcgaggagggcacacgcgaccgcccctacggccactgcctcgtcgccggcctagccaagtaccccaagaaggtgatccgcaaggactcggccaagaagacggcgaagaagtcgcgcgtgaagtgcttcctgaagctggtcaacttcacccacatcatgcccacccgctacaccctggacgtcgacttcaaggacgtcgcctccggcgggcccgacgccctcgccacccgcgacaagaaggtcgcctcctgcaaggccgccaaggcacgtctcgaggagaggttcaagaccggcaagaacaggtggttcttcaccaagctccgcttctaggagcagagcgtctttacaatacttattagtagttccttgttcttgcaatcaatagcacactgagctatctctatcactgtttttgtattgtccatgaggattttgtggttagtatggatctcggagagagtttaattaaggcatgatgatgatgatgttccatgtgttaaatcatgctaaatgatgcacatggttgcaattttgttaaaaaaaaaaaaaaaaaaaaaaactccaggggggggcccgtnccccantcccccctanangtgag

SEQ ID NO: 24799 - DNA, 737 bp, Triticum aestivum
  Clone ID: PAT_TA_24799
aagctcctcccgtccaatctatccccatttcccagaccacccaaacccacacaacccactcggcggcggcgacggcggcggcggcggagcacgcgaagatggtgaagttcctgaagccgggcaaggcggtgatccttctccagggtcggttcgccggccggaaggcggtcattgtgcgcgttttcgaggagggcacgcgcgaccgcccctacggccactgcctcgtcgccggcctagccaagtaccccaagaaggtgatccgtaaggactcggccaagaagacggcgaagaagtcgcgcgtgaagtgcttcctgaagctggtcaacttcacccacatcatgcccacccgctacaccctggatgtcgacttcaaggacgtggcctccggcgggcccgacgccctcgccacccgcgacaagaaggtcgcctcctgcaaggccgccaaggcacgtctcgaggagaggttcaagaccggcaagaacaggtggttcttcaccaagctccgcttctaggagcagagcgtctttacaatactagtattccttgttcttgcaatcaatagcacactgagctatctctatcactgtttttgtattgtccatgaggattttgtggttagtatggatctcggagagagtttaattaaggcatgatgatgatgatgatgttccatgtgttaaatcatgctaaagaatgcacatggttgcaattttgttggatcttaaaaaaaaaaaaaa

SEQ ID NO: 24800 - DNA, 715 bp, Triticum aestivum
  Clone ID: PAT_TA_24800
ttttccagaccaacccaccaacccactcggcggcggcggagcacgcgaagatggtgaagttcctgaagcccggcaaggcggtgatccttctccagggtcggttcgccggccggaaggcggtcattgtgcgcgttttcgaggagggcacacgcgaccgcccctacggccactgcctcgtcgccggcctagccaagtaccccaagaaggtgatccgcaaggactcggccaagaagacggccaagaagtcgcgcgtgaagtgcttcctgaagctggtcaacttcacccacatcatgcccacccgctacaccctcaacgtcgacttcaaggacgtcgcctccggcgggcccgacgccctcgccacccgcgacaagaaggtcgcctcctgcaaggccgccaaggcacgtctcgaggagaggttcaagaccggcaagaacaggtggttcttcaccaagctccgcttctaggagcagagtctttacaatactagtagttccttgttcttgcaatcaatagcacactgaactatctctatcactgtttttgtattgtccatgaggattttgtggttagtatggatctcggagagagtttaattaaggcatgacgatgatgatgttccatgtgttaaatcaagctaatggttgcacatggttgcgattttgttagagcttactccctgtgctgtttattcccccaattcttgtaactatattgt

SEQ ID NO: 24801 - DNA, 830 bp, Triticum aestivum
  Clone ID: PAT_TA_24801
cgtccgccgagcaccacaaactagagatcaattcactgatagtccaccgagatggctaagcggttagtcctctttgtggcggtagtcgtcgccctcgtggctctcaccgtcgctgaaggtgaggcctctgagcaactacagtgtgagcgcgagctccaggagctccaggagccgcgagctcaaggcatgccaagcaggtcatggaccaacaagctccgagacattagccccgaagtgccaccccgtcgtccgtcagcccgggtcgcgggggacaatacgaagcaagcaaatccgtggtgcccgcccaaagggcggatctttctaccccgggcgagaccacgccaccggcaagcaactccaacaacgtatattttggggaataacctgcactactaaaaaaggtattacccaagtgtaacttggtccgcagcaggtttcatactatccaggccaagcttctccgcaacggccaggacaaggtcagcagccaggacaaggacaacaagggtactacccaacttctccgcaacagccaggacaatggcaacaaccggaacaagggcaaccaaggtactacccaacttctccgcagcagtcaggacaattgcaacaaccagcacaagggcagcaaccaggacaagggcaacaaggtcagcagccaggacaagggcaaccagggtactacccaacttcttcgcagctgcagccaggacaattgcaacaaccagcacaagggcaacaagggcagcaaccaggacaagggcaacaaggtcaacagccaggacaagggcaacaaccaggacaaggacaacaaggtcaacagccaggac

SEQ ID NO: 24802 - DNA, 1425 bp, Triticum aestivum
  unsure (1)..(1425): unsure at all n locations
  Clone ID: PAT_TA_24802
gaccgagcaccacaaactagagatcaattcactgatagtccaccgagatggctaagcggttagtcctctttgtggcggtagtcgtcgccctcgtggctctcaccgtcgctgaaggtgaggcctctgagcaactacagtgtgagcgcgagctccaggagctccaggagcgcgagctcaaggcatgccagcaggtcatggaccagcagctccgagacattagccccgagtgccaccccgtcgtcgtcagcccggtcgcgggacaatacgagcagcaaatcgtggtgccgcgccaagggcggatctttctaccccggcgagaccacgccaccgcagcaactccaacaacgtatattttggggaatacctgcactactaaaaaggtattacccaagtgtaacttctccgcagcaggtttcatactatccaggccaagcttctccgcaacggccaggacaaggtcagcagccaggacaagggcaacaatcaggacaaggacaacaagggtactacccaacttctccgcaacagccaggacaatggcaacaaccggaacaaggggcaacccagggtactacccaacttctccgcagcagccaggacaattgcaacaaccagcacaagggcagcaaaccaggacaaggacaacaaggtcggcagccaggacaagggcaaccagggtactacccaacttattcgcagctgcagccaggacaagggcagcaaccagcacaagggcaacaaggtcagcagccaggacaagggcaacaaggtcagcagccaggacaagggcagcaaccgggacaagggcagccatggtactacccaacttctccgcaggagtcaggacaagggcaacagccaggacaatggcaacaaccaggacaatggcaacaaccaggacaagggcaaccagggtactacctaacttctccgttgcagctaggacaagggcaacaagggtactacccaacttctctgcaacaaccaggacaagggcagcaaccaggacaatggcaacaatcgggacaagggcaacatgggtactacccaacttctccgcagctgtcaggacaagggcaacggccaggacaatggctgcaaccaggacaagggcaacaagggtactacccaatttctctgcaacagtcaggacaagggcaacagtcaggacaagggcaacaatcaggacaaggacaccaactaggacaagggcagcaatcaggacaagagcaacaaggctacgacaacccataccatgttaacacagagcagcaaacggccagcccaatggtggcaaaggcgcagcagcccgcgacacagctgccgacagtgtgtcggatggaggggggcgacgcattgtcggctagccagtgatagaactctctgcagcttgcatggtgcttgngcatgcatgcaccttatcta

SEQ ID NO: 24803 - DNA, 1674 bp, Triticum aestivum
  Clone ID: PAT_TA_24803
atggctaagcggttagtcctctttgtggcggtagtcgtcgccctcgtggctctcaccgtcgctgaaggtgaggcctctgagcaactacagtgtgagcgcgagctccaggagctccaggagcgcgagctcaaggcatgccagcaggtcatggaccagcagctccgagacattagccccgagtgccaccccgtcgtcgtcagcccggtcgcgggacaatacgagcagcaaatcgtggtgccgcccaagggcggatctttctaccccggcgagaccacgccaccgcagcaactccaacaacgtatattttggggaatacctgcactactaaaaaggtattacccaagtgtaacttctccgcagcaggtttcatactatccaggccaagcttctccgcaacggccaggacaaggtcagcagccaggacaagggcaacaatcaggacaaggacaacaagggtactacccaacttctccgcaacagccaggacaatggcaacaaccaggacaagggcaacaagggcactacccagcttctctgcagcaaccaggacaacaagggcattacccaacttctctacagcagctaggacaagggcaacaaataggacagccaggacaaaagcaacaaccaggacaagggcaacaaacaggacaagggcaacagccagaacaagagcaacaaccaggacaagggcaacaaggatactatccaacttctctgcagcagccaggacaaggacaacagcaaggacaagggcaacaagggtactacccaacttctctccagcagccaggacaagggcaacaagggcactacccagcttctctgcagcagccaggacaaggacagccaggacaaaggcaacaaccaggacaagggcaacatccagaacaagggcaacaaccaggacaagggcaacaagggtactatccaacttctccacagcagccaggacaagggcaacaactaggacaagggcaacaagggtactacccaacttctccgcagcagccaggacaagggcaacaaccaggacaagggcaacaagggcactgcccaatgtccccgcagcagacaggacaagcgcaacaactaggacaaggccaacaaataggacaagtgcaacaaccaggacaagggcaacaagggtactacccaacttctctgcagcagcctggacaagggcaacagtcaggacaagggcaacagtcaggacaagggcaacagtcaggacaagggcaccaaccaggacaagggcagcaatcaggacaagagaaacaaggctacgacagcccataccatgttagcgcagagcagcaagcggccagcccaatggtggcaaaggcgcagcagcccgcgacacagctgccgacagtgtgtcggatggaggggggcgacgcattgtcggctagccagtgatagaactctctgcagcttgcatggtgcttgggcatgcatgcaccttatctatccaataaacgtgatgcgtgttcacagtttttcatgtaactagagtaaaacccaataataatgcaaaatgaaaagcttctccagctaaaaaagaaaaaaatgggtgttgtatagtatgggttgcatgtctcagctcattgtgttgatgcatattgatgacccacaagtataggggatcaattgttgtcctttcgataagtaaga

SEQ ID NO: 24804 - DNA, 2452 bp, Triticum aestivum
  Clone ID: PAT_TA_24804
acaacaccgagcaccacaaaatagagatcaattcactaacagtccatcgagatggctaagcggttggtcctctttgcgacagtagtcatcaccctcgtggctctcactgctgctgaaggtgaggcctctaggcaactacagtgtgagcgcgagctccaggagagctcgcttgaggcatgccgacaggtcgtggaccaacagttggccggtcggctgccatggagcacggggctccagatgcgatgctgccagcagctccgagatgttagcgctaagtgccgtcccgtcgccgtcagccaagtcgtaagacaatatgagcaaaccgtggtgccgcccaagggcggatccttctaccctggcgagaccacaccactgcagcaactccaacaagtaatattttggggaacatcttcacaaacagtacaagggtattacccaagcgtaagttctcctcagcaggggccatattatccaggccaagcttctccacaacagccaggacaagggcaacagccaggcaaatggcaagaactgggacaagggcaacaagggtactacccaacttctctgcatcagtcaggacaaggacaacaagggtactacccatcttctctgcagcaaccaggacaagggcaacagacaggacaagggcaacaaggatactacccaacttctctgcagcagccaggacaagggcaacagataggacaaggacaacaagggtactacccaacttctccgcagcacccaggacaaaggcaacaaccaggacaagggcagcaaataggacaagggcaacaactaggacaagggcggcaaataggacaagggcaacaatcaggacaagggcaacaagggtactatccaacttctccacagcagctaggacaagggcaacaaccaggacaatggcaacaatcaggacaagggcaacaagggtactacccaacttctcagcagcagccaggacaagggcaacaagggcagtacccagcttctcagcagcagccaggacaagggcaacaagggcagtacccagcttctcagcagcagccaggacaagggcgacaagggcagtacccagcttctcaacagcagccagcacaagggcaacaagggcagtacccagcttctcaacaacagccaggacaagggcaacaagggcactacctagcttctcagcagcagccaggacaagggcaacaacggcactacccagcttctctgcagcaaccaggacaagggcaacaagggcattacacagcttctctgcagcaaccaggacaagggcaacaagggcattacccagcttccctgcagcaggtaggacaaggacaacaaataggacagctaggacaaaggcaacaaccaggacaagggcaacaaacaagacaagggcaacaactagaacaagggcaacaaccaggacaagggcaacaaacaagacaagggcaacaactagaacaagggcaacaaccaggacaagggcaacaaacaagacaagggcaacaactagaacaagggcaacaaccaggacaagggcaacaagggtactatccaacttctccacaacagtcaggacaagggcaacaaccaggacaatcacaacaaccaggacaagggcaacaagggtactacccagcttctctgcaacagccaggacaagggcaacaagggcactacccagcttctctgcagcagccaggacaaggacatccaggacaaaggcaacaaccaggacaagggcaacaaccaaaacaagggcaacaaccaggacaggggcaacaagggtattatccaacttctccgcagcagccaggacaagggaaacaactaggacaagggcaacaagggtactacccaacttctccgcaacagccaggacaagggcaacaaccaggacaagggcaacaagggcactgcccaacttctccgcagcagacaggacaagcgcaacaaccaggacaaggccaacaaataggacaagtgcaacaaccaggacaagggcaacaagggtactacccaatttctctgcaacagtcaggacaagggcaacagtcaggacaagggcaacaatcaggacaaggacaccaactaggacaagggcagcaatcaggacaagagcaacaaggctacgacaacccataccatgttaacacagagcagcaaacggccagcccaaaggtggcaaaggtgcagcaacccgcgacacagctgccgataatgtgtcggatggaggggggcgacgcattgtcggctagccagtgatagaactctctgcaacttgcatggtgcttggtatgcatgcaccttagctatccaataaacatgacgtgtgtgcacaggttttcatgtaactagagtaaaacccaataataatgcaaaatgaaaagcttctccagctaaaaaactaaaaaacgggcgttgtgtagtatgtgttgcatgtctcagc

SEQ ID NO: 24805 - DNA, 748 bp, Triticum aestivum
  Clone ID: PAT_TA_24805
cagcccacaaccccctcccccaaacccaccaccggcggcggcgcggcgcagctcgaggaaggaggcgaagatggtgaagttcttgaagcccggcaaggcggtgatcctgctgcagggcaggtacgccgggaagaaggcggtgatcgtgcgcgtgttcgaggagggcacccgcgaccgcccctacgggcactgcctcgtcgccggcctggccaagtacccgaagaaggtgatccgcaaggactcggccaagaagacggccaagaagtcccgcgtcaaggtgttcctcaagctcgtcaacttcacccacctcatgcccacccgctacaccctcgacgtcgacctcaaggaggtggcctccggcgcgcccgactccctcacctccaaggacaagaaggtgggcgcagccaaggccgccaaggccaagctcgaggagaggttcaagaccggcaagaacaggtggttcttcaccaagctccgcttctaggcctgcaggccgaccgcgcagggcgtttctctgccgttactacctgaacccgtttacatttttagctgcttgctcttggtatccgtccctgttttggtaattgcccatgaagactctgtgtttagcgtggatcttatgagatatgatggtgtttcatgtgttgaatcatgtgaagaatagatctttgttggaattttgttcagcgttattacttcgtgagatatgctgtgctgttgtgtccttaatattattgttttgtaaaaa

SEQ ID NO: 24806 - DNA, 1446 bp, Triticum aestivum
  Clone ID: PAT_TA_24806
cccacaccccaacaacaatttcccgagcaatcacaacaaccatcatcacccacaacaccgagcaccccaatctacagatcaattcactgacagttcactgagatggctaatgcgcctggtcctctttgcggcagtagtcgtcgccctcgtggctctcaccgccgctgaaggtgaggcctctggacaactacaatgtgagcacgatctcgaggcatgccaacaggtggtggaccagcaactccgagacgttagccccgggtgccgccccatcaccgtcaagcccggggcacgagacaatacgagcagcaacctgtggtgccgtccaaggccggatccttctaccccagcgagactacgccttcgcagcaactccaacaaatgatattttggggaatacctgcactactaagaaggtattacccaagtgtaacttcttcgcagcaggggtcatactatccaggccaagcttctccccaacagtcaggacaaggacagcagccatgacggacaagaacagcaaccaggacaagggcaacaagatcagcagccaggacaaagacaacaaggatactacccaacttctccgcaacagccaggacaagggcaacaactgggacaagggcaaccagggtactacccaacttcacagcagccaggacaaaagcagcaggcaggacaagggcaacaatcaggacaaggacaacaagggtactacccaacttccccgcaacagtcaggacaagggcaacaaccgggacaagggcaaccagggtactacccaacttctccgcagcagtcaggacaatggcagcaaccaggacaagggcaacaaccaggacaagggcagcaatcaggacaagggcaacaaggtcagcagccaggacaagggcaacgaccaggacaaggacaacaagggtactacccaatttctccgcagcagccgggacaagggaaacaactaggacaagggcaacaagggtactacccaacttctccgcaacagccaggacaagggcaacaaccaggacaagggcaacaagggcactgcccaacttctccgcagcagacaggacaagcgcaacaaccaggacaaggccaacaaataggacaagtgcaacaatcaggacaaggacaccaactaggacaagggcagcaatcaggacaagagcaacaaggctacgacaacccataccatgttaacacagagcagcaaacggccagcccaaaggtggcaaaggtgcagcaacccgcgacacagctgccgataatgtgtcggatggaggggggcgacgcattgtcggctagccagtgatagaactctctgcaacttgcatggtgcttggtatgcatgcaccttagctatccaataaacatgacgtgtgtgcacaggttttcatgtaactagagtaaaacccaataataatgcaaaataaaagcttctccagc

SEQ ID NO: 24807 - DNA, 1079 bp, Triticum aestivum
  Clone ID: PAT_TA_24807
cgccccttctcatatggactggtcatctgcaatgtctatgacagtgggtcagtcttcagccctgaggttcttgacctcaccgaggaagacctgatggacaagtttgcatctggtgtttccatggttgcttcactgtccctggcgatctcataccccaccatggctgctgcgcctcacatgttcctcaacgcatacaagaatgttcttgcggttgctttggagacagactactcatatgaccatgctgataagatcaaggagtacctcggccgaggtacagccttgtgttgccaccgtaacgatcacgctcatcgtagcccccaacccaccggcggcggcgcagcgcagctcgaggaaggaagcgaagatggtgaagttcctgaagcccggcaaggcggtgatcctgctgcagggcaggtacgcggggaagaaggcggtgatcgtgcgcgtgttcgaggagggcacccgcgaccgcccctacgggcactgcctcgtcgccgggctggccaagtacccgaagaaggtgatccgcaaggactcggccaagaagacggccaagaagtcccgcgtcaaggtgttcctcaagctcgtcaacttcacccacctcatgcccacccgctataccctcgacgtcgacctcaaggaggtggcctccggcgcgcccgactccctcacctccaaggacaagaaggtgggcgccgccaaggccgccaaggccaagctcgaggagaggttcaagaccggcaagaacaggtggttcttcaccaagctccgcttctaggccggccggccgcgccagggcggtctctgccgttattactacccgaaccctttacatttttagttgcttgttatcggtgactgttgctgcgcttaaggtgtcctgttttggtattgcccatgaagaagactctgtgtttagcttggcatcttatgagatatgatgatgtttcatgtgttaaatcatgtgaagaatagatctttgttggaattttgttcagtgttattacttcttgagatatgctgtctgttgcgtcccaaaaaaaaaaaaaaaaaaaaaaaaagtcgacgcggccgcg

SEQ ID NO: 24808 - DNA, 837 bp, Triticum aestivum
  Clone ID: PAT_TA_24808
gccacaacccctccccaacccaccaccggcggcggcgcagcgcgaggaagaggaagcgaagatggtgaagttcctgaagccgggcaaggcggtgatcctgctgcagggcaggtacgccgggaagaaggcggtgatcgtgcgcgtgttcgaggagggcacccgcgaccgcccctacgggcactgcctcgtcgccggcctggccaagtacccgaagaaggtgatccgcaaggactcggccaagaagacggccaagaagtcccgcgtcaaggtgttcctcaagctcgtcaacttcacccacctcatgcccacccgctacaccctcgacgtcgacctcaaggaggtggcctccggcgcgcccgactccctcacctccaaggacaagaaggtgggcgccgccaaggccgccaaggccaagctcgaggagcggttcaagaccggcaagaacaggtggttcttcaccaagctccgcttctaggccagccgtttgaccggtcgcgcagggttgtctctgccgttactactacccgaaccctttacatttttagttgcttgttatcggtgactgttgctgcgcttaagatgtcctgttttggtattgcccatgaagaagactctgtttagtgtggatcttatgagatatgatgatgtttcatgtgttgaatcatgtgaagaatagatctttgttggaattttgttgagcgttattacttcttgagatatgctgtctgttgcgtcctaatattattgttgtatggtttatagtcttggtgaattacgcatctctgttattctgtctgtcaactggttagtgaatgattttggtataaaaaaaaaaaa

SEQ ID NO: 24809 - DNA, 1387 bp, Triticum aestivum
  unsure (1)..(1387): unsure at all n locations
  Clone ID: PAT_TA_24809
aggaattcggcacgagggccgcaagccgtccgcctcgctcttctcccgagcctggtcctcatcctctcgcctctctccccccacacagatttagcaatctaggtttagcgcctccgtccatctcgtagctgctgcgatggcgatcaagaggaccaaggccgagaagaagatcgcgtacgaccagaagctctgccagctgctcgaggagtacaccaaggtgctcatcgccgtcgccgacaatgtcggctccaagcagctccaggagatccgcaagggtctccgcggtgactccatcgtgctcatgggcaagaacaccctcatccgccgctgcatcaaggtgcactcggagaagaccggcaacaaggacttccttgagctcagcaacctcctcgtcggtaacgttggcctcatcttcaccaagggtgacctcaaggaggttcgcgaggaggtcgccaagtacaaggttggtgctcctgctcgtgttgggctagttgcacctgttgatgtggtggttccccctggcaacactggtctggatccctcccagacgtccttcttccaggtgctcaacattcccaccaagattaacaagggcactgtggaaattactatccctgtggagctgataaagaagggtgacaaggtgggctcctctgagtctgccctgcttgccaagcttggtatccgccccttctcttatgggctggtcatctgcaatgtctatgacagcgggtcagtcttcagccctgaggttcttgacctcaccgaggaagacctgatggacaagtttgcttctggtgtgtccatggttgcctcactgtccctggcgatctcataccccaccatggctgctgcgccacacatgttcctcaatgcatacaagaatgttcttgcggttgctttggagacagactactcatatgatcatgctgataagatcaaggagtacctcaaggacccaagcaagtttgccgttgctgcccctgctgctgctgcctccggtggtgctgccgccgctgccccgaaggaggaggagaagaaggacgagcccgaggaggaatcagatggcgagatgggattcagcctgttcgacgactaagctgtgtgccttccttcataaagccgtgtccagtcgccagttttgttaagtgttgaacactgaagtttttcaagtcttattattaccttgaacaagaattaattatgctgtttgttagtgtgtattcgaatatgttaacgttatgttatgcacttagttacttatgcattgctctgctttgtgcttctctcttttatgtttgctgggattcacttcgttagattttaagtaggcttgttcatcgattgcnctgttcagacaggctcattcanccagcaaaagtaatgg

SEQ ID NO: 24810 - DNA, 1479 bp, Triticum aestivum
  unsure (1)..(1479): unsure at all n locations
  Clone ID: PAT_TA_24810
ctactaaagggaacaaaagctggagctccaccgcggtggcggccgctctagaactagtggatcccccgggctgcaggaattcggcacgagggccgccgcaagccgtccgcctcgctcttctcccgagcctggtcctcatcctctcgcctctctccccccacacaggcttagcaatctagcgttagcgcctccgtccatctcgtagctgcttcgatggcgatcaagaggaccaaggccgagaagaagatcgcgtacgaccagaagctctgccagctgctcgaggagtacaccaaggtgctcatcgccgtcgccgacaatgtcggctccaagcagctccaggagatccgcaagggtctccgcggcgactccatcgtgctcatgggcaagaacaccctcatccgccgctgcatcaaggtgcactcggagaagaccggcaacaaggacttccttgagctcagcaacctcctcgtcggtaacgttggcctcatcttcaccaagggtgacctcaaggaggttcgcgaggaggtcgccaagtacaaggttggcgctcctgctcgtgttgggctagttgcacctgttgatgtggtggttccccctggcaacactggtctggatccctcccagacgtccttcttccaggtgcttaacattcccaccaagattaacaagggtactgtggaaattactatcccagtggagctgatcaagaagggtgacaaggtgggctcctctgagtctgccctgcttgccaagcttggtatccgccccttctcatatggactggtcatctgcaatgtctatgacagtgggtctgtcttcagccctgaggttcttgaccttactgaggaagacctgatggacaagtttgcttctggtgtttccatggttgcctcactgtccctggcgatctcataccccaccatggctgctgcgccgcacatgttcctcaacgcatacaagaatgttcttgcggttgctttggagacagactactcatatgaccatgccgataagatcaaggagtacctcaaggacccgagcaagtttgccgttgctgcccctgctgctgctgcctccggtggtgctgccgccgctgcccctaaggaggaggagaagaaggacgagcccgaggaggaatcagatggcgagatgggattcagcctgttcgacgactaagctgtgtgccgtccttcaagtcgccagttttgtttagtgttgaacactaaagttttccaagtcctattattaccttgaacaagaattaattatgctgtttgttagtgtgtatccgaatatgttaacgttatgtcatgcacttagttacctatatgcattgctctgcttgtgcttctctcttttatgtttgctgggattcacttcgttagattttaagtaggcttgtttatcaatgtctccgttcagacagcaaaatantggtatctgtgcaatcagatttaantttaaaggaaannnaaaaaa

SEQ ID NO: 24811 - DNA, 2334 bp, Triticum aestivum
  unsure (1)..(2334): unsure at all n locations
  Clone ID: PAT_TA_24811
agctcgaaattaccctcactaaagggaacaaaagctggagctccaccgcggtggcggccgctctagaactagtggatcccccgggctgcaggaattcggcaccagcgagcaccacaaaatagagatcaattcactgacagtccaccgagcatggctaagcggctggtcctctttgcggcagtagtcatcgccctcgtggctctcaccaccgctgaaggtgaggcctctaggcaactacagtgtgagcgcgagctccaggagagctcgcttgaggcatgccggcaggtcgtggaccaacagttggccggtcggctgccatggagcacggggctccagatgcgatgctgccagcagcttccgaatatgttagcgccaagtgccgctctgtcgccgtcagccaagtcgcaagacaatatgagcaaactgtggtgccgcccaagggcggatccttctaccctggtgagaccacgccactgcagcaactccaacaaggaatattttggggaacatcttcacaaacagtacaagggtattacccaagcgtaacttctcctcggcaggggtcatattatccaggccaagcttctccacaacagccaggacaagggcaacagcctggcaaatggcaagaaccaggacaagggcaacaatggtactacccaacttctctgcagcagccaggacaagggcaacagataggaaaagggaaacaagggtactacccaacttctctgcagcaaccaggacaagggcaacaaataggacaagggcaacaagggtactacccaacttctccgcagcacacaggacaaaggcaacaaccagtacaagggcaacaaataggacaagggcaacaacccagaacaagggcaacaaccaggacaatggcaacaagggtactatccaacttctccacagcagccaggacaagggcaacaaccaggacaagggcaacaagggtactacccaacttctctccagcagccaggacaagggcaacaagggcactacccagcttctctgcagcagccaggacaaggacagccaggacaaaggcaacaaccaggacaagggcaacatccggaacaagggaaacaaccaggacaagggcaacaagggtactatccaacttctccacagcagccaggacaagggcaacaactaggacaagggcaacaagggtactacccaacttctccgcagcagccaggacaagggcaacaaccaggacaagggcaacaagggcactgcccaacgtccccgcagcagtcaggacaagcgcaacaaccaggacaaggccaacaaataggacaagtgcaacaaccaggacaagggcaacaagggtactgtggaaattactatcccagtggagctaatcaagaaaggtgacaaggtgggctcctctgagtctgccctgcttgccaagcttggtatccgccccttctcatatggactggtcatctgcaatgtctatgacagtgggtcagtcttcagccctgaggttcttgacctcaccgaggaagacctgatggacaagtttgcatctggtgtttccatggttgcttcactgtccctggcgatctcataccccaccatggctgctgcgcctcacatgttcctcaacgcatacaagaatgttcttgcggttgctttggagacagactactcatatgaccatgctgataagatcaaggagtacctcaaggaccccagcaagtttgccgttgctgcccctgctgctgctgcctctggtggtgctgccgccgctgcccccaaggaggaggagaagaaggatgagcccgaggaggaatcagatggcgagatgggattcagcctgttcgacgactaagctgtgtgcctatcttcataaagccgtgtcccgttgccagttttgtttagtgttgaacactaaagtttttcagtcctatcattaccttgaacaagaattaattatgctgtttgttagtgtgtatttgaatatggtaacgttatgtcatgcacttagttacttatatgcaccaaaaaaaaaaaaaaaaaaaaaaaaaaaaaaaaaaaaaaaaaaaaaaaaaaaactcgagggggggcccggtncccaattcgccctatagggagtcgtnttacaattnactggccgtcgttttacaacgtcgngactgggaaaaccctggcgttncccaacttaatcgccttgcagcacatccccctttngccagctggcgtaatagcgaaaaggcccgaccgatcgccctttccaacagttgcccaacctgaatggcaaatggcaaattgtaagcgttaaaattttgttaaaattccgttaaaattttgttaaaa

SEQ ID NO: 24812 - DNA, 781 bp, Triticum aestivum
  unsure (1)..(781): unsure at all n locations
  Clone ID: PAT_TA_24812
gccttgttgccgaggcacggggggcttgggtcctgtaccagggctgctggctgagaccccccgccgcccggagccgcctcgtcgtgcgagagcacttcgaggctcgtcccgacgacaccttcctcctcaccttccccaagtgcggcaccacctggctcaaggcccttgccttcacggtgacgaaccgttcctgccacgccgtcaccggcgacggccacccgctgctcagccgccaccctcaggacctccgtgccctttctcgaggcgccctaccgccagctccaccctctcgcggatctcgagaagctcgcctcccccaggctcctctccacccacatgccgctcacgctgctgcctccgtgcatgtccagcctcgggttggccgaattgtgtacctgtgccgcaatcccaaggatgtgttcgtgtcgttatggcagttcatcagcaaggtaaatgcggactacaccatgggacaaagcatttgagttgttttcccgatggtgtgtgcccatatgggccaatctggggacacaaccttgggttctgggaagaaagcatancanagacgacagantctttcttgaaatatgacaagngatggcgaaccgtaaacacgtctgatctcgcaagttctcgtgtcccttatgaggangagtagcncggatctgaggattttgactgttactcaaantaggacgtacgtaannacagatcataanattgnggggcaaggaaacctccantngcggagttgacngaaacacttcgaatgaaactntcc

SEQ ID NO: 24813 - DNA, 681 bp, Triticum aestivum
  unsure (1)..(681): unsure at all n locations
  Clone ID: PAT_TA_24813
cgcactcgccccgtgtgccgtcgtgtgccaccgccaccacccccctactgcctcacgtacccctgttctctcctctcctcaaggaggcggggcggccatggcggcgccgaacgggctggcgcggatcgacacgacgcacccggagaagaaggcggcggcggcggcggccaagcacgagaacgggatctgccacgacgacagctcggcgccggtgcgggcgcaagaacatcgacgagctgcactccatgcagcggaagcgctcggcgcccaccacgcccatcaaggacaccgagcgcctcccccttcgccgtcgccgtctccgacgaggaccgccggaagcagcagctccagtccatcaacgcgtcgttggcgtcgctgacccgtgaaacccgccccctggggccgggcgattcngcaagaaaggcnaggcgccgcaaaacngccggcggcgggcaacgccgcgnactataacacacacacaagtngaccacatanctaggacagcctaagtcaacattctcnaactccgccgggacttncacaagcanaatncaaaggtcntatacgcacgggcctgnacttcgggcaaacgcgtnncaggaaagattaggnaggggggagacccngnggnaggtncaatcaatgcacncttctanaagaagctgaanaacctgagtntna

SEQ ID NO: 24814 - DNA, 773 bp, Triticum aestivum
  Clone ID: PAT_TA_24814
gaattcactagttgcttgcgtggagaattcccttagtgattagggttggcggggccggggggaaaaaagaataatcctctttttttttttttttttttaagcttagcgaagcatcaccaaatacttctttcttacacgtgtccaggtgcatatgagcagatccattgtgttaactcaacaaggtcgtatcttttgacacttttactagattacagaattaattaacagcattaactaaccattcaaccatttaagctgtaacattaagtacaagcccatatgttcgtcactgaccggattgtgcctgagtaaggtcatatgtggagagcgtgccggactggtcaatgtcgagtttgtcaaactcctctagaaaagaagatatgtcctcttggctgatcttccccagttctttgagcttgtacacgacaaattcagcagcacccactttccgatcactatccagatcagctgcttcaagatccatggttgttactctccgtgtgagacctgcccgggcggccgctcgatatccccataagcctgggtagtgattgtggcacagacacaataaaaggagtcaacaaggctcagcttctcaaccttccagagaaaaacagtccccacaacaatggccgtcacaagaagcagagcggccgtgtagaatttgtacctgcccgggcggcagcaaggtacatgaagaacagcgccagaattatggtgctcgtaattatccaaaataccgcgaaagtgcgccccaattggacgagaagctt

SEQ ID NO: 24815 - DNA, 641 bp, Triticum aestivum
  unsure (1)..(641): unsure at all n locations
  Clone ID: PAT_TA_24815
tggtgtttgctgcacacaaatggtgcacacatttgttataagtgtggatagcataattagaaggagtacagacgaaacgaacaagagtgcaccgcactgcgctacagccctgttcgcatcctacaatggacgatccagggtgctacatgattggagcagagctcgctaactgcagccagttcatttctactctgcgctcggaggatatgagatacggagtatcggaggagattttgtagtttgagtatccagccgaccagtgaccaatgagatattacaattttactatccagccgatcaatgagcaatagatatcatggaaataaaaatcatattgtcatatttttcttaaattgtgcagaagctatctgagattacgtgccagatcgaactcgttcccggagtcttggtcttacacgagctggtaatgggtcataagcagcccatagtaaaggccaagcacctgagcaaagtgtctacaaagagacgttacttcgcctatctcagaagatcaacggtaaaggagaagtctatcatggcttagaagcttgcgatcggttccgcgcgtctctcaatcccaggtgtcactatttggctcccatgatcccatcncaaaggccaggaagacccaggaaacaaac

SEQ ID NO: 24816 - DNA, 451 bp, Triticum aestivum
  Clone ID: PAT_TA_24816
aatccgcaaacaacagcatgcatgctatgttgattttcatttcagcagcaacgaggtgttgttattcttcagttatcttgagctactgtagcctacaactacgcttcttcttcttcttcagcgagcgagcgagcgatcggcggccccggccagcaagacgatgtgagtcacaccctgtaaaccatgccgacctcgatgagggaggtgtgggggatgccgagcacgacggcgggcctccgcgagttgcgccggaggtaacccgtacacgacgttgacggcgaacttcttcaccgcggacgacgactcgtgcgcgaacacgcaggtgtgcccgatcatgtacgacaccccggcctcccgctcctccagcagcgccctcacctccaccatcgtctcctccctcctccacgccgccggcagctcctcgaaccgcaccttcttggcgccgccgccg

SEQ ID NO: 24817 - DNA, 527 bp, Triticum aestivum
  unsure (1)..(527): unsure at all n locations
  Clone ID: PAT_TA_24817
taggaagtggcggtgcgtcagacacgaagtgctcaattgttcaagatggatgtgtgttgtggccactccaggttttgaagctgcnacctctcctgctctagggtgagcgcctctcaggttcgacgggctggcgtgcgatgcaagggcgagagggaagggtccctctgtggcgagagaggaggttgcctggagttcttcaccctggggtttacccgggttcatagttacactgttttcgcaggaccttgtcgttctcatgcttgctgctttcctagatgtttgtttgcttgtagtcttcggttagggcaaacaatgatcttttcttttctacatttttccgagcttggtcgctccgttgagttgtaagcttccaagagagttcctatgtatcgttatgccgatgaggtttgtatgtggttgtaattcctggtcgggtgatggctttgttaattcaaagccgggctcttctcgagcccacgtttaaaaaaaaacttactatgtggaaaaaaaaaaaaaaaaaaaaaaaa

SEQ ID NO: 24818 - DNA, 632 bp, Triticum aestivum
  unsure (1)..(632): unsure at all n locations
  Clone ID: PAT_TA_24818
cggagcgccacgccatcccaatccccacagaaatccccatctcaaaaccctagcccgcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctctgcaccggcgaagaagggcgtccggcaagagcggcaagcccgctggcactacaagggcaggccttcccaccgcgtggatccccgacttcaatgtnccaaaggcgggacttaacccggggcaacggaccggcggcgatccatctacggngagaatttcgccgaacgaaatttcgtccacaanacacaacccgggatctctccaatggcaaacgcgggcccaacacaacgtcccatatcttcatctgacgtcccctncattggtccacgnagaactggcttcggcaagtctccaaggatggctcntcaagaatccaaagggggtccgcaacggactgctcaacaagcgtcccccacctggccagcttattggccccgcggtccctctccccccctccccccctctccttcggccccgtgtcntcncctccttgctca

SEQ ID NO: 24819 - DNA, 577 bp, Triticum aestivum
  unsure (1)..(577): unsure at all n locations
  Clone ID: PAT_TA_24819
cttctgttgtcttgttattgattctactatcagttttcgctttcatctgcttcaagagaaaaattaaggctgccgaggacgataatccattcaagaaaatggcgagagccttgatctttgatttgctggcactgcaagaggcaaccggaaacttttcagaggcgaataagcttggagaaggtggttatggaattgtatacaagggaacactgccggatgggcaagaaatagcagttaagaagcttttgggagcaactgagcatggtttgcatcagttgcgcaatgaggtggttctattggcagagcttcagcacaagaatcttgtcagattacaggggttttgctcgcatcaagaatgatacgttgctcgtctacgaatatatcaagaatgggagcctcgacaactttcttttccgataccagtngaggaaaatactctaaactggggagcaacagtacaacatcattcttggaactgccaagggaatactgtaccttcacgaggccccgagcccggggataatccacagggaccttaaagcgaataatattcttcttgacgaggaaatggatccta

SEQ ID NO: 24820 - DNA, 815 bp, Triticum aestivum
  Clone ID: PAT_TA_24820
aactaggaaggggcacactctccatgtctggacatttaatttgccatcagtttggactttggacgacttcgcaatgcccagcacaaatatcagctcagctcctcatcaaggtgaatgggagaaagagctcaggcatcaggcaaaatgcaaccttccagttccaggatttaaatccaagcgacgataacataaacctaaggtttgctttgcattgctaactagtagtggttactacaagcggaagcagtaataagctcatcgactccgggagacacacacaacgcaaactgtcttcatagtaagcttgatctcgcaaatgagctcctctacaggagaacttctttcaccttgccgttcaccacaagcttgcacagcccattgaacgcatcagcatcaaagttgtcatcaaaatctttgcaagtttcagcactgatggactggtcgttgtcagcaatcccaataacctctagataatgtgattcacggccttccgaggcacctctgatggtcaactgatgtccatcagtcgactgcccaacaagaactccaccttgagtgtgttggaacttaagtactgtacgcactctttgcccaacaaacatcttgagagtctctccattgacgattgctgaacgaaatgatgcatccatgtccatgtcgagagaggagatgagcctcgatcaatctgtctacttctgcgcagcccaccccggacggagatggaagccttcgaagtggcgcagcggaggactgccctgctctcggccgcgctggggttctgcacttctgctggattcggaacgggtgagccgggc

SEQ ID NO: 24821 - DNA, 1888 bp, Triticum aestivum
  Clone ID: PAT_TA_24821
ccgccacgcgtccgtccactcgtccgctgacgcgtgggcggacgcgtgggctgcctctttcagggcttaggaggttcaaggtcgggagcgatctgccgttcttgcctatttttggtcttggcgtatccaatatgaagaccagaatggataaaagcatttgcagttggtggaacggtccttgcctttttgaaattctggacaaaatcgaagttcctttgggtgatcccaaaggtccagtaaggctgccaattattgataaatataaagatatgggcacagtcgtaatgggaaaattagagaatgggactatcggttttgccttcttttttttttattttttgagcttttctttcgcagtcactttggcctttggatgacttctcaagtacttcgcaatgcccgacacaaataccagctcaggtcctctgggaggtgaagggggtagagaaccaacccaaaatgaagccttccagttccaggatttaaatccaagcaacgataatataaacctaaggtttgctatgcattgcttactagtagtgattactacaagtgaaggcagtaataagcgagacacacacacacaacacaaactgtcttcatagtgagctttatctcgcaaatctcctcctctacaggaaatcttcgttcaccttgccgttcatcacaagctcgctcgcgttgattggaagcatcagcaaataagtttcacaattcccagttagtaccttccagcattgattgatggtatgctggcagccaatagcattcccgtttaggttaattaaattcttgccaatccgatgcgcatcttaacttatattcatgtccacccggcgattccggaacaacacctccatgttaatttcactgggggttacagtttgttggttatgccaaacaagacccacgtgaaagtcactggtataaacttggatgagaagaaagtaagacgtgctggacccaatgagaatgtaagtgtaaaagtgtctggaattgaagctcaggatatcatgacaggtttcgtacttgcaagtgttgccaatcctattggtgcgttcagtgaatttaaggcccacgtccaccttctggttttgcgggataatgctattttcgaagggaagacaatagctgtaggcaagattgacgctgtgcctccagttggtaagtctacgtattcagcagaagccatttttgacaggatgatgagagaatgaaatggcgctgtcttgaaatagtttttggaaagcagcagtgagatcgattgttcaatgctagtctccctgattcacttaacaatattgttattgctagagaagttctctgaattccctcgagcttggaaggtttaccctacgaaccgaaggtgaggacaatagctgtaggcaaggttgttgatgttcctccagttggcaggtcaacgttttcagcttaagccaattttgacaggatgatgggagaatgaagtggcgctgtctcgaaataggttttggaagcagtaagatcgatttttccagccaggctccatgagtcacttagcattagtttattgctgaggtccctttattgagttggggtgtataagtgttgtagctctggtcacatgtttgagtggttgtaaaatcagtgtggttatatgttcccgctacccaatctgatatgacaatataacacaaggtgtactgtactcccatcttttttcctccacgctacggaaagctgctcccagtttcaaaaaaaaaaaaatgacgcatccatgtccatgtcgagagaggagatgagcctcgatcaatctatctactcctgcacaccccaccccggacgcagacggagatgggagccttcgaagtggcgcagcggaggactgcccacctgcccgggcggccgc

SEQ ID NO: 24822 - DNA, 583 bp, Triticum aestivum
  Clone ID: PAT_TA_24822
tttttttttttttttttttaaacattcagaatccgagcaaagctaattgagtccaaaatggatacatgtccttgaggaaaaaacaaaaatgcaatatggccaacaatcaagtaagattttagcctcaagtgaatggacaacacactttagaaatagtatgaaatggcatctggagcagcatgctgacattgcagattttttatatagtagaacatccacggtaatagtgaaaatcaaagatcagctaacttgatgatactacgtacgatgatagcaaattcacaacattatagacagtaattccgatgatgaagtccagaatacttctaggtagaccctgcagctcggagaagccttcaacacccctttagttaccaagatgacttttgaacaacgccatgtcgcagattggcacaagaggacaaaccgttgaacatgagccatagcgcacgctcatgttataatcttcatcggtcaaaggagcataagttgttaggcgagaaacacagctgcaatctggtttacaaacacctcactgtattcaaacaaaaaacccgtctaacttgttatgaacctcactttt

SEQ ID NO: 24823 - DNA, 942 bp, Triticum aestivum
  unsure (1)..(942): unsure at all n locations
  Clone ID: PAT_TA_24823
cctccccctcgaaaaacgagaaaggctttcatttttttcttccttgaagaaatttcacgtacagctcgcaggttattacacgtacgtgcatgcagtggtcactgcgtgcggcatctctgctacgtaatacatacacatatgcatggtacatctgctactaatcagaagaagctttcttaattaaccaaacacccaatgcctggttgccgacttgcttctcgctacatcatcacactgcattacatattacacggtgaaagagagagcacggagatggagagaaaaacaaatgttggagcaagaaaaaaaagacacttcattcattccctctggttcgtaatctgcctagctaagctagctagtcagtgtctcttggagaggcatgcagcatgcagcagctttgcttggcttctcagctgctgacctcctcctgcatatccgaggagctgccgccgcttgtgacgcagctggaagacgacgacgacggcgatggcggcatcgtgcggcgcgcgtcggtgccgtggatgcccggcgtttgtctgttggacgacgacgacgacctgtccctttgaaagatccgccacactacccactcggaagctccagccctagccaaggagcaacgacagggcgaggcatgactcgtgcatggcccggccggtcgcagctgacgcccgcgcggccttggagcccttgcccttgccacgtcgttgcccgaaggccagggacttcttgacgccgacgaggtggctccggccgcaccgggacaccaccaccggcctctccctcgcgctcgcaggcttccagcacccgctccccgtcgtggtcctgccacccctcttggcgccggcggccggccggaccgcaaagtagtacttctcccctctctcgcgccngggattccaangggtcaagctggggggggccggtaccaatncgccc

SEQ ID NO: 24824 - DNA, 525 bp, Triticum aestivum
  Clone ID: PAT_TA_24824
tttcttttttttgcgggaaattagtacatgtattatttacttttttttaggattttttttttttttttttatttgctatcgccgggtacatgtgttatgtcaacacaaaatattacacacctcatgtataaatacatatacggtgtctaaaatatatataaatacatacgtagcacggtcctgggctgcccactgctcaaacctgggccacacgatcgccccatttggacgggcagaaggggaccacgtactcctgcgcgtagcagcgcgccggggggggggccacgtcgtaggcgtagctgtagtaggccgggcaggcgtccctgaaaatccgcgagtagacgctgccccggcacgtttccgcggggccgtacgccccgcggcagcagaaggcgtccagcccgaaggccaggcacgcgctcctgcacgccaccacctttttgcccgcgccggtcgggacctggcattccggggggcacaccggggtcacgtttttggcccccccggggaagaaacaaccccccc

SEQ ID NO: 24825 - DNA, 1903 bp, Triticum aestivum
  Clone ID: PAT_TA_24825
gatgatgatgccgatgacgactttagtgttgggcccaatgctagggatggcagtgataatggcagtggcactccatgttcatggacgaagcgtgctgtggagattgatagcccacaacttttgtcttctgatcatctagcagaatcacctgatagtacttgtgcgcaggtaattcaccccagatcagggataggcagcaataggtggttgccgactgcaaataaaaggaacatcaataatcaaaaagaaaataatgatgactccatggggaaatacttagaaataggcgctcctagaaattcaagtcttgggtatcaatcttctccaaatgagatgtctgttaatccaacagaaaaacagcatgagaatctcacatcccaaaacaagtcagtaaacaaaatagtcatcgacaaaccaacttgtcaaactgctgatttgattagttcaatagccagaaacacagaatcgaaacaggctgctagaatcactgatgcacctgactgctcctccaagatgccaaacgggaatgaaatgaaaaacgattctcccatcaacatgccatcccaagagctgggtctgaagatatcggaaacaactagatgtgaaactgaaatccatgatgaacgaagtattccgaaaagatcaaatctgtcagcattcaccaggtaccatactcccatggcttccgatcaaggtggggcaacatttcggggaagctgttcacctcaagataacagctcagaggctgtgaaaacgaactccacctgcaagatggagtcaaattcagatgctgctcaaataaagcagggctcaaatggcagtagcaacaacaatgacatgggctccagtaccaagaatgccattgcaaagccttgtacagacagggagagagttatgtcaccatcacttgttaaatcgaaccagcagacttcagcattccatccggtgcagcaccaagtgtcaccagctgacgcggcacgcaaggacaaagcttctgaagaaattgtcaatgcagtgaaagtgggccactcaagcgaggcacagcaaagctctgtgcagcatcaccatcatgcacactattaccgccatgttattgcacagcaacagacattaattgaccgtgcatcaaacgctcggtgtggttcatccaatgcgtctgatttacccctggaaggtcatgctgctaactatggtgtgaacgggagcatctcaggcagcaataatggaagcaatacgcaaaacgcaagtagctccgctcccaatattgcaaggccaaacatggacagtggtgccatggacaaaacagaggctggcggtggcaacggtagtgggagcgggccgagcggtagtggcaatgacatggtatgtcagaatcagctcagccaacgagaagctgcagtgaacaaattcaggcagaagcggaaagagaggaacttcgggaaaaaggtgcggtaccagagcaggaagagactagccgagcagcggccacgtgtccgtgggcaattcgtccgacagtctggacaagaagatgaggcaggccaagcagaagacagatgacgcgaccctcccttctggtccactgtagcgtctgttactacatatacataggttattgactcacattagagtgctcaacaaataaagacccacccgtatgattattgtccctggccggccgactcaagatgaacatttgtaatatctaatctatgtggccatccgtcgtagtaagtacagtaccatgcatgttacccctcgttgtggtttgcgatcttcagttctcctggagagatagatatgcttagtcttactcaagaagagtcttaaggagcaagccagtagccaagttgtcactcatatctgtatatatctatctatatacataatgcatgttcaattattc

SEQ ID NO: 24826 - DNA, 623 bp, Triticum aestivum
  unsure (1)..(623): unsure at all n locations
  Clone ID: PAT_TA_24826
ggcatgccgcaaagaaaaggcctgtgtcaaggagagggtagtagcaccttgctctcctttgccttcagagaaaccggaagcaatggcgtctgctactctcctcaagtcatctttccttcccaagaagtctgaatggggtgccacccgccaggctgccgcccccaagccggtgactgtctccatggttgtccgcgctgggtgcctacgaccatgagcttgtcaaagacccgccgaaaaccattgcatcaccaaggaaaggggtatccctgccatggnatgatcccaacgcgacctgccggtaagaaggcttgcctcaattgggccctgnagaacacccgaggcaaccgccaagccttaccggacctcccttgtcaaccgcaccggccttgggcatattctcccccgcatcctcctttcnagaanccnttccatcaacngttnatgggaagaatttcaaccnccacngacaaaatnttccannacaaggcnaaagctttccctngcgcccaaaacatcaggggcaagctcaaggttctcccaagggaatcaaaagggccctccaatgggnacgttaacaccaaggcacnaanccctaagaggtctggctncccacncatttagaa

SEQ ID NO: 24827 - DNA, 626 bp, Triticum aestivum
  unsure (1)..(626): unsure at all n locations
  Clone ID: PAT_TA_24827
ggcatacaaaaaaccaacccaaccgccgccgcatcgccctcgttagaacgatggccgcgtcggcgctgcaccagaccaccagcttcctcggcaccgcccctcgccgggatgagctcgtccgccgcgtcggcgactccggtggccgcatcaccatgcgccgcaccgtcaagagcgcgccccagagcatctggtatggacctgaccgtcccaagtacctgggcccgttctcgggagcagacgccatcgtacctgaccgggagattcccggggagactacggggggggacacggcggggctatccggccgacccggagacttcgccaaggaacaagggagctggaggtgatccactccccggtgggcgatgctgggggcctgggctgcgtcttcccggggatnccgtcccaagaacgggtgganttncgggaagcgtgtggttcaaagccgggcgccattttctcccaagggggggtccacaccggggaccccacctngtgcagcgcananatctcgccatctgggcgncaagtggtgccaggggccccccgggcgcntcgtgggcccccggganggcntaaangtncaaggnggctnacgtcgctcccgaaaccnaacttncannaag

SEQ ID NO: 24828 - DNA, 618 bp, Triticum aestivum
  unsure (1)..(618): unsure at all n locations
  Clone ID: PAT_TA_24828
ggcggccgtacccttgtgactacacccgcttcgcttcctcccctctctaagccggggaagctaagccatggcgtccgtcaccgcccgcaccccggtcgcagccctccgctcgtcggcgtcgctcaagtctaccttcctagggcaatcctccacccgcctcgcccgcgcaccgactacgaggcgtaatgttcgggcggaggccaagggagagtggctccccggcctcccttctcccacctacctcaacggcagcttgccaaggcgataacgggtccgacccctttgggtctggcgggaggaccccggagaacctgccgtgggtccgtgcaagcggactggtgaacgggcgtgggcgatgctgggggtggcgggatctgctgcctgaagtgctgacgaaattcggttgatctaccccccgcaatggtacaccccgcaagcactactcgcctcctcctncacctgttctcatccattaacctgttccactactggaatccggcggtgaaggatttgactggtggtnacaagaccanctnanagtaactccgcgaaaatgngtacccgganctctnaccctaattnaccacncaagcaaggnaagacncaaggagtggatnt

SEQ ID NO: 24829 - DNA, 579 bp, Triticum aestivum
  unsure (1)..(579): unsure at all n locations
  Clone ID: PAT_TA_24829
ggcatagaagtactcgagcaaagaaggagagagcttggtgagctgcagagatggccccctccgtgatggcgtcgtcggccaccaccgtcgctcccttccaggggctcaagtccaccgccggcatgcccgtcgcccgccgctccggcaactccagcttcggcaacgtcagcaatggcggcaggatcaggtgcatgcaggtgtggccgattgagggcatcaagaattcgagaccctctcctacctgccaccgctcaccgtggaggactcctgaaagcagttgagtacctgctccttccaactgggtgccctgcctccattctagcaaaggtcggctttgtccaaccgttgagaaccacaggcccctggatactaccaacggaagtactggacaatttggaactgccaaggttcggtggaccganccacccaagngctcaaggaccccaggaggcaaaaagggtccccgannattctcnttnaaacggttntnaaactttngaagnaactanaatttaatcctaaaaccccgggtnaaaantcgggggaaaaacctnctcaaaaannccnttaatttccccg

SEQ ID NO: 24830 - DNA, 752 bp, Triticum aestivum
  unsure (1)..(752): unsure at all n locations
  Clone ID: PAT_TA_24830
ggcacgaggcctagctcgctagagaggatggcgcttgctgcccggtcgtctctgcgctccccggtgctgctcgtgtcgcacgggaggccacagctgagctcattcttctcctcctccgccaccgccagaagcgtgccgccgcccatccgaggagctgctactcctccggccgctccagctgtccagaccccagctccgccagatcgttcacgccccaagcaggaagagaccgttcttcacccactcccaggggtgccacgcccatgcccacgcccacctcngagccgttaaagatgttagccgacaaggtttatctgaacgccccagaagatcctagtagtgcacacccaacccctgctcagggctcaatctagcacacttggacctgtatttcaaatctccgaagatcctcgacacgggcttgttgttccgccgggtcgacctccacttccagccgttaaaagtgtagccggcaaggcttatctcgacgcccccgtacctccaccacccaccccgcttctggttatggatcctgcaacccatctcggccactagctgccgccatcctcgcggtccctagacagcggctcccgatccatcgacaacggcgcggaacgcatgacaacggngacnagcctggncaangnaccnaggagcannctaagnacccannttccgacagntnaactaacnaagggccctgttnaggaacatcttgatgcncaantnctggntacnggnnnatgtancnc

SEQ ID NO: 24831 - DNA, 839 bp, Triticum aestivum
  unsure (1)..(839): unsure at all n locations
  Clone ID: PAT_TA_24831
ctgcaggcgaaccagcacggcgcacaaaccctacatccagatccatcccacctctgacctaggctatcatgacttccatcgtctccaagctcgcgcgggcagccgtcgcaacccacgcctcttccgcaccgattggatgtactgctggtggcagtcgctctacggcccggtgtctccctgggctctggctgactggcggtaccatccgacgcatgtgtagaggcgtctctcctgcaggaggtcccaattcagaagaagagaaaggcagacccaactcggaagatgctgtagatgctgcagccatagatcctatagattatctccatgttcaagaggatttcctcaagtcgaaggaagccctgtgggccttgtaagactactggcgcaagtatcatggcatctcgcgggacagaaatgagattgccagacggttcaacatattttgcagaacggcaaggcatgtgcacaaagtcaacaattccggcaagtcattaaagttgacactgaccaagtattcagatcggaccacgcgggagatgtttcgtccaaaacatggccctaaaacttgatctcagcagactcttgtgtcacctgtaagcccgaaatttaagcttcagaataccaagtttcccagacatggcgaaagttctagcattactgtatggtgctttgttgtgtgaacttctttagctatacactggacatgctggtgctgatatggttgtgtattacttcctatnatgtttgcaaaagtttatgtttgtctgttccntttcttgtagtcctgtttcgtcacccgctactattcagggtttttttttgcttttaaaagatatgtt

SEQ ID NO: 24832 - DNA, 649 bp, Triticum aestivum
  unsure (1)..(649): unsure at all n locations
  Clone ID: PAT_TA_24832
ggcataccacaacccacgagcccggcgcgacaccaccgcgcgcgcgtgagccagccacaaacgcccgcggataggcgcgcgcacgccggccaatcctaccacatccccggcctccgcggctcgcgagcgccgctgccatccgatccgctgagttttggctatttatacgtaccgcgggagcctgtgtgcagagcagtgcatctcaagaagtactccgagcaaagaaggagagagcttgggtgagctgcagagatggcccctcccgtgatggcgtccgtcggccaccaccgtccgctcccttccaaggggctcaattccaccgccggcatgcccgtcgccccgccgctcccggcaactccaacttccnggcaacgtcnagcaatgggcggcaggttcaagtgcatgcaggttgtngcccgattntaaggctccaagaattccggacctctcctacctgccacngtcaaccttggagactccctgaacaattgatactgtccttccaanggggcctgctccattaaccaggccgttttcacccttgaccaccccccctgcacacacacgaagtacggncaagttnactgcaatcngggacgancacaangnaaagaccnaggagcaaaggtaccganatctctacacgtca

SEQ ID NO: 24833 - DNA, 382 bp, Triticum aestivum
  Clone ID: PAT_TA_24833
gttgtgtatggtcagtgttgatcctgtgcacgtgactttaatacgatgtgcagagtgttgaatcttggttcgtgcacaggcgagggcagccgttgagcacataattaggcagtttgcatccagaatgaccagcgggctcgggaagttggttgagggttggacgtcccttaatggctctgacagcgacgcggttgcgaggcatttcactccttttgttgcagaatggacacatcggccaactggttgccgtggtcggtacgactacaaaagctcgcaggagctttcggacacacaagatgaactagatggagatgctgctctcgacaaggacgatgacgataacatggagaacgtgcatcatgacaccgaccctgatgaacat

SEQ ID NO: 24834 - DNA, 632 bp, Triticum aestivum
  Clone ID: PAT_TA_24834
ttgcgtctgtttccctttcaagcagcaacatgactatttattcagcagcaccattgttacaacatgacactgtcagaaaacacacagctacctacagagttcctcagacgaggaagaagaaagaaacacaagactcaacgcacgaggagcctaggacgaggtgaacttggtgacggccttggtgccctcggagacggcatgcttggcgagctcgccggggaggacgaggcggacggaggtctggatctcgcgggacgtgatggtgggcttcttgttgtacctcgcgagcttggcggactcgccggcgagcttctcgaagatgtcgttgatgaaggagttcatgatggacatggccttggaggagatgccgatgtcggggtgcacctgcttgagcaccttgaagatgtagatcttgtacgtctccacgctcttcttggccttcttcttccccttcttgtcgccgccctccttggacgccggcaccttcttctccgccttgggcttcttgcccgcgggggtcttctccaccggcttcttctcggcggccttgggtgccatggatgctgcggcggctgctgcttcgagggcgagagaaaagtttggctgggatggagtagcagagcgcctcgtgc

SEQ ID NO: 24835 - DNA, 546 bp, Triticum aestivum
  unsure (1)..(546): unsure at all n locations
  Clone ID: PAT_TA_24835
gtccttctcgcctccctttccccctttgctctgtctcttcttcccctccccacgaacgccgcccagcttcttccccctccgattcttcgtcttcggcgtgcctgctgttcctcctctcgcttcggctcccgcgtcgcaggaaattatatctagtcagtgaccatgaaaacctctggcgaggttcccttttatcactccgttgcccgtgccaaggagctcaaagacagcctcaaggatcaaattcacccaaaggttatgggcacgataggcaatgtcatgaaccccattgaatcggaaagcantgcctccacaaactgggaaggggcatgggaaacaactgggaatgtcgttaacccctcctatcaaaactgtccggggaagaaccgtttgatttttaacgggcggaaagatttctttgatgggtaaaaattcccggatgatatggggagtnaggataacaaaagggaanaangccatttacattagaaccggcngggggtaaanttgcntcattggcggaattgnaaaagntggcatcaanatcaa

SEQ ID NO: 24836 - DNA, 602 bp, Triticum aestivum
  unsure (1)..(602): unsure at all n locations
  Clone ID: PAT_TA_24836
ctctcacaggacgcaacaaccagcccaccgcccccgattgtcgccgtcgtcgggtctctgctctccgtctcccacgggagcctgtgatctgcgccgcactgtgccatgtcgtcgtcgtcgtcgtccaccgcggcggcgggctccgcgctgggcggctcccacgccggcctcgccctcgccgccaccgccatggcgctctccggcaccctcgtgctcttctcgctctgccgcgccaagcagacggaccaccacctcgtctcctccgacgccgccgccacgtccccgtctcccgcccggctccggccctgcctctcctcctccgagaagcggaagcgggagaaaggcgcggcgcgggagcatgaagcgggtgcgcttcgcccgccgactcgttgacaaggccaactcgcccggcgccggaagtggaggaagcggtggcgttcgggccggggccgttctgnagggcccccgatccggcaaccggaagcgtgtacgcgnatctccgcggcgtcatgtnagacgctgtccacaactgccggggtaattaacccgcgttatcanccaaccgttatcggcaagtgnatgcttncttctgtataagtccn

SEQ ID NO: 24837 - DNA, 501 bp, Triticum aestivum
  unsure (1)..(501): unsure at all n locations
  Clone ID: PAT_TA_24837
tttttttttttttttcaggtcacgacacaaatgtctgcactgccttcctttttacggggttgttcagcccctgcacattccaacttaggacggagaaatccataaaacgagacaaacccactcataattgtaccaaccaactgcaaccacgagcagtttacagcaacagaacacattccagcaagacccggatccattcggcttgctggggaccatcaagaacactttccgaaggaacacccccacacaacgcatacaaggacaaacataacagagttggcactaacatcaaggaaactaagttacacaccatcacaaatcaactggccagggaaggcaggtccaagcagggatttnggntgcacctgcccccggcttcaaacccaactttcttttnctgctccgtcaactcccagcaggatccaatgcttccataanttgtcccggcaaaagtgctttaaaattgccctgtcatcccaaaccgccngngcactttggaag

SEQ ID NO: 24838 - DNA, 830 bp, Triticum aestivum
  Clone ID: PAT_TA_24838
ttggttcctttttttttttttttttttttcatgaagccctagatgtgttcttgaatttaattatcactcagtgctcttccttagcagctatgaaatagtcaactttgatttttggacccagaattcatcgttgtcacactgatgtagttctgtactacacggggggcacgcccgttatccgcacaattttccctgcatcctgtacacgtaatgtactcaagttccttctaagatctagccctgcccacaagcgggagacgatcgactttatccaacgggagcgagtctacctgccgcggcatatactcggcctccaccgccacctccagcaccgccaccacgcacgccacgatggacttcctctgtacgcacgccatctcctccccgagggccatcctcggccccgcgtggcacccgatgcgccggaacgggctctccggccggaccggtccctccgccctatccgggtccagccaccgctccggccggtacgcccgcgcgtcctcgccccacaccgactccatccgccccatcgcgtacgctacatccgacacgaaccaccccgcccccaccgcggtgccgtccgggagaacgtccgccgcccgcgcctgcaccgagttcaccggcaccggcgggtacggcgggcgcgcacggcggcgacctcgtcgcggatgcggcgctccacgtccgggcgcgaggacagcagccagaagaaccaggtgagcgcggacgacgtggtctcacggccggcgagcaggaagctgatcaccacgtcgcggagcgccgtctcgtgtagccctcgccctggctcgccatgaaccgcgacagga

SEQ ID NO: 24839 - DNA, 615 bp, Triticum aestivum
  unsure (1)..(615): unsure at all n locations
  Clone ID: PAT_TA_24839
atgactttgtcgagtaatcttttcacatcatacttcgtgtgtccgtggcaacgcacgggcattcaactagtttttttttttagaaaaggaggatgacgggcattcaactagtacacactaaagcacttaataaactagatcaggtactgtagcaacatgtccttttttaacangacggtgagagcagcgaaccgaactataggtatgcaggtttctgatgctcttcccatcggcgcgcttactctttctggttccgattactttgtgcctacctttcccactgctacacttaattctttttaatcattctgtctccgtaaaaatacttcataagtaaagtcgactcaagtatttcatcctaatccgacatatagcccacaaacatgaatagtttccaccctgctttcttaccaagcctagacgtgaagaatactacagagaggatactccaaacaagtggnactccactanagaaaacgcatgtacacctcnttggcctctttcggngtcacattcttatactaagatgggctaagtattaaaattgnnaattctggnnnttatagtcatcagtanatatgaccaattctccaaaaaaataactcgcttnaattt

SEQ ID NO: 24840 - DNA, 513 bp, Triticum aestivum
  unsure (1)..(513): unsure at all n locations
  Clone ID: PAT_TA_24840
tttttttttttttaatcggtgttggatgctttataatataaagtgggggaaaaccctttttcttaattacactttaaaaagcacacctgcctccaggttcagggaattacaaacacaaatctcaacccagattattcgaaaagcatgcaaacacagggactgaaaaattacaaacatttcaaacatcatgccggcaatttggcaatttaccattcgatgttgcacaacatgatcatgccataccgctccttccggttgacagcatcgtaatcttgcatcatgctgcagctcaagactgatgttcagataggctttccaggtgcttatccacgatgtccaaaccacacatttccttcacacacgtcattggcgcagggacgtcaagctggaacgcgatctctgagcttccaaactccttcctcgctgcccggatggcttctctcactgcacaatggacgggggctgcgagaaccaaggcaggttccccanaggctgggtagaagcaccactttc

SEQ ID NO: 24841 - DNA, 661 bp, Triticum aestivum
  unsure (1)..(661): unsure at all n locations
  Clone ID: PAT_TA_24841
tagcgtggtcgcggccgaggtcttttattctgctacacactatctggtaaccgttcctcagattctatatacaaatttcagctgtatgacataaaatatgcatctgagaactgaaatcagaggccgtataaatgttattgagctaacaaaaaccctatatggtggtttcagaacgtttttttcaatagttttgcttgacctgcccttctctggcagaatgactcaatcctatcgcaggcttccagtattacatgaacaggtgccccaaagaatatcctaacccagttcttcaacccaaggacaagaaccaggtaaaataagaactgatccttctttgatcaattccgcgagcaaagtccatgtcatctgcaacgccgaacagaagtgaagtgtttgatttcaaccatcatgaacattgaaccgtgaggctgtgtgtcgcgctgcactcctccggtctgctccgctctgccgtcgacaccgtccgccgctcactccagcaggtgcaccccctgccgtcggaactcctcgggtcccgcctgaaggtccggcggcccggctccctgattcaccgattctggccctggcggctcctcctgtggtctcatgcaaccacgtctgccacccgtgcttgtacccttgaaggccaaagnaaagggcagtt

SEQ ID NO: 24842 - DNA, 728 bp, Triticum aestivum
  Clone ID: PAT_TA_24842
gaattcggcacgagaaaaccccggagaggagcagcgatggcgacgagggtgtgggcggcgtcggcggcggccataaaccccactctcctgcccctctcgtcttccccacgtccgagcaggcccgccccctccacgcggccgcccgggcacctccgcctgcgcagccgcccgccgctgccggccagggtcgtgtgccgccgcgccaagaacgccgccttcgaggactacaagttcccggaccccatccccgagttcgccgagcaggagacgagcaagttcagggagcacatgacgtggcggctggagcagaagaaggagcagtacttcggggagcacgtggaggacatcgtcgacgtctgcaccgaggtcttgggcacgttcttgcaacatgagtactgcggacccgggacgctcctggttcacccattcttggacatgaagggcgagatcaaagagaggggcctccctggcgcgcctcaggccgcacgcgccgccatcgcgtgggctgagaagaacatcgacaaggactggaaggagtggaccggagattattagcgccgatttctttttgccactctttgtctctgttttagcagccgtctgttgtacctgtagtagtttcgatgtttcagtacagacttgggtctagctagattctagactagtcatgttagtccgatctggagcccgtgaaacgcatgaagtgaatttatgctctgaacttgatg

SEQ ID NO: 24843 - DNA, 759 bp, Triticum aestivum
  Clone ID: PAT_TA_24843
ccccgcgtccggctttgcttgcccttgcccccgtcctcccccccgtctcctcatcatcctccccgccgccgccgccgccgccaccgccgccgccgccgccggcggcggcttctccatcaatatcctgccccgtcccccacccccacccccacccccacgacacacgcaccaacagatcagccgtcgaaacttcagtcatgactccgccctcgccttcccttttcctcctggatcccttcgtgggcacgtatctccccggcggcgaaacagccgacaacaagaagactttgctgtcctctggagccaagagggcgttcgggttccctgcggacctcgattgcgatgcgctcatgcggggcctggcgctagaagcagaccttgctggtgcgccagatctgtcccgcctgaccctccgaggcgtccgcccgttctccacttgtatccatgccgtcgacaagaacctgattatcatgataacttcctttcctcaaagtttacccccggggtatctatctcatctacaacgcaattgacagatcgctcctcatgatcccgtctgcgcccagcacacccccttccgtccttacgtcccgtgttcttgtggcgcgccgccgggacgacgacctcagctcctacgccctggtctttcccgggaccgtctacgacataggctgtcctggacggcagcctgttctcttcgtgtcgggatcctcatctaagtctcagtgggagattgcgaagttcactaatttccccgac

SEQ ID NO: 24844 - DNA, 351 bp, Triticum aestivum
  unsure (1)..(351): unsure at all n locations
  Clone ID: PAT_TA_24844
ttcgctgacgtatgttcccttttttaaccaatgggcattcattagagcatacatatatgattgtccagtacataaacgtagttgatcagcacgagccgtgtctcgcagcgttattgtacgaacgtgcatgcgtatacatgaatgagtaagcaaatactgctgcgccactgcacgatacgagacgtacgacggccgacggagggtttaggcgaggaagctgggtgagcctggcgcaggcctcgacgaccctgtcccggctgttgaaggcgctgaccctgacgaagccctcgccgccggggccgaacccgctccccggcacggtgatgacgtgcctcntctccaagggggggn

SEQ ID NO: 24845 - DNA, 1392 bp, Triticum aestivum
  Clone ID: PAT_TA_24845
cccactcgtccgcgggttcatggcgccgttcctgtacccggaacgtggagtgggacttccggctgcagctggtgaagagcctcaacgtgagcgggcacaagtacggcgaggtcaacgccgggatcgggtggtgcatcgggacgagcatggaggacctgccggacgagctcatcttgcacatcaactacctcggcgccgaccagcccaccttaaccctgaactttcgcaacggttccagccaggttatcgcgcagtattaccagctgatcctccatggtttcgaggggtacaggaacatcatgcacaactgccaggagaacgacgtggtgcgacaggaaggcggcgagcgcaagggccggttcggcatctggttctgggggcggggggtggagctgccggccgaccccctctaggacagcagccagcacgacgccgaccagacctccgagttcccccgccgcttcggatggatcgagccagcctatcgccatggctccccagcgaagccgacttaggttcaaggtgcaccggcgccgtctgccgcaactgcctgcagaaccccatggcgccgaagcgcctggtcatagcacatggagacgggtttacccgtcgtgcgacggcctcccgtccggcccgcagggggcccgccctgcagcaccccaacggcgacagcgtcggcgagaaggacctggccaggcagagctcgtgggcctccgcctgggagtggggcgtgcccgcccagtaccaccagccaggcagcccgctgaccggctccgagtcgtcctcctcgcggcctccactcggctccttcgctgagcgcctcgtcattgacaccgaaagggtgctccaccgagctcgacccgctcctcttgcgcaggagctggccccccctgctcgaccccaacggcgacacggtgagcgagaaggacctcgcaagacagcgcggggcggtgtccgtgtcgaagagggccctcgccgccagaaagacgaccaagggcggctgctgtgcggcggacatgcacctctcacctgctgctggcgtttgatgatgctatagctgctgctcgatctttatggttgtattgccgactttaggctgctacctcttctctggcccatcaccactctctatggtatgccactagatatttatggttgtatttcctaatttaagctgctacttctcttgcccgtgatgattttttagaggacggaactaatagttctggctccaatagatcgatcgagtaatacttatgtcatgtatgtgttgaacaacagtactgtacttgcatatttgtacctagcagcaatcatgtctttatttgggtgcctgatattcgatcaaaatcgttgaatctgcataggttcgttgtcgtaactcggaccatg

SEQ ID NO: 24846 - DNA, 1027 bp, Triticum aestivum
  unsure (1)..(1027): unsure at all n locations
  Clone ID: PAT_TA_24846
cccacgcgtccggctagcaccatggcactttgcagagcgcgcagcgggctgctgcttctcggcatggctctgctccctctgggcatggccatggacgccattggcagtaactgcgccgggaccaggtacgctggcagcggcaaggccaacatcgactccgtcctggcggacctcgtcgccaagggctcctcgggaggcttcgccacggccgttgccggcaagggtaatagcgccgtcgtctacggcctcgcgcaatgccgcggcgacgtctccgccagcgactgctcctcctgcctcgcggacgccgccaagcagctccccactgcctgcagctacctatccgacgccagaatatggtacgacttctgcttcatgcggtacgacgacacagacttcgccgggcagtcggacatgggcgccggcgtgatcttggtgaacgtgcaggcggcggacgaccccaagccgttcaagaaggcggtggggaaggtgatgaacaaggcgacggcgcaggcgtcggcgtcgggccgcgcggggctcggcaggtccaaggaccagtacacgccgttcgtcaccatctacggcctggcgcagtgcacgcgggacctcgcgccgctggcgtgcgcgcagtgcgtctcggtggcgctgtccaagttcggcgactactgcggcgcgcagcagggctgccagatcaactacagcagctgcagggtgcgctacgagatctaccccttctacatcccgctggacggcgccggcggccgcgccaccaccgatatgacgaaatacaccaagatcgtcgtgcacgcttgacgtagaggctccttgcacatgtccgacgtgcttcatgccttctcgtacatgatccacgtgtttcgtgcctttggtgttgagatgcaagtgagacgtgatatctgagctgcatgcacttaataagcgggggttatgtaagctgtagccatcgcgtgcagcgattgggaataaaattatgcaccaagaaaaaaaaaaaaaanaactncnaggggggggg

SEQ ID NO: 24847 - DNA, 1617 bp, Triticum aestivum
  Clone ID: PAT_TA_24847
gccaggagcgcgcccccacccgccggcgacggccacatgccgaccgcctcctgcctccgcccgcctctccgcagcggccgctccgccgcggcgggcctcaggttccctcccccggcgcagctctacccggcggggctggcgattgggagctggcggaggaggctcgccggggtcggggtggcggccgcctccgcctcgcccttcgacgagctctacgcgcggggaaggcccatccacggcccctccaagaaatctaccttgtggaatttgatccaagacatagagcctttggatcttagtgtcattcagaaagatgttcctcttgaaacggttgatgcaatgaagaggaccatctctggcatgttgggtctgcttccatctgatcagttccgtgttgttgtagaagccctttggggtccatttttcaagttattggtatcttcaatcatgactgggtatactctacgtaatgctgaatgcaggctctcttttgaaaggaacctagaactttctgaagaagatgctgaatgtgagaaaagagacacgactgaagataatcttcatgatatcaatttgggtaggcctgttacaattttcagattaccggaagacgacatgccccaagacccgggaaaacgtgacgaaggagcatctggtgagactatgggagaaatgtttagtaacttaacaccccaagcagaagccaagattattcggttgcactctcgtttggatcccatgcgaccgcccacgcgtccgctgaagaggaaaaattctgcccttcaaatgcaacagtttgttggggaagagaaaaatgatctgctagactatctaagatccctaacaccagagaaggttgctgaactctcggaatccacctgtcctggtgtgcaagaggctatccagtctgttgtgcatggtttgcttgctactctttcccccaaggtacactcgaagtctcctccaccagtagagaatgctgggggagccctaaattgtgggggtgaggacgatgactgtgcagagcttgtcgagaatacttccctcccgtttcagcccctaatatctgtcccacgtgattatcttgcacgtttgttattctggtgcatgttgctgggtcactacatccgaggtctggaataccggttagagctggcacaccttctcagaatatctagcgacgtggggtctttccccattgatgacgatcattttatttgagaaagcttcgctggcttattgagatccgtcagcgaagaggatgaaaatgcactggccaagaggccgcagaagttgctgtttggggcatttcctgacaatgaaacagggagttctgggccatagctcctgttgtagttcttgtaaagtcggaacgaaggcgttcgggtgtaaagttagtgttacatatcaatgtgaacaatatattttatttccttctatttattgtgtcgtatacaaaataaacatgttgttcttgctgctaatctcgtggtagcatggtggatactgggtattaggcatccgttgtactcataggttgtatgtatttgtctaacgtttatcatgtgaatgatattatattgtcgagtcctataaaaaaacagacgcgtgggtcga

SEQ ID NO: 24848 - DNA, 767 bp, Triticum aestivum
  Clone ID: PAT_TA_24848
tccggccacataaccgagcggcgtcctcatccctttcctcttgctacagtacacacaggagaggcgactcgtttgacgacctcagcgcctgggctaccgccgtcgatctcgtcgggtcccctagcttccgtcgctctcgtgggcgtcgtgaggttagggggccccagatccatgggtgggctgtgtattagcgtatagtttgttggctctgtagctaggcttttgctgtcggggtggactcctaggtgcagcgcttggctctggccgggcggcgagggtggcggagacgcccgcgacttggtgtgcttcgggtgctgcgttgtctcgtcgtcctcgttcatggtggcggcttcaggtcagctgcttgtgtgtgctccgaatcgagcgctcgatctggttcggcgctcgctggcgtcgtccttggctctggcttgggaggcgatggaggagctgcacgcggcttgtgtatgacgagcgcgcgatggatccgaggaagtttccgatgcagagttagctttgggaggaagttttgttgcacactgttcacatgctggtggtacgattggtgctttctgcagtcttattgccaactggacagaagtaacttagcatttgttgggctttatttatccatcaatgccaaaacagtaaggcttagaaaacgaaaaatgaatgcctgtttttaagctctccgttgaagaaaaatccaaatttgaaaaagataatattatttatgaaggtattgtttttggaaccaacaacccacc

SEQ ID NO: 24849 - DNA, 804 bp, Triticum aestivum
  unsure (1)..(804): unsure at all n locations
  Clone ID: PAT_TA_24849
ccatcattggatagttttgtccaaggaagagcgagttttctccaagactatcaattctgtaccagggagaaggagttggcgctagcacactagtatccatcccgaataccatgcaacgggtgttggaatatgtccggagagtgcgaccatgggagactacacctgcttccttagcagtaacatcatcagtgggctgtatacacacgagaagaggtgatccatcggaattagttgccaaggcgccaaatagtatatgggccctgctcgtcctcatgctcgtgatcatcaccatcgtcatctcccccttggttataaaaatcttcaagtataggtgggtggaatgttcacaggaccttgggaaacacaagaagaagttaattaataaggctggccatagtgggggtaacataattagtaccatgcactttggggactccacaaacatgattatgttggcaagcaatttnaggaagagagaatggttatagtaacatangtaatanccgttacatataatgtgatactacaagtgtcatgccatgggcaataatganacaactaatgatactaacccaagatactatgcactatagaggtanttacataactaantacatatgcattttcnaancaaattacccccactatgacaacctgcaactgtatcattggatgaacatttaatncggngaagataactncgaacacaggntcatcaaaacatgcacagtgtganaanaaaggccnctangattnacaataccaccttaacggnttttncataccagatcacntacnngaaan

SEQ ID NO: 24850 - DNA, 1796 bp, Triticum aestivum
  unsure (1)..(1796): unsure at all n locations
  Clone ID: PAT_TA_24850
gagatcccccgaccatgtgcattgctaactatgaagcatcaggcagccaagtgcaaattacactggagagaggcattcctgcaatgattggttcatttgcatcaaagcagcttccatatccctatctttcctttgatatggtgcattgtgcaaaatgcaatattgaatgggacaaaaacgatggcattttcttggttgaagtggacaggcttttgaggcctggtggatactttgtctggacatccactctgcatacacatagggccttgcgtgacaaagaaaatcaaaagacatggacagccatccgcgacttagctaataacctctgttgggagattttgtcacaacaagcaggagactcgtcttgggtcatcgtcggacgcaaggggccgttacagtgctcgggcatctgcgcccggcctaggtcctatgcttggcggctaagctttccaggccaaggttttattgccacctacacacggtgatgaaggcggcaaagttaattttgtagcaaaaccatatctttattaaagggatgatgctgtggcgtacataatcgcggccaatgtctcagagtgaattcagaagtctttgctgaggatacttcatcctgggactccatggtgcgaaggtactggtctttattgtctccacttatattttctgatcatccaaagagacctggtgatgaggagccacatccaccatttaacatgcttaggaatgttctggatatgaatgctcactttggtggatttaatgctgctttactcaagtctggaaaatctgtatgggtgatgaatgttgttcctataaatgccccgaactatctgccgcttatttttgaccgtggatttattggggttcaacatgactggtgtgaagcatttccaacttacccaagaacgtatgatatggtacatgctgatggatttctatcacttgaaaagcgccaaaaacgtagatgttctactcttgacatattcttggaagttgatcgcatcctacgaccagagggctggattataatacgtgacaccgcccctcttattgaagctgcaagatctgttgctgctcagctcagatgggatgcccgtatattggatcttgacatagccagcgatgaaaaactgttggtctgtcagaagccctttctgaaaaaataatgagcataccagacactgacacacgattcagaaattggaattattctttaccccctaaatactgttacaacgtgttacccgagaacaactgggaacaaatttcagttgaaacactggaggaatgggtcagctaactcgtcatgaatcgtcatgggccgcaaggcgccatgagactgatcgggcaagtgcatgctgcagacatgattggcggctaagctttccaggccaaggttttactgccaggacacggtgatgaaggcggcaaattatttttgtagcaaaaccatatatttaataaagggatgatgctgcggcgtacataatcgcagccaatgtgtcatatgggtataattccatttttctccctctccctcattacattctcctcctctgtaatggtgctcattcattcttgtatcttgtatgtaaaatttgttgaaatttatactggtcatccccagattacagtgctgtgaaatcaaggtcaatatttcagatgaatgataggaaagagcaaaacaaaattcttcatattagatgtttccacctgcatttctctttgtgtcgattttgtgcatgtcccacagcatggtatctgtattattcaggaacttcctgncttggacaact

SEQ ID NO: 24851 - DNA, 698 bp, Triticum aestivum
  unsure (1)..(698): unsure at all n locations
  Clone ID: PAT_TA_24851
gcacgagggcaaaatccccaaccggaacagggctgacagcgcgagatcgggcagagagagcgcgacagatggcgatcggcggcgttggcgctgggggcggggctgggggcgccgaggcgcaggggaggagcgtgctggtgaccggcggcgcggggttcatcggcacccacaccgtgctgcagctgctggagaagggctacgccgtcaccgccgtcgacaacttccacaactccgtccccgaggcgctcgaccgcgtccgccacatcgtcggccccgccctctccgcccgcctccaattcatcttcggggacctgacgatcaaggatgacctggagaaggtcttcgccgccaagaagtacgacgccgtgatacacttcgccgggctcaaggcggtggcggagagcgtggcgcacccggagatgtacaaccgcaacaacatcgtcggcaccgtcaacctctacgacgtcatgaagaagcacgggtgcaacaagttggtgttctcgtcgtccgcgaccgtgtacggccagccggagaagggcccccgcctcgagcccccccccccccagcccctcgacccctacggccggaccaagctgccctggcggcggcctccgcgacgacccacccgcccctacccgaccgcgggaacanacggantcggagacccanggttccaaactgnccaatcanagngcttc

SEQ ID NO: 24852 - DNA, 960 bp, Triticum aestivum
  Clone ID: PAT_TA_24852
gggccaccttatccccaggtggagctcgccaagctcttcctccgccgggacatccccgtcgtcatcgccgtcccgacccctccggcctccaccgccgatatcttcgcctcctcagcccccgccgtcgccagcgtggccgccgccaaccccaccatctccttccaccacctcccggcgccggaataccccaacccggacccggacccctacctgcagatggtcgacgcgctccgcctcaccgtgccgtccctcctcgccttcgtccgctccctcccctccgtcgccgcactcgtccttgacaccttctgcgtcgacgccctcgacgccgccgccgaaatcggcgtcccggcgtacctctactacacatcctccgcggccgacctcgcggcgttcctccacctcccccactacctcgccatgacggacggcggcgacttcaaggacatgggcaagcatctcctccgcttccccggcgtcccgccgatccctgcctcggacatgccccagatcgtgcaggaccgcgcgagccggacttgcgccgtgcggatggggcaatacgggcgcaaaccggaggcccggggcttgctcatcaacacctatgagcggctggaggcgagggccgtgagggcgctcagggacggggtgtgtgtccctggccgcccgaccccgccggtgtactgcatcgggccactgatcgtgaaaggcgaggcggcggctccgcgtacgcagaacgcgtgcttgtcttggctggacgcgcagccggagcggagcgtggtgttcctctgcttcggcagcttgggcgcgatgtcggcggcgcagctcaaggagatagcacgcgggctcgagaactccggccaccgcttcctgtgggtcgtgcggagcccgcccgaggacccggccaaatacttcctgccgcgcccagagcctgacctggacgcgctcctcccccgagggttcttg

SEQ ID NO: 24853 - DNA, 758 bp, Triticum aestivum
  Clone ID: PAT_TA_24853
tcgccccgcctttcgtgtatatataggaagggttttagtgtacatatttgccagaaatgggtatttctggcacacctgttggttccatgggtgaggggttgaaggtgttaatagtgtgcctgagtgggtcgggaacttcagaatcggtccacttgaacggttggggaagccctgcactgttactatgtctgtttacacaatgtgtactgtaagcatatgtaactttgttgtcttcttgatgtaagaggagttgtagtaatcgctggttcatttgaaatccattaacatacatgcagcaagcacgtaaattggtgcggcggctgatgtgaatacgattcgttgtattaatgcaatatatgttgactatgggacactgattctgctcaaatctagattctttgtcttcatactgcatataatttacacaatcttcctgactaagctgggaatcaagccttcactgaggcttccacgatggctggggaaagcaacgtctagttgataggtagaatgccaccatactaatttgtagttgaagatttgctcccatggcctttgtaatatgagcattgttgtccggcttcctggtagatgattgtggttttaccgacaagatttttgttggttgtgattctgcattggtggcattgactgatcgacaagtgttgtagaacttgtgagacttgtcgagtatattgcctcggtcacgctttcatttaaactttgatttttgcagtgttctgttaatatatatttag

SEQ ID NO: 24854 - DNA, 536 bp, Triticum aestivum
  Clone ID: PAT_TA_24854
cttcgatcacgaggcactactcgcgctaacagacaggatcggctatgtaagcacagggctgcgcgacgacgagatcgttcgcggccttagggtgggcaaacacctgccgttcgaccgcaagcatttctcaacagagacggagcggagctgcagcatttgccaagaagaatttgaagcgagtgaggaagtagggaggctgagctgcggccacggctaccatgtgcactgcatcaagcagtggctctcccggaagaacgcctgcccactttgcaaggtcgccgtctcaaaaccatgagagtctcctacgccacagtttgtattttctggtagaatacttgtattcatatcatatctgaaagggtggttgttctgtatacgtagttctgcttgtacagccccctctgctgctctgcatatacacatggttgttgtaagaaaagatacacaggcacacatgcatatagaaatgatattcttgtcccaaaaaaaaaaaaaaaaaaaaaaaaaaaaaaaaatttaaaaccaacaaacacccc

SEQ ID NO: 24855 - DNA, 610 bp, Triticum aestivum
  Clone ID: PAT_TA_24855
gccggccgggccgggttcgaacgagactactggttgggaagaatgggcatgtatgatcaatatcaggattggcgccttgacgttgataacatgaattacgaggagctacttgcactcgaggacaggatcggctatgtaagcacagggctgcgcgaagacgagatcgttcgcggccttagggtgggcaaacacctgccgttcgaccgcaagcatttcttaacagagacggagcggagctgcagcatttgtcaagaagagtttgaagcgagtgaggagatagggaggctgagctgcggccacggctaccatgtgcactgcatcaagcagtggctctcccggaagaacgcctgcccactttgcaagaccgccgtctcaaaaccatgagatagatcatacgtagatccatacgccgcccagtttctttttctctggtataatacatgtattcatatcgtatctgaaaggtgtttgttcttgtgcgtagttgtacttgtacagggccctctaccgctctgcatatgcacattgttgatgtaaaaaagatacacaggcacacatgcatatagaaatgatattgtccgcgtaaaaaaaaaaaaaaaaaaggccccta

SEQ ID NO: 24856 - DNA, 709 bp, Triticum aestivum
  Clone ID: PAT_TA_24856
cggcacaggtgctcacacacacacacagagagagacaagagacagcgagtcacagaccgagggagggggagctcagaccaggccagcgggaatcgcgcgcgcgggccgggcgacgactgaggcggagatcccttccgaccggccgccgccgccgctcgtcgacaccgaccaacagagagtttccttcatgtcaatgaccatcaacgggaatcggtagtcgctcccaaggtcagtgtcacgtcgtgcacgtgaaagcgaagccagtttgttggagaattttggcctgccttgtcgatcggacctcaacctctttggactgcgggacgcttcctttccttcttcctcagagcaccaccaagagctttcgcctgtcgtggaggtgcagccaactgacactgtcgtccttgtctgcctgcccgagaacgaaccgacgccggacacgccaggcacacacctgctcactgcctctcgttttcgtcccgatcctgtgcctctcgttttcgtcggcgtcgcactgtcactgttgcgtgcttgcgccttatctctgtctgactccttccttgttcaagtacactactagtgccagcagtggaatttaattatgtagtattccactgagctgagctaatcaaatgtctaaccgtgacacgagctaatcatagagtgtgaaagatttagcgtgttcacacgcacgcaatcttaaaaaaaa

SEQ ID NO: 24857 - DNA, 779 bp, Triticum aestivum
  unsure (1)..(779): unsure at all n locations
  Clone ID: PAT_TA_24857
gcgcggccccgcgcccctgccgccccccctcgcctctcccccccgcgcgcctcctgccccccgcccccccgcccgcggtccggctcgtgccccctgcccccccccgctccccctccccctcgctctctcgcgccgcctcccccccctccccttcccgccatcctgtcccctccccggcctgccctcgccgcccccacgcgccgccccttgcctcccccctcaccggcggtttattggtgcatacgtcctgctcgacgtaatgctcgtgagacgccttttgctaccggtgaagctaactagccagcaccttttcttgggccgggtcatggggggattgattgagcgtccacgagccatcgggcccggtcggagaggaccgttggtgtgggtcacgagggacctcacggatccacgaacaaccccggctttgggccgccgctgccaagggacgggcgcggtgcctccctgtcctcagtatggtggcccggccgaagacggggcgcttcctaccccgggcggctgctccccggtggtggcgtcaatggagtcggcttgcgcaccttgccaagctccctggatggcgctccggctgccccctccgtgctgatgccacctcaagacaacttgccgcgctctgctatgcgtcctttccctcggcgccacacaagtggtctgactcttcgcctcgaccttttcactggtgcggggggacggtnttaaccatggaagttatangaaaaggcttcnttcaacgtcaaatnntgggaaaggnntnaaat

SEQ ID NO: 24858 - DNA, 813 bp, Triticum aestivum
  Clone ID: PAT_TA_24858
gtactggataaggcggccttcggctaaatccccactcctgccatccgctcttgcccggcttctccccacgctcccatggccgccgtttaccccaccacggccgccctcccagcgcgccactcccctccttccttcctccggccgtcgtacctgtcgtggtccgcctccatcacccagcaccgcgtccccttctcaccgcgcctcgctctctcgccgccaccggcggccaatcggcggtcgttcgtgatccgagcggcttggacgcggcggtcgcgcggcgagttggacaagagcccgaaccgcaagtcgtggaagcagcgcacggacatgtacatgcgcccgttcctgctcaacgtcttcttctccaagcgcttcgtccacgccaaggtcatgcaccggggcaccagcaaggtcatcgccgtcgccaccaccaacgccaaggacctcaggaccacgctgccgtccctcatagacgacaacgcctgcaggaccatcggtcgtctcatagccgagaggtccatggacgccgatgtcttcgcaatggcgtacgagcccaagaagaatgagaggatcgaggggaagctcgggattgtcatcgacaccattaaggagtatggcatcatctttgcataggcaagttccagtgtaggagaagaaacagttgttatgtggagtatttctttagtttgatccatgtagctgtttttgttcagcttaaccttatactgatggtgatgattccataataactcttctgcgtgcgttggccttttaaattgggttgcatgctttttagttgttaaaaaaaaaaaa

SEQ ID NO: 24859 - DNA, 623 bp, Triticum aestivum
  Clone ID: PAT_TA_24859
gccgaaaggacgatgataacgatacctctggtgatgttgcaccgggacaaagaggtctggggacccgacgccgacgagtttaacccaatgaggttccagaatggcttcgcgagagccgccaagcattcacatgcactgctggccttctcgtatgggcctagggtctgtgtcgggcagaactttgccatggtggaggtgcagatcgtcatagcgacgatgctcaaaagtttctccttctccctgtcccccacttatgtgcacaagccgagcaatttcctcacattgacgcccaagtacgggctccctctcatcgtgaggaacctgcagctgactaggtgattgtcttgtgacatgacataccggagccatgaccctatagttagatgagacttgggtgtacaaatgtacatccgttatttcgtcaaaaactatctatgcttgggtataattcacatacggaacaatatacatgaaatcgattagaagaacttgagaaaaactgtgtttttatcgcactgtgtaatctattgtttagataccgttatcgcaactgacgggacctgtatattgtgatgtgtcttgtactacaccatactgtactaaataaactaggccactttcgc

SEQ ID NO: 24860 - DNA, 622 bp, Triticum aestivum
  Clone ID: PAT_TA_24860
cgggatagcctaattcatcgtggccgataagaccatcctctccatggcaaggaagcactccttcgaggacgcgccggaccatctcaagaatacctccttcaactaatcagcctataagatatctattattagtactgtaatgttcaggcagcacttatgtgatatcaggcgaggcttgcagacatgcagtggtgtagtaccgcgcttctctgtgcggcagtgaagaaggggaacacgggaggaaggaggcggtcacaccgttaggcgtaccatgcgcaatcgtcgcgctgtagcacttccctttgataatccatgccaagcaaggttcatgcacctggtgagacatgttgtagtaccctgtaattctacaaccacacatcctgattttatgtactactactaggtcaaacaaaaagaaatgggttgggtcatctcttaagaacatctttgcttgtttagtggatgaggggactcgattttccaagccaaacatcttgtcacgaattattataggcttatgaggacgacttgagaatcagaatgtcaagctgaacagctgataacataggtcacttattagaggctacagccaaggaaaagggttgaagtggcaacatcaaca

SEQ ID NO: 24861 - DNA, 1635 bp, Triticum aestivum
  unsure (1)..(1635): unsure at all n locations
  Clone ID: PAT_TA_24861
aaagagccnttggcgncttataggatcttggggcgggccccccgggccccctggggttctggggtgtctctctctcccacgcacgcacttgttgtctttngctacctaatcgaaataacatatctgccgtgtgattgcctatatctcctccgttttttcgttcgtttgacctttccttctgtataaaataatcacaacggattggcgatgagcaaaatatgcagaagtgatcagatatctgattcagctacttgcatcaggctcacacgttcgaaaagaaaaaggaaaattgcttctccgaacataattagatgtgctctgtgtcatctgtatgtatgtatgataatcaggcggctgtgttttcaaaatggttttcccgctgcggcgcatcgaaggacgaacattcctaggcggcgacgccgaccggcgccgccccgacggcggcgaggatcttgtcgtcgaggtcgaaggtcatggccttctctccccggccgctgctcgcgtactcggcgaaccgctccttgaggtcctccggcaggttggtggtgctcgtccatcccagcacctccttggccgcccgaggctccgcgtagaaatgcatgttgcggaaggggaaggccttcttggcgtcgacgccggcggcggccgggtcgtagttgacgatctcgacggtggcgcccgcggccgccgcgcacatcttggccaggccgttgagcgtcacgccgcggtcgctcacgcagttgaagatcttcccggcggcggcgtcggggttgtcgacggcgagcgtgagcatgctgcccaggtccctcgcgtgcgagatgttggtcagctgcatccccgaccccgggatcggcaccggccgcttccgcacgattctgtcgaagaaccactcctcgcagtccttgttgttgccggagccggtcatgtactgcggccggaacgaggcccagctgccgaactccgccgcgatgtacttctccacgccgacgtgcccggcgctctccttcacggcgtccccctccacgtgcggcggctcgtcggtttgaaggtagatcccggcgctgctgatgaacaggaactggccgaccccggccgacttggcccagtcggccaccggcttgacggcgtcgaggtccttgccgttgttctccagcacggcgtcgaaggacgctccgccgacggccgcgccgacgtccgccgggtcaccccacaccgtcttggccccggcgctcgtcagctccgagaagcgggagaacggcggcttcttcatcttgtcggagccctcgtcgccgacggtgagcacggtgacggcatgccccgccgcgaggagcgccttggcgaagtagaacccgatgaccgcgtggcctccgctgttggtgttgacgaccagcacgttcttcttcgcggctccggcggcctgcgcgcgcacgggcgaggccgccgcacgggccccgcgtcctcccctcctcgcgacgatcgcgccggccacccgcgggaggaacggcgacgacagcgacggcggcggcgagctcgagacgcggcccgaggtgaatgcgcccgccgcgcgcgcggctgtggcggtggtggccggggagaaggccatggaggaggacgacgaggggatgagcctcgtgc

SEQ ID NO: 24862 - DNA, 1138 bp, Triticum aestivum
  Clone ID: PAT_TA_24862
caataaaagggagtatgtgtttagggagccgcgggatgttcgtctgggtgacattatggagaagcttagtcatacctatgaggccaagatggatgtgaatcacacgttacatatcattcctgactcaaggcaagtcaatgctgatgagctgcaacctggtatatgctatctacaaataactgccgttgatcctgtaatggaggacgaggacttggagagcaggagggaaaggattttctctttatccactggttctgttcgtgcacgtgtgtttgaccgttttcttttcgacacaccattcacaaagaacggaaaaacgcaaggtggcctagaagatcaatggaagagacgcacagtgctccagacagagggttcctttcctgctctggtaaatcgtctggtggtgataaaatctgaatctctagagttctcacctgtggagaatgcgattggaatgattgaaacaaggacagctgcattgagaaatgaactagaagaaccacggagctctgaaggtgatcaattaccaagacttcaaagcctgcaaaggatactccaaggaagtgtggctgttcaggtcaacagtggtgtattaagtgtgtgcaccgctttcttatctggcgagcctgcaaccaggctccggtctcaagaactgcaacagctgatagctgcattgcttgaattcatggctgtctgcaagcgtgcaatccgtgtgcattttagattgataggggaagaagaccaggagttccacacgcaacttgtcaatgggtttcagtctcttactgctgagctttctcactatattcctgccatactttcggagctatgactgtagcaaggtggcaggcagttaggtagcatgtgaatggttggttgatttttcagttggggatctgctccaaatgttcatatttcgagtagctttggttgtatagtttgagaactaaccggggcctttgcatttctgctgtgtcacgattttggggtgtaaagtatatgcaacttcttagtgtgatgtacctggatcatcgtgtttgtttgtggtttgctgacagtgataggcaacttagctggtagctgtggagcggcattattcttactattattatcattatcattatcattaaaaaaaaaa

SEQ ID NO: 24863 - DNA, 1022 bp, Triticum aestivum
  unsure (1)..(1022): unsure at all n locations
  Clone ID: PAT_TA_24863
tcgcggccgcgtcgaccccaaaccacctccttggcctctagctagctaccgcccaacgcgccattagcagcagcagcagcggtgaaccggtggtagcaaccggtcggacacccatggcccagatgctctccgccatgaccatgacgatggacaccgtccccaccgcccccgccattatgcccgcccagcccatctgcctgggacgcgccgctgtcgggctccgggcatcgccgtgctgtccgaggcaggccgtgcgcccgggacggcccgccgtcggcgctcgggggacctcacgctctccgtctccgacctgcccatgctctcctgccactacatccaagaagggcctcttccttccccgcccccgacgtccccatgggctccctcgtctcgctcctcgtctcgtcgctctcccgcgcgctcgccgtcttcccggccctcgccggccgcttcgtcaccctccccgacgaccgcatcgtcatccgctgcaacgacgccggcgtcgagttccatcacgccgtggcgccagccctgtcgctcaacgacttcctcgtgcccaacgccgacgtccccaccaggctcaccaaggacctgttccccatggaccgcaccgtgagctacgagggccaccgccgccctctcacgtccttccagctcaccgtgctcggcgatggcgccgtcttcatcggcgtcgtcgccaaccacgccgtcgtggacggcacctccttctggcacttttacaacacctgggccgccctctgccgcggcgcgtcgcccaggctgccggacttccgccgcaacttctttggcgagtcaacggccgtcctccgctttgccggcggcgtgggccccgccgtgacctttgacgcggacgcgcctcttcgcgagagaatcttccacttcagcagggactcaattcgcgagctgaaggcgatggccaaccgtcggtccagcgccggtcaagacgccgaggtttacggcaagatggcgcatgaccccaacaagaaccannnnncgcgcgg

SEQ ID NO: 24864 - DNA, 526 bp, Triticum aestivum
  unsure (1)..(526): unsure at all n locations
  Clone ID: PAT_TA_24864
aatcccccgagtctccatggctcccagatcggaagcacgccgngcgggagcgcctcggcggcagcggcggcggcggcggcggcggcggccgcccacagccccggatccgggttcgactccatggaccccttcttccacgcgctccgcgtgagtccccttcgccttcctccagccgccgcgcacccgcctgaagctgccgtccaacctgggcgctcccggtccccgatgggtcgtcttctcgctcatcctgcntcacctacttcgccngtcgtctccgngcctcggcttccccgtcgtcctcccgccccccgcccccccgcggctcccgggcccccgcccccgggcgccccccgccccctcggcntcctccccggcccccgctccggcagtccttcccccggggccgcccctcccgcggcctggtccccctccggccgcggcgggcgtcctcccctcggcgcgcgtcgtccgcccctgcccccggagccggggctccggcggggaggccgcctcggnncnctgtttc

SEQ ID NO: 24865 - DNA, 567 bp, Triticum aestivum
  Clone ID: PAT_TA_24865
gtacgctgctgcgggtgcagagcaggcgttagaaatcctgctgctgtgtcgagagaatcaggagaaggcaagcatgcgttccatctagcttctctaggatgtcctgctccttctctttctttactcatgccatgccgctgttgctagtacttctctatatagctagtctgtagcactattcttgttgttaattctttcacatcagctagtgcgtacgcatggtggtttgggttctgcatgctagttgtgaaagatgcatgcgtcccgctccctctgttcgaaattacttatcacaaaaatgggattaaaatggatatatatatataactaaaatacatcctaggtacattcatttcttagacgagtaatttcgaacggaaggagtatctcccgaagaactcctccaagattattttgtctttcctcactttctatcttgtaccacatgccttgttctgactaagtacgcctcacttttacttgttggaccgtacactcgttatgctaagaatagcacatgcaagactaccttctctggtgcgcaggcttgtgatggggatctttgga

SEQ ID NO: 24866 - DNA, 533 bp, Triticum aestivum
  unsure (1)..(533): unsure at all n locations
  Clone ID: PAT_TA_24866
tttttttttaaccgaaccaacaacacatcattaaacagaaaattttgggaagacataacagcctgaccgccaaaccatgaagagcgcggtcatttctatgcctatttacatttgttactgatccaggccttgcccgaccaaagctctaatggataaacacacgatgcgcaatgcttgggcgggaaccttgctacatccacaggtaaaattccattgtttccaaactaaagctaccttgggagtaggaattacagaccccatctggtaccggccagcccagtcaagaatggtaagtagatgccagtatgtcactgatgtgttgggtaaaancccagcgcatcacgtatgctgggaaaatctcaagcattaccttacttgccttacttgtgtttcctcctcaggttaaattgggcttgacttganggccttggttagaggatgtaacagcactctccactgtggatcctgtgtaagggatggccctctcctgaacaaggtaacacctcgatgggtgggccttccacgttggtcgt

SEQ ID NO: 24867 - DNA, 586 bp, Triticum aestivum
  unsure (1)..(586): unsure at all n locations
  Clone ID: PAT_TA_24867
ggaggagcattaactggctatacctatcacgacttgcggccctaaaggaatttgcttttatgaaggctttaggagaccatggattccctgttcccacagcggtggactgcaatcggcactgtgtcattatgtcacttgtgccgggatatccacttgttcagataagagaattgcaaaatccagatgatgtttttgacaaaattcttggtcttgtaattcgtttggcggagcatgggctgatacattgtgattttaatgaattcaatatcatgattgacgatgatgaaactgttacgatgatcgacttcccacagatggtatctgtttcgcaccggaatgcccagatgtattttgatcgagatattgggtgtatctacaagttcttcaacaaaaggttcaatcttacagagaaaggtggacaagatggttctgaaactgatgatgatgacngtggcaggccgtcctttctgtccattccaaagtcttctggtgccttggacaaagaactagctgccagtggcttcaccaaaaaagagcaagttgagatagaaaagttcattgatgagaatgctgaagaacacgattc

SEQ ID NO: 24868 - DNA, 542 bp, Triticum aestivum
  Clone ID: PAT_TA_24868
gacaacttcattttggagtttggaagcacagttaagccatgccacatcattacaatcaagagtataattgctgaagcagcttctgcatagcatagctactatcccgagagggaattattgctgtaaaccttcttaatcacccattctaaattcgcaacaagctctagctaccatctctgcttgatcacttctggagcttcagatccttcaagaattcggcgaacgccaaccgcgacggcccgccgtccgccagcgcctccgccgccttctccttcgccgatgccagccttgccctcagcttttccccttcgcccgactccatcaccagcctcaccttcttctccacttcctcggcctagttcctcgtcgtacccttccatcaccaccccgagcttcatctcgtccaccacgaacaccttgttcgccctctgctcggcgtactgcggccagcacagcatcggcaccccggccgacgccgcctccaggacggagttccacccgcagtgcgtcacgaacgcgccggtcccggcgtgccgcagcac

SEQ ID NO: 24869 - DNA, 763 bp, Triticum aestivum
  Clone ID: PAT_TA_24869
tgaggaaagcttcagtttggaattcagaagcacagagctatgacatatcatttcaattgtatattgctgaagcagctattataactttcaccacaagcacaagttcatagttcagggtgggaattgattcaaaccattagaatcacacattccaacaccaatcctgttgctatcttgtgtgcttgatcacttaaagagctttgaatccttcaagaattcagcaaacgccatcgttgacggcccgctgtctgccagcgcttcggcagccttctccttggccaatgccggcctctccctcagcttctccccttcctctgaccccatcaccagcctcacctttttctccacctcccgggccttcacaagctgctcgtcgtacccctccatcaccactccgaccttcagctccgtccaccacgaacaccttgttcagcctctgctcccgcgtactgcggccagcacagcatcggcaccccggccgacgccgcttccaggacggagttccaccccgcagtgcgtcacaaacgcgcgggtggcggcgtgccgcagcacctccacctgcggcgcccacatcttcagcaccatccccctgtctcgtgtcctctccgtgaacccctccgggaggagcgcgtccatgtctggctccggacgcggcaggaagaatttggccgggtcagccggaggggtacgcacgacccacaggaagcggtggccggagttctccagcccgtgcgctatctccttcagttccgccgccgaccga

SEQ ID NO: 24870 - DNA, 441 bp, Triticum aestivum
  Clone ID: PAT_TA_24870
atcagttcctctcctgtcgacagagagggaggcgccgccatcgccgccacacgggcacacggccgcagccagcgccgctcccctcccaggcgtcgccggtcggccgccggctcccctctggccttttccttctcctcgccggctcgctcccacgctccgctgtgctgtcccctgtcggctgtcgccgagacgccgacgccagctaacccgctcccatcacggcgccggccggcggcacggtcccctcccctcgccggctcgcctccaacctgcagggcgtccgcactccgcaccatttctgcctcctccgcggcgccagaccgggcactgccgacctaccgtagcaagttagcaaggtctcttggccgtgcgtggagggagggagaagggatagaggaggagtccggcgcatctggatcggcgacgccaagcttactttct

SEQ ID NO: 24871 - DNA, 817 bp, Triticum aestivum
  unsure (1)..(817): unsure at all n locations
  Clone ID: PAT_TA_24871
ccgcgctacacatcttctacgcaagctgcaacccatcaagcccttcatcagaaatcttatcatgtctaccgtacggcgcggnggccgggatcccatgtgctcctccggcatgactgccgatctggctctcctccgcggcactccgggattctcttgggctacgtcccccttgctggtgtggtgcatgcatcgtaagaggcgctccccggggtcctcccgtcccgtctatgtctctgtttcatccacggtaagctccggcgctgctcctccactggccgtctgcactactcaagccaagctgcaacctcttcttgcatccaccgtccagacagttgtcgcctcccttccccgttcatgggcccaagcttgccgcacaaccccattgcggctgcctcatcagttacatcaggccaccccatgcatgttgacatcgtgtagagatgcttctactgcacactccaggtatgctgtggattcccccctggtcacttcttcccataatgtaagggtgctcgttcggctctttcctgtcgcaatttctcttttgattcctataatatctctattcctcttcgtcatagtgtctttatccatcatctttcttttctgttattttttgggatggctccgtgtacatgtgtcccttgattttgcagcaggccgcacctacttctactaccgcatgannntatacgcactgatgtttcatcctgtttttgatctttcaagcccatgctgcattctaatttcttccccttcccttactgttgtgcancnnnntgttccatatccctgcctcnnnanctgcannnnncct

SEQ ID NO: 24872 - DNA, 622 bp, Triticum aestivum
  Clone ID: PAT_TA_24872
gcacgaggactcacaccaaagaccaaacccagttaccacatgacatgtgtggttagctatcttacgctaagttgagacaagtatttgtggaagaagaagaaagaacgggaaagaccactcccgcccgtcgcccctcggcaaagaaagaagcggatccatggctttcgtcccggaggcacctgcagcgaggaagctcctgctacggcgcggcggagccgtggcgcggtccctgcgcgacgccggcctcggcttcgaccccgacggcgccgggcgctttctcgcccccctgtgggagctcatcaagcagaaggccgccgagctcgcggccttcctcgccggcctcctcgccgcgctcgccaagaaggccgacgagctcttcccgccggagacccgctcggagacgctcgcgcagtgggtgcgcgtcggcgtcaccgttgtgctcccggccgcgctcggcgcccttgtgctgttctggctcgcccggtgctgctgccgctgctgctgcggccgccgccgctgcgggcgaacgatggtggctcccggccccggcggcgcgcgcatgccgcgctacgcgttcgaggatgatccccggacatatttccgcgactcccttaaaaaaccc

SEQ ID NO: 24873 - DNA, 730 bp, Triticum aestivum
  unsure (1)..(730): unsure at all n locations
  Clone ID: PAT_TA_24873
atcaaccctgccttccatctggagaagctcaagcgcatgttgccggccttcgcagcatgttgcaccgagctggtgcagagatgggagggtctagccctagccgcgggcgacgcgccgtgcgaggtggatgtttggcctgacatgcagaacctgacaggggatgtcatctctcgcgccgcatttggcaagcagctacctggagggcaggagggtcttccaagctccagggggagcaagcttgagctcgtcttgctcgccatgagcaagatgcacatccctgggttatttcttcttgccaacaaaagccaacccgaaggatgaagcagttcgctgccgagatcgagagggtcctcaaagggtatcgtcgccaagagagagaacgccatgagagccggcgaggccacgaagcgacgaccttctccgggctgctgctccgatcccccatggccgcgcccgggattccaaagggccccgcatggcatcacnaccgacgactgatncgggaatgcaactttctactcccccgtgcggaacactcngtgctgctcanatggacaatatcctgtctgnatcacccggantggnaagacccccaaggaagaagtctgcngtctcgggccccggacccggttaaaanggtaaaccctaaggggngcaaggnctcacaagtttcggttaacccgtanggattaccaaatnaaccaggnccggggnaataccgggggggcna

SEQ ID NO: 24874 - DNA, 682 bp, Triticum aestivum
  Clone ID: PAT_TA_24874
cccggtcgacccagcgttcggttgactgtgaggtagatgaaccaactcgttcgaagacgacccgcaggacacgttcgagcaaggcaagtttattctccctctgcatttctatttgtacccaaataatgcatataataatgtttacttttcggatattgcataatttgatgggatttgcctaagtaggatttcctcgaattaccaaccctattcctcgatttactctaggataaatgctatgcttagcaatttttgctattgctcaacttgataaatatgatgtcactcttttaatgatactatgttctgaaaatgaagtttttatttatgatgttaactcaatggttaaacaagaacattttgtattaaatggaacatggattgaccacctaggataacagtgcaaccacgagtgctataatggctctggctttggtaattagctctatagacttagtgctcagcaaccctacatgaaatatgggcaagagagggtgacagtggtttggttgcaactcatgttaacatgggttggtagtcttcgctaagttaccccccctcccccgccatcaatactgacatggaaaccttagcgggtggctttgtactaaggatattttgtgaaagcctcatagtggatccctacccattcccctaggaagtgtttatgggtccgcccacc

SEQ ID NO: 24875 - DNA, 652 bp, Triticum aestivum
  unsure (1)..(652): unsure at all n locations
  Clone ID: PAT_TA_24875
gnatccagagtccactgtatcaaaaagaaaaggtaggatcacaaattaattattacccgacctcaaagataagcttcttctaaatgtaacatcaaaaggaagttgaacacatacagacaacttcatctgccctcggtgagaaatgtcatcgaagacccataagacaccgcagcagtactagtcgctgatggagggtatgacataatgtacgaatccgaagccgtcattcctgcatcaagcgccaacatgctgtanctcatgttagtccggcgccaggtaaggaaccaactgcccacgatctaagtattgtgtaacctttccgcatgctaagccttgcatcaaggcaatggggtgcgagcacaacaaacctaagtgcacacgagggtactcctccgggtcaaatttcccgttaancntggttcacgcctngataatgatccatgcngtgggccaagcaccatcatcatcactacagggtttcnntcgcaagctcgttgtctcnccanatcaactctaagagaaagcacgaatgaacacatcggttaggtgttccttccggncgcaaanctctgggcaagnatccatgnccncaaaagggtnttnacacggtcanatgaaactncagccaatccaggacatnacgttacaagna

SEQ ID NO: 24876 - DNA, 1481 bp, Triticum aestivum
  Clone ID: PAT_TA_24876
cggcacgagggcagcgccgcgggctggactccagccggaagcgccgccagaatggcttggacggccgcggcctccctgtgctgccgcctcgtccgcgcgccccccgtccgtcgccgcgctcggcgccggaccttgtgctccgccgcgcggagcaccgacgcggtggacagggagtacgcgggcctcgggctccgccccccctgccccggccgcgccccccaccggcgcatccggctccatctgagatcatccgttctgcttgtggacgaacgatccccagtgcagttaatttcagtgttacccatgcacgaggagctgcccctcatggtcgacatcggctgcgggagtgggagattcttggtttggttagcaaagaactccggggaaaggcggaattacctcggactggaaatccggcagaagttggtcgagcggacacagttctgggtaacagaattggggcttagaaatgtttactttatgtttgcaaatgcaacggtgtctttcgagcaaattgtgtcatcataccctggtcccctatcacttgtttcaatactgtgtcctgatcctcactttaagaaaaggcatcacaagagaagagttctacagacaccattggtggattcaatcacaaagaacctttgtctgggtgggcgggtgtttgtacaatcagatgtgcttgatgtagctacagacatgagagaaaggtttgatggatactcgaatgtgtttgagcatgctgatcgtattgataaagatcttcagtgtgacaaagaaggttggcttctggacaaccctatgggaatacggacggagagggaaatccatgctgagctcgaaggagcgaccatatacaggaggatgtaccaaaagacaagatgtttctcaccagattactccatcagttaagaggatgcctgcgtggccaggtagtgctgggctaatggctggtttctctctgctgattcgctaaccttgagcaccaactttcacattccctggcatgtcccaaagcaaattcttagtgaatgaattgggccttgtgcttgtgaggggttaaactggtcaaggcttggcatctctccagtggttgatatttttcaatatgagatcatcgttctgcttgaggaagaattagaaagatcacagtgcagttgatttcagtgttaaccatacacgaggatgtttgacatctgcaatttgtatccagggctgcattggccatcttagttatgatgaaaggcaagcaagttatgttgttggcaattaagagcattgtcttttgcccttctaaaaaaaagagcattgctgtttgatctacgactggatgtaacgaaactttgctctcagtggccagaaacgatggatgggcgatttcttttcgcactggttcttgtaagagactgatacttctctgcgcgcgaaaaatgtttacatctgcaaattcatatcaacctaatatgaaaatatactccatgatt

SEQ ID NO: 24877 - DNA, 1270 bp, Triticum aestivum
  Clone ID: PAT_TA_24877
aacaccccgaggccccgcccgcgttggcgcaaaacgcacaagcctcccctcccttcctcccctcctgcgccgaaaccttgctccacacccaccccctgcccccatccgccgtctccccaccctccccgccccttccccttgcttctccgggagggaaggaacccgcgaggccggcctcccaccctccgcaaaagccacgcgccaccaacccaacccctccgccccgccccgccccgcgcgtcgctttcgcctttctccgcgcaaccgaaagagaccgaccgagaggcccataaagagggaggcgccgaggccggcggctatgggcggcggcagcagatcgcgcgcgaaggaggccgacggcgagtcggaggtccggccgggcgggatgttcgtgcagcgcagggacggcgaggagggccccaccgtcaggctcagggtgtcccacggccccgccctgcgcgacgtcttcgtgccggcgcaggccaccttcggtgaactgaagaggatcctcgcccagactattggcttggagccagagagacagaggctctttttccgtggtaaggagaagagggacgatgaattcctgcacgcatcaggcgccaaggatggagcaaaattgcttctgcttgagaaacatgtccctgccaatgtggaacagaaggtcgagccagtgatgatggatgagagcatgatgagggcttgtgaggctgttgttcgtgtcagatctgaagttgacaagctctctgctaaggtgtgtgagttggagaagagtgtccttgcagggaagaaggtcgaggataaagaatttgttgtcttgacggagctgcttatggtgcagctgctgaaactcgatggcatagaggcagagggagaagcaagggcacaaaggaaggccgaggtgcgccgagttcagaatcttgttgagaccttggacaagctgaaggcaaggaatgccaaccctttcagtgatagcgccaaatctgtttcggtgtcgaccgagtgggagacgtttgaaaacggcgtgggcagcttgaatgctccgccggcccgattttcttcgacgcaaaatgacactgactgggagcagttcgactagcatgagaatgtgcattctcgatgtattattatgtaactcgcgacgaaagctactgtgtacatgtatgaagtatggtgcctcttgccactccactgcctgtgagattgttgccagatgatgctggtgaattgctctgcaaaatcgttatgttttcaagtttcaaaaaaaaaa

SEQ ID NO: 24878 - DNA, 834 bp, Triticum aestivum
  Clone ID: PAT_TA_24878
ggccgggccgctcacccggggctcccggcgtgcggcccctcctgccctgcccgagcgctctctccgtatcaggggccgtggcaccgtccctggcttccggccctcagaccctggtctgcggggcccttagcagggctcagttgaagagcagggaatcagcatatcaagcatggttagggtactacaactcaaacaagaccattggtggtaacaagtcgagacttgttactctcggcgaagagttcagccggagcatggggcttgcagccccaccagccatacccaagctcattcttcgtaagatgggtcttagcaaagttcctggctttcgatctacataacctgatccgcaagggcaagcaggactcgtgtgctagagcgcacgacggggccaaccacaatgctctcagtgtcgtaaactatggctcgcccctactgcacctcagtgctgctgatactggggatttgcagattggtctgcggaggatggtcaagagtttggacaatcaaagcttctctccgagctcagaagtcttgagttcaagcatggccactgtattccttttgacgccaaatcttgaccggtttactacccataggagacggggttcagacagaccccattgattcattatgtaaagcaacggaccaaacgattcagtgacctgatcaggatatgttccgatccattttcagaaatgtattgctcactgtaaaaaaaaaaaaaaaaaaaattaaaacactcatgtcgccacgatatgtatcagctagtatttctacctgttgtatggaatcaggctttttcttatgggcagattaatgtgaaaaaaaaaa

SEQ ID NO: 24879 - DNA, 686 bp, Triticum aestivum
  Clone ID: PAT_TA_24879
gggcggggctccctcccgcccccgccccctcccccggcgcgcccgcgcacccgcccccggcgggcgccccggtgaagccgcccccgcccgccccgcccccgcccgcccccccgccccccgtcgcgcccccgcccgccacccccccggcagtgaaggcgcctccaccagtgactccgcccccggtttccgctcccccgccagcaacgcctccgccggctgccgctccggccgagacgcccgcggtgctccccccagtggcgacgcccccgcccgtggccgaggcgcccgctgtgctgcctccggccgaggcgccgtccaagagcaagaacaagcacaagagaaagaggagcggcaagaagaagtcgccggcccccgcgccggagccgctcagcccgccggcccccatcgcgcccgagcccaccaccgtcgaggacgtgtccggccccgcgccctccgccaacgatctgagcgggagcggccggcagtacgggcactgggggatcgtcgtgcagaccgccatggccgcgcttctgctgtcgctagcctggtgaacgtgaaacccagcagagagatgcatccgtccatacattttattcatgtaccgagtccatgatttaaccattacgcttgcttgtaatgttaggggtccatcatttgttcgaggcttgtaataaacattttttgac

SEQ ID NO: 24880 - DNA, 960 bp, Triticum aestivum
  Clone ID: PAT_TA_24880
ccccacgacgcggcgatcaagcactcgtcccatccgccgcgcggacggccacaggggatcgcctcggccgaggacgagcacaggttgttccctctcgggcttgaaaagtatggcaaaggtgactggaggagcatctcaaggaacttcgtgatctcaaggacgcccactcaggtcgccagtcacgcccagaagtacttcatccgcctcaactcgatgaacagggagaggcggcgatcaagcattcacgacatcaccagcgtgaacggagaggcatcagctgctcagggcccaatcacaggcacaaatgggcaggccgcagtccctggcaagtcccccaagcaatctccgcaccagccagggaacctgcctccaggcgtggacgccttcggcaccaccatcgggcagccggtgggcggccccctcgtgtccgccgtcggcaccctggtcacgcttgcttgagccgccccgcctcacatggaatacgccatgcacgccccggtcccagggaccgtggtgccccgggctccgatgtacccgatgccgcccccaccgtcccggtgatgggcccgtgctacaaaatagacgttgttaagcgatgctgctgggcttcctgacagaccaactcagaaccttctccatgttgtccggccttgcagtgaaatgctctgttatgtctgaataaaggaataacgataaacccttgtacattaccgatggtgttgtggacgttgtggattatatgtaatcgtgacgcgtttcgtcgtcgtcgttcgatgttcgccttcgggtcgggtggatggatactgggtgtgtttctgttagtgatctgtgtaatgcaggcacaggggaagagatacttagcagtgttacttagcaatgtatgaattggttattacagagattatcattatcatctgtggtgtatctgtgtaacagatgatcaacaaagatttgtccagg

SEQ ID NO: 24881 - DNA, 620 bp, Triticum aestivum
  unsure (1)..(620): unsure at all n locations
  Clone ID: PAT_TA_24881
cgggaccccagccgccccactacctgacggccacttgtgcggtggtgcacgccatggccgcctccgctgccgcttcttctcgccgtggcttccttcgcctggtcgtcgcggccgccgtcctcgcggcattcgggctcggtgctgcccgtgctgcggggagctcggttgatcgcgcgccgctgagcgtggcgtccctgttccccggcccggcttgccccacgacagcangagcacgaacccacgctgccgngttcagcgaggatgaaatctcaacaagaaggccanntncccttctggttattccaaagggaaatnncggtnaaanaanttttnccgccgaacaaaacggtcaattcattnaagccnggnttccgnanaaccggccgggaaangacaaagncctgcctngtcaacccggaaanaaaacccggnatcgggnctctcaaccctnctcccgggaaccaacccccctnaaacggaatagtgtgactcggtcnganccgggnaantaagggggttcaacggaacaanactggtnatccncctctgtaatcncanaaagaccntctnacggaatctcacancaanttctgccncccnaaactnaaaagttncgggaa

SEQ ID NO: 24882 - DNA, 1073 bp, Triticum aestivum
  unsure (1)..(1073): unsure at all n locations
  Clone ID: PAT_TA_24882
aaannnnncccattccaccccccaganaaccctnaaatttttttaaatttnaaggntgtttaccagccccaacaattttcncgggaaaaanttgtataaacaaacatggtggngttnaaataagatcaatgtganaaagatgtcccacaaaagattttttcttcaataanagccggngcnccttggtcggtcaacatccactatttgccatgccttcatcgcaatatttcnccantncctgcactcaaccaagnncattnccagatccccncaccccaagttnactggttnaagtgtttcaagctaatcttctccccagttctatattcttttctatagctctccaaaagagttattccgtttgtnaggttttgaagaancanaataggagtgcattgcccacaggtcctctggtctcaagttggcatcaggaagctccctgactgcttcatcccacattccctgctgtagctttgaccagtttggcactttgtatctcagtgttctccgagagtcggttcctgaggggttcaacatgatcacttccatcaagttgcacgcccgataaagtactgatcccccccccgccgaccccacataggctgcaggtgaaacaagttccagaacttcttcccgctcttggtgtagttaattagctggacggtgacctccttctgctccctgatggcctccctgatcttgtcaacggtggtctggtcggtctccgatccctgaagaaatctgcagttccgccccaggatctcttcgcgcgtgtactccgtcagctccaggaagccgtcagccgcgctgatggctgggttctctggcagcctgcggccgtgtgccctgtggcggctcgcctccgaccccgggggaaatccatggcaaaggagaagcggctgttgcaacgccgaccacgcatgcgatacagggcttccggcgcagcatggcggcgtgcgcgccgacgccaaaggtgacctccttcgccgcatactcgcgcggccactgctgctgctcgctcctgccgccgccgcgggcgagctgctaccgcagcaccgaggaggaggaggacc

SEQ ID NO: 24883 - DNA, 570 bp, Triticum aestivum
  unsure (1)..(570): unsure at all n locations
  Clone ID: PAT_TA_24883
ggcaccctcgtgccgtacgcgccacgggcatgaatcgacgctcgcgccgcagaggcaagcgcgggcgcacgagcccggaccccccagcgaagcgccgccgcggcccgctggagtcgatgcccggcgagctggaggccgctccagctccagcgccgtccgtagtgatggtcgccgggctgccgcccgggtgcggggtgatagagctaaagtcgcgcctgggaggcgttacggccccgtccgcgcgcactccgcatagacgcagccgcggccaccgggcacgtcacctcccgctccgctgccgctgccacggccgccattgccgcttccctccgacccccgagtgcggcatcaccatcggttccaagaaggttttttgttcgggcaggcccgccagcccgccnaccgcgtcgtcaatccgtccttcggtccagtaccttgccgattgggcttttgcatccaantcaaatatccaagaanatcacaaaggcgagaatatcctatatnttgtctaaagngtctctcanataagagatatgtcttgtcatatagggcttagntcaatgtacgagg

SEQ ID NO: 24884 - DNA, 1716 bp, Triticum aestivum
  Clone ID: PAT_TA_24884
tcgcacgggcacggtcagcggcgacctccgtcacagcgtcgctttgccgccggccgtagataccctgcaccgccgccctttggtttccagacggaattgtatcgggccctgttgatgggcagcttgcgcgctccgcctcacctcgccggcggtaccagccttggtcgcggttacccgccctgtcttgcctcctccggggtccccatatccaaagtgctgagtgttagctgcccgctgatgtcctataggctgtccgtactccgcgataccgaggttagcgggctgaaggcgcgccctcgcattgacttcacctccattttcagcacggtgaatccgattgttgaagatgtgcgcgtcagaggtgatcctgcggttaaggattatacacgaaaagtttgacaaggtcactctcgataatgccggtgtgcgtgttaacgatgtcccagatgcaagagcttgatgcacctgttaagggaatcctttgatgtggcgtatgacaacacttgtgccaatcaagcctcaaaaacgtcggtgactacgctagtgggaagaatcaaagcctcccaatctacaggtacgcgaggatgtacaggggtgtgtcgctgaattctttcctcaagtacatcactgttcaatccctgactgaagaagggctgagaaggctgggtccctacgtcgcaaagatggcagaagtcgaaggcctagaagcgcacaagcgagctgttaccctcagactgcaagagatcgaagccactgtaactgtttaaactgttaacatggtctgttgtgccagtctatttgatgcttgggaactgatatttttcttaattcttatcggatgggacttgccagagtttaaggtgaagaatacgaagctgtttcatggaataatgctacttatgtcgatccgttaaatgaataaacttgtgagttggcccttcagaagttctggtaattgctgacaaatatgccaacccagttcatgttgccgctgatctgctatctcaggcagaacatggcccagatagtcaggttgttctagttattgctggagatggtgttgatttaggtgccattgaagcagaagttagcaagcagtgcgatgctcttcctagaggcgactttgcttccaaagcacttggccacagtttcactgtgtttgccagagatatggttgaggcattatcgttctcaaatatgtatgctcctgagcatttgatcatcaacgtaaaggatgctgagcaatgggaggagctcatcgagaacgcagggtcagttttcttgggacaatggacccccgagagcgtgggtgactatgccagtgggacgaaccacgtcctcccaacctacggttacgcgaggatgtacagcggtgtgtcgctgaactctttcctcaagtacatcactgttcaatccctgactgaagaagggctgagaaggctgggcccctacgtcgcaaagatggcagaagtcgaagggctagaagcgcacaagcgagctgttaccctcagactgcaagaggtcgaagccactgtaactgtgtaaactgttagcatggtctgttgtgccagtctatttgatgcttggggactgatatttttcttcatttttatcggatggaacttgccagagtttaaggtgaagaatacgaagctgtttcatggaataatgctacttatgtcgatccgttaaatgaataaacttgtgagcaaagta

SEQ ID NO: 24885 - DNA, 494 bp, Triticum aestivum
  unsure (1)..(494): unsure at all n locations
  Clone ID: PAT_TA_24885
gcactccgcacttcgtgatgcaagtagccagacattacccatacccacaccccgcactccgcactctgtgtgcaagtagccatacattatagctagtgactgagacagcgggtctgaggagcacacacttaacgtacgtacgccaatgtcgcaagctgttgcacctcccaccgccggcggcggtgcatgatccaccagcacagcagcccgagacagattcccnccccgttggcctggcgtcagaacgcgccgaaggagcccggcggcaactttnaccanttctccgtgtccanttctgccgcttccctaacggatcnttttggcgaacgnatgaacttctgctccnccaatccaacgttctacgggctccttcgccggnagtctccaagctctgctgnccccgcatttcncaagggaacaanggcnccnattaacngggcnangaanacacccccgnaaggcccccgagaacccgggggtngttatngtccccc

SEQ ID NO: 24886 - DNA, 818 bp, Triticum aestivum
  unsure (1)..(818): unsure at all n locations
  Clone ID: PAT_TA_24886
gtagaaattaatactagtagtagcttgaggctttggcctggatttgccttgatggcgactggcgtgatgtcgagatggtgtgtcaggagtgcatcgtcgaatctctcgggccgcttccgatgatttgtggtggttgctcttctctctgtggtgctccggtggtcggagctgaggagggaggggagtctcaccactgcctccgtgagtaagcccgcttctgccccagatctggagcttttgatctttcccccgcagctctcttcatgccttcgaggtggaggaagaggggatgcagtggaggcaggattgatctccagttatgctgcctctgcaatctcgatccttgagcacatcagcaggcgtgcttggagtggagctacggcgcgcatcgttcgcttgccggcctctgccaccgtcctgcttcttctggtcgaagggcgaccttctggagctctgttggctccgttctttcctcccggcgcgtcgtcgccagatgggagccagttcagttccggtcaagcttctgtgacgtcctctgcgggtgctccgctaaagatggcgcagcaaatccgccgccccaagtggtttgtccccggtgacggcggctctggtcttcggttggtactgttttccctggaccggattgcgttttctttccctccccccgggtcctntatgcaagatgcaaggacagtgttgtaatttttgtttcttccagagatccttgtgtaatatgtgcttgtactgctgcgagatatatctaatgcaatcgggatcctcgggatcctctcccaaaaaaaaaccccccccaccccaac

SEQ ID NO: 24887 - DNA, 1184 bp, Triticum aestivum
  unsure (1)..(1184): unsure at all n locations
  Clone ID: PAT_TA_24887
ggggaaacccgaagagaaaatcaagcggaggcggagatggcgaccgggggcgagggcccgccgggggaggaggatgagcgggactgggcggatctgacggcggtgtgcctggcggaggcgttctcgcggctgggcccggaggacctgtggcgcggcgccatggcgtgctgccgcgcctggcgggaggccgcgcgctcccggccggcgctcttcgccgcgctcgacctcgaaccggccttcgatgccgtcggcgccgacgccgccgagtggtggacgcccgccttccagcgccgcgtcgacgccatgctccgctccgccgcctcgctcgccgccggggagctccgcgaggtccgtgtccggcactgctccgacgacgccctcgccttcgccgccaagagctccccacagctcagcatcctttccatccaaagcagcccaagcgtaactgaccgatcaatgctcactgttgcgtcctgctgtcctatcctcacagaattggacatcagctactgctacgaggtctcatacaagtcgctcgaggtaattgggcagagctgccctaacctcgtggtccttaagaggagcatattcaactggcttgattcatcagagcatgtacgaacagttccagcagagtatctaagagcatgcccccaggacggcgacagggaagcaatagcgatctcgaggtccatgccaaagctgaaacaactcgtgctcaggtttgcaaagctatctggcgtcggcctcaactcgatcgcagaaggatgcaaggagctggaggtcctggacctgtttggctgtgcgaatttgacgagcaggggcatagagcaggctgctgctaacctgaagaacctggagacgctggtgaagcccaacttttacataccgaggtcggccttccacatggagaggtacgggcactggcagttatacgacgagaggttccagacaaacgtatttcagatatgaaaagaacaaccctcgtgttctcaagggtcgcctctgactgatgacggctcgtatgctcgttactgttatatactgtatgtgtatgacaggtatgtttgtttgagagcagtaacattctgttccagccatctttctgcacaatatatatacatgggaaatggttttgcttcctgtgtgtgtacctgtttctctgggcaaaacntttanttttg

SEQ ID NO: 24888 - DNA, 769 bp, Triticum aestivum
  unsure (1)..(769): unsure at all n locations
  Clone ID: PAT_TA_24888
taaatcctcgtctcccgtaccaactaaacccccctctctctccgctggggttctcgccgccgccgccgccgccgacgatctcgtctctcgttcgctctgtgcagcagacttggagtcccgggcgaccgtgaagcagcttcaatcgtcggcatggcgctcgtattgcatagtggggctggaaacaagaatgccttcaaagcacttattgctgcagaatacagtgggatcaaggttgagttgaccaaggattttgagatgggtgtctccaacaagacccctgagtttcttaagatgaacccccttgggaaggttcctgttctggagactcctgatggccctgtttttgagagtaatgctatcgcacgctatgttgctcgcttgaaggatgacaaccctctttttgggtcttcccgtattgaacaagcccacgttgagcaatggatggattttgccgcaacagaagttgatcctggtgttgcatggtacttgtatccaaggcttgggtacctcccttatgttagcacaactgaggaaacagctatttcttcattgaagaggtcgcttggtgctctgaacacacaccttgcttcaaacacataccttgttgggcatgctgttactctagctgacattgtaatgacatgcaacctctaccatggaattgcacggatcttgaccaaacttttcacgtctgcccangtcanagnattctggncangtaacacctactcagangcattgtangcaacaggaatctgaccccntccaa

SEQ ID NO: 24889 - DNA, 1392 bp, Triticum aestivum
  Clone ID: PAT_TA_24889
cctacccggcctccctcccctcccttctctatctcctctctccactcctccggtttgggggcggcggggcatggacgtgcaccacccgccgaatgcggcggcggcggcggccgccgccctcggcgacatgttcccccaggagcccgccatggaaagtgaagacagcagcacagagtggctctccatctatttagaggactgcttgactaaccctgcatcctaccctgtctccgaggaacaagcatctgtaaacccaaacctgccacatccttcatcttccaatcccagaagaaagaagagaagcctggcctctgttataagagatagtgatgaagaatatttcctgattgttgagccaccactactacttgatcagaagcattggctagcagagagtgagctcatcctccccaagaaagacaaggaccaagaacttgtccaaaaactggagcaggaacacgaggaagaatataagccctacactgtgcagttcaagcaagagcaggcggtgatgaggtgtagcgtttgtttgtccaactccaaccaaacaccacagcagtggcagggcggtccatcaggggcattattgtgcaacacgtgcagcctgaggctcaaggcagggaacgggttcatcaaactggagcccacctcatgacaagttgacgaacaacaagatcatggaagggggcaggataagaggaagatcaggaagaccacatattatggagatgatgaggagcctccgcaggagaagaggaggatcaagaagacttcatttgtagatgagcagggcaagaggaggaccaagaagacatatgtgaacgaggaggtcccactggaggagccagtgaagcggtgcacccattgcctgtcccacacgacgccacagtggaggagcggccctctagggcccaagactctatgcaacgcgtgcggcgtgaggtacaagtccggcaggctgctgccggagtacaggcccgccaacagcccaaccttcgtgagcttcatgcactccaattcccacaagaaggtgatgcagatgaggaagagtgtcgagaacgagcacgagcacgagtactcacactcggatatgtgagcttctgccggtggtcaggagcatctcctgagtctgtcgcatcgggtcttagaggccattgggccgtagtcatgtagatcatcagtcaggaggaaagaatcgaacgcgaaaatccgattaggtctcagttgaaactccttgttagctctagcagtcagtctttcgcttgagagaaccatttctcttgtcctggattcgtcgtcacttgtggttggttgatacaatattatgcccgccattatatcgcgatgttatgctaaaaaaacacaaaaaaaaagctcgctcgtgccgaattt

SEQ ID NO: 24890 - DNA, 298 bp, Triticum aestivum
  unsure (1)..(298): unsure at all n locations
  Clone ID: PAT_TA_24890
ngcanagtagtatcacacgagtcaggtcactcacaccagggaacaacaaatatggatgcacatgccaacaattattattggtaccttgataagtgttcctatatatcgatctggcacggcacgcatctttcagcaatgagataagcgcagagcaacatgacacaagacccaatctgaaacctcgagcgtacggtcgtcctcccctgcccgcgcctggagggggcggatacgaagacgcggatctggtcgaggaaggtgaggtgctggggccggtcgacgcggcggacgtacccggcgg

SEQ ID NO: 24891 - DNA, 2335 bp, Triticum aestivum
  unsure (1)..(2335): unsure at all n locations
  Clone ID: PAT_TA_24891
tctgcacgaggactggatgcaacacattgcactgcagcgcgcgcacaccatggatgtactcctgtcactcgtctcgcttcttctgattactggaggaggcagtcatcatgtgagcttcgccaatgcggccacgacgaactcggtgacgccgagggcgtactgggaggcggtgcttcccggaactccaatgcccccagccgtcagcgacctgttactccaacaagaagtgcgtgcctctccagacgatattgatctcaagtttgtcaaaggactacgaaaaatcggaccatattataagaaactcaagtcagaagctgatcaaggggaagagcatagatcatactgcatcacaagctgaacacaagttaaaggaggactctttgtcgtatggatacaaagatgtagacaatttaaaggaggtctctgtgacatatgcggacaatgacagagagatccacagaaaagtcgcatcctctcatggcgacactgtcatagagcttcaaacaagctaacgacgtaaagtcggtcacaagagggagatgtcccaaacatagctacaatgggatagacgtccgaacaaggaagtgtctcaaagccacttgaaagaaagaaaagcacatgtgtcccacgaacgcgacctcacccggcccgcgctcatagccaccccacccaaagccacgaggaagtttttttcttccatgactcgctgcgacgagggtcaatgatcaccccaaccatcccaccgcccatcgcaatccggcggcttctttcccgcaacgtcgccggcgaccttcagtcccctaccgggcccctcccacacatcggagcgatgttggccccaacgtgccgtggggacgatcaaggcccattcggtggaacgctgggacacctgctgagcacccacggacgctccccggacgaataggccggatgcaccacctcactctcagaccctcggccgggctaacgacgtccctcctgaagaacgtcccacgttcgctgcgttcaccgccgccaatctatcccatggaggcccctggcaagaccggaggtcgcgggggacggtacaacgtgacgacacaccgaagcctacccaagtctacggagatcatgacgtaccacgtctaaaacgtacccgtatgcggtataatacaggcactgaccgtgaccccaccgccgcatacctcggaggtcggtggcctgaagcacccttcgttcggcgtcgcacaacgttaaacccactggctgtctgtgtgtgcgacatcctcaccctagctcctcctgcttcagggctgcgccgcgggcaatgcccagccacgcacatccggccggcccgcttccgccagaaagctcttcttcgttacggcgccggctcggtgcggtgctccacccgaacgcggcgccgcgacatggtcgcgaagttaggtgcgtacggcatttgtgtgtgattgcgggtcattgggtgggacgcctgtacatgtgtgtatcacggacggacgttcccaggtcgaaaaagcaggatgcgccacctccctcgagtccctcggcgagctcacgacgtcccttctcagaacgtccaacgtccgtgcgttctccgccgccaagcttcccgtggaagccccgggcacaccggcactgcgggggaggtacaacgtgacggctgcccgaaggctctccaagtcatcggagatcgtgacctgccacgacttgacgtacccgtatgcggtgtactactgccacacatccaaccccaccgccgcgtacgcggtgacgctggcgagcgtggatgggggcgcggcgccagcgacaatggaggcgttggccgtgtgccacctcgacacgtcgcaatggagcctgaagcacccgttctttgcgctgcacaacgtcaagccaggggatgtcgctgtgtgccacttcctcaccaagctaagcgtggtgtgggtgcaggccggcgagcccggaaacgcacatgcggcggcccggtaggctggaaagcacgtgtgtgtaggtatgtgtgagatgcggcgcattcatgaaatggacgattctaggtgcatgtatcgagggtgtactaaataaatgtgtgcttgttgtgtcttggtgacgttgatgttaattttggggtcaccttccatttaaagacactctcaatgcattattatcttaagttatacttcctccatcccaaattacttgttgcagaattaagatatatccattttcatgacaaataattccggacggagggagtatcacactatatgttaaatatatacttagatctcttgcaaaaaatatatactanctgtacctctaatggattaaaaaaaaaaaa

SEQ ID NO: 24892 - DNA, 1984 bp, Triticum aestivum
  Clone ID: PAT_TA_24892
aagcttggtaccgagctcggatccactagtaacggccgccagtgtggtggaattcaattcatctacgtttccactctcttcctcctctcctcctcggactgctcaacggtggtccgtcgtcggcgacggcagtttgatgacggcgccgccgcctcctcctcttcctccgactgctcggtggtccgtggccggccacggcagtttgatgacggcaccgcctcctcctcctcctcctcctgctcggtggtccgtggccggcgacggcagtttgatgacgacgccgcctcctcctcctcccactgctcggtggtccgtggccggcgacggcagtttgatgaaggcgccgcctcctcctcctcctcctcctcctccgactgctcggtggtccgtggccggcggcggcagtttgatgagggctccgccgatcccactctctcgtgaaagactcgctctaccataccaggacggtgagccaccggccacgaccgacgacctaagcatgaggccgacatcctctccgccaccaaccagcgctgaagaaacacaaggagcacggcgttcttccgtttcgccggcacccgtcaccacggggatggccacctctcgcgggccgtctaccctcatcgaggccgaggagggtcgtgcaactgagaggaaggagattgtggtgaaattgcttaaagccagggccaaggacaacctcgagctcggcggcatagccgccatctttggtttcgctgtgctgtttggttggtcctgcttccccgaggagatgaagcgccccggcaacttgaaattcatcttctccttgctgctggcaatcgcaaccttcttcagcggcacggccctcacgctcctcagcatgaacatcgtcggcctgccggagagcctcgtctccgccggccagctggtcgcctccaagtgcctatttctcatctgcaccgcgctgtccgccatgactctggttagtctcctggccctcctgccgagcatgctctacctgtgccttggcctcgtcgtgatgacggtagtcgtgctgccggccatcgtggtacactgttacatgcgacggcacacagagggaggagacgaggcagcggcactcgaggagcataaggaggagctggaggccgcatcaaagatcacctcgtgcgtcaccaactcggcgttcgggggactggtcggtgtgctgtttagcgcatccaagtccaaggtctccggcgccccgacggccgtttacacggctatgtttttcatgttctccaccgccatcttcggcatggtcgtcatgacaatgtcgaagaaagtatcgaaggtcgccaatcggaggctccggcagttgctcgtctgggcgatcaggctcgccaacgcctttttgctctgctcgctggcgtgcgcagcgttcgcagcatcgttcgcggtcatcagatgccaaatttttgcggcgttcgggccgttggccattacggctgtgatctgtttgatcctccatcattgtactgtccgccctggcgaagccgacccgagaaaccaggagaatcaaaaggcccggctcaaagtaatggaggacatggcgagcaaggtgacggcggcgacgttgggggcgatcatgagcgttctcgcaggctctgtcggggaggaacaccacgagaagaagggggctacggatgcattcatggttgtcctgacatcgacctttgtctcaagctttggattcatgcttctcgccgccgcgccgagctcagcgagggtgtaccttgcaccggtctccaaggtgctcatctggtcgtcggtggccttgtttggagccaccgccgtctctgtttatagcgcagagatctccagggcagttagccagtagtgtcccgtaatttgttgcttgcttgaactaactcagtgggtagccgtcgtatattgtgattggattggttgctactgcgaatggctggatttttgcaatgaaaaaaaaaaaaaaaaaaaaaaa

SEQ ID NO: 24893 - DNA, 585 bp, Triticum aestivum
  Clone ID: PAT_TA_24893
acttaattcacgagttcattcagaaaatcagagagcggacacgcaccaaaatccaatcctaatatcgcccaattttcaccggactagcgacggcacaacattaggcaaagctgtagcaacgcgcgcggtcgccggacctagtcgaggatgtcgcactgccgcctgacgacgccctgccgccccgtcttgacgccgacggtgccgagcttctgcatggccttggcgaagtcctggaagaaggcggtccggttgtcggcgtactgctggacgaacaccttggtgggcgggtactcccacagcgcggcgtcggaggcgagcagccccaggccccggggcaggttcttgaagtagagctcgtcgaactcccgcggcgtcacgatgtcgttgaagatggagatgtccgggttgctctcgtagccggcgcaggagctctgcagcgcccgcgcgaactccgggttcagcgacgggtcgtgcccgctggcgccgccgcccttgcccttgtagttgtacacccggtgcgcgaactcggagcagtgggagaagcccacggtgtgggcgcccgccagcgccaccatctcccggacg

SEQ ID NO: 24894 - DNA, 1796 bp, Triticum aestivum
  unsure (1)..(1796): unsure at all n locations
  Clone ID: PAT_TA_24894
gtttcctaccgcgtggcacggcattcttagccttcgtgtaatgtactctactcgtccacgaaccccattggattggagtcagtactgagcctcgctttcgaaacggaagtaccaacttccgatctcctcctgcaaacttgaacgagcgtgggcgggaattctttgggtcacccgaccgcggagctagctccctccccgaatccccagcagaggccgccattctccagttccgtaggaagctcagacagcggacacacaccaacatcacaatcccggtcatatgcgccgaggcgttgaggggatgctgatggagaccggcgcgacagccgcgagcagctgtagcaccgggcccggtcgggacgcccgagtcgaggaaataacactgccggtgccccaataccccaagttcacgtatgcacgacgatggcgcccatgctatgcatggtccttggtgaagtaccgggaatgagtcggtccggttgtcttcgtagtgcctggccgatgaccttgttgggcgcgttctcccacaacgcggagtcgaagttgtgcagaccgaggctccggatcagcttccataagtcgagcttcgtaggagtcccaaggcgctacgatgtcgctaaagatggagtataccgggtggctgtcgtagcagtcgcacgatcacaacagcgatgacgcgaccaatttaggtttactaacagctcgataacttttatgccaatcatagtaggtatgtaaagagcagaaatgatgcgcaaatacgaggtaataagaggtccaatacgacaacctcatgtgaccctgccaggttcacggctgatggaaaaccaattgttccgtgtggtctgattgcttggagtttgtttaatgacacctatagcttcactcgtggtaaagaaaacttgacagtaaacgagaaggacatctcctggaaaagtgatagggagcacaaatttgccaaaaatgtctacccaagcaacttccagaatggtgcgctcataggtggaaagaagcttaactcgagtatcccgctgagcgaacaggaggatcttattgtttggatgcggactgcagcgcttcctacattcagaaagttatatgggaggatatacgttgatctcaaggcgaatgataccataacagtgaggctgagtaacaactacaatacatatagcttcggtggcaagaagaagttggtcctttccactgcaacctggcttggaggaaagaatgattttcttggatttgcatacctcatagttggtggactctgtattttcttgggcatttgcattcaccttgctatacttgataaagccaaggaaactgggagatcacaactacctgtcctggaacaggcaccccgcaggccgctaagggtgtttccgaactcgatatggcatatgattgatgcccgcctcgactacgtgaaatgtatcatcatgccctaaatgatacatgagattgccagtagctttagaccacctgtgtgtgtaaatgttaacagacggatctatgttcttttgtttgttgttgtagggcatgcatacagcagccgatccttgttgttgagtactactacggattgtattactacctctgatccaaaataagggttgcagttttgaactaaccccagtttagaactgcgacacttattttggatcggggggagtagaggttactcccccgggattagggcgtccctatgaaggctgtgaccantaatcaactgatccttggacaantctgnaaaaagggggcgnaccatnccaangagcatanccccangcgct

SEQ ID NO: 24895 - DNA, 1267 bp, Triticum aestivum
  Clone ID: PAT_TA_24895
aatagttactgacgggaaaccacaagtaaggagggccagttatgccatggaaactcactcagcaaagttaaagcgcaatgttcggaagtcttctactgccactgttgagactcaggcaaataccgttgaacctgaaaaatggaaaagaaacccacggaaattcaatggctcacctgctgattcagtaccagacagccagttatctgaacttgagaaggttaaaaggaaccttaagaaggcagctaactccatggctgaagcctctaagatatctaccaaggctgatgtgtcgaaggtacctaattccatagctgatgagctgaagatacttggttccatggctgaaccctcaaaaaaatccagcaaactgaacggtatctctgaccatcaagacagcgaatgcgagaaagcactagagagtacacgtgaggctctgtttccccttgaaactcaagattctcacagtggcaatcttttggaaaattcaaatataggtaagttggtacctgacataaaatatgatttagaagcatcattcttaggggacaaagttaatgaacccactactgtcgctcaagcagatgaagtcatacaactgcagaaccttgataacggatatgatattatagaaaggaaagaagagactaggtccaaggaagaacctctgcctaatggaagccttaaaaccaagagaaggtcttcgttctctaattcagaataccctgagagtggaaccaagaacactccagttccatcaaggaagccaagctatatggctccaacagaatcgttaaaggcgaaattgcgaggaccacccagattagactctgatctaccagtggacaagaatgccttcactcgccgtcagtctcttccttctgctgcaaacaatagagcaatcaaaacagaatggaggcggtgaagaggctatcaagcttccaacagaagggtgcattattgtggaagaaatttcaagctgtataaattattgattagtttatgaagtttgctgatgtctacctgtctctgtccttgttgttctgtctacgttataaacatatgttcttacgcccttttcgaactagcttgtggtgatatgtttggtgctattttttcctcgagttatcttatagttccttggtccgtgtattaaatgtatagctccagttatttggctcatttctgttttgatgacgacacagcataaccgattgcattatgaagtgccaaattacaagtttgaataaaaaaaaaaagaaaaaaaaaa

SEQ ID NO: 24896 - DNA, 1179 bp, Triticum aestivum
  unsure (1)..(1179): unsure at all n locations
  Clone ID: PAT_TA_24896
gtcgcctcgcgcccctcgcccgaacgcctgcgccttttcccttcttcttcctctctctctctctctaaaaagaaacgccttcgtctccatccacggatccacctcccgcccccgcgcgccgccgctcgccggagcccgcctcgctgcccctgtcaaacccgcccccaatcgtcaactgtgagcctgaattgctagcggacgacagggggcgttagtgagcttcggagggaactattcagagccagccagtcttcttctgttccatagttgcactagggcgaacttccttctttgggaaccggtctcagtcccatccttcctcactaccagatagacggcactcaggagatctacgcaggtggagttccctgtttgtctgcggtgcaccgtacccggcagtcctttgtagccatggttctatcactcgaagttttacttatgccggtggaaccagggtttccctttgcctgtgacttgtcactcttacaaaaactcatatgaagaggcagagtccttgaggagcggatttgaagtagatgaggggtggtaacaagcgggaagccgcatcaactttgtttacagagctaatggtactcctcaaaaacgttggtggccttttgccaacaggaagttcatgaaccttgtcatcctctagcgtcataattgaagcatttcagcaacaggcggccgcccggccaggtgtcggaactaaggcaatcattaacctggggttggaaaaagttcctgtgcctggggaaccagggtttccttttcctggacttttcactctcccccaatctggggaggaagcagaactgctgaggaactatctgaagcagataagggaggaaacgagcgggaggctgctcaactgcgcatacagagctaatggcactccaaacaaatggtggctggcttttgcaaagaggaagttcatgaacgttgtcatcctttagagcgtaagcatatcatcagtgacagcttaagaggcgtttgtgtaaatcctgattgcgcttgcacatttattcctacgatgatgtaaagcacagtttcttgcaatgcacctgctgaacacagtttcttgcaatgcaccttcactgaatgaaactctcattgatatttaataatgtgcgccgctgaggcattcccaacctcggccgcgaccacgctaatcnatcc

SEQ ID NO: 24897 - DNA, 642 bp, Triticum aestivum
  unsure (1)..(642): unsure at all n locations
  Clone ID: PAT_TA_24897
cggagacgaggacgccgtcgcccggccgccggaccaccgcaccgccagctccaaggtcggctggactgcttcgtgccgcggctacttgccggcgcagccagttccaccaccaccgctcgcgttccggccgccagtccgcccgtccgtccgtccgtccatggcggcgacagccaccggcatcagcaggacaagcgaggcggcgggcactccgccttccgcgtcctccaaaacccacatcccgcccngccaccaccgccggctgctcaaaggaatctggagttaattcttactccaccggcaactgtttcagttacccgaatacttgttcttggtgttaagccctgaactttaacaaccatccaccttgacacaagcattaaacttgctacaagttaatcccccaatgattatagaattttgaaccaaagtcaaatgatgaaatttaccaatggtcattttaaggaccgttgtcaaactgggaagtatcattgcacttaccatacaatcatcnacggncaagattaaggatctgaatanatcctgaagttgctgcaacttactcatatgaggntatgacncattaccacgcngggttcaatnactgtttgaaaaggattnatcccccctctataattttgacaa

SEQ ID NO: 24898 - DNA, 523 bp, Triticum aestivum
  unsure (1)..(523): unsure at all n locations
  Clone ID: PAT_TA_24898
tccaaacccaatcagaaatctcaagcttagcacagcaccaatggcgtcggagcagaccttcatcatgatcaagcctgatggcgtccagaggggcctcatcggtgaggtcatcagccgcttcgagaagaagggcttctacctcaaaggtctgaagctccagaacgtggagaagtcgttcgccgagcagcactacgccgatttgtcctccaanccttcttccgctgggtccgtggagtacatcctctccggcctgtcctccctatggtctgggaaggcaagagcgtcctctccaactgggacgccaagataattggngccacaacccctgcctctgaccccggacatccgttggtgactttgccgtccacatccggaagacntcatccatgggagcctcaattttanatgccaggaggaatttccctgntggtccccngaaggatttcaaattggagganaaccaacacaacggtttattangctaaatttccagatggtgagtcaagtccttaaccactacaaa

SEQ ID NO: 24899 - DNA, 545 bp, Triticum aestivum
  unsure (1)..(545): unsure at all n locations
  Clone ID: PAT_TA_24899
gcggccgcgtcgacgacgcagacacctcgtctcccacacgcaacctcctcttcccactccccatctagggccgccgctgccgccgccgtcccgtcgctcctccggcgctggccaccgaaggaaggttggcttctcctatggatcttctcctcttggtggcccctccgtcctcttcgccggcggcgagctcttcgggtcggggtcctcgccgctcgtcttcctgaccctgctcctgaccgagggcggcggcatggacctcctactctcctctcttatacccctgtgcctccggcgaggtgggccaagccaacgcacaccacaaagggtgggtgcgccgtctcctccgaccccggccccgccgangtnggangcggagtnccgtggtggtgatggattgccgcgacaacggttaagttcnnacgantcancaactccaanggnactcaagaantaacaattatgnttngacggcgatccttgtgttggtgatgtggtaaatggaataagataacatntttaanaactgaattatcanaggtttaanc

SEQ ID NO: 24900 - DNA, 527 bp, Triticum aestivum
  unsure (1)..(527): unsure at all n locations
  Clone ID: PAT_TA_24900
tgcagcggtcgtcggggccggccgtgctcgccgccgagcgggctcccccggcgccccccgtgcgccgccgcgtgcggctgcccgccgcggcgccgtggcgctgcgcgccggcgctccccgtcccgccccggccgcccgcgccccccccccccgcccggcccctcccccgccgcctgccgcgcgcccgcgcccccccccgccgcgcgccccccgccctccgcgcccggcggcgccgccccggcccgcccgggcccccccgccggcgccgccctccccccggcgccgcccgccgcctccgcctggccctgctcctcgccttccgccgcccgcggcgccccctgcgcgccccccggtggtgccgctcgccccgtccctgcctgttgctgtggcgttgcttgttcacgggtttgtcccggtttctgcgggttctattggttccccgttcttcttgtaattaccgaagatccttgcnttggggggggccagtaccaaattnccctaaaatgngtctnntaacccnccccacn

SEQ ID NO: 24901 - DNA, 1409 bp, Triticum aestivum
  unsure (1)..(1409): unsure at all n locations
  Clone ID: PAT_TA_24901
tcgacccacgcgtccgctctccactgaatatgaccatgttcaaaatgaaatatcggctactctcataagtggtaatgcacattcctccgcgctccgcgacccgtcctcccgccggccgccgcctccactctccgtcggacagcggcggcgctccccctcgcccccccaccccccaccccccaccgccactccctcgggcaaggccgcaacacggggagatccggggaggaaggatgtcggggttcggcgacgggtacgtgggcaccgcgcaggatgcggtgaagatccggcggcttgagaagcagcgcgaggcggagcgccggaagatcgaggagctcaagaacaagaacgccgacgggcagccgggcctcctccagttcggctccagcacctccgagattcttgagactgcattcaagaaggaaactgtcggcctagttacgagggagcagtatgttgagaagagggttaacatacgaactaagattgaggaggaagagaaagagaagcttcaaaaattgcaacaagaagaagaagaactgcaaatgcagaaaaggaaaaagaggagagtgaggggagatccacgcttgtcattctatgatgacattgggaacggaagtgacgaggatgagtttgagaaccaagaaactcagaagaaacaacttggaaaggatcccacagttgagacaagttttctacctgacagagatagagatgcagaggaacaagcagagcgagaacgcttgaagatgcagtggtcgcgtgagcaagaattgatcaaaaatgaacctctttcaatcacttacagttactgggatggtactggtcacaggagagctatccaggtgcgtaaaggtgactctattggagaattcttgagggctgttcaacagcagcttgctccggagttccgtgaagtacggacaacatcagttgagaacctactctatgtgaaggaagatctcattatccctcatcaacacagcttctacgagttaatcattaataaagcaaggggcaagagtggaccgcttttccactttgatgttcacgaggatgtgcgtaccattgctgatgcaacaaaagagaaggatgagtctcatgcggggatagcgtggtcgcggccgaggtacgagaagaacaaacacatattcccggcctcgagatgggagatctatgacccgactaagaagtgggagcgctacacgatccatggagattagtgtttgtagaatgatgcagcatagtttgagaactgaagtgtttctactttggatttatgtagcaactagcacggcgattttcctaatgcgatatccaaagatcatcagtgttgttgtctgcaacgatttcccttactgaactgtagtaaactgtacctgcccgggcggccgctcgaaatcnannnn

SEQ ID NO: 24902 - DNA, 548 bp, Triticum aestivum
  unsure (1)..(548): unsure at all n locations
  Clone ID: PAT_TA_24902
gtcaacaagaacaaccagaggctccaaaagtgtgtctgttggagtggaagagggtcttactttcactgaagataagatcctggcagctagtggacatcaactgaagatcctggtagaatcatgtacggcgatcagcagtgaaggccagggtgataaggtgatagtttcccccgggcaccctctcgccagcggccgcccggcctggtcctgtgggggttcagtcagcaagcgaaagttcaacatttctgatgaccaagaaaagctgcagcaggaatcaccgagcatttccaagcgactgcacagaacatcaagtgttccgttcgacctgaacctccccatcgacgaggatggttcgagcgatgtctgatgaccacagcgggcagcaatgacaactcatatggcactccgagagaggtccatggacagcctcttgtgtttggttgacgagcccatccgatttcaagccattcgactttgacaaagtcgccgactacgtgccgcgggagttgagcaatacactccacaaaagntctgggctccngctgcaa

SEQ ID NO: 24903 - DNA, 548 bp, Triticum aestivum
  unsure (1)..(548): unsure at all n locations
  Clone ID: PAT_TA_24903
cccgacgcgactcccctcccaagcccaaatccccaaatcgcccctaaaaccctagccgccgccgccatggccgcctcccccaccgcctccgcctccggctccgcggccgcggcggcggcggccgcctccgaggccaacgacgggcccacgctctccgtggtcaccaagcgcctccgcgcgctgcgcaagaagcagaaccgcatcgcgcaagatggaggaggccgtcgccggccggcaagacgctcaaccaaggagcagaaggaggtgatgcgctccaagcccaccctcgccgccgtcatcgacgagctcgaggcgcctccgcggcgccgcttcgccgtccgccgtcgccgaaggaggtctccgtcgcccccgcccccggccccgggccccggggcccgccggccccgcggcctccggcctgccccccctcgcgctcctcccccccgccccccgcttcgacgtcaagccgcaanagcgacttcatcgccacgatggtcgcgcgcgagcatgagcggagcaactgatcactatgactgcgtcgggaagan

SEQ ID NO: 24904 - DNA, 632 bp, Triticum aestivum
  Clone ID: PAT_TA_24904
gccagcacgtccgcacaactgccgcacccgccgatcggtagccaccacctccgccagccagcttcgacagatggacggcgacacgacgttcacgaagctgttcgtgggcggcctggcgtggcagacgcagcgcgacgccatgcggcgctacttcgagcagttcggcgacatcgcggaggccgtcgtcatcgccgacaagcacaccggccgctccaggggctacggattcgtgacgttcagggaccccgaggccgcggcgcgggcgctgcaggacccgacgccggtgatcgacgggagaacggccaactgcaacctggcggcgctcggcgcttcgcagcgcgcgcatccggccgccgcggcgccgtttgggatggtcaggtcgacgccgccggcgacatcgtcttcgtcgtaccagagctctgccgctgccgcgattgcagcctcctacttcccccagcaggctcactacgcctatccttactactacgggtatacgggagggtattctcaacgaaaacatgtatcaaaatgcaaatgagctactatggcgcgcaaggtggaacgagcgtgcagcagcaacagcagcagcagtcacaagtgcaaacatactacacagcagctgggccggaagg

SEQ ID NO: 24905 - DNA, 730 bp, Triticum aestivum
  unsure (1)..(730): unsure at all n locations
  Clone ID: PAT_TA_24905
gaggcccgaggacgtctccctttcacgagctgtctgaatcaggccacacaattcagcatacgagtcaattcagattcctcgacaaggctgccattatgctgcccccctcagacaaggcatgcgtggcgccgccgacgagttcgtggaagctctgcacggtgacacaggtcgaagagctgaagatactgctgcggatgttccccgtctgggcatctttcgtgatcttccacgccgtcaccggccagctgtcgtcgacgttcatcgagcaggggatggtcatggacaaccgcgtcgccgggttcgccatcccgcccgcctccctctccatcttcggcgtcttcagcgtgctcgtctgggtgcccgtctacgagaccgtgctggtgccgctcgcccggcgctgcaccggcaacctcaagggcttctcgcagacgcagcggctcggcgtccgcttcgcgctgtccgcgctgaccatggtctactcggcggcgctcgagacgaagaggctggcggtcgcgcgagccaagcggcctggccgggcagaacgtgccggtgccgatgagcatcctgtggcangcgccgtcgcacgtcctgcacggcgcggcgggggccttcgccggcatcggcatgacggagttcttctaacaacaagncccgtncgccaagaaaaacctctgcgccgggntngcgcaaatctcaancccntccngggtttaaatttaaaaaggtttgg

SEQ ID NO: 24906 - DNA, 576 bp, Triticum aestivum
  Clone ID: PAT_TA_24906
gggtggggggggttattacggctaaacatttaaatgatgaagacttgaggtatcacaagatgcacaaaatatcccaaaccagcacaaactttaaccagttcatagcaaggtataccagatcaacatcgacactagtaaaagggcaaactcttccataagcaaattcaagggctaaacagttctgtctccaggcaagcacactcacttgaagcatttcgcgtcaagcaaggcctcgccctcaaagggctcctggtcctcaatcatcgcattgacacgctccttctgggcctcatcagagatgtccaccttggtccactcgtagagctccatgtcatagacctcgtccattacaaacttgggaacatcctggccacggaagagccaaaggcccttcagcttgaagggtggctcagagcctatcacgagcatcttcccaaaggcgtacttgcggcacaggtccatccgctgcaggaatccaccaaccttgttcagggtcacaaaggagacggtgttctcatcattgtacttgtagtcacagaaccacaaggagtagccctctgggtcgtacatgtccca

SEQ ID NO: 24907 - DNA, 567 bp, Triticum aestivum
  unsure (1)..(567): unsure at all n locations
  Clone ID: PAT_TA_24907
acaagcccttcccatctattgtaagccttgcttcctgtcgaccaaagctttagcaatggcgccattgaccaagctcttcctcctactcctgggcctaaacttgatggtcaccgctgtgcatggtggctgcggaccccactgcccgaccccgaccccaccaccacctccatcgaccaacggcggcacgtgcccgatcgacacgctgaagctgggcgtgtgtgccaccgtgctgaacctcgtgaagctcgggctcggcgtgccgcccaacgagcggtgctgcccgctgctggccggtctggccgaccttgacgccgctgtgtgcctctgcaccgccatcagggccaaggtcctcggcgtcatcaaccttaacgtccccgtcgaacctcgtcctcctactcaaccagtgccacaagacctgcccgcccggcttcacctgccccgctctgatcaatcgacgtacttgtccaagcatgccatgctgcggtcacatgccatgcactgcacgctttccgccttcccacaacactttggggttcaanttaacctataagtccncgtgcatgccta

SEQ ID NO: 24908 - DNA, 538 bp, Triticum aestivum
  unsure (1)..(538): unsure at all n locations
  Clone ID: PAT_TA_24908
gatctgtcgaggtcgagaaaacatggagatgaagaagcctcacgcggtgatcgtgccgttgccgacgcaggggcacgtcacgcccatgctgaagctggccaagcttcttcactgcaagggcttccacatcaccttcgtcaacaccgagtacaaccaccggcgcctggtccgctcccgcggcgacgcagccgtggagggcctcccggacttccgcttcgccaccatccccgacggcctgccgccatcggacgcgggtgccacgcaggacataccctccctgtgctactccacgatgaccacctgccttccccccttgaagaggctgctcggggaggctcaacaaggttgggccgccggggacgtgcgtggggggcgggcaacgtgatgaagcttcanacctgggacgcggcggccgggggttacggggccgcgcggcctcctccggtccgcatcccccctgcgggtaaattggctaccgcaaanttccgggtcctcaagcaagaaggnaatcgctcccctcaaagatgaaacgcaactn

SEQ ID NO: 24909 - DNA, 755 bp, Triticum aestivum
  unsure (1)..(755): unsure at all n locations
  Clone ID: PAT_TA_24909
gcacgaggcttctgcggcggggtgactgcgtcgactacgcaccagtggacgacgctctctggcagtggcgcggaggacgtgcgcgtgatgacccgcaagagcgtcgacgaccccggccgcccgccgggtatcatcctcaacgccgccacctccttctggctccccgtcccgccctcccgcgtcttcggcttcctgcgcgccgacgcctcccccagcgtgtcgggcgtcctccccgtcggcgccggcgtccacgcgatggcccacatcgccaacggcagccaccacggcaacgccgtctccctcctccgcgtcaacaacgcgaactcgaaccagagcaacatgctgatcctgcaggaatgctgcacggacgcgacggggtcgtatgtggtgtacgcgccggtggacgtggtggccatgaacgtggtgctcaacggcggggacccggactacgtggcgctgctgccgtccgggttcgccatccttcctgacgggccggccggggcgccggatgccggcggctcgctcctcaccgtcgccttccagatcctcgtcgactccgtgcccacagccaagctctcgcttgggatccgtcgccaccgtcaacaagcctcatcgcgtgcaacgtcgaccgcatcaagggcgccgtcgtcgtcaaccccggggacaacaccggggccgccgccaancggtgaccgccatcgattcatcgtgcgcaatggagatngaganggacaatanccggtccngaggtttan

SEQ ID NO: 24910 - DNA, 697 bp, Triticum aestivum
  unsure (1)..(697): unsure at all n locations
  Clone ID: PAT_TA_24910
ggaaaggcgtcttcgtactcgcctctctccgcgcaaccgagccttcgccctcgtcctccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcacgtcccccgtgctgtcttcgtagatctcgagcccactgtgattgatgaggtgaggactggcgcttaccgccagctcttccaccctgagcagcttatcagtggcaaggaggatgcagccaacaacttcgcccgtggtcattacaccattggcaaggagattgttgatctctgccttgatccgtatcaggaagctttcagacaactgcactgggtctgcaggggatcccttgtcttcaacgccggtgggggggtgggaactggctnctgggccttgggatncgcttcctccttggangcngtcccctncttgttganctaatggaaaanaanttccaagncttggggntcaacaggtttaaccantcctnccccagggnncnccaacttnctggttggttngagccaanaan

SEQ ID NO: 24911 - DNA, 956 bp, Triticum aestivum
  Clone ID: PAT_TA_24911
caacggaacaactttagtttcggttcccatctctattaatttgttggatgggtgcacccatagacccatagaggccttctgccatcacttcacattatgacacttgaattcagtcaggtggggggacagtacaatcccatatagcagcagcagaacaggaacaaagatacattaggtgtaacaagcgaagatggccccaacatcatcctccaagcgcggctccagggtcagcccattgcatacttctgggtccagctcctcgctgtggactcatacttcgcacggtcgctcttgtacatgtgtgcaatctccggaaccaacgggtcgtcggggtttgggtccgttagtagagagcagattgaaaggagcacctggaaataggggcttgtcagataaacgtgcaaccggagaacgaatgctgctgcaaggttactgcacagatagtttaattttaacatgctttggctaagctgtaagaattaaaactgctggaactccagctcaatgacaggcatcacattcacgaccgagtttgttacaaagccatgaaaagaaagaattgtgtcacctttgaaactgtcaatgcagggctccattgctccttcaagatatcaagacagatgctcccattgctgttgatatttgggtggaaaacctttgttttaaatgcaaccttgggtggcttgaatgggtagtctggggggaagtgaatagtaaccaaaaatacaccaccagcatatgggctttccgatggacccatgatcgtcgcttgccagtggaacatatcttccgccacagggccggcgctgcaggaggtggggggatccctctgcaggtccttgagctccttgaggatccgcttggacgccatggggacggggctgccggctaatcaagcggcggagctagttgcgattccgatcggaatcgagagggaggaggaagtgggacggagt

SEQ ID NO: 24912 - DNA, 924 bp, Triticum aestivum
  Clone ID: PAT_TA_24912
taggggccttttttttttttttttttcttttttttttttttttttttttttttttttttttttttttttttttttttttttttttttttttttttttttttttcagttcccatctctattaatttgttggatgggtgcacccatagacccatagaggccttctgccatcacttcacaatatgacacttgaattcagtcaggtaggtggacagtacaatcccatatagcagcagcagaacaggaacaaagatacattaggtgtaacaagcgaagatggctccaacatcatcctccacctaggctcacaaggtcagcccattgcatacttctgggtccagctcctcgctgtggactcatactttgcacggtcgctcttgtacatgtgtgcaatctccggaaccaacgggtcgtcagggtttgggtccgttagtagagagcagattgaaaggagcacctttgaaactgtcaatgcagggctccattgctccttcaagatatcaagacagatgctcccattgctgttgatatttgggtggaaaacctttgttttaaatgcaacctggaaaattgtttccatcataatttagctagaggaaatgcggagctcaagacaagcatttcagatttaccttgggtggcttgaatgggtagtctggggggaagtgaatagtaaccaaaaatacaccaccagcatatgggctttccgatggacccatgattgtcgcctgccagtggaacatatcttccgccacagggccggcgctgcaggaggtggggggatccctctgcaggtccttgagctccttgaggatccgcttggacgccatggggacggggccggctgccggctaatcaagcggcggggctagttgcgattccgatcggaatcgagaggaaggagtaggacggagtcccccggccggc

SEQ ID NO: 24913 - DNA, 920 bp, Triticum aestivum
  unsure (1)..(920): unsure at all n locations
  Clone ID: PAT_TA_24913
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggggccttttttttttttttttttcaagcaacggaacaactttagtttcagttcccatctctattaatttgttggatgggtgcacccatagacccatagaggccttctgccatcacttcacaatatgacacttgaattcagtcaggtaggtggacagtacaatcccatatagcagcagcagaacaggaacaaagatacattaggtgtaacaagcgaagatggctccaacatcatcctccacctaggctcacaaggtcagcccattgcatacttctgggtccagctcctcgctgtggactcatacttcgcacgatcactcttgtacatgtgtgcaatctccggaaccaacgggtcgtcggggttcgggtctgttagtagagagcagattgaaaggagcacctttgaaactgtcaatgcagggctccattgttccttcaagatatcaaggcagatgctcccattgctgttgatatttgggtggaaaacctttgttttaaatgcaaccttcggtggtttgaatgggtagtctggggggaagtgaatagtaaccaaaaatacaccaccagcatatgggctttccgatgggcccatgatcgttgcttgccagtggaacatatcttctgccacagggccggcgctgcaggaggtggggggatccctctgcaggtccttgagctccttgaggatccgcttggacgccatggggacggagacggggccggggccggccggctaatcaggcagcggagctggctccgattccaatcgaaatcgagaggagggaggaagtggggcggagttttgacccggccggc

SEQ ID NO: 24914 - DNA, 1177 bp, Triticum aestivum
  Clone ID: PAT_TA_24914
cttttcctctctggatctcttcctccagcctgctagctagctcacagaggcacgttgagagatcctcctgccgtagcatccatgatgagcatgatggccgatttgagctgcggagcttccggtgtgaccgtgaatgatcatcagctggccgctccggctccggaggactcggcggtggcggggagcgagaagatggggaggggccggatcgagatcaagcgcatcgagaacaccaccaaccggcaggtcaccttctgcaagcgccgcaacggcctcctgaagaaggcgtacgagctctcggtgctctgcgacgccgaagtggccctcatcgtcttctccagccgcggccgactctacgagtactccaacaacagtgtgaaagccaccattgagaggtacaaaaaggccaacagtgatacatccaactctggcacggttgcagaagtcaatgcccagtactaccagcaggagtcctccaagctgcgccagcagatcagtagcttgcaaaactcaaacagtaggtcactggtgagggattctgtcagcaccatgaccctgagggatcttaagcagctagaaggcaggctggagaaaggcatagccaagataagagctagaaagaatgagctgatgtatgctgaagttgagtatatgcagaagagggaaatggagctacataacgataacatttacctgaggagcaaggtgtctgagaatgagaggggtcagcagccgatgaacatgatggcgtcggggtcgacgagcagcgaatacgatcacatggtcccgccgtttgattccagaaacttcctgcaggcgaacatcctgcagcagcagcagcagcagcagcttactcccagcagctgcagccaactgcccttcagctcggccagcagtacttcaactagttttgctccacacgctgcaggcagttcacacacgctagataatactgtcgccgtgctgtgtgcctgcaatgtcgttgctcttctacggtggtataacagtagtaaccggaatttgtggatcaggtgcatgtggtacttgtaatgtactgtatatctgtacttgctcatgagcaactaggtgctgctagtcgatcaccacacaaaatggtcaacttcggcgtgcaccattgcgttgcctatcttccccatgtattaattattaccagcgc

SEQ ID NO: 24915 - DNA, 2189 bp, Triticum aestivum
  Clone ID: PAT_TA_24915
acccacgcgtgcgtggacgcatccgatccatgccatctatctttcccatctctctgctagcgcccacgaaacacaaacatgcagatactcaacgagcagctggctgcaccatccacaggcctaatggtgaaggagtctgcgtccccgggctcgggctcaggatcgccagggggggctgccgagaagatggggagagggaggatcgagatcaagcgcatcgagaacaccacgaaccggcaggtcaccttctgcaagcgccgcaacggcctcctgaagaaggcgtacgagctctcggtgctctgcgacgccgaggtggcgctcatcgtcttctccggccgcgggcgcctctacgagtactccaacaacagcgtgaaagcaaccattgagagatacaagaaggcaacaagtgacacctccagcgctggtacagtcgcagagatcaatgcccagcactaccagcaggaatctgcgaagctgaagcagcaaataaccaccttgcagaactccaacaggactctaataggcgatacaatggccaccatgagccacagagacctgaagcagctggagggaaggctggacaaaggcctaggaaagattagagcaagaaagaacgaattactatgcgctgaaattgagtacatgcagagaagggaaatggagctgcagaataacaacttcttcttgagggaaaaagtagctgagactgaaagggggcaacagcagacgttgaacatgatgggggcggcttcgacatcgaatgagtacgagcaaaatatgatccattgtgatccgagaaccttcctgcagttcaacttcatgcagcagcagcctcagtactactcccagcaggaggaccgcaaaagtttgaactcagttggaatctaacctcctttccgacaactgaacacatttagtttcagttcccatctctattaatttgttgaatggatgcacccatagtacccatcagtacgcctttctcctactcattttgttagatcgcttgcacccagacaagccataggtgccctttctgccatccacttgacaatatgagacttgaattcagtcaggtaggtggacagtccaatcccatatagcagccagcatgaacaggaaccaagaagcattaggtgtaacaagcgaagatggccccaacatcatccgcctaagcgcgtccataagggtcagccccattgcatacttctggggtccaagctcctgcgctgtggactcatacttcggcacggtcgctctgttgtacaaggtgtgacaatctgcaggaaaccaaacgggtacgctctcgggtttgggtccccgtaattcagcagaagcagattagaaaagggagcaccggtttgaaacttgttctaaatgccagggtctccgattgctccgtttcaagatatccaagcacagatgctacccattgctgttgatatttgggtggaaaacctttgttttaaatgcaaccttgggtggcttaggaatgggtagtcttgggggggtaagtgaatagtaacccaaaaatacaccactagcatatgggctttccgatggacccaatgatcgtcgcttgccagtggaacatatcttccgccagagggccggcgctgcaggaggtgggggggatccctctgcaggtccggtgagctccttgaggatccgcttggacgccaatggggacgggggctcgccggctagatcaagcggcggagctagttgcgattccgatcggaatcgagagcgagtaatcagggagcggagctggctaccgattccaatcgaaatcgagaggagggaggctgcgcctagctgtatgcggggaatagaactagatctttcggtgggtgatggatgcatccatgcatagctgtgtcgtctctcatttacctttcaagtgagattgaagctatatagattatccgtgagatataactagaacttccatgaatgtgtgtatttctatacacgcacaatcaactttatcccataattaaggcttggccacacctgtgcaacgtatccatatgtattgtgatgatactacttaattatctcagtgcaactcaggtacttcgcatatatctatgtaccttttccatacgcaatagtactggtggcgatttcatctgaatggaaaaaaaaaaaaaaataaaaaaaaaatagtactggtggcgatttcc

SEQ ID NO: 24916 - DNA, 559 bp, Triticum aestivum
  Clone ID: PAT_TA_24916
gagttgctcatctctccacccaatcatcactagctaatacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcaaggtgtaatgggcgacgattcgtcaagctggtgctcaactcatccatccacgtggagttgaagcgcgcaacctctatccctatgtatatgggcactaattatgcgagtttatactgaatatgaataagaaccccccccctggg

SEQ ID NO: 24917 - DNA, 397 bp, Triticum aestivum
  Clone ID: PAT_TA_24917
cggggggctgggggcttccaggaaccgcgtgctatcgcctgcatcttgggcggagcccaggccccagcctcgcagcgtatctaaaagcagtttgctcgtgaagtgaatgcagccctccccaagctcgaagccacacgcccgctcagatggtcccagtgccccatcacgttcaactcggcagatcagctcaagtgcgcagctaccgctggcgccctcccatgctttgctccccaatcatcagcagcgtgcaacttaccaagaccatcatcgacgtgcgaagcgagaacgacaaggccaaagccggcgtgccgcagctcccctccaacgcaaagaacaagatcatcgctctgccgctcgaagaacttccgaacaagataaagggaatggtgcgcaatgc

SEQ ID NO: 24918 - DNA, 1399 bp, Triticum aestivum
  Clone ID: PAT_TA_24918
ccgccggcgccgcgcccccgcgtgcttgtgtggccgagagagcagcgcttgtgggtagactgtacggcgagcaagccggagccatggcctttacccccacgtcggtgtcggccaccctggcgccgtcggctcctcctcctccggcggccaccaagggcacgccccgccgggcgccatggaatgccgcgccgctggccgcggcggctgcctcgtcgacggctgcattgatggccgcgacgcccgcggcgcgcgccgcggcgttgtccaaggaggacgtcgccgggtcgttcaccaaggtggtggacacggtggacgtggtgatcggcgtcggcggcaaggtggccgagcagtcctttgtcgtgctcagggcgctgggcgaggccgcgaagccggcgctgccggtgctgcagaacgccggcgagcaggccctgaagctcgcctcgccggtggtctccgacgcctccaggcaggccacggaggcgctccagggcgccggcgtcgaccttgcccccttccagtctgctttcaagacggtcgcagatgcggcgcagccggccatcggcgccgcgaagccgatcgcgtccgagaccgtgcagaccatcgggtccctggaaggcacggactacgtcgtggccgccggagccgcgttcctcgcgtacctgctcctgccgccggcctggtccctgctctcatacggcctacgcggctacaaaggtgacctgagcccagctcaagctctggacatggtcacctctcaaggttaccttatcatcgacgtgcgaagcgagaacgacaaggccaaagccggcgtgccgcagctcccctccaacgcaaagaacaagatcatcgctctgccgctcgaagaacttccgaacaagataaagggaatggtgcgcaatgcaaagcgagccgaggcggagatcgccgcgctgaagatctcctacctcaagaggatcggcaagggctccaacatcgtcgtcatggactcgtacggtgacaactccaagattgtggccaagacactcaacagcgtggggttcaagaactgctgggtcatggccggcggcttctccggcgggaaagggtgggcgcagagccgccttgggacggactcctacaacctctccgttgtcgaagtcgtcaagccgtcacgggtgattccagcggccgctgaacggttcgtgacggtctcgtcgacttcaactccctccaggacgactcgcaagcttcttcctgggaatgtggacagctgagaaaagatttgaactctgtagagatccgatgcccatttcactgaatttccagcttttgttctgtaacctgtacaatgttagtgctgcaaactgcttatagcatcctcagaaaaaaacgccgcaaataaaaagaaaaaaaaaaaaaa

SEQ ID NO: 24919 - DNA, 705 bp, Triticum aestivum
  unsure (1)..(705): unsure at all n locations
  Clone ID: PAT_TA_24919
cgaccagcagccccatgctcaatcatcgccactgcaactggcagattctccatatgaccatactagagaaatgcacatatcagatgcatacccgatctcaacagccccggtgagtgctgctggaaaggcaaagaagcccaagaagaacagttcccaagcatctccactgaagaggccgtcaggcgtgctccggaaaaccaagaaagccggcggtgactggagagatgccggaatgtctggtgtcggggaggatccagctcgcgccgcttctgagatgaagaacgagtggaaggaccaggaccttggcctgaaccaggtctcgttcgacgagtcgtccatgcctgcgcctgcctgctcgtgcacggggggtcctccggcagtgctacaagtggggcaacggcgggtggcagtcgtcctgctgcaccatgagcatgtccatgtacccgctcccgggtgatgcccaacaagcgccangcgccatnggccggcggaaaattancggaacgccttacaagctgtnaaccggntaccggcnaggcaacatttctccggtcngnngcctcaaaggacanntgggcaanaacggacaanagttatcacatccgtnaccngctctcnttcaacancaagggggaatcaaggcctgtanccccttacngggggcatnacaacctgtaagtcattaggantnngcaaaatctgttt

SEQ ID NO: 24920 - DNA, 814 bp, Triticum aestivum
  unsure (1)..(814): unsure at all n locations
  Clone ID: PAT_TA_24920
caccatcagggcttagtcacctcatcacaacagcacgtacgtacagtacgtaggtagccagctagctagcaaggcggcggcggcgacatggccgacgaggaggcgtgcatgttcgcgctgcagctggcaaactcggcggtcctgcctatggcgctcaggactgccatcgagctgggccttctcgagaccctcgtgggcgcctgcgggaaggcgctgaccccggaggaggtggccgcgaagctgccgtccgccaacccggacgcggcgtccatggtggatcgcatcctgcgcctgctggcctcgtacaatgtcgtgtcgtgcgtggtggaggagggcgagggcggcagcctctcccgtcggtacggcgccgcgccggtgtgcaagtggcttaccatcaacgaggacggcgcctctctggccccgttcgccctccttgcaacggacaagatgctcatggagtcatggtgctacatgaaggacgcagtccttgacgggaggcaacccgttcgtcaaggccttcgggatgacggcgcgtgagtgcaacggcaaaggacatccgcctgaaccgcgtcttcaacgatgccatgacgcaccattccggcatcatcaccggcaagttcctcgagctgtaaacaggttttgatggcatcggcaccctcgtcgacgtccgngggcagcgtcggnnccctcatncacgccatcgttctcaagttanccgangcaatcaggggggatnaaactttggacttcccctttcggtcatcncngcaacgcccccggattaccnccggngttgcagcaantttgnnccggt

SEQ ID NO: 24921 - DNA, 827 bp, Triticum aestivum
  unsure (1)..(827): unsure at all n locations
  Clone ID: PAT_TA_24921
ctactccctccgtcgtaaaaataagagcgtttttgacactatactagagtcaaaaacactcttatattatgggacggagggagtaacttctatgaatgccacacaaattgtaatggtaatttctatacatgtgtgtgattttgcagcataccaatgaagccttaaaaataacttggattggtaaaaagtaaaattagacggtgggagctgtgtgagtacgcaagttgtaccttgtcggttttgatgacaagaagtctctctatgagggcatccatagcttgatgattttgcacctctaagattgcctttaatgattttctgtttgcctttatatattgcaggtttcattctggaatcctctaggcagggtgcttgcaatcccctacatctcggctgcaacaaaaaagacccaacgaggctgttgtttcaagctcagaccctcttcattgcacgcggtgctagaaggagaactgggttgtggtgctgttgctggtcgttttcctttttacttttgcactttggccgtcataaacgatacatgcttgctccctggatggatctctttctctccctggatcttttaaacaggtgttgtgattaaaattgtgataaatcagtgttcatcactattctttttggacttgaatagatctatgtctaaattacccccaatgtgtaggagaaaattactatagctggactttcatgtctttcttgaatcccatggcaaagcatagtccccttagtactatgtccctttgcacgctattctcatggccttattaaagatnttgtttcccatggctttaaaacaaccccaccccagc

SEQ ID NO: 24922 - DNA, 895 bp, Triticum aestivum
  Clone ID: PAT_TA_24922
ggagggtccctttcttcttgagtcgtccaccgcactaagatttcccccttaggtagatcgtgttctacaaggtagactccccaagtttgaagatgtaaaagagctgaagtacttgatgcgctgtatcaatgagtccatgcggctatacccacatcctcctgtgctgatacggcgtgcactagttgatgatgtgcttcctggaaactacaaggttaagactggtcaagatgttatgatttctgtgtacaatatacacagatcacccgaggtatgggacagagcagatgaattcattccagagagatttgatttggagggtcccattccaaatgagtcaaacactgatttcaggtttatcccttttagtggaggtcctcgaaaatgtgttggagatcagtttgctcttttagaagcaattgtggcacttgcaattgtcatacaaaagatggacattcagcttgtggcagatcaaaaaatcagcatgaccactggggccactatccatacaaccaatggactgtatatgaatgtaagtctgcgtaaagttgagcaagaagctgacttagcactgagtccatcgggctagacaaaagcaaagcaaaacagggtgggattagtacaggcagaggcaacagaattgtcaatacgtgagatgcctctgcaattaaatttggacatgtttggaatgtttccttgtcccagaaatttgagataccttttttcagttcttgtattttttcagcaggttccagctatcaatggctaataggttgcgtaaactgtaaagaaatggatcattgacttgctgattttgacagttaatgtaaatcggtagtcccttgtctaaaaaaaaaaaaaaaaaaaaaaaaaaaattaacccccccccccccccccc

SEQ ID NO: 24923 - DNA, 488 bp, Triticum aestivum
  Clone ID: PAT_TA_24923
atacgatcctaaatgaaaacctgtattactttcttgattatctaacaaactagagatttcaagaagagagaagccaaatattagaactatcggataacacgaggtaatactaatatgttatatgtgcacccaatgacaatctcttctgttttagcaccttgtatttgttgctccagcgtaatcagaacgatgcacatgccatttttataggcactggttccagcctttcctctacatgaaaatggttgtgaccgatcttaaccatatggccaagtatcgatctataaagttcacatttactatttgctccaaatgttagaccaacctctccactttggcaacaggctcatgtggtgataactttgagttacgcactaaagtttctagaaaatagttcgccactaatgaatcatcttgttgagcgtatctttctttattttaaaattgacttcagatcagggacatacgtaaaaccccccccccccagc

SEQ ID NO: 24924 - DNA, 551 bp, Triticum aestivum
  unsure (1)..(551): unsure at all n locations
  Clone ID: PAT_TA_24924
gaagcccggtgcctccgcgtctccgccgccatcttctaccagacttctcctagttagtccggccagccgctccctcacagcccaagcggagacgacaatatttaccgctttctttctgcccatgtgtgcctaatccagctggtcgtgctcgccgctccattaccgtctcgaagcgaagccgactagatctgtagatcagcagatccaggggatatagcaggtaatcggcgttcggacggaggaaccgcaggtatataggattttgctgctgtcaggccatctctcagaagattcgattattcaatttggacttggagaggatgcatcgtcggtttttgaatgtgatagtacaggacttgagcactcgcatcaattcgttgtacctcgtcgacctttggaagcatctcttctgccggtcaacaggaaaagcacaagctgcagaagatgcaaaactgggagaagaaaaatccagcagcgttgatagatcccttgaagttgcataaagccgcaactcaaggttggataattccctcnccgntcngttgananan

SEQ ID NO: 24925 - DNA, 738 bp, Triticum aestivum
  unsure (1)..(738): unsure at all n locations
  Clone ID: PAT_TA_24925
gncgaagnagaggtcttgccgcagacgtggaggagctccggcgagtggtgccccaggggaccataccggtgaggcggacgttggagggcgacctgctccgggccagctccgtccggaggttcgggatgaagccccggagtgccgcggcgcggcgggactccaccagcaacggccatgagcacgcggtggggtacgtgagcggcgggcagttctacggcgcgaaggcgagcctgaacgtgtggccagcgcaggtgtcgtcgccggcggagttcagcctgtcccagatctgggtcatctccggctccttcggcaacgacctcaacaccatcgaggccgggtggcaggtgagccctgagctatacggggacaacagccccaggttcttcacctactggaccaacgacgcgtaccaggagacggggtgctacaacctgcactgcgcgggcttcgtgcagaccaacggtcgcgtggtgatcggcgccgccatcacgccggtgtcggcctacggcggccggcagttcgacatcacgctcatgatttggaaggaccccaagaagggcaactggtggctgcagctgggcccgtcgggcgcgctggtgggctactggccctcctccctcttctcccccctcggcgcgcacgccaatatggtgcagttcggcggcgaggtcgtcaacacgcgcccctcgggctcccacacccccacgcagatggggagcggccacttcccgcgcgagg

SEQ ID NO: 24926 - DNA, 1661 bp, Triticum aestivum
  unsure (1)..(1661): unsure at all n locations
  Clone ID: PAT_TA_24926
gagagagctgatcccagtgtggtggtggtggtacttctgcgcctacccggtgtcctggacgctgttcgggctcctgacctcccggttcggcgacccggacccgcccttgctgctgctctacggggtctgcaccgcctccgtcgtcgcgctccgggaggaccccttggggtcccgccacctctgcaccgccgccgtcgtcccgctcctggacgcctgcttcggcctccgccacggcttcctcggcgtccggcgccccgactgcggccgcctgcgccgaccattgccaccaccggctgcaccccccgccgtcccacccatcaacccagcatgcacatgttcgaccccttaggtgcccctccgtttttgcggcgccgacatccacgcctagaagtcgatccattgccctgtaaatcacgcaagcgcgttgagtgaaacaacaaaggtacaggggagcctgtattccgggctggcgctaatcctgctgcatggatgttggatgtcacgagtacacaaatggagcagattcttggagtggattttgctgaatactatcgacagtcgaaattatttctgcagnccaaagaaatcgtcgaggccttgagcaaaccgaacagtgaagtgaaagagcttactttctctaccaagtatgctcagccattctgtgctcagtttattgcttgcttatggaagcaaaacctatcgtactggaggaatcctcaatacactgcagttcggtttttctacaccgtcatcatctccttgatgtttgggaccacgcgcccgaaatttggctctacaagggagacccaacatgatatattcaatgccatgggtgccatgtatgcagcagtgcttttcataggaatcactaacgccacttccgttcaacctgtgatctccatcgaaagattcgtatcgtacagagagcgagctgctgggatgtattcagcattacctttcgcattctctctggttactgtggagttcccttacattcttgtgcagtcacttgtttacggtacaattttctatagcttgggttcgtttgagtggacagcagtgaagttcttgtggtttctgttcttcatgtacttcactctgctgtacttcaccttctacggcatgatgacgacggcgatcactccgaatcatatggtcgcgcctatcattgccgccccattctacacgctatggaatctcttctgcgggttcatgatcccaagaaagctgatcccggtgtggtggaggtggtactactgggccaacccggtgtcctggacgctgtacgggcttctgacctcccagttcggcgacctggatcagccccttctgctggccgacggcatcagaaccaccaccgtggtggcgttcctggaggagcacttcgggttccggcacgacttcctgggcgtcgtcgccacgatggtggtcggcttctgcgtcctcttcgccgtcgtcttcgccctcgccatcaggaacctcaacttccagcgcagatgatgtgcatgatcggtagcagcaaatgtaccccgccgttttaacttgtccagtgtgcatgtgtgcaatcaattaagagctcgtaaataattcgagagagacatttgaaacaacaagtgtatgtatcatcatgtatagcaagcaaaggttttgagaaccccccc

SEQ ID NO: 24927 - DNA, 520 bp, Triticum aestivum
  unsure (1)..(520): unsure at all n locations
  Clone ID: PAT_TA_24927
nctgcaatccttcccaggcaggggnagaaagaaaatcccaactcatctcgtctcgtctctgcccccaacctccgcgaccgaatcaaacgcaggcggagccggggccggacccgtaccccgggaggactcagatttggattggaggaggtcgcttccgtccgcccgcaagggacggtgggaaaccccgaaagctatctatcccccgcccaaatccgtgcggggttggtgaaccggccgaattgggggcgagacacgtcgatcccacccaggagcccccgtctctcgccggaattccaagggagccgccgccttcccgccgcacgggtcggagattgggtgcctgcgattggtgggaaggcaggccgcgggcttcgtgtgcgcctgggcgccgagagattgaggatttggtgcctgggctgcgactccgtgccgtttggtggttgccttgtttggtggcgtggtagacccgcagtttttaatctgaaggggcgtgaagcagaaaaggaaagcaggaaacccc

SEQ ID NO: 24928 - DNA, 853 bp, Triticum aestivum
  Clone ID: PAT_TA_24928
ctccgccacacctgagtgccacctccctccctgaccacgccgccctagtgccatccctcccagaccactcccccgagcaccctccgccgccccgacgaccattcgccaccagccccgccgctccctggagatcctccatcgagcagcgccgtcgcttccaggagatccagcccgagaagcgtcgctgcttccaggagctcctggcacgggcagcgtcgctgtttccagaagctccgtcccgccacgtcttcgtcctctcccccaagagcgccgactacatcctctcccccgagcagatgccgcttctgcgttctttcacacgagcagtgccgcgtcgactacatcccggtctcctctacttcctcaccccaacccttcaacaggttttgtctcaagcttgtaagttttgtcacgaggaggagattgttagaatgctacagaacttctactacatgatagtagttggaccagtcaactaggatgcccacatgatgtttcttgtattcatagcaacaacagaatcatgtggggcgaggttaagctgtgatcttcaaaacattgcaagtttggtgactcttctgcgaagagacatgtggccctctttgaaggatgcagtttcacaggatggtggcgagtcaagttattcacaaagacatctaataaagccatccaacaaacgggtgcgaacgaagcaatttgtcctcctgaacatgggtggtagctgggcgtcaagctcaaaccatttggttatcctaagtttggacaaaaagaaatcctaatggcctaaggtaaattccgtttaaccatgtaggttgggtgctaccaaatggggtccttttgaatgggtggaaaa

SEQ ID NO: 24929 - DNA, 1742 bp, Triticum aestivum
  Clone ID: PAT_TA_24929
aggaattcggcacgaggctctcctcctcctcctccctttacctttgggctatataagctttgggggattggaaagcggcagcgagcgggcgggcggggctctcgccgagtttgaagttgaacccaccccaggccaaaacccccacctttctctctcctcctccccgccgccgccccttcaaatcgcggccgctcccccccgcctccgtccccgatcaaatgcggcgagatctgcgcgcgtgaccccgatagtttgaaaagagcatagcctgctgtgtgcgggctgcagcagactcagacaaggatggatcagtatgaggtattggagcagattgggaaaggagcattcggctctgctctgttggtgaggcacaaggtggagaagaagaagtatgtgctgaagaagatccggcttgcccgacaaacggaccgcactcgccggtctgcccaccaggagatgcagcttattgcaactgtgagaaatccgttcatcgtggagtacaaagattcgtgggtagagaagggttgctatgtctgcattgttattggttattgtcagggaggagacatgtctgaagctattaaaagaactaatggtacctatttctctgaggagaagctttgcaagtggcttgtgcagctccttatggctcttgattacttgcacacaaaccacattcttcaccgtgatgtgaagtgctccaatattttcattgcgagggaccaaactataagactcggtgactttgggcttgcaaaaatattgacttctgatgatctggcatcttccgtggtaggaacgccaagttacatgtgcccagaacttcttgctgatataccatatggtagcaagtccgatatttggtctctaggatgttgtatatacgaaatgactgctctcaggcccgcctttaaagcttttgacatgcaagctctgattaacaagatcacgaagtcaatagtatcaccattgcctaccaaatattctggtccatttcggggacttattaagagcatgctgcggaaaagcccagaacacagaccaagcgctggagaactgctgaaacatcctcaacttcagccttatgtgtttcaagttcaactgaagtctagtcctactcgcaatattcatcccatcaatgaatctctgaccgacaaagttaagaagatgacagttcctgatgatgtccctgattctgcgcgcagaagaatggttaggagaaactctttgggaagtcataggattgtaacatttagcaaaccatcacccgagcgtaactctgttagttctactcggagcatcaaggagtatacaaccactcagagttgcaaagagttatccattgacagcagtcaggctgaggatgacgaggttaccagtaaagccatgataaccaagacatcaagcatcctaaggactcccaagagtaatccagtcaagacattcacaagtagaaacaggcttgaaactccaaaaacatcttataacagaacaaaccgcgctgagccgccctcagtgacacctgtgaacaagagtgctcgactggctcgaagagtatccctcccgctgtcgacatacgaaacgcccatcaagcgcagcatcagcattcttgaccagctaggctcccctgatgtctccatgaacgcgcctcgaatcgacaggatcgcagagtttccactggcttcatccgaggaccccttccactccatccacaagctctcttcagcccacggctcatgctc

SEQ ID NO: 24930 - DNA, 552 bp, Triticum aestivum
  Clone ID: PAT_TA_24930
cggaggtggcggccatggtgcgggagaccatcacgtctatcgactacgatgagtacacccaggagctggtggactgggtggaggagcacaagacagagaggctgatggagaagggcgtcatcgggctcggtacgcccaccttgaaccagacggtgttcgcgtcgttcccgctcgacaccgacttcggcttcggccatgccgtgctggcaatgcccatgtgcgactacgggaggctcagctcggggtacctgtcgatcggagctcggccgggaggcgacggctcctggctggtcaacgcctacatatggcctcgcctcgcggcggcgcttgagtcggaccaagcagcgcatcttcaagcctctcacggcggagtatctagggctcgtctaggcgtaccactctgctgtctgcccggtttcttcttcaataagtctttgcttcgtcttttgaggcatgaaagcagctcgtgcttgttttacttccaccctattttgcaataccccaaataaagcccttctgtgtggagggtaagtttgtttgattcaattcccc

SEQ ID NO: 24931 - DNA, 1051 bp, Triticum aestivum
  Clone ID: PAT_TA_24931
cctcgtccgttcaccgccctcgaggtccggcagcgacaggccaccggctccgcctccctcttcgcctggctgggcctcggcccagtcaccctcttccagggcctcgccctcgccgccctcgcggcctctgcccacggcggcgggacagttttttagttaaggacctgtatccgtcgttcactccggcagtactcttgttcctcgggggtacgtctggcgacggcccggtcaggtactttgaaggcgagaaaagcaaaggctagacacaattcaaaacaaagcatctcaaagcagagtttgctaactttgaggggtggagttccttgctagtgtggtaaaggcacatagtgcctcagaagtagcttaaggcaggatatgagtcccagagagctaggctgtttctgtaaaagaatttctctttttctcaccaatctttgcccacagattgggacctatgtaaaggtaatagcctctgtatattcatgtatgaactgagctgtataatggttcgtacagattagtatacctggctgtctgttactttctactcgaaaaaagcaaatgttacatgtccagtgaaaacaaagcatctcggagcagagtttgctgactttgaggggtggagttccttgttactgtgtggtaaaggaacatagtactgtctcaaaagtagcttaaggcaggagatgagtcccagagactgagctaggctgttgctgtaaaagaatttctccttttgtcgccaatcctgaattactgatgatcttctatgtaaaggtaatagccattgtatattcatgtgaactgagctgtatattggttcctacacattagtcacctggctgtccgtacatgctactcgtatcgagcaattgtgccctgtacagtgtacatggagtgcatggatatggtactgtcagaatgatgctaactgagtttaattatgcttattttcatgaagaaaaagaatccaaatcaaaatcagttatgtatccaaaaaaaaaaaaaaaaaaaaaaaaaaaaaaaaattttaaaaccaaacaaacacccc

SEQ ID NO: 24932 - DNA, 601 bp, Triticum aestivum
  Clone ID: PAT_TA_24932
agaacttcaacaagtacttccgcaaggccgcgcggggcggcaagaagcgccccgcccacgccaagacctgcccctacttcgacgagctcgaccgcctctactcccgctcctccgcccatgcctccggtgcctcctccgccgccggcaacaacaccagcaccaaagccaccgccaacgccataaccagcgccgacgacgcggccaacaaggcgagctccgagctgctcgacgccgtggtcaagtaccccgccgacacccactacggcccgccgccggggttcccaaacgacggcggcaatgcagacaccaaggacgacggcgagggcgacgccgacatgggcagggcgtcggggagagcgggcgaggagcatgacgacgaggctggccagagccatgggcacgacgacgacgatgaggacgatcattagagcttgattaactaggactgcatgcttagctagctaggaaatgatcgaccgaccgacgccggagaaaatttgcttctttcttctcctttgctgctcctgctgctgcttctgcttgttgttaattacctcctaagatgaatcattacttacttgttagtactaaaaaaaaaaaa

SEQ ID NO: 24933 - DNA, 620 bp, Triticum aestivum
  unsure (1)..(620): unsure at all n locations
  Clone ID: PAT_TA_24933
cggccgcgtggngtccaagttcaggagcgcagagtttgagaatccaagcacagcatccgtctgcttcttttgcttgcttgcttctctttctctgcgaccagatcctcccaccgtctcgtctcaatggccgccgtctccaccaagtccattgctctcctcgccgcggttgtgctcgtggcgctcgttgcgtcggcggcagggaggattgtggagcgggaggaggagttcttcctgggcagcctcgctccctcgctcgccccggcaccggcgccggcggcggtggttggcgcagcaggcgccgtcgctcccggggcgtgggccgtggccgccgtcgtctcgctcctcgccttcctcgctcactgaggcgtcgttgcgttgggtgcctagcttcttgagagatggaatcctgcaatctgaattgcggcgagtcgcgtctgtttgtttcgttcagtttagttggttggttagactaccagtagtagtgatctatgcagtgatggtgttgcgtactgggtatctctctcttttgcctgtataagagagaaagtatgttttaaataatactatttattgattattctttatatgatttgttgtggagttcccnacaaaaccccccc

SEQ ID NO: 24934 - DNA, 648 bp, Triticum aestivum
  Clone ID: PAT_TA_24934
gctcgctcctcgccttcctcgctcactgcaggagtcgctgaacttcaggagcgcataggttgagaaaccaagctcggcatccgtctgcttcttttgcttgcttgcttctctttctctgcgaccagatcctcccaccgtctcgtctcaatggccgccgtctccaccaagtccattgctctcctcgccgcggtggtgctcgtggcgctggttgcgtcggcggcagggaggattgtggagcgggaggaggagttcttcctgggcagcctcgccccctcgctcgccccggcgccggcgccggcggcggtggtcggcgcggcaggcgccgtcgcgcccggggcgtgggccgtggccgccgtcgtctcgttcctcgccttcctcgctcactgagccgtcgctgcgctgcggacggtcatgggtgcctagcttgagagatggaatcctgcaatctgaattgcggcgagtcgcgtctgtttgtttcgttcagtttagttggttggctagactagcagtactagtagtgatctatgcagtgatggtgttgcgtactgggtatctctctcttttgcctgtataagagagaaagtatgttttaaataatattatttattgattattctttataaaaaaaaaaaacctaaaaaaaaaaaa

SEQ ID NO: 24935 - DNA, 2177 bp, Triticum aestivum
  unsure (1)..(2177): unsure at all n locations
  Clone ID: PAT_TA_24935
cccgcagtagtcattcatcactgatcaccagctgctccgcctctgcctccggcatcggcacggtgtcccaaggcgagctgatcaccgtgagatccagagccgccgccgccgccgcatctgctagcgcctcactcccttccggcctcccttcccgctgcaaagatggggaggataccgtctctgaagaacttcaatgcgtttccgcacgccgaagaccacctgctgaagaagacttactcgggtgctatagtgacgattctcgggctaattgttatggttacacttttcgcgcatgagctcacgttttaccttacaacctatacgatgcatcagatgtctgtagatctgaaacgaggagaaactctaccaattcatataaatgtatcatttccatctttaccatgtgaagtcttgagtgtggatgcaatcgacatgtccggcaaacatgaggttgacttgcatacaaatatctggaagctccgtttggataagtatggccacatcattggtactgagtacttgtctgatcttggtgaaaaggagcatggaactcatgatcatgaccatgggctcgcgccgtcgccgccttggtacgtgccgcggtctgcctcggccatcggatacgtcggtgcatgctatgaatatttttgttccgaatcagacttacccccggccgcgccctctcatcgtaacccatgttacccatcgaccgtcccttggtccagtatacccggggattcataatccacttgatgatacttcaaggattccgcacgccgcaagtgggacgttcaaatagtatatcacggttgttccaatcgagtacatatagctctcaatggtagtgttaccatctacgcaggttcccacatctgagcatttacatcctattcgcccaatcataagttcctagccagcagtataccccaaatttgacctctcattaataagtgtcactttcatagttaaccaagggaactctctagtgtgcatgcatcccatttgtccggcacttcggagtttaatttcaatgaaaataattcgtacccgctgctggttcagtataatcgagtctatgtcaatgtctaaatatctgagcggcttgcgttagcgggtcatcctaaggcgagcgaaggtggccattaacgcaagtggacagtcaagtgtgaagtcactcaaattgtagatgcaaacaaggtcatgaagcccggcgaacttgctatgggatattgtgaatgtgtccgcctgtgtagtgattcgtatcctcagtagggctgcttgacaactaccatttatccgagcttgggttaaatattttggttgcagatcagattttcgatgggtcaagccatgtcaatgttagccatgttatccatcgacgtcctttggtccagaataccctggaattcataatccacttgatgatacttcaaggatactgcacgacacaagtgggacattcaaatactatatcaaggttgttccaaccgagtacagatacctctcaaagggagtgttgccaacaaatcagttttccgtgacagagtattttgttcccattcgcccaactgataggtcctggccagccgtttacttcctgtatgatctctcaccaatcacagtcaccatcagagaagaaagacgtaacttcctacatttcataactcgcctttgtgcagttcttgggggtacatttgcaatgacaggaatgcttgaccggtggatgtacaggatcatcgagtctatctcgagctcaaaacctagaagtgggatgcggtaaccgggcatcccatgccgaaggaggctactagccagcctggtgaccagtcaagtcagtcgtcgacgatgttgttgtctcaaccaagtgatcaaagcacggtcacccccctgcgggctttcatgttttgtccagtccatgcatctataacttaaaagatatggttttagtcttatgattaatcatgttagattggcactagtggcaagtatacagttttgttatgaatgatgcaacgggaggcgccaacgatgtcatgtagcttgtacttaccatggaaaaaagcatatcctcagtatgacagtatgacaaatagcattaaatcaactttgaaaagggaattaaaagcgtaaacgaaaagggggggcccnggtnccaattcgccctaaaatgagtcgtt

SEQ ID NO: 24936 - DNA, 1105 bp, Triticum aestivum
  unsure (1)..(1105): unsure at all n locations
  Clone ID: PAT_TA_24936
ttgnaatataaacatgctcggnaaggnaaacaccataaagtgtacttctgggatgtgttgtaatggtgtgttgcattttgttacgctgtatgtggcataattttcactttgcagttcccagcgctatatcagcaaggaccaaataaccttttctttgactggtaccggattttaggatggatggcaaatggcctctactcatctctggcgatattctttctcaacatctgtatattctatgatcaagcaatccgctctggtggacagactgccgacatggcttcagtgggaaccaccatgttctcctgcatcatctgggctgtcaatatacagattgctctgacaatgagccatttcacgtggattcaacatctgtttgtgtggggcagcatagggacttggtatgtcttcattatcacatacgggatggctttgaagtccagagacaacttccagattatgacagaagttctcgggcctgctcccatttactgggcagcgacccttctggtgactgctgcttgcaacatcccctacctgattcacatatcctaccagagatcatgcaatccacttgatcaccatgtgattcaggagatcaagtacctacggaaagacgtcgaagacgaaacaatgtggaagagggaacggtctaaggcgagacagaggaccaagattggtttcaccgcaagggtagacgcaaagattaagcagctcaaaggggaggttgcataagaaaagcccatcgttaaccatccatactgtagcgtagaacacctctgagtcatctggtagtctcgtcgacagtagttgtcgccttacgtgctcccgccgggctgcggtcttctggcgtcaccgagtgttcccgcgtcttccttctctctgccctgcctgcggccttccctcgctttggggctgttctgggttctgggccatttgtgtaagaaatgttgggttgtaattggtggccttaccccccaagtagaagttctgaagccagccgtgtaaaaagtatagcgctcctttcagttggaagagacaaacctaccgagatagctgacaagtatatgtatatctgcaattttgactaaaaaaaaaaaaaaaa

SEQ ID NO: 24937 - DNA, 901 bp, Triticum aestivum
  Clone ID: PAT_TA_24937
gtggatacaggaggtcagagcaaaatggtcctagaagaagaagaagagatatgatatgataccaagacgctgtgtgctgtaagaccaggggaagatcatgcaacactgagccttcgtggcaccactaagcaaccaacacgtatgggcccgagatcatgctgatagcagatactattcttatctggagaatagtcttgagcatcagctttctgtttatggaaggatttggtccatgggagatgaacttgggcttgacagggacaacaaagatgcttctgctgatatgctgcagatctggagatgacattgttggagccagcatccgcacagggacacaacttgggcagttctgctcggctttccaccgatgtaactccactggtgagacctaataggactgtcctgttgacctgcggtccacgattcagctatcgatataaacaagggcaggcagaaacttgtgcttttcggacaccattgtagatcaggtttgcatatgcctttgagaattcagacaagtggcacatgaagatcattcttcattgttcatcaggattgcgagattatcggcttattttgtgtgtcgcccaccttttcgccttacccttaaccctggaaagattgtaccacatgtggtgatgccctgttacaagttcatcaggactgtgacggtcatcatccgtttcgtcacagagtaattagtctctgaaattatcaatgcagctgcatgtttattgtgctaaaaaaaaacgtgagtcagcttcagtcgcccccagtagagactgggactttgctttgcatttacacctcgagatttggttgtcatgcccaagtatttatgcgtattgcagcgattgatgtagacgcttggcaatttggaggtcacccacacccccccccc

SEQ ID NO: 24938 - DNA, 1198 bp, Triticum aestivum
  unsure (1)..(1198): unsure at all n locations
  Clone ID: PAT_TA_24938
cgctatataacatngaaaaaatgtgtgaagtgcccatgaaacaattgcatcttaagaattcgttgaatcggaaagtaaaatggttgattcatgggccaatgtccactacgcatacatcagtagcaacgtgaagagagggaatatgctcactcggcattacctgaatgttctaaactggtatctcgcgaagggttttaacccgccttcgtccacgacaggttcacattaatcatggaccccgtttgtccctggggttgaaagcactgctctccctgcaatgagtttcctgatggggtttggcgggccgtggcgggggggggggatgaggtacaagttcgttcgattcgcccccgcccccggcgcgccccttttgctggtagtgttgcagaaataggaacgcagccacaaggggcacgccgagctgggccaacctggcaccgggcgtggagaccatcgacgcgtagagcaccggcgcgaagccatctctggccgtcgggcatggagaccagcgacgccgcctagcatcggcgcgagccatcccggcgagctgccacagcgctccaacgtacggcggctgcggggacactggatctcgccgggatgaaggcggcctcctcgttcacccgcgcctgccctgttcagcgccgcctggaggatgttgcacgcgcagccgcggccttaccggcaacccgagcctcacgtcgtagacgcgccgtcggacgtgtcgtcttcccgccgctcctctccgccagcgctgacggcgcgcgctccccggacgaccgcctgcactctgcaattgtgcagctcctaaagcgtcgccggagccgccccaagcatgagcgcttgagcgcgccgccacggcagcccctgccgggtcagccgcccggaggagatcctccgccgcggtctccgggcatgccgccgcggcagccaccggcacgagctcgcctccgtgagcagcatctacaccgtccacacctccaaccgcggcgagatcccatggagggcgagacccccactcgccgacgggagaacgccctcggggaggactcccacggcgtcgccaaccgtcgcaggcgcgtccatggcgtcgccgggcctctgcctccctccacggagccgccgcggccgccgtcgacgagccgccgcccctaccctctttcgtccctccatcccgtgcgagtgtgtgcggtgagcc

SEQ ID NO: 24939 - DNA, 832 bp, Triticum aestivum
  unsure (1)..(832): unsure at all n locations
  Clone ID: PAT_TA_24939
cttcgcgcaacaaccaacaggagcatttaccgtgcaagnaccaaaatacctccctccccttccaaccatgtctaggtcggtggaacctcttattgtggggcgggtgattggagaagttcttgatacatttaacccatgtgtgaagatggtaacgacctataactccaacaagcttgtcttcaatggccatgagctctacccatcagcggttgtatctaaaccacgagtagaggtccaagggggtgacttgcgttccatgttcacacttgttatgacagaccctgatgtgccagggccaagtgatccatatctaagggagcaccttcactggattgttactgatatacctgggacaacagatgcttcttttggacgggaagtcataagctatgagagcccaaagcccaacataggcatccacaggttcatttttgtgctcttcaagcagaagcgaaggcagactgtaactgtgccttccttcagggatcatttcaacacccgtcagtttgctgcggagaatgacctcggcctccctgtggcagctgtctacttcaactgtcagagagagactgctgccaggaggcgctgaaaatccagctctcgttgtcccagttatgacaaataaaggcctatggagttccaatcttcttttcgaagtggatactcgtctgcccccccccccgctcgtgaaccaatgcttccttgccacattacttgctcatggatctacaaataaatcaaatgcattttgcagattgtattagaattagattgttttgtaagcagtaagattgataatcatgttgacaaatgccaaccccccccccccagc

SEQ ID NO: 24940 - DNA, 818 bp, Triticum aestivum
  unsure (1)..(818): unsure at all n locations
  Clone ID: PAT_TA_24940
tgnaagtgaagaacaaactatccaggactatcaagnagattacaattanttaccttgaaaggaacctggaggcgagagaaagggaacttgcacgtgcggaagagctcgaggaaaagcccccaaagtaaaagccaagtcaaaaatgtcaataggccgaaaaacttgcaaggaagaaacagaaagtgcaggccttccaacaaagcaagcagaaatcaaaatcaatgaaaaactcgaagaggtggaactgagatgctgcccctatcggcagtgcgattcacggtgccatagagcatcggcgacagtgcctgggaggcccctggtgtgctgaaatgctacaaggagcgcatatcaagagaagcaacagcatgcatacatgagcaatggccatggaggcagttgatgatagtaatagcattatagaacgccaaactatgtaactaggcaggaaataatttttaaccttgtatataacacaggcagtttctgattgaggaatgctttatttgcaacgattaacaaatagcaacaccatttatgatnncttcgtgaaaaatctctactattaatcgttacccgccagagaggaatgatgcagcaaaaaaaaaaaaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaaaggaaagaaggttccggtaagagggattgaagagtccataggctttaaaatggggggcgcctaaattaaatttaggggacctgaaattaaaaaggccggggacgggaaaaaacacgggg

SEQ ID NO: 24941 - DNA, 1481 bp, Triticum aestivum
  Clone ID: PAT_TA_24941
ggacgccgaccaccctcccccacggtaccagtggaacaccagctatcctgaacgtgggggaagcggtagaacggtgtgggcaagatatagtcgcaagtgcgggttcggggataagatattgtgccacagtgctaatctattagtttagagaggcgaaaagatagccattattggccccaatggatgcggtaagagcacattactgaaacttgctttgggaatggagaagccacaagaaggggaagtcattcttggggagcataatgtcctgcctaactacttcgagcagaatcaggcagaagctcttgatttagagaagactgtactgcacactgtagctgaagctgcagaggattggaaaattgatgatatcaaaggtctccttggtcgttgtaactttaggggatgacatgctgaatagaaaggttcggtttttaagtggtggagagaaggcgaggctttccttttgcaagttcatggtgactccatctactttactaatcttggatgaaccaacaaatcacctcgatattccatcaaaggaaatgcttgaggaggcaatatcagaatacatgggcactgtaataacagtttctcatgatcggtattttgtcaaacaaatagttaacagagtcattgaagtgaaagatcaaactatccaggactatcaaggagattacaattattaccttgaaaggaacctggaggcgggagaaagggaacttgcccgtgcggaagagctcgaggaaaaggcccctaaagtaaaagccaagtcaaaaatgtcaaaggcggagaaacttgcaaggaagaaacagaaagtgcaggccttccaacaaagcaagcagaaatcaaaatcaatgaaaaactcgaagaggtggaactgagatgctgccccctatcggcggtgccattcacggtgccatagagcatgggccacagtgcctgggaggccccttgtgttctgaaatgctacaaggagcgcatatcaagagaagcaacagcatgcatagccaaggaggtgatgatagtaatagcattatagaacgccaaactatgtaactaggcaggaaatgatttgtaaccttgtacataacacaggcagtttctgattgaggaatgctttatttgcaacgattaacaaatggtaacaccattttttatatggaagacaacgagctagctattaaaccgcgcaaggtttcgagaaattggaaggtggaagagatgcagcaggccgcaatcttctttgtgagcatatatgaaggccttgctgtatacagtagtttgtatacactgtgtattgtgttagcttctgtgctcagttcgtgatgtgcacttcctgaacgatgcatgcgtgatgtgccatttactgctcccgtcggagatgaatcggccgtgtgaaatttccgtgtgctctaaatgagcaccgtatggtatggtgagaccctgggtgtgttttaaaaaaaaaaaaaaaaaaaaaa

SEQ ID NO: 24942 - DNA, 391 bp, Triticum aestivum
  Clone ID: PAT_TA_24942
aaactctgaatgaggaagccttgcgaggatatgagcacattacaaacttcactgaactactgaatatgcatatatcctaaggatatattctaatcatgatgctttggagaacatcagaatcattattttgttgaacttctgtagaccttcaattgttgaacttttgtagaccttcaagttgcacgggaaatatgaaacttgtaattttgttctactaatttagtttctggaagatcctttttttacttcctagatacatcagtttctccacggatcaaatcataatcaccggcgatctcaaaccaaacttggtgtacttcttgatttgaggaaatctacaaaaaaaagatataggattgttccaaaataaaaaaaaaaccacacccaaccc

SEQ ID NO: 24943 - DNA, 799 bp, Triticum aestivum
  Clone ID: PAT_TA_24943
cgcgcgcgtggggccgcaccgcaccgcacgaatcctatcgccgacgggcggctttgggtttggggaacgccggcgggagatgggcaacgccgggagcgcgggctcgccggagcaggcgaagaagccggagcaggccgacggcgggggcgggggcggggccccgccgtccacggtgcggttcttccccgccgccgcgcagcacacggccaggcagccgccgccgattaagctggagggggaggacctgccgccgccgccggccgagggcgtggaggaggacatggccgccccccgcaacctctggcaggtgtacgcgctgggagcgttcctcgtggcgcgatggggctgggccaagtggcaggagagcaaggaccgagacgactccgcggatggccagttgccgccgccggctgcttcatcctaggtccatctcctgccaccgcaaggactgaccgggctccgcttccggtctgaaccatcactgttagttgcagcaaagtagatgaacgtcgccgaacttcctctcaaaggtagcggttgcggcgacgacgagttgatggcgttgcatcatcgcgatcagaggtttttcctcccaccatcgtcgctgtgtaaccggataatgtgtggattcgcaacaagttgtttatgagacttgtgctgctactgaatatgtgccgatgagtcgaaacctggcaatgtttttccagcacgaatcatacataactcgatacactatttcatctggcggcaaatgcattgatccaatatcgcgaaaaaaaaaaacccaccaaaccccgcc

SEQ ID NO: 24944 - DNA, 801 bp, Triticum aestivum
  Clone ID: PAT_TA_24944
cccacgtccgcccgccaccacccacctaaacccgcgaactcaccaaggcggcggcggcggcggcagcagcagcggcgatggggagcgacacggagacggagaagaagaagaccccggtggcgctggcccccatcgccaagccgctcgccggcaagaagctctccaagaaaaccctcaagctcgttcgccgagcctcggaggccaagtgcctgaagcgcggggtcaaggaggtggtcaagagcatccgtcgtgggagcaaagggttgtgtgtaattgccggaaacatctctcctatcgatgtgattacacatcttcccatactttgtgaggaagctaatgtcccatacatatatgtggcatcaaaagaggagcttgcgactgcggggaccaccaagaggcccacctgctgcgtattggtgatgaccaagccagccaagggggagatcactgaagaggtgaaggagaaactggaatcggaatacaagcaggttgtatctgaagttgctgaggctacatctgctttgttctgagaacatttccatggggaggaaccatgaatatctttctgtctgtattatgtagcatgattttgtcaccctatccttgctagtgatcgacgtgtttatcaggcagctttaaacatctggagttctggtactgtgctattcggtgagctttaaacattacaaaatatggtactgcgtgattagataaaaaaatagtcattgttaactaatatgggtgagcaaatcattatcgttgatgttgcataaaaaaaaaaaaaaaaaaaaaactcgagac

SEQ ID NO: 24945 - DNA, 755 bp, Triticum aestivum
  unsure (1)..(755): unsure at all n locations
  Clone ID: PAT_TA_24945
tgcgaaagcgatacgccttcctttccttcttctggcgagggagcgagcgagagtggccacgcgcgagtgggtgggtgagcgagcgagcgcgtgagtggtggtggtggtgggacgggagcgagctctcctctcgtgcggacatgatggatcacctgagcctggtgccctacgagggaggcagcggcgccgggggcggcgcccggcccccgctcctgcggtgccggcgcgccctccccgccgccttcggccgccgggccgtccgcggctgcccgcgcgccaggccggccgcgcccgacccgccccggggcgccgcctgcggctgccaccgcagcgtcctcccccccccggcgggcctcgcgggccgcccctgcccggcgcccttcttcttcagcccgcccccgccgccgcccccgcaccatcacccgcagccgcaccaccccgtgctgcagggcttcctcccgtcggcgcccccgcggccgccccagctcgcgctgccgtaccacgccgtgcccgccgcgtggcaccacgccctgctggaccccgcgcgcgccggctcggagacgcctccccgggcggacgactgcagccccgggtgcgggagcgggagcttctcgaggaagcggcaccggaccaagttcaacccgggagcaagaaggagangatgcgccgccttcccccgagaagcaaggggtggcgcatcaaaccgcgaacgaanggnggggcctncaagcggcttcggcctcnaaattngggtn

SEQ ID NO: 24946 - DNA, 552 bp, Triticum aestivum
  unsure (1)..(552): unsure at all n locations
  Clone ID: PAT_TA_24946
ctagtctcgagttttttttttttttttttgataaagagcagaacactgcagcttgaaatgtacatcaatcagagtgaatacatgaactaaacacgggtattcatgtaaacttcagagaaaattagactgttaacatcatccggtgaccggtgtagttctcacatattacatcaacttactacacattcttccaaacatacagtcggaggacctattaaccatccgaccataaataacacagagatctttgtgagaatacaattngaggaattatacatggacatcaaggaaacatatggcctattgactacattacgatacagaagtttatataaatagacatcctaaaatgctgaagttagtacttttacagggagacactgccaaaagccatgggtaccaacgctagttgcgcccttctaaaggaggccccccctgggtggcactccgtggcggtgccctagacngagaacancctgttgacagctatngtttcaactccaattngaatatataacgttacggtcttanagntgagttgtcattgcgnta

SEQ ID NO: 24947 - DNA, 494 bp, Triticum aestivum
  unsure (1)..(494): unsure at all n locations
  Clone ID: PAT_TA_24947
gggaaacctccgatctaagcgaagccaaggctctctcgtcctcctcctcaagatgcagatctttgtgaagaccctgaccggcaagaccatcaccctggaggttgagtcctcggacaccatcgacaacgtcaaggctaagatccaggacaaggagggcatccctccggatcagcagcgtctcatcttcgctggcaagcagcccgaggatggccgcacgctggctgactacaacatccagaaggatccacactccaccttgtgctcaggtccgttngtggcatgcagattcttcgtcaaagaccctgactgggcaagacatcacctccaggttgatccctccggacacatccgacaacgtcaagntaagattcaaggacaaggaaggattcccccggacaacagctctcatcctttctgggaacaactccaaggattggcccacctccctgactacaacatccagaaggagtcacctccaactggtctcaagntct

SEQ ID NO: 24948 - DNA, 2398 bp, Triticum aestivum
  Clone ID: PAT_TA_24948
ctcgaatttttagaggagagtcacttgacactgaccggcagttcgcatcctccggtagccacgccaccctctttgggttttcccggctgctggtcctgtgctcgatcgtactaccgggtctccacgcccgcggcgcgtgcttttcgcccacgcccccgccaagaccctcttcagccgcgtcgagctgtacgagccccagagcgggcttcttctctcggccccccacgccagggaccaaagggcgcgggcccggccgttctggttcggtaaggtgcaccccggaggtcgctgacgcgtcagtgcaggcgcccaggccgcgggcccccaagacgcgcgtcccgggcgtccgcggggggatcggcgggctcacgatggcgcgcgcagccagtcggaagggcttccaggtgctcgtgctggagagggacatgagcgccgtccgcggggaggggcagtaccggggtcccatccagctgcagagcaacgcgctcgctgtcctcgctgccgtcgacatcccagaaccggattttgaatagcttctgacagaattaatacgttgcagttctacgaaaatgaactgagggttttccttctcgttttgcatttatatctatagctactgtagttctttgatttaaatctgatacacattcatacaaagtcatcgtctcatagatggtggcgacagactatgaactaatattccatgaagacatgtcatgctatacatatgcactccaagttcattattgaaattaagatgctgcaattttgtacttttggacttcgctactaattgaatgtcagattttttaccgtcgcaaatcaaagatttttcatggcaattatagttgtcgtgatgatgccaaatttcatttccgaccagagcacacccttcgcgtgtgcagttttttatcaggatgtggacatgctgtttcttggtcataaacaatatttcgtctcctcagacgttggtggtggtaaaatgcagtggtatgcatttcacaaggaacctgctggtggtactgatcctgagaatggcaaaaagaaaagactgctcgagatatttagcggttggtgtgataatgtcatagatctgctaaatgcaactgaggaggaagcaattcttcgccgggatatatacgatcggccacctactatcaactgggggaaaggtcgtgtcaccttgcttggtgactctgtccatgctatgcagccaaatctgggacagggtggctgcatggctattgaggatggttaccagctggctgtagagcttgagaaggcctgggaagagagtgtcaagtctagaactcctgtggacgttatttcctccttgaggagttatgagaaggagagaaagctacgtgttgctatcatacatggattggcaagaatggcggcaatcatggctaccacttacagaccatatctaggtgtgggtctgggacctttgtcgtttttgacaaagttgaggataccgcatcctggaagagttggtggcagatttttcatcaaggttggaatgcctttgatgctgagctggattttaggtggcaacagctcaaagctagaaggaagaccgttaagttgccggctttctgacaaggcaagcaaccagcttggtcgatggtttgaggatgacgatgcattggaacaagctatgggtggagagtggtacctcttccctatgagctctggagatgactctgccttgcagcccattcgtttgatcagggatgaacagaggacactctctattggaagcaaaccagatccgagcaattctgattcttcgttgtcgttccccttgccacaagtatcagagatccatgctactatcacatgcaagaataagggtttctatttgaccgatctgggaagcgagcacggtacatggtttaacgacaacgaaggcagacgctaccggttacctccaaacttcccagttcgtttccacccttccgatgccatcgaatttggctcagacaagaaggccatgttccgggtgaaggtgctgagcacgcttccgtacgactccgcgagaggagggggagaagttctgcaggcagcatgagtggggacttcaacgaccccttgtcaccagccactgtacagcattcttcagtaaacagccgacactgcatcatggaaagaaaaagaattgtaacttttgcactcatccagatatccaaagcaggattttgagtagcttctgacagaattactacgttgcagttctacgaaaaagaaccgagggtgtacaatagggtaggcaatttttagctgttgccactgtaatattgtacctagtacagtacattgttgtgcctattaacacgtgttcatactgagttatagcaccacaaaaaaaaaaaaacgacggcactgcccgcgcccc

SEQ ID NO: 24949 - DNA, 479 bp, Triticum aestivum
  unsure (1)..(479): unsure at all n locations
  Clone ID: PAT_TA_24949
cttaaacgtcaggcagagatgatggcgtctttctggccgctgtgcgctcttgtcgtactgctcgccgcagtcggctccgtctccatcgcatccgcctccgtggccgacgcaggtagctcgtctctcaattcttcgctgctcgcatcggcggctcctccgccaaccgccgtccttccccgcaaggtgctccgccctgcaggcgtgggcgcagacgtgccgcaccgcgtgagcctcggctgccccggcccggacgacttcccctccgagcgggccccggggacgacgctgcccagcggcgccccgtcctacacggtggacataatcaaccgctgctccggcgcaggacgcgaagcgtgcgccatctctggcatccgcgtgcgctgcggctggttcagctccgtcaccctcgtcgaacccaacaagttccgccggggtggggcccgacgactgcctcgtcaacgacggnaagccgctcttgg

SEQ ID NO: 24950 - DNA, 544 bp, Triticum aestivum
  unsure (1)..(544): unsure at all n locations
  Clone ID: PAT_TA_24950
gaactanaagccaagccacaccgngtaccgccctccggaccactttcactggcgatgacactcgaagaagagctctccaagctggctgccgatgtagcggccatctcgccggcaccggtgaggaaggccgtggatgcactggcgcgcagcagccccgcccgcggcccgccgccgatgccctagttctacctctcccgtgggcacctcccgcgcgcgcttccgcggccccccgcctctcctcctcccccggccctggcctgcgcccgcggctgggggctgcaccccggctattcctgtccggagatagcggatatctatccacacctgtcctgttctccctgccgccgggtcctgtcttcttcctcccgcgccgccggtgcaangacaaggcggcggacgaggagagctcatcntgaagatgacgaaggggaacttctgtcgcgtccccgtggcttgggattccgnggtttcatgggggcgggtcnatggacactcttcttctttcaatgtggtaaaganttccgactctcggtaccggttctgt

SEQ ID NO: 24951 - DNA, 586 bp, Triticum aestivum
  unsure (1)..(586): unsure at all n locations
  Clone ID: PAT_TA_24951
cccaaaccgtattccggccgctccggtgcagaggcagcggcggcggaggtgagagagatgtcgagggccgtcaggatccgcggcgacgagctggagacgacggagcgggaagcgaagaggcgaagcgtggcagaggagggggaggggacagctctccactccacaagccctagatctccgggcgagctagctgttcggacttcccatccagagatacacttggcgatcttcgagcccaacaaagcccaatcggaagcaaaacaagatcgtgtgtacgatgtggtcgagtccgtggcggaggaatcctccgatccacccagccccccgatctaccaaccctacattcccgacgagctagttgatgatctgggacgtactcgctgacttccgaggacgccaaggcaaagtacgaagcaaaacgggaatncgtccgagcttaacctccttcactatggggcctcactgctataaagcagcctcctccctgttcaagacccatcgcttgcttcctattcttgaacaagcaagggatgcgacacttcttgctgctaaatctgtgattttgctctcatcatttgtcgagagt

SEQ ID NO: 24952 - DNA, 999 bp, Triticum aestivum
  Clone ID: PAT_TA_24952
gagagatcgaccctcaagcctttgtttttttttttactgaagcaaaaaaggtcttcggctcttatcaaatagatattacaacattgcatccaccagtgcgatttgtgtctggtctattctatttaatctacattacatgaacaaaaccttcttctacagtaagcctcaagagggagctcttgatctgaattgctagatagtttatgaactaattctctaagttttgaaccaacaagtcatgtcatcatgtgcttcttctgtaagctagatgctttgtgttacatacaaaggaaaagggctactccaacagcagatgtgtaccgccgcaatatggtagcccacataatagtatctctaccaaagaattacctatttgttgcccagtcaaagagctccaatattatagcggttggagttcttgctcaggccccactgagcccacaggtctatatgcagcttgacctctaaatttctttctccagagatacagtcctaaaaaggccgataaagacaggaaaacaactagcaaaacaccaaccagtatggagacaacatgttcttgcaaccatgaccttctcgatacaggttgctgcacattccactcgagtaactgataactgccaagatgttcaggcaactgaacatgatgttgagtcagccgataaatgatacccattgctgttgcattagacatagaattagaagatccagctgggaaaatatcccatctgattagagtagagtttccctgcccagtaacattcataagtcgtacctgactggaatctatctccagctctttagccaacagctcagccaactcatgtaggtgaggtttcaggtttggatacgtaacatttatcgacatataaacagcgatgagaccaacatcatattctggcaaaccacttggagcaggagctggcgataaatctgcttgtgaacctggatcacttgaaggagctggtgaaggagccccaccaccgaagcccggccggc

SEQ ID NO: 24953 - DNA, 512 bp, Triticum aestivum
  unsure (1)..(512): unsure at all n locations
  Clone ID: PAT_TA_24953
ccaagtcttcctcctatcaacagctagctgaagatgaagactgcacacacgctgctcctggcagtcgccttcctcgtgttggcatcagaggctgtggtgaaggcggacaattgtgcagcgtcacttcacaagacgccgctaccgtgtgatcaggtaggttgcctgcacatttgccgcgagcatgtgaatggggaagggcacgcgtgccctcagtgcagttggagtgctagttgcaactataatggattatgccggtgtgatgtctgcctccctcctccttcagctcctatccaacaccaacagagcgactgatatatactgggtactacctttctgtgatagggacaggatagttggggccccctggtatgaccatgggctgcccggcctgacctacgcattctccgggggtgcccgggggccgggtatccctcccccgtttggtgccttagtgatggcagcgggggaaatctngataattcaacttcnacccgggttaataaatgaataan

SEQ ID NO: 24954 - DNA, 692 bp, Triticum aestivum
  unsure (1)..(692): unsure at all n locations
  Clone ID: PAT_TA_24954
tagcgtggtcgcggccgaggtactattgggtcggccgcttaaggcaatgaaagagggacaatgcatctctaaaacaagagctgaaagagagccttggcaaaaacaagctcctgagcaaaggatgggatggatccttgagcacggaacagaccatcgtcagcaaccttaaccatctggtcaacagcagtctaagcccaggttctactccagatgacctggagctcaataatgttcttctcaatgtagaggccaattgtgaataccttcagcagtacccgcccgggcccccggcccgccttcaagaaactggtgtgtatatccttatggccaggagcagttaacagacgacgatgaggacctgccaacctcacttgatgatgagcagatcttcgacaatgaaggaatgctctaatgatttatgtgtcgtacctgaagataacttctaacagccttgcaagaatcttcagatcactgctatcatcattagagctagctgttgctccctactaatatagttatctatagccatatgtaatatatatcctatcgcaccatggcacagtcggttctcccgaagctatctgttgagccttaatgatatantgtgtagtgaaccaatgatgtatatgtcctatcgaaccatgcactccaattatgcaatctacgctaatgtcatgcttaaaaaaaaaaaa

SEQ ID NO: 24955 - DNA, 942 bp, Triticum aestivum
  unsure (1)..(942): unsure at all n locations
  Clone ID: PAT_TA_24955
ttttttttttttttttttggtaaaaaatctctatgagggactttttctagtctctnacacaaaaaagtctctgggaaacaaacatcttctctttgtgttaaaatgacgcgctataatttttattgggcgcgaaatttttgtgcggcagttggagatactctaatccagaaattttactcccttacgttcttttagaggatcggttagaacttagaaatgcacctagtccgggaggattccctgcccctatctcaaccgcccatctgcacataaaatggctaaattttgttctcctgcgtagaggatcttgccacgggtcagatattagctgctcaccccgaaccaaacgggagaaaggcagaaaatccagtgcacgaacagcagtgcccattttgtatctttgtgaacagctttatgctttttgcgttgcgcacatcaagaattcattcactgatcgactgagtcagctcagttcactctccggcagtttagccggacttcgccgttcttcccggtgagcgccaggttgcccatcctcaccatggcggcggcgaagtctaccgcgaagagcgtggcgttggcggcgtaggcgcgcacgagcgcgtccgtgctgccgtcgccgacgccgctcccgtagagctcctggtcggagcgcaggagcacgcggcgggcgacgaggtcctggaagtagccgttgtcgaatgcggcgggggcgcgcagctcgagcggcgcgaggttcccgtcgccgccggcggaagggcaggccttggcgcgtatctgcgtggcgaaggcggggtccacggccgcgttgccggtgtcgttgtagatgtgcgtgcggaaggtggtgcagcgggcccagcccacggtgtgcgccccggacagcgcggtgagggcgcgcgcgtccaggcccttgtcgctgaacctggcgaggaggtcggggag

SEQ ID NO: 24956 - DNA, 532 bp, Triticum aestivum
  Clone ID: PAT_TA_24956
gttgtggggaaagggtaaataactgatatttgatccattccaacgaacaagcagcatacaacataaattacaccgattaccatgaacactgaacaacgcctagctactgctaatctgaatatctgatcaagtggtgcgagctgaattcgcctagcctccgaatccgtagagggtgcgtccctggcgcttgagggcgtagacgacgtccatggccgtgacggtcttgcggcgggcgtgctcggtgtaggtgacggcgtcacggatgacgttctcgaggaagatcttgagcacgccgcgggtctcttcgtagatgagccccgagatgcgcttcacgccgcccctgcgagccagacgacgaatcgccggcttggtgatgccctggatgttgtcgcggaggaccttccggtggcgcttggcgccgcccttgccgagcccctttcctcccttgccgcggcccgacatcttctcgcttctccctttctctctccgccgatgttgctagtcttggcgaggttgttgctgcggtgggaat

SEQ ID NO: 24957 - DNA, 447 bp, Triticum aestivum
  unsure (1)..(447): unsure at all n locations
  Clone ID: PAT_TA_24957
agcagttggcccgcaagcgagggacggagggagggcgaccgcgacacctgccagtgcgccgcgccgccggctgccggcgactgcccccacgctcctgccagggactgctccgccccctgtcgctcgacttccccccacccccgggcccccaagttcccagacagccggcagtccccgcctcccgcctccccgctgctcaggacagccggtgctgctctaggcggacgccgccgcaagctctacagcctctactccggcctctcctcgactccccgtctcccagtcgcaaccaagcagtccgtccgtccaaaggaccagggcaactcgatcacgccggcggcggnccaaanaatcgttataaggctcctccttccttcaacggccgaaancccctccaatnataaanatcngtttctccngctngcaaanccanaatccttncaattg

SEQ ID NO: 24958 - DNA, 515 bp, Triticum aestivum
  unsure (1)..(515): unsure at all n locations
  Clone ID: PAT_TA_24958
gtgagagatagctagctagctccatcaggatagcactgcctgctcaagaagaggaagaggaagagggaccaatggccggtggcgatcaacctgcgctgaggcaagtgctcatggtggcgaaggcctgcttcgtcctgggcttggtgatggccgtgatcgggcttgttgccgccaccaagcaacccggcagacttccagtcgcagacggacgccggnaacggaggcggaggcgctgcgcctgcgctcggggggcngctcacccctggtggctcctccggggcgccccggcgagggccgccgccccggccggcgggtggcccctccgggggcccccccgcaggggggggccgccccctcgccgccttgcgcgggcccgccgtcgcccccgccggcccattcccggccgcagagtcgtctacatggtgggaagcatnccggcgggaacttactcgacnctggggccanatctccatcgcctggancntcctctccttctcnccgcanactctcgcann

SEQ ID NO: 24959 - DNA, 746 bp, Triticum aestivum
  Clone ID: PAT_TA_24959
tgcccaccggggccctttcttcaggtgcgtgtctaattcatttgtcaccaaaatttacacccgtcatcttccccacccgctcccaaaccctagccgacctcgccggcggtgggctctcggactatggagacggagggggcggcccccccgcccaagaatcccccccgccgcccccggcgccgcgacctcaacgcactggatccatatttagaggaatctgatggacaggacattggcattccagaagttggcatggtgttcaataaccacatggaggtcaaccgattctaccgtaggtatgcccgtcgtgttggttttggtgtctcggttaggaggtcctcgttctcacaagaaggcacctgcttatatctcgagctgatgtgctgtaaaggagggcgtccacgttatgagcctaagttcaggaagcgggcctcatcaaccaccaattgcccagcaaggatccgtgtgaagttatggggagacaaattgttgcatgtagagttggcaaaccttgatcataatcatcctgtgagcccagcaatggcaaggttcttgaactcttataagcagctttctggccctgcgaagaggcggctgcgtatgggtggacctggagctatgccagttgaagagcccagcaagatgcctgttgataagttgggtgcactcgaggaacttctgtttggagagagcaagaaccatagttttgttgagaggggccgtttgaagctccagcctggagattc

SEQ ID NO: 24960 - DNA, 502 bp, Triticum aestivum
  Clone ID: PAT_TA_24960
cgccgcggcccccccccgccctccccccgccccccccgccgcccgccccccgcaccgccggcgccgccggccacccgaccgggtggccacgcccccggccccgcccccccgcccctcctcccccccccccccccctcccccctcgcgctccccctcgccgccgctgccccccacggcccccccggcctcgctctccccgccgggtcccgcccgccccctcctgtgccccccgcgcccctcccccacccgcccgcccgccgcccgccggttcccctggtcccgcctgccgcccggtgctcgggttctagccgcgccggctgcctccgccgcacagccccccgggcgccctattcctcctcctcctcgcgcttggcgacgccttgtgctttgtggtcgccccctcgccctgcttttacccactcgtggacgccgcgtcctcctcacctctgcctgctggtttgctataaaaaatccgcgatggtgaacccacaaaaaaaaaaaa

SEQ ID NO: 24961 - DNA, 543 bp, Triticum aestivum
  unsure (1)..(543): unsure at all n locations
  Clone ID: PAT_TA_24961
cttaagagtgtttttcatgtgtgtttctgcactttaggttgaatttcaccctgcatccccgacgtagcgcttctctggctcctcccccgcttgctgccaggtctgtctctccttcctcccctgcttgccgtcatgtgcggcgttggacgtggctacttgatggagtgaagctggcctccgagcaccgtcagttgcactgcaccctacaaaaaaagaacagccgcaagttcagaatcagaaaaattagaagttcaagaagaacaaaggcactgccttcactcgtgtgcttgcaaactgctaggttgtagctcgtatgttgtttgcaactatcttcaatttcttcagtagctggtacacactttgccaaaatctaagtactttcagaatgggtaaagttgatagttggcctacaagggacaaacatgttgatggcgaattgaaaagaagnttccggaataatattnattgggaancggaaacccaaattttgaaaagggcccaanttcaangggatcccaggggtttccccgagggggggtnatg

SEQ ID NO: 24962 - DNA, 441 bp, Triticum aestivum
  Clone ID: PAT_TA_24962
ccatcttcgtcaggggcgaccaagccaactttgagattgaaccatcctttggcgttgaggccactgagctgtaccccgacctaaggtacaccactgtcgacgagtatctcgaccgcctactctgacagtttttggctggctggaacggcacccagccacagtcggcatccagagtaaagatatgagcaagtgccccctccaaatccaatgatgtctgcggctttgtgtgtaacatgtgtaaattcaccatgaataagaacctctgcttcgctgaaaagcaggggtttttgatgtagaaggttataaatcagcagttatacctgattattttccagcaccgatcttgggttgaatgaccatcggagactttggttgatttaatattctagttggcccatcaagtcggcaaaaaaaaaatataaacgatcaagctcggtccta

SEQ ID NO: 24963 - DNA, 617 bp, Triticum aestivum
  Clone ID: PAT_TA_24963
gcccacacgcaaagttcaagcttcaaactaaaccccattcccttcttctcccagatccatcgacgatgtccgggcgcggcgagggcggcaaggggctggggaaagggcggggccaagcggcaccgggaaggtcctcccgcgacaacacccagggtatcaccaacccggggatccgcgaggcgggcaaggaggggcggcgtgaacgcgcatccccggcctcctccacgaggagccccgtggcgtccacaagcatcttcctcaagaacatcatccacgacgccgtcacctacgccgaccccgcccgccgcaacaccgtccacaggcacggacgctcgtctacccgctccagcgccagcgccgccccctgtacggcttcgtaggctagatccgtctagtggagcgtcttgctcgtttgctctgtgtgacatgtattgtgctaggtggtatttactgctttggcgtgtgtcgtggggttctgtgcttgggtttagtaggctgtgtaatacctgttcaatgcaatcagttcgattctgaatcctgacgaaaattaaaaataaaaaaaaaaaaaatgcctgctgggacaacgaaccacaagatctccttcgggggtacagctg

SEQ ID NO: 24964 - DNA, 1677 bp, Triticum aestivum
  Clone ID: PAT_TA_24964
aattcgccccgccctagccgccagcggcggccagattttgctagtaacaagtgcttattagcttcacctccccctccagctgccgccgcctgccatctccggcgacgagcagggcggagaaggagaactagccatggcctcggtggcgccggaggttgagaagaaggaggaggaggagcaggtggtgaacccgtgggaggtgtcggcggggaagggcggcatcgactacgacaagctggtcgaccagttcggctgccagcgcctggacgccccgctcatcgaccgcatcgcgcgactcaccggccgccccccgcaccgcttcctccgccgcggcctcttcttcgcccaccgggatttgaacgagatactggacatctacgagaagggggacaagttctacctctacacggggagagggccctcctcagaggcgttgcatctcggacacctcgtccccttcatgttcaccaaatatttgcaggatgctttcaaggttcctctggtgatacagctaactgatgatgagaagttcctgtggaaaaatttgacggtagaggaaagtaaaaggcttgcgcgtgaaaatgcaaaagacattatagcatgcggatttgatgttgaaaggacttttatattctctgattttaattttgttggcggtgccttttacgaaaacatggttaaagtggccagatgtgtgacatataataaagttgtgggaatatttggattcactccagaggatcacattggaaagattagctttcctcctgtgcaagcaggtacatcattcccttcttcatttcccaaacacttttctggcaatgaccaactacggtgcctgataccttgcgcaatagaccaggatccttatttcaggatgacccgtgatgttgctccaagaattggttaccagaagccagcactgattgagtcaagatttttccctgctcttcagggggagaacacgaaaatgtcagctagtgatccaaattctgctatatatgtgactgatagtactaaagatataaagacaaaggtgaataaatatgcattctcaggtggccaggactctgtagaacttcacagaaaacttggagctaaccttgaggttgatgtctcaattaaatacctgaacttcttccttgaagacgatgatgagctcgagcgcataaagaaggcgtacaaggaaggaaggatgctgacgggtgaagtgaagcagcttctggttacggttctttctgagatggttgaaaggcacaaaagagctagagctcgagtcaccgaggagatggtcgacgccttcatggctgtgaggcctcttcccaacatgtttggctgagcattgggtgggaagttcataccctttctctgtggattttattgaattccaggagcaacatatggagtttcaggatttagttgtaactattaatgtgaacctggtcgctcaatcctgtatggcggccactgtttttgcaaaatcagcatgtgatatgtttgttttcaagcttgctcgatcactgcaaagatttctatttattggaattagggaacatacacatgttttctggctgaaacacagcctcctcaaatgatcatagcactgtctctacaagcttccttctgtattatggttatgtcagtactaccaaaatacgagtttgaaaaaaaaaaaac

SEQ ID NO: 24965 - DNA, 906 bp, Triticum aestivum
  Clone ID: PAT_TA_24965
cccacgtcgtccgagcacagcttgtagttcagctttacttctgctttaccctacacacaacacaacaaaccatggatgatctggttagcagctcatctttgaagagtgtcctcagctgcagtgaagcggaggctcagccggaggagagttcctggaccgattactttgtggatttcatgatgtccgaggaggaggagaagaggcaaggagcctcatattgcacttttgatcaggatgatgaggaggagggctctatgatctccgatgccgcctccctcgctccggcggcgttggcagataggtacaaggggctcaagaagctcaagaagaaagtcttcaaggctctggatcatgatgattcattggaggatactgcaagttctcctgtcaatagccctaaggtcagtgctttgtcacagctggaattcagccctaaaataaggtgcaatgttacggacctcgccaagggggctgggattggcaactattacgggagagacggaatagactgtgaagatgcagatgcggtgatggaaggagtgagatttctggatcaaagccagaggggtataactccatgtgcagagctcaaggacaaggggctttgtttggttccgttgtccatgttgctcaactaccagggctaactttgagacttataaggccctgtgtttggaacgcactatttgttttttccgaatcttgtcggaattggattgcttcctgaaattcctccaaaatttccgtgaaattcctgcgttccaaacatgaagttgaacatgtgtgtggtttacactgtacagatatctgtgggataattgaccaaaacatacagtgtgctgatggtaatgtggatactttacttcgtgaaatatatgtggatattattacaactgtatttcatcc

SEQ ID NO: 24966 - DNA, 1056 bp, Triticum aestivum
  Clone ID: PAT_TA_24966
ggtaaataagtcaaatcatacatgtcctaatgatgagagtaaattatataatatgtgcataagagagcctcaaaagcaccacaaacaattgaacggcggcgaaaccggcatgaagccaactaggcttaccgcagaacccagctttaagaccgcacacaccacaacgacctttctttagacgacagggatctcggaaacccacccagacatggacgatatagattgcacaatggacgggactagctagatgtttcaggcgatttggaaaaattatcaaagccatgtaatgcaagtgccatgtagacactatgttggtcaaatccattcatcaaacatatctatataatgaatacaaagaaaatgaggaattgccaaaaaaatgattaaaagaatataactgctgtacttcctctactgactagaaatatacatttcttttggccagacattggacaaatgccagcttggtgacatagttcgtcaaagcccaaagaagctggactcaacagttgtcgaaaatggggaaaactggagtgtcggacagaggcagttgttttgtctgggaagggttctactgaagcgaagcaatgtccttgtcctcgatgaggcaactgcttcagttgactcatctacggatgcaattatccagcaaacactccgtgaggagtttggggactgcacggtgctgacagtagcacatagaattcacacagttatcgacagtgatcttattctcgtcttcagcgaaggaagaattatagaatacgacacgccgtcgagattactggaggacgagaactctgaattctccaggctcatcaaggagtactcacggagatccaaggggttctaaagcaccacaaacaattgaacggcggcgaaatcggcatgaacccaactaggcgcacagcagagcccggcagaaagaccgctcacacacaccacacggcctttctccagacgacaagcactcacgaaacccgtccattgtacatcctatatcgtctctagttctagatcgcctagctagattatcaaggcgatttggaaaaattt

SEQ ID NO: 24967 - DNA, 521 bp, Triticum aestivum
  unsure (1)..(521): unsure at all n locations
  Clone ID: PAT_TA_24967
gctagctctgctgctcacaacataatttgcaaggatgggcgacttcgactgtggcgccatcgactgcggcgactgtggcgaccgcgactgtggcgactgctgcgatgagtgcttcgactgcggcgacatcgagccgcggcttctgctgcgtctgcttctcggatgccatcaagcggcaaggcactcctccgcatcctctgtggtctccgtgaatcttcgccgtcctcgccgccgtggtcacgctgctcgtcatcgcccctccgtcccccgcccccgcgccgccagcgtcgggggcgcggcccgcgcccccttcgcccgcccccgcccttcccccgcggccgcggcgcccgccggccacctcgccccccccctggccgtccacctcccgatcggccggtcccccccggcccacaccccgccgttcttctcggtgctgccccccccgggggcccgcttcccccgccccgcttctaacggcngggattttgctcctttccgaaangggggccccgncttttcgc

SEQ ID NO: 24968 - DNA, 977 bp, Triticum aestivum
  Clone ID: PAT_TA_24968
ctcgtcccgcatgcggcacgagctgcaggagacgctggagaaagcaatgtgctcttacacagccacgactcatctctcccctgcctgcatccgtcgccgccggcgcgcgacctccacacgccacccgtccaccgccgccgccgccccctccgccacggcgctcgccggcgcggccctcccgctccccttctccgcgcgacctcaacccgctcggttctccgcggtggcgctcccccggacggcccctcctcccccggccctgcggctccggtcggtccggcgcctggcggcggcggaggggggaggaggcggccggcatgaaggagacgctggacaaggtggtgtcggcgcacaaggtggtgctgttcatgaaggggaccaaggacttcccgcagtgcggcttctcccacaccgtggtgcagatcctgcgctccctcgacgtccccttcgagacgctcgacgtgctcgccaacgacgccctccgccaggggctcaaggactactccagctggcccaccttcccccagctctacatcgacggcgagttcttcggcggctgcgacatcaccctcgaggcatacaagagtggggaactgcaggagacgctggagaaagcaatgtgctcttagcaaatgacgggtgatatcatacaggaaaccattatatatggctctagcccttgtcgatgtacgcactctttcagcccatggcagagagctggagatgcagttgccaagttgtagatgactcaaattatgaagcagtgagttccaaatgtacaatgcactttggctatggtaaattttgtgcaatgtgtggtcaattgtatagtatcaatcgcttgtatgatggtttcctgtgacatggagggcaaccctggggagggcctttatctgcaaaagtgggtgctgacactgtttcaaacgacgaggaaataaagatgccatgcatcatctatttttcactccccccaaccc

SEQ ID NO: 24969 - DNA, 982 bp, Triticum aestivum
  Clone ID: PAT_TA_24969
cccggcgctgtgcgagatcctttcattatataaagctagcaacaggtctagtgctcctgagttgctagatgaccacctggaggcggttcttgtgaatgttcggttggtctatcttcttcggagagcccttgggactctaccccaaactgggaagacgttttgtcgctgggagaacagcagaaccttgggatggctcgcttgttcttccaccatccaaaattcggcatcctcgacgagtgcacaaacgccacgagtgttgatgttgaagagcatctgtacaggctagcaacaaacatgggcataactgtgatcacttcgtcacaaaggcctgctcttatacccttccactctgtggagttaaagctcatcgacggcgagggaaactgggagctgtgcgagatccagcattgattgacgcccccagctagagttttatcagatctcagtcacttacgccaatacagaagatgctgctgctgctgctaccgcagcgatttgttcatatcgggtcgctctcacagaccgtctggaagatgtagcagcctgtacaactgtgaagcaggccggaaaaagaagaagaatccgcttcaggaactcggcgcagaacattgcaatcatagtctaattacaccgaatttagtaacagctgaacgagcaggggccggtggtaaatcagttacttaggattgggaggtgtttcggtttggaggtgtggagtgaagtaggaagagagtgtagaacagcagtacataatctcagagcagctgttgatgtgaattcatcaaacctattattgattgattccatgctagtgtagtacatatggaataaatttggctgttgttgccaatatcaaacctagttgtcatcaaaaacatctgtgtgaacaaaaggtggcataattatggcggttgttgccatcgtcttcaccatgcccccgtgccgtttcacagtttttgatgacgacagcgaaccctcgtgc

SEQ ID NO: 24970 - DNA, 803 bp, Triticum aestivum
  Clone ID: PAT_TA_24970
ggcgttgcggctgctgcagagggggcacctcttatggccctggtatagtccgggcttttcaatactgggggcttgatgaaagaaaaggtactcttttgcagcagtgaagtaggccgaacttcgtttgttcgacagttggagtcagatttccacatcgacgcaagcctcgagataatttcccaactatctcggttcatccggtgccagctattcgtttcctccatggaaggagggcagctcgcagccaatgtatttaactccccgagcctggaggagttcttctcttgagtacggaggggaaaacataaggggttcacaccctaatagcacatcctttcaagccccgaggtgtcaggcaattccgtgatgccagcttcgcttcgcagaatataaagtgaagcaggcaaccactgctgatcatgtcaccgcagctgtcgctggttcattcaattggcctcgataactgtgctgtagttaataacaatggtaagttagactcatcaggttgattatggcagtttgccgaagatgttgtaaaccgcatgaatgacacaaagcactatgcctctatataaagactgctgatcatgtgatggcagctgtcgctggttcattcagttggcctggtagttgtgcttgtagttaataacaatggtaagttagactgatgaggttgatcacggcagtgcactcaaggtggtatacgcacccaccccacccaccaagcatcctcctctatataaagagaactttcgtcattggagcttgggcagtcgtatcaacttgtgtgtgtaactgtagat

SEQ ID NO: 24971 - DNA, 1341 bp, Triticum aestivum
  Clone ID: PAT_TA_24971
ctgctttgggtgctgatcagggttggtgatacatgtcggtgacggcaggagctagtcgggagagcctctgtagggctgcaaggctgtgcggaggtgaagacgagttgccaccaatgccggaggagtgtcaatgccgtttggtgtaccagctgtgacaggagggggtattgcggcggctgcatctccagatggtactctgacattgcaatagatgatattcaaaaggtttgtccagcatgccgtgggcatttgtaactgcaaattttgcttacaaggagacaacttaattaaggcaagggtgcaggagatatctgttgtagataagttgaaatatctccatagcattttgggcatatgttcctcccagtgctaaagcagatttaccccgaccaatgctttgaaataggtgttgaaacaagagcttatgggcccaagatggacatcattagggcaaaagatgaattctgatgagcaaatgtgctgtgactttcgcatgctgcctgggtttcaccacccgccacactgtccgtggtctttccctgccttgcgccttgacgcctcccgcgacttttggcgctctccgacatatggcccctgtggagaatatgctggatgtaacggtcctctgcgacagacaaataaagatagtgcgagtgacagagcaagattggaaccatctgcagcagcggtcaacgataagttgttcccacagccgatagatgcaaatgatattggcatcagatctttgtttcctacatggagagtcaacaatgatggcagcatcacttgtgggcctcatgaggctggtggttgtggctcctcaaagctggtattaaggcgaatattcaaaataaactggattggtaagcttgtaaagagttctcaagaaatggttaatggttgcaaagcacatgatcttgagaatggatgctcatcctgtaacgatagcagcaagattggactcaattggtcgccataactttggtctctcaaaatgttcagatagtgatggtattgatgggaattctgtgtactcttctgtactggagaacttaaaatacgagggtattgtccatttccgtaaacactggataaatggggagcctgtaattgttaggaatgcatttgagccttctttatcatcaagttgggacccgttaagtatttggcgaggaatccaggagatcatggatgaaaaaatggatgaaaatgccatagttaaagctgtggactgctcaaaccaatcagaggtgcatatcaagctcaaccaatttatcaaaggttattcagatggtcacaagggagaagatggcaagttaatgatgctgaaattgaaagatt

SEQ ID NO: 24972 - DNA, 1042 bp, Triticum aestivum
  Clone ID: PAT_TA_24972
gccggccgggtcgggaaaaaaaaaaaaaaaaaaccatcacctcgtcccatcccgccggcgaaggctccccaccacccaaccctagatccatacagtcgttagattagatccgagcggcggcggccgcggcgtggaagatggtgtgcatccggcaggcgacgatcgacgacctgctggcgatgcaggcgtgcaacctgatgtgcctgccggagaactaccagatgaagtactacttctaccacatgctctcgtggccgcagctcctgttcgtcgccgaggactacggcggccgcatcgtcggctacgtgctggccaagatggaggaggacccctcggagccctgccacggccacatcacctcgctcgccgtgctccgctcccaccgcaagctcggcctcgccaccaagcttatgtcggccgcgcaggccgccatggaccaggtcttcggcgccgagtacgtgtcgctccacgtccgccgctccaaccgcgccgccttcaacctctacacctccaccctcggctaccagatccacgacatcgaggccaagtactacgccgacggcgaggacgcctacgacatgcgcaagatgctgcgccagcccgtgcccaagaagcaccaccaccaccaccacgccggcgggggctgctgctcccacgacgcccctgctgccgcggcggccggctcgtccccgacttctgcttcgcccgagaagaaggccgactcgtgaggaaagccatttcatgcgcaaagagctgctgaacctactggatgatatgaagcatatggtgctctccttctggatcatgattgtagccttgtaccaatgatacagagggaacattgtactgtgatctgtaggcttgcctggtcatgttggccatagtctcttgtaattcttgtgagaattattgacatgcacatattttaactacctcccatttgttgttgtgcctgaaattttgggggcaatcatgcctgaagtgtggacggttagaccagcactcgataaaatttgttttgatgccctcttctatgatcgcc

SEQ ID NO: 24973 - DNA, 1047 bp, Triticum aestivum
  unsure (1)..(1047): unsure at all n locations
  Clone ID: PAT_TA_24973
agcgccggcgaacccgccggcgaaggctccccaccaccaccaaaccctagattacagtagatagatctcgttctccggcggcggcgaagatggtgtgcatccggcaggcgacgatcgacgacctgctggcgatgcaggcgtgcaacctgatgtgcccgccggagaactaccagatgacgtactacttctaccacatgctgtccgtggccgcagctgctgttcggtcagccagaggactaacggccggccgcatcgtccggctacgtgctggcgaagccgtggaaggaggcacccccctcggagcctatgtccacgcccacatcacctcgctcgccgcgctcccctcccaccccgcaagctccgcctcgcccccaagctcatgtcggcggcacccagcccgccatggcaccaggtcttcgggcgccgagtacgtctccgctccaacgtccgccgctccaacccgcgccgccttcaacctactacacctccaccctcggctaccagatccacgacatcgaggcccactactacgccgacggcgaggacgcctacgacatgcgcaagatgctgcgccagcccgtgcccaagaagcaccaccaccaccaccacgccgccggcggccgctgctcccacgacgctcctgctgccgcggcggccggctcgtccccagcgtccgcttcgccggagaagtaggccgactcattagatgaaagccatttcaaaaacaaggagctgctgaacctcctggataatatgaatcatatggtgctctcctcttggatcttgattgtagcccctgctgtaccattgatacagagagaacattgtactgtgattactttggtcagatcgcacacctttggccagaatccttgtacttcttgtgagacttaatgacatgcacatattttaactacctcccaattgttgcctgaaattttgtgggcaaatacgtggctgaaatgtgggacggttagactgccagaggagcactcanataaaatttgtttggggattctttttggcaagaaaaaaaaaaaaaaaaaa

SEQ ID NO: 24974 - DNA, 1281 bp, Triticum aestivum
  Clone ID: PAT_TA_24974
ggcgcgggggcggggccgcgggcgccgtcgcggccgcccccggggccgccgcgcgcgccggcgcgccggcgcccgggcggcggcgccgcccggcccccggcggcgccgtcccgccgtcgcggccgggagttcactagtgattagcgtggtcgcggccgaggtgaaaacctgctctatcttcgaacggaccggcggcggcgaagatcgttcccttcttgaaggcgtcgtcgaggctctcattgcccgtcatgcggctccgggggaaactctgatccttggatcgggcggtggcggcgctccagcgtcgtatccttcctgaaggcgccgccttggagcgcatggttcgtcatatgtagtttcatctcttcagggcggtagtgctaggagtggtgttgctgcgctcaacacctatgtatcctgtcttgggtgtgtgcgtgtgttgtggtggcgtggcgtgtggttgtactggatgcttgtggtttggtgctttatatataaaacggggcgaaagcctttttcggtaaaaaaaaaaaaaaaaacctgcccgggcgggccgctcgaaatcgaattcccgcggcggctagtgggggcccgctcacctcgcgcccggtgctgccaaacgggtcgatggaggcctggtggccggcctattgggtctcggcgctggggtcgcccaggggtgcaaaaggtgcgacctttctgctcgtctctttggttgggatagcggcaggtctcgggtgagggggtgtcaaggtcttgaatgccggggcggcggccctggaggtggttgcgcggctctctcgggcggaggccgtggcttggtgctgcccggtggccatggccgtgtgggcggcatggtcgccgggggctggcgtcggtggcggtgagttttagccggggtgaaaacctgttctatcttcggacggaccggcggcggcgtagctcgtacccttcttgaaggcgtcgttgcggctctcattgcccgtcatgcggctccgggggaaactctgatcatcggattgggcggtggcggcgctccggtgtcgtatccttcctgaaggcgccgccttggagcccacgattcatcatatgcggcttcatctcttcgcggtggtagtgctaggggtggtgttgccacgctcagcgcctatgtataatgccttgggtgtgtgggtgtgttgtgatggcgtgcgtctgtattgggctgttgtattgggctgttgggttcgtgctttatatataaaacggggcgaaagcctttttcggtaaaaaaaaaaaaaa

SEQ ID NO: 24975 - DNA, 550 bp, Triticum aestivum
  Clone ID: PAT_TA_24975
agatggccgtgcaccgccccccgccggccatgatgacgccggacttcgtcctccgggacttcatccagaaactgttcatggacaacagggagcagctcaccctcttttcaaggggatcacggtgggcaccgacaagttccaagtcacaccattgtcccaggaagtgttgattgtctggggagagcacgaccagttgttcccagtagacaaggcctactcaattcagaggtctttggatgggaacgctagagtggagatcatcaagaagacgggccatgctccacagctcgaggacccggcccggttcaacaacatcatgctggacttcttgacaccaatggcagctcgctatgagatgcatagccactacctaccccattgattgcaataagattgtttagccatttgggcccatgcattcagagctatcatgtactactgatgtgtacatcaatcagggtctatttgatttgcatgattttgggatgcaggattagagtgtcacatctctctcgatatttgattttatgtaccccccccccccccccgc

SEQ ID NO: 24976 - DNA, 1093 bp, Triticum aestivum
  Clone ID: PAT_TA_24976
ccccggcccgccgaccccgccgcccggcgcgggctcctcgccgccgccctccgcccccactcggtcacgctcccctaccccgacggcgggtctacgggcacatgcaccgtgcactactgggcgccggcgggggagccgcggctgccgccactgctgctcatccacggcttcggccctcgggccacctggcagtggcgctgccaggtggggccgctgtcccgccagttccacgtcatcgtcccggacctgctcggcttcggcggcagctcctgggactcgccctcggcgccgccgccgtccgaggccacgcaggccgcggcgctcgcggcgctgctggactcggtggaggggctcaagggcaagcgggtggccgtggcgggcacgagctacggcgggttcgtggcgtactggctggcgcgcgcggcggggccccggagggtcggccccgtggtgatcgcgagctccgacctgctcaagacggcggccgacgaccgcgcgttcctgaagagggccggcgaagggtggagcggcgcgcacgagctgctcctgccggccgaacccgccgccatgaggaggctgatggagatggccgtgcaccgccccccgccggccatgatgacgccggacttcgtcctccgggacttcatccagaaactgttcatggacaacagggagcagctcacccatcttttcaaggggatcacggtgggcaccgacaagttccaagtcacaccattgtcccaggaagtgttgattgtctggggagagcacgaccagttgttcccagtagacaaggcctactcaattcagaggtcattggatgggaacgctagagtggagatcatcaagaagacgggccatgctccacagctcgaggacccggcccggttcaacaacatcatgctcgacttcttggcgcctgcggccgcgcccgctgagccgcctcgcccctaccgccgcccgcgatggcatgcagagccccccgccactccgccccttgccttcagggcttccttgcccttcgggcccgtgcatccagcagggtcgtgttgacttgcgcgtacaaaaaaaaaaactcgagactagttctctc

SEQ ID NO: 24977 - DNA, 904 bp, Triticum aestivum
  unsure (1)..(904): unsure at all n locations
  Clone ID: PAT_TA_24977
gntaaanagatcttaagcaccaatcatcacgtngaggcacaaatattgagtatttcttagtagcagctggacaaagccatctctacctgattaatgagtggataccatattgcagtgccatttgcttcttaatggacttaagacctatggaagctattccacaaccccaaattatagttgaggagcccgctataattctgtgagatggtagttactggaggcggtttgatctctcgacggagttgactacaaccgaggataaccaacaggagatttaggggttggtgactgatgcaggaagacgatgctgaagtgccacttgttggaggaagttgacgtcgaagtgttatttgccggaggaagatgatgtaccagcggtactctaaaatctagaggacaatgacgttttggggtggtcgaagcattgcctggtgaagatatttcagggatagctgagttgatcacgtttgcacgatggaaggagaggctatttggatgctgagagactttatctatgtataagcgaacatcagattttggttctatttggagagatagtatctctatacactattgagagagtttggttatgttttgagagcctttatctatgtataagcgaacgtcaggttttggttctatttggagagatagtatctctatcccctattgagagagtttggttatgtcttgagaaattgtatctttgtacaggattgtgagaggccaagagttatttgcaaaaaaagaagaagggtgagccccccccccctgtaccatgtaggggggtgtgtgtgctgatcaattttttatattgtgggggggccccctactttgcaaaaaaagaacctgagagtttggtccttcaaaaaaaaaaaaaaaaaaaaaaaaaaaaaaattttaa

SEQ ID NO: 24978 - DNA, 535 bp, Triticum aestivum
  unsure (1)..(535): unsure at all n locations
  Clone ID: PAT_TA_24978
tgcaagtacccatccancaagcaacggtgctgccgtcctgaacacgacgtctccggtgaccccggtgaacccgacgtacggatcccctcccggcggctcctacaactctcctcccggtccaggcggctactacaactcccctcctatctacgggtccatgtcgcccccggactacggcggcaagcatcagcgccgccacggcaatgatgcccggcagcaagtgcacgacggccgtgacaacgtcgctgacatgcctcctcgtcacgacgatgtccctcggcctgcacaagtaagaagcgaagttcacatggttttaattcgcgcgcaaaatgcacttggatgccagaatgaactgaagaggattcagatgaaccggcaccaatttgcatccaagaaaacagaggaggcgccatgacagaagcaagagtagcaatggggcaatggccgccgggcaagctggtagtagtcantcagtgtttgcaaaatattttgtanctgtngtcaagtgtctgcgagttttgggggttatgtttgg

SEQ ID NO: 24979 - DNA, 1279 bp, Triticum aestivum
  unsure (1)..(1279): unsure at all n locations
  Clone ID: PAT_TA_24979
cccacgcgtccgctcacacggcacgagccgcgccagccaagtggtgtgcgacgcgagacgcgtgacgggctcgctcacgccggccggccgggagcggacgggccggtcgatccatccaggtcgtcggcgtcgtcgtcggcgtcgcctccagaagcacgagcccagcatagcacggccgcagaatattccacgtcccttccgtttccggccccccctcctcctccccagcagcaataaaaaagcaagccaatcccccacccctcctcctcttcctccgattaatcaaaccgcgcggcggcggcggcggcgagcgtgcgacctacgaccaccagacgacccaaccgacccactgacccacaccaccggagagctcttccttctacgtcaatcaaccgaacccagttcaacaacctttcaattgcccgccagccgatctgccaggcttatgttctccgtctcctccgacctcacctcgccccctcgccccgcggcttctgggctccttgggggccaaaatccccgcttgccgatcccaggcgttcaaagaaacaaggggcctttcattcaagcgattcctgccagtgtcaagttcgccatggggggctgtgtgggcaagggtcgtagcattgtggaggaaaagcttgatttcaaaggtggaaatgtgcatgtcataacaaccaaaggaggactgggaccagaagattgaagaagcaaacaaggatgggaaaatagttgtggcaaacttcagcgcttcgtggtgtgggccatgccgtgtcattgcacctgtttatgctgagatgtccaagacttaccctcaactcatgttcttgacaattgatgttgatgacctaatggatttcagctcaacatgggacatccgtgcaaccccgacgttcttcttcctcaaaaacggccagcagatcgacaagctcgtcggcgccaacaaacctgagctcgagaagaaagtacaagctcttggtgatggcagttgaaccatgctacagaattagaacagagccagcttgtcattgcttatatatctgtattgccatgcttgtgtgtcttatgtgttgcatgatagtttcctggtgtacagtttccgtgtcttttccgtctagacaatgttttacaattttgcgacacgcatatgcatatgctgtgaaactgtaagatgaccctgctggtaaaatgctagttttgtgagagtgtcaaaaaaaaaaaaaaaagctggtgagcgccgntccgggttgagaaaactaaggctcctggnagtgttang

SEQ ID NO: 24980 - DNA, 988 bp, Triticum aestivum
  Clone ID: PAT_TA_24980
agacaatgcttctgataagccggacacacccatgtgcccgcgtagatctgatcataggaaggagaagtcgcttgggctgctcactcagaatttcgtcaagctcttcctcaccatggaggttgagacagtctcacttgatgaggctgcaaggctgctccttggagagagacatgccgagagcaatatgagaactaaggttcgtcgactgtatgacattgccaatgtgctatcttctttgaacctcattgagaagacacagcaggtggactccagaaaacctgcattccggtggctcggtcaggcgaagcgaaaggaaggtgccactgtcacggttgctttaccgcccccctggcagtgtttccccagcaagagggcttttgctgccgacttctccaacttccaccttaccaggggcgggctagtctcggaaacagagaacaaacccaaactcatgcagggtggcagcagcatgttgaaaactttcgagagtcagctcgggcaagggaagagtagtggctttgtttatgggcccttccaccctgctggtgcaaggaaacatgaagttgatgatcagacagtgagggagaatgagatgaagaacattcaagactgggagaatctcgctgtttcattccgtccacagtaccaaaatcatgcgctgaatgatctttttggccattatgttgaagcatggaaatcatggtacttggatcttacacgggaatcaacctcatgaaggatggtttagtttaggcaggtctgttgtaaatcagttcttgtaggcagatcaactcatctgccgaggactctagaaaggattcgacctgtacaagatgtcataaacacaaaggctcatttcgcctttgctcgatgtatttactcaatgcaaaaaagaaacagaataatgatacacttgactgtccatcttttttggcacagtgttttttggtctacttagttcatcttcagtctttttgcaaaaaaaaaa

SEQ ID NO: 24981 - DNA, 966 bp, Triticum aestivum
  unsure (1)..(966): unsure at all n locations
  Clone ID: PAT_TA_24981
cgtccccaaatctccaagcgcgagcgacagccggccctgcctcaacctcccggcgcgtctccgaccatggcccgcaccaagcagacggcgaggaagtccaccggcggcaaggcgccgcggaagcagctggcgaccaaggccgcccgcaagtccgccccggccaccggcggcgtcaagaagccccaccgcttccgccccggcaccgtcgcgctccgtgagatccgcaagtaccagaagagcacggagctgctcatccgcaagctccccttccagcgcctcgtccgcgagatcgcccaggacttcaagaccgacctccgcttccagtcctccgccgtctccgccctgcaggaggccgccgaggcctacctcgtcggcctcttcgaggacaccaacctctgcgccatccacgccaagcgcgtcaccatcatgcccaaggacatccagctcgcccgccggatccgtggcgagagggcctaggctgcaacccatgcgtcgtctgttagatccctgttaggctgagttcgtcggcggaaatgtgtgtgctactgtagtagtgttccagaatgtacctgtgttcttgtcatggttgatgcgttgtgccccatctgatggtaccctcttgttgccatcagcgatggaaatgaaaaatgttggcttcctcttctcaaaaaaaaaaaaaaaaaaaaactccgagnggggggggcccgggtacccaattcgcccctaattagtggaagtccntattaacnccncggctcaactgggcccgntcgtttttaacaacggtcnntngactggggaaaaaacccctggncgtttacccaanctttaatcggcctttgcaagcacaatcccccctttcccccaagctnggnngtaataaacgaaagaaggncccggcaacgnattcgcccctttcccaaacaagttgccgcancccctgaatggncgaaatggggancgcnc

SEQ ID NO: 24982 - DNA, 1159 bp, Triticum aestivum
  unsure (1)..(1159): unsure at all n locations
  Clone ID: PAT_TA_24982
ctctccccttccgcagctctcgatccagatcggatatagaggccaccaccgagcctcctcgagcgccttcttccttcctcccaccggagctctagcatctccctgcaacatcctcctttctccttcttcctctcttcctcccatgcctttcacttctttctttttccattggccatgcagggagcacgcgcagggagcctcgccgttgctgccaccacccggacatcgtcgcgccaccgccacctccgagttaacaggccgccgccgctcgtcctcccatgcgaccggcactgggccgcactgcgcgcgggcaaaccggcccctgccggtggaagtgtgggtaccgcgaggggaagcatccggtgcaacacgacggtgactgagatgttgctcgggctatacgtgacggcgaccgagactccttcgcgttcgttccttattatccaatctgcatctcagctttcttcctcactgaagatgtttcatgggaatcatgctgattattttgtattcggatttcctcatggaagaataagatgctgctgattgtaacctcctataattggagaatttattaattccacaagtacaagattaacaaagagaactattccgcccaccggcgggttgtnctttttagagcggccggggggccccattncgatttttncaccccgggnggggtaccaggtaaagngtaccccaattcccccttntagggagtngtnatnaaaaattcacnggcccggncgttttacaacgncgtgggantgggaaaaaaccctggnggttaccccanctttnaantnnncctttggaagnaantttccccctttttngcccagntgnggnggtaaaaaaccagnananaagggncccgnnaccgnatngccccttttccnaaaaagtttgcccccaacccttganatnngggcgaaatnggganaaccccnaattttttttaagnggggtnataaaagggggggttaaaantcnccgggaatcctnaaantggggttnggggggtattttttanaaaattcaacaaggntccccnannggggntttattttttangngnncccctnananatccntaacnaaaaanntgggtngcntggganacaaataanaanggangcnctntaacccanantnt

SEQ ID NO: 24983 - DNA, 1047 bp, Triticum aestivum
  Clone ID: PAT_TA_24983
gagcgtggtcgcggccctggtacgtgcccttgctgcggccttagtgttgctacacctcctcatgtgatttcagggcgtgcggcctgcgggtctagtagctggcgcccctccatcaggtcgtcctccccctctccaggctctccggagtgatcctgcactgccactcccgcgtgcctcccggagagtgttgcgggcgctgctttgccagtcgctaaacgaccggttgtttttgcctccgacgccggcccgccgtccggccaagcctgtgggtgtcaagcgattaatcatgcacattcttaaattatgaagagtaaaaaaagattttggtgttggaggagcagccagcaagtgtagtttgcaaaccaaatgcagtttctatagtgaacactgatttgcgacctcagctcagccatattgaacggattgattgctctgtgaaataggagttagcccataatagaaatgccactccaatattggagtttgtgttgattgagctgagaaacgaccagggtgtgtaaaatctggatcgctacaaacaggtcaagaataacttctccaagctctcagaagagaagcaataatgtgactcccaggtgcctctctgagagaaaagctggagatgctttgccagtggcaaaacaaagggaagtaattgctacggacgccagccaggtgttcatgctattggattaatgttttctgctcttaataatgcttccgtttttcttcttttagaacccttcttttgtactcttacaaatagcagatgaaaggagaaggatgaagaagtcaagctattggagagatcaattgaggagctcaaaagaactttagtgttctcaaaagtagctttatttagtttgagtgaattttgtggcctaagtgttgtagctattcattttgccacgcattctgaatgttagtacacacccatgttggtacagaactcctattgttatgcctgttatgacaacaactttcccagattttgtgcataaacatacatatgtggactaaattcttttgttacttgctcaccccccc

SEQ ID NO: 24984 - DNA, 1205 bp, Triticum aestivum
  unsure (1)..(1205): unsure at all n locations
  Clone ID: PAT_TA_24984
naganctaangagaattggcagcatccattcttcccggcccgatcgcaccactcccctatctcgctgggggacgcttgcctgccgccggggtggccgactctggcccctccgtcgcgcctgttgacctccacccgatcctcatcccaaggaaggactaccttatcggaccccgcccgttccggcccagcgttgtggcctccggtccccacggtccgcgcccccttttcgcccttccacctgtggctttcaccccttgccctttgcgtttatagctgtatcctttctcagcgcatgccactcttatattgtaatactctttagcttacaagtccagttccacagttgtgcagttaggaggcactccgggcttaccaaacagtcctgtggcatcagttgatgagttagccgatgaggttgcagaagtacttgatttctttgtattgagttctgttatgtgcttaggtgtcagtgctggtgcatacattcttactctcttcgcaacaaagtatagggagcgtgtgctaggtcttatcctcgtttcacctctatgtagaactccctcatggactgagtggttttataacaaggtgatgtcgaatttgttgtattattacgggatgtgtgacgttgtgaaggactgtttgttgcagcgttactttggcaagagagtgcgaggaggctctgctataccagaatctgatattatgcaggcgtgtagaagtttcctagatcaacggcaaagcatgaatatatggcggtttatccaaacaatcaatcagagacatgacttgacagaaagcctgaagcatctgcagtgcagaactctgatatttgtcggtgagaactcgcagttccacactgaagctgttcacatgactgcaaaacttgataagagatacagtgctctcgttgaggtgcaagcgtgcgggtccatcgtgacggaggagcagccgcacgcgatgctgataccaatggagtacttcctcatgggatacggcttgttcaggccgagccatgtgagctctagccctcgcagccctttgaacccgttctgcatatcgccggagctcctctcgcccgagagcatgggcgtgaagctgaagccgatcaagacgcgggccaatctcagagtgtaggtacatatatggaagaagaagaagaagaagaagaagaagaagaagaagcacctagttctagatcgcga

SEQ ID NO: 24985 - DNA, 1068 bp, Triticum aestivum
  Clone ID: PAT_TA_24985
ggccgacctttttttttttttttgcgaaggcaaatatatcatgacagaccaatcacgccatggcacaacatatctgtaattgatcatggacaccatctagcagcaagttacaatatcagacgatgtacatcactatatagtgcctaatgtcaatccatacaagcagtacatgaggcatacacaacctgaagtgccgaaaaggacacacaacagatctatctcttatgaagaagattttctgtttcaggcatgactccctccttttgtgctaccgagcttggatagtaggtagaggcaacctgaagagaggaagatagatccagcgaagcagaagaggtcagtacatgacgtgatggtcaccctcttgctcttctcggagatgccaaccagcagaaccaggacgattacatgacccagctttgtcttgaggtcactcaccgagcggatttccagccacttgggccgttccggaagcttgaacaagccaaagaggctggagcggtcatgggactgttttgcgatgtccatgttactgatgaacagctcgtacaggcccgtcccgaagacaaacatgaccgtgccgatgagatacatatcaatggcttcaatcagcatgagcacgaccttcccatcgccgcgcaagtagtactccacgaaggcatccatcacaaaagtgcagcccttgaggaagcagaggacggatccggcgagagatccggcgatgccgaggaaggccatgaagcggcaggcgtagatgaccttctcgatgcccgcctccaggtccgacccgaatcccgcgcggggcagcccaaacgggcggaaccgcacgccgtggtggggctccgcgtgcacggcgctcgccgccgccgccgcggccgcgtgggggccaggctcccccctgaccctcacgcgctgccccggccgcgccctcggcctcggcctccacgcccagcctccgcggcaccccgcgcccaccgaagcctcggccgcggccgccgacgccacaccggaaccgaagggtctgggcctcatcatcactgccgcttcgatttttgtagtccggccggc

SEQ ID NO: 24986 - DNA, 378 bp, Triticum aestivum
  Clone ID: PAT_TA_24986
gctgaattacattctgacaagatggtttgcgcaaaaatgttcatttgcacgtgctacctgtggcatggcctcaatcgattgaaaagaatgtcaaggttcacctgattgatgcttttcttggcccagttttcgttgcaactagaagcaaaggtgcgctttgctgcgttgttcctatcattcttggcattgtcatggtgattgatatggcaaataatccgatgcgctgcaagaatttctatctagtcaccttcctgaagaatgtaacgtgagctaaatgaggaatgttatacaaagttaatctgtaataagaggacacattctaaataaaaggaaccattagctcaaaaaacaaacaaaaaaacaaaaaacctgttaagt

SEQ ID NO: 24987 - DNA, 661 bp, Triticum aestivum
  unsure (1)..(661): unsure at all n locations
  Clone ID: PAT_TA_24987
atntggaaaaagaggtaaaataaataatatngnttnaaaanggnaangataaggtnaggaatanattntgaagggannattcnatccccccaaatgntattcacaggtnaaanatcgaggaaataggtgggatanaancnactcangangcgctgtctggccccgacatgctcatgtgnaaacatcaattaaatctatcgcccggtgtcatttganttcatccctaggtcagcctactggtgttggagcagttactccaccgattatttttggagcacagaatgcataaaccttgtgaataactcttgcagatatagcagcagctgatagggtcccaccgcactcccataatacagaaaggtaaccccgatcataacaatatgacataacatctctaggatttagcatgtcaaattccactacttcaacacccttcatagcaagcttcttttggaaatctctccgagcacctctttgtgttgcaactattgtataggcctcatgaacattccaggaatttgcttcttcaggaaggttacaagtttgtgacattacaatgcgcactggaacatgcccccgcgcctgccttgcagttaatncgaggatcatcacggggaactgtattcccaccaactatacaagcatcacttcctccacgcan

SEQ ID NO: 24988 - DNA, 868 bp, Triticum aestivum
  Clone ID: PAT_TA_24988
ggtaggccccaggggctccctccacttcgggagccaccattccatgtcgctccacgcccgctggcggcggccgccccagcagagcgaagctaccggcgcggcggggcggtgggtgcggcgacccccctcggctcttcccgcgaccggcgccggcgcccccagctccgcgcaagggcggagcgacgtgacgccgcccctccaggccgcgcctccctccgcgagtccgcggccaggaggctggacgcgtggtggcggctgctcgccgcgggccgtcccagacatcgtggccggccaggccatccgcgtgaagcggcggcgcgacgaggagcagcgcctcaaggcggcgcgggggcgcgagaagagctccgacgaggtcttcgtctgcgagcgcgtctgcacctccaagcggatgctcaagaaggtgggcgccttctccaaggaccccatcccggacacctgcgtcaccgtctgcggcgtctccgagctcgacgcctgcgccgacgcctgcgggcgcaccgtctgcgtcaaccagcaccaggtgcccaactggaacgacgtctgcctcaagcgctgccagagcgagtgcctcaagctctcctccaccgtcatgtagtagccagttgccgcgccccttatcctgatgcggtctgtcctgcttcagtttactttcctgcctagagacttcagacatctgtggctgtcagtttatatatccgcagcggaggatcggagaaatccgagtgaaatgggcttatcctcgttgttatgctcggttcattccatcgattctttgaaaaattgacctctgcacatatcttttgtcgagatgaatcagggttgtctagctaaaacaaacaaaccccccggc

SEQ ID NO: 24989 - DNA, 536 bp, Triticum aestivum
  unsure (1)..(536): unsure at all n locations
  Clone ID: PAT_TA_24989
gctcgatcaagccttctcttgccctgctttctcctctgtttcctcgagaacaaggaagaggagccggccgaccatggtggtccttgccaagggcgagctcgagcagatagcgctgccggcggcccagccgccgctggcccacgtccgggcggtcgacctgtccgccgccccggggcccggccgcgcggccgcggcgcgcgcgctggtgtccgcgtgcgaggagcagggcttcttcaaggtgaccggccacggggtgccgccgngagctcgtgcgcgccgcggaggcggccgcggcggagttcttcgcgctgccgcaggccgagaaggaggccgccgcgggccggccgctcgggtaacggcagcaacgcgcatcggcgtctccggcgacctccggggtgggatcgagtacctcatgcgggggcgtcacccccgccggcngcgctggccccgccgcctcctttcggcgtcctggacattgccctgcgcgcgcgccgccgccgcgcccctcgccgtgcccccctcccccttgcgggatc

SEQ ID NO: 24990 - DNA, 835 bp, Triticum aestivum
  unsure (1)..(835): unsure at all n locations
  Clone ID: PAT_TA_24990
cggcacgagggtcggcgtcaccgcctgcgtgctcggcgacatgtcgtcccgccccaacttcggcctcaacgagctcgacttcgtcttctccaccctcgttgtcggatccatcctcaacttcgtgctcatgtacatgctcgctcccacagccggggtctccgccgccgcctctgccgccgccgcggccgccgtctcctccctccccagccacatgttcgagccgggtccttactcgctcggctcccgcgtcgcgaccctcgtgtccaagggcaccacgttcgcggtggtggggggttcggggccgggctcatgggcaccgcgatctccaacgggctcatcgccttgaggaagcgcatggacccggccttcgagacccccaacaaggcgccgcccacgctgctcaacgcaggcacctgggcgctccacatgggcatcagcagcaacctgcgataccagaccctgaatggggtcgagttcctccttggcaatgtcatgccacccccggtcttcaaggtggccgtgatcgcactccgttgcatgaacaacgtgcttggtgggatgtccttctgtgttgctcgcaaggctcaccggtgcgcaaaaatcagataagccggcatcctctggattcagaagccaaaggagaagattgatanctgaggggcgatgccattgctgctaatgttagcaatgangacaagtgatttgagtatagtagacgtaantagtcngggcatgcctgcttgcgttgtgcatcgccctaacctcctttgcttggacacanggcaanaaacttgtagatggtaagtcgtccgttggttgnaataatgaatgaggc

SEQ ID NO: 24991 - DNA, 505 bp, Triticum aestivum
  unsure (1)..(505): unsure at all n locations
  Clone ID: PAT_TA_24991
gaaacacaagaaaatcgttgtagcaaagccatgaggccatcacaagctctctcgcttctcgttgttgtcctcctcctcgtctcgtccagtgcttccatcctagaagatacctgcaagcgcttcgacggcgctgacatctatgatatctgcatcaagttcttcaaggccaacaaggacagcgccaccacagacaagcgtggccttgctgtcattgccactaagattgccagtgcgacagctgtggacacccgcaagcgcattgccatcctgaaggccgaggaaaaggaccagatgatccaacaggtcctcgcctactgtgacaatatgtactccagagctatgggcttgtttgacaaagctgccaggggcatcttgtcaggcaggttgggcgacgcggtgacgaacctcagctccgcgttggntattcccaaatattgcgatgacgagtttcctcgaggnaaggcgtgaaagtcaccgttcgatgcccgangaacaacgaagttct

SEQ ID NO: 24992 - DNA, 463 bp, Triticum aestivum
  unsure (1)..(463): unsure at all n locations
  Clone ID: PAT_TA_24992
agatcacaagaaaagttgattgtttcacacttccaccgagccaagtacccaaccatagctgcggtacccgtcaatggtaaccaaagcatataacctacacacgaccaagtaataccaagtaacaagctacaaatcggctaaacagagcacacacggaacatgaaatgcatgcataagcatcgaacaccggccacctccatatagattgatcacagctgtgtcttgaacatggtgacgtggccgaggcgctggacgatgtcggcgacggagcccacggcggcgagcagcgacacgacgaagcgcgccgacgttgagcgcctgcagcgccacccacttgccgctgccgcgcggcacctttgcctgcgtgatgtacatggtgaccggggaagttagacggtgagccggaaaagaaagnggcggcgcccagcaaggccgaaggattggcgttgaagaaagggcacan

SEQ ID NO: 24993 - DNA, 734 bp, Triticum aestivum
  unsure (1)..(734): unsure at all n locations
  Clone ID: PAT_TA_24993
gggggggggggggtttttttatttttttttttttttttttttttttttttttttgagaatgactgggtaaataacacttttttaagggcaccggggggaggggaacctcccacctcgaatgtattcattttccctataaaactttggggggggtgtgggggagaatggttcaantgaaccaaagatacctgaggcacaaggggaaaaaaaataaagcaaaacaacccatattgccaacccacaaggggaaagaacaaagaggggaaacacaacactaaaacaaacaaagagcgccgcctgtgcaatcgaacggaatcagccaaccaaaaccaaaccacgacactgcaccgtcgacacagtcaaaaggcttcgcgcatccgaaactggacaacgccgcngacaccacctgtgtcgtggggcacattcgaagggtcacacgagaccgagacggatgtcacaacgcctgcgtgccaccaagcatagtcgaagagcatcgcctagcagaccaaaccatggcactgtaccgtcgacgcaatcgaaaggcacatgccaaccaagactgcacaagggccgcgacaccaagctgtgttgggggtacattcgaacggtcatacgaggccgagactgcgccacgacacctgttgtgccaccggcgtntccgcanggcaccgcctagcaaaagacacaccaagggggcnntcccnggggggggcccggtncccaantccccctan

SEQ ID NO: 24994 - DNA, 2625 bp, Triticum aestivum
  Clone ID: PAT_TA_24994
tctgttccgccacttccacccacccaccttgacctcgcctcgcctacccgttttttttcttcgccctgcccgtctcgatccggagcgagcgagcgcccgcgggtcgccacgccccggcggagcggagaatgggcaggggaggcatcggaggcgccgtcgcggcggcggacctcgagaacagcgactccacccgcggcttcgtcagggacgtcaagcgcatcgtcgtcaaggtcggcaccgctgttgtcaccgggcagaatggccggctggccatgggcaggctcggagctctctgcgagcaggtgaaggagctcaatttccaggggtatgaggtgattctggtcacctctggcgccgttggcgtcgggaggcagaggctcaagtaccgaaagcttatcaacagcagtttcgccgatctgcagaacccacagctggacctggatgggaaggcctgcgctgccgtcggccagagtggcctaatggctatctatgatacgctgtttagccaacttgatgtaacatcgtctcagcttcttgttacggatcgtgatttccgggatccaagttttgggcaccagcttcgtgagactgttgtctccctgttagatcttaaggtgataccggtgtttaacgagaacgatgctatcagtacgaggagagcgccatacgaggattcatccggtatattctgggataacgacagtttggcgacgctgttggcaaaagaactggatgctgatcttcttatcatgcttagtgatgtggagggactctatagtggtccaccgagcgatcctcaatcaaagattatccacacatacatcaatgaataacacgggaagctttgaaaaaattaattttggggagaagtctcgtgtgggaagaggtggaatgcaagctaaggtggcagctgctgttactgctgcatcaaagggcgtacctgctgtaattgcaagtggatttgtaacagatagcattattaagattatgcgaggagagaaaattggtacacttttccataatgaagcaaatgtctgggattgttcgaaggaggtgacaacccgtgagatggcagttgctgcaaaagattgctcccggcatctccagaatttgtcatcggaggagcgtaagaagattttgctagatattgccggtgctctggatgcaaacgtggatttaattatatccgagaatgaagctgatctagctgcggcacaagattcaggttacgagaaatccttggttgctaggatgaccctgaaggcaggaaagataacaagccttgctgaatcgattcgtgcaattgcggacatggaggaccctatctcacatacagttcataaagatcttaacaacaaagaggtcagttttcgagtagatgtagaacccctcagggaatcttcagattattttggtgtgtcgttcgcatgtcctagtttgtaatgcacatctataaattcgttgcgccatgagtatagttcagaggcatgcactctcggatatgttgatgatgtgcagtcagctaacgatcacataaatcgttatggaagtgcacagacagactgcagcatcacaactgatgtaagtgctgcggaggcttttctgcagcaagtcgatagtgctgctgtgtttcataatgcaagcccaaggttttgtgatgggacacgctttgggctaagtgcagaggttggcataagcattgtgggcatacatgcccgtggatgtgttggtgataatggacttccaactaatctcggcattttacgacgtattggactagatgtgaaggttgataagggagtggtttgtactgatatggaaatactttttgtttatggcaaagaaaacctgttgtagaaccttgatgatctaatgatagggcttgcgacaccttgaggtgttctttttggtgggcctgtgccacaaaaaaaggtgtcggaacaagcagaaggttctgatcctcatgaggatagctcaattgcatgcaccctggagtttgttgatgatgtgcagtcagcgattgtacatattaatcgttatggaagttgcacacacagattgtatcatcacaactaataataattgaggcgtagcatttctacaacagcttgacagtgctgctgtgttccataatgcaagcacaaggttgctgtgatgggactcgcttcggtctaggtgcagaggttggcataagtacagggcgcatacatgctcgtggacctgttggtgtcgacggtcttttaaccactcggtgcattcttcgagggagtggacaagtagtgaacggcgacaagggagttgtgtacacccacaaggatcttcctttgcaatgagggtagaggattcctgctgtagagcaatttttgtagaataatcctcttcaaagcccccttctctctgtgcgaggaatgaagaaagacaagagagcattgttgttactatgtcgctatctagttccgtgattgttcgtgtacaatgatttatccatacaatgtcctagttatggcactagttgttgtaactgtagaattgcatcggtacatctatgctacatatatgaagtagctgtactgtttctgataaatctcgaatccgttgtcatgtgtctttctaggcaaagagcac

SEQ ID NO: 24995 - DNA, 485 bp, Triticum aestivum
  Clone ID: PAT_TA_24995
gtttttttttttttttgaatgaatgacaaccaagtcttagagctgaaagtataaaccaaggaaagtagtagtgctgcttacaagatgcattccacatactgtggcttgtccaaaagggtatcaagatcgacaaataaacatgcaatcttagcactgtatctagcacatctcatgtcattgtactgcagccacgaggacctgccactatagagcaactgctcatctgcccatcatcgaggttctccaggccgtgctcgttttgctcgccatcgtagtagtcctcgatgcagtccacatccctctcacgggcatcgcagaagtagtgaccattgccgtagaggataaactggagcaagtgtgcgctggggaattctagttcgccatagtgcaaaccaatcgttgcgcctgacaccgaggccggcatggttgtggcgcaacgtcttgagcaagcggagtttgtgtgccgcgctccccttgcgtgccca

SEQ ID NO: 24996 - DNA, 1826 bp, Triticum aestivum
  unsure (1)..(1826): unsure at all n locations
  Clone ID: PAT_TA_24996
cccacgaattcggccaccaccaccaccacccgaaagagcttctcgaagcttccccgattcgccgccgctcccccaccaaatccccgacgccgcgagccggagctgctacaggaggaggagtcgccggcctccgggtagaaggcgcgcgtgaggccaggccgtaccggattcggtgccgcggctctgaagctctcccccatccatcccgggcgggggcccgtgggctgaccaccaaccatggccgcggcccgccggcgccacgccgagctccgctccgggcagcatcgccgaccgcacaccaccatacggttgtagtaaccccgagcagctactgatttggactcttggagagaacacgtacaaccatagggctgggctcaccactttgctgttagaaaggggggagcaaagtgatttactgtctccttgtgattgcggtccgctgagtgatggcagatgctagctcaacggactgacaactcaactgttctagacaacgacggcaagatctataggttagaacaaggacaaagtggtggggcaatcatggcttctaattcttcggataggtctgacaggtccgacaaacccttggaccaaaagacattgcgccgtcttgctcaaaatcgtgaggctgcaaggaaaagtcgactgaggaagaagtcatatgtgcaacagctagaaagcagcaagctgaagcttgcacaactagagcaggagctccagaaagctcgccagcagggaatcttcatttctagctccggagaccaaacccatgccatgagtggaaatggagcaatgactttcgatctagaatacactagatggcttgaggaccaaaacaagcaaatcaacgagttgaggactgccgttaatgctcatgcaagtgacagtgacctgcgccttatcgtagatgggataatggcacattatgatgaaatatttaaggtcaaaggtgtagctgccaaggctgatgtgttccatatactgtcaggcatgtggaagacgcctgccgaaaggtgcttcctgtggcttgggggtttccgtccatccgagctcttaaagctgctggtgaatcatctggagccgctaaccgagcagcagatgttgggattgaccaacctccagcaatcttcccagcaggcagaggatgcactgtcacaaggaatggaagcattgcagcaatcactggcggagactttggctggatctctgggttcctccgctggctcttcagggaatgttgcaaactacatgggtcagatggccatggccatgggcaagcttggaacgctcgagaactttcttcgccaggccgacaacctgcgacagcagaccttgcatcagatgcagcggatcctgacgatccgtcaggcctcccgcgcccttttggctatacatgactacttctcgcgtttgcgcgcgctgagctctctgtggcttgctaggcccagggaataaccaaggatcatcgcgcgctggatttcccccaagctgatgtgtacaacgccgggggtgctcttcatattgctgcagataatttgggtattcgagcttttcttcttgtataattatgtgtagctgctttttgggtccagggtttgtactcaggtggtatacaagtaggtggggggagcctgtaagttacaatggttgtagaactgtgttgggaataaaaactaggtaagtcaggacgagtcctaattaagttgtgtcacagaactgtagtggctggaaaattggtgctccgtgtattttagctgttgtccctgtggtggttgaacatggtgaatacatatgaacttgttccaaaaaaaaaaaaaana

SEQ ID NO: 24997 - DNA, 359 bp, Triticum aestivum
  unsure (1)..(359): unsure at all n locations
  Clone ID: PAT_TA_24997
tgtgggggtacttatccgtcgcggggaggcagtggatgcttgaacggcgacgatcggtggcgtggacggcgtgcaggcactgccagcgccatggatgaacaggagaggaagacaaagtcactggtgggctgggcctgcgccttgtcggtctaaggcccaggggaagcaggggggtttccctttcctttttattctacgtttcatctttatttatttctgttttacttttagctactgttttgctatttctattaaaggcaaaggaattttggttcaacaaggtacttgacacataaatactatgtaatgctatgagctagcacgacgaagttccaagttatnaaaaaaaaaaaaaaaaa

SEQ ID NO: 24998 - DNA, 730 bp, Triticum aestivum
  Clone ID: PAT_TA_24998
actactaccacgacctccaaaaaatactttcagaattggcaaatggcgcagctgagagcgttcgccgacgagcagcagcaagaagcgctgcacggccacggcggcgacagcaacagcaacaagaaggcgcgcgcgggcctgtgcggcgtgctccgggagcgcaaggtggtggagctggcgcgcgccaagcgccggctggtggaggtcccctacacggcgacgctggccaacgcggccaacgcgctcctcgccggccgcgtctccgccgccaccgtggccgcgccgccgggccactggatcggggccggcggctccttgatcgtcgagtccgaccccgccaccggcgccgcccgcaagcactacatcggcatggtcaacatgctcgacatcctcacccacatcgctgagaccggccacgacgacgacgccgacgccaccgccgtcgaggatggcggtggctcgccgccggtcgacctcgaccgccgcatgtccgtgccggtgtcctccgtcatcggccactccttggagggcctcaccctgtggacgctccacccaaacacgagcttgctggactgcatggagacgttcagcaagggcgtgcaccgcgcgctggtgccgttggagagctcggcggacaacgtggtggcggtggagctggtggagtcggcgccggtgtacaggatgctcacccagatggacgtggtgaggttcctgcgcgcgcacggcgcgg

SEQ ID NO: 24999 - DNA, 553 bp, Triticum aestivum
  unsure (1)..(553): unsure at all n locations
  Clone ID: PAT_TA_24999
ggggcgctctanaatatggtccccgggctgcangacgccataacccctccccgccgccgcctcccctttcccctgcggccccaaaagcgccgtcttgaaggtgcgacttcacccgcagccatggtgaattcgaaggaaccgccaaccgagcccccctcgtcaaatcgcgcgatcgaaagcagcgtcgggcaggcggggggcactgccgcggaggttgcgacaatgtcactgagtgcccaccgcgagacgctgtcatcgctctcgtcgacactcaagacgccggggagccatcgtgtgctgcgttatgctcccgtcaaccgtgctggtgaagccatcgccccggcatgggctcctcctcgcaagatctcaacaaaggtcagacagaggctacaactcgggcctccggtgaagttaaacgcggcaccgggtgtcggtaaacccaagggacaacgagtcccctgtggtcactgaagggnggtttctcaacaaacaattgaaaggggnagccccgccgccggccttgctatgtcatcccancacggacgccaacngc

SEQ ID NO: 25000 - DNA, 625 bp, Triticum aestivum
  unsure (1)..(625): unsure at all n locations
  Clone ID: PAT_TA_25000
ggccctgntcggggtgggccaggtcggctgcgcccccacgagctggcgcgctacagccccgacggcgccacctgcgtcggccgcatcgacggcgccatccagatcttcaaccggcggctggtcggtctcgtcgaccagatgaacaccctccccggcgcgcacttcacctacatcaacgcctacaacatcttcaacgacatcctggccaacgccgccgcctacgggttcacggagtccaccgccgggtgctgcggcgtgggccggaacaacggggaggtgacgtgcctgccgtaccaggcgccctgcgccaacagggaccagcacatcttctgggacgccttccacccgtcggaggcggccaacatcatcgtcggccggaggtcctaccgcgcccagtcgcccaacgacgcctacccgatggacatcagcacgctcgcatccctttgatcccatatgcaaagatgtacaagtcccatttcctatccccaacaagggcatggaaaaggatttcttttcgatctgtaagcgcgcgtatattagtctgttcttgttttttttcatttagcgatgaatacgcatgcagttgtgtaacaggtatagacaataattggttttcattcatcac

SEQ ID NO: 25001 - DNA, 1546 bp, Triticum aestivum
  Clone ID: PAT_TA_25001
gggctagctcgccagctcctcctctggtcgacatccccacccctccccccatatccccctctctacgctccctgctcgcccagctagtccaccggcctcccctgcaagcttgccttggctatagctgcctatcttcgtctctcctcggaagccagctagcttggccgtggcagcgggcgcgggcgcggtcgagctggggctgctggcttgcgtggtggcggcgggggccctggcgctggcgacggcggcgaggggcgacccccaggtgccctgcgacttcatcttcggcggctcgccggtcgacagcggcaacaacgactacaccacgtccctggcgcgcgccaaccacccgccctacggcatcgacttcgccggcggcccggcggggcgcctcaccaagcggcctcaccaccgtcgacgtcatcgctcaacttctgggcttcgactatttcatccctccatacgcggcgacgggcggcgaccagcgcctcaacggcgtcaacttcgcctccgccgccgccgggatccgtgccgagaccggccagcagctcggcgggcggatcccgttcgcggggcacgtccagaacttccagacggcggtgcagacgctggtgaacatcctgggcgaccgggacacggcgtcggagcggctgagccagtgcatcttcacggtgggcatggtcagcaacgactacctcgagatgtagttcctgccgtaccaggagaccagcgccaacagggaccagcacatcttctgggacgccttccacccgtcggaggcggccaacatcatcgtcggccggcggtcctaccgcgcccagtcgcccaacgacgcctacccgatggacatcagcacgctcgcgtccctttgatcccaatccatgagcggtccatccagtacagaagtgtacaagtcccatttcctgtcgccaataagggcatggaaaaggattgatccttttcgcctacattagcctgtttctcttttcattttgcgatgaatacgacgccatgcaggtcgtaacggctatagcagactaatacgggttcacggagtcaaccgccgggtgctgcggcgtggggcggaacaacggggaggtgacgtgcctgccgtaccaggcgccgtgcgccaacagggaccagcacatcttctgggacgccttccacccgtcggaggcggccaacatcatcgtcggccggaggtcctaccgcgcccagtcgcccaacgacgcctacccgatggacatcagcacgctcgcatccctttgatcccatcgcgtgactatctatggctagtggtcgatccagtacaggcatgtgcaattcccatttccgctcgccaacaaagggcatggaaatggattaattcttttcgatctgtaaaagcaacacattagcctgttcttttttttcattttgaagaatgaatacgccatgcagtttgtaacaggtataggcaataattggttttcattcatcacaaggattaaggtgttcagtggagagaaagggatgtgttcaggacagttaaaaaaaaagggggggc

SEQ ID NO: 25002 - DNA, 1909 bp, Triticum aestivum
  unsure (1)..(1909): unsure at all n locations
  Clone ID: PAT_TA_25002
tcggcacgaggatctcctcgtgctctcctccccctcctcgcctctccctcctgctcctccgagctcgcgccggcgccttgctgccggcctgaccccgcgcgctccccccccgacccccctttttgtcccccagctggcggacctgcctcctccggccccggcgactgcccccccagaggggggatcaagcggcggcgagcggcctccaaggttcccccctgccacggcttcctgcaactgctcgctccctcgaccttcatcacggtcccggtcgccggggagtacgcctgcgcgcccgctctcttccaggcgccgggcgtgccctgcggcccggagcacggcaaggcgtacgcgacgcccggggagcgcgcggcgcggctcgcggctttcgcggactacgaggccttcgtcgcggcgcaaaacgccggcgtccactgctccaacggtgcggtgggttcccgggcgtacacccccgctctcaccgcattggctgacctcacgctagaccagttccgcgccgcgcgcttcggtcgcctgggttccgccggtgccccgctgcgtggccctgatggttcatttgcacgctgctcgcaccacgtgtgcgccgacccccacgcatgccacgaacggcgacgtggatcggagtctgcactggtgaaccacgcagccggtactgtattgtagtacgtataattttatgatgattgtacatgtcagattagcctatgatgggttgagccagatattggttacacagcggaactaatcgattgtgacagatcctacaatgctggttgtggcggtgggctcatgacctatgcttataagtttgtgattaaaaatggtgggattgacacggaggatgattacccgtttcgtgaagcagatggaacatgcaacaagaacaagctgaaaaagcatgtggtaacaatcgatggctacaaggaggtgcctcctagcaaggaagacttgttactccaagctgttgcccagcaacccattagcgtaggaatatgtggcagcgctagagcatttcagctatactcccagggtatcttcgatggtccatgcccaacatctcttgatcatgctgtcctaattgtgggatatggttctgaaggtggcaaggattattggattgtgaaaaattcctggggtgaaagatggggaatgaagggctatatgcatatgcaccgaaacactggctcatcgtcaggtatctgtggcataaacatgatggcatctttccccacaaaaacaagcccgaatcctcctcctttaccgggccctggcccaaccaaatgcagcgtggttacctcctgccctgaaggatccacatgctgtagctcatggcgtgccttgggattctcccatgactatcctatatgtgatacagctagggnacgttgctgaagggcaatggcaacttctccagcatagagggaatcaagaggaagcaagctttctccaaggttccctcttggaatggtttgttggaactgctggatcaatagacatacaaaaaattacggatcacagacagatacacatgtgcgcatgatcttatacaagcggcgggggttcgctgcgttcttgaagtgttctgccgcattgtatgctcccatagtctctatctgctggctgtcttgcagagctgtccaatgtcgttatgagagacaaaaaggagatgtccagaactccaaaattttagtgtgtattggtgagtcatcgcagctggtactgtattgtatatttccatgatagtacgtgtcaggtactcaggttagcctatgatgggttcagtcagatattggttacatggcacagatggtttatttgtactcagcttgtactagatgtgagagaaccgcccataatacaataaagagataggtgcatcaggttcagt

SEQ ID NO: 25003 - DNA, 431 bp, Triticum aestivum
  Clone ID: PAT_TA_25003
gaatttctggagtagggatcacatatgatataagatagattttaagtaccacccacaacattttcttcgctgctgctgtctggtggaatatgcactcttgaggttctgatcgagactgcgtgaaaaaggaaagaacatatgctatcttcagatgttaaggcatgaggcaacacaaggcactgtgaactgtggacctccagcctagttgttagtgatgacttgtagtctttagatgaatggcttaatcttgttgtattatgttgtgacacaatttaaaacttcctaaaattgtataagcaattttcctgtaagtcatgcagtagaaagatgacaagttctgttttactgaaaatgacaacttgacctcaacctgaaaaaaaaaaaaaaaaaaaaaaaaaaaaaaaaaaaaaaaaaaaaaaaaaaaaaaaaaa

SEQ ID NO: 25004 - DNA, 700 bp, Triticum aestivum
  Clone ID: PAT_TA_25004
cccggcttccctcgcaccccacctgctacccaccaaccccatgagccacagccgccgtcgcctgtaaccccgcgcgccactccgtgggccgggatacgtcccatccattgccgccgcccgctgctccccgtcgatcttcgcgcgccaccgccccaccctctccgccatccccgccaagcaccacctaccgccgacggcgcccacctcccagccaccattgcggcccactcccgagccgctagatcgcgccgccgcgtcccgagtcccgactcccaaccattggatcctgccgccgccttcccccaaactcatcacccgccacctcccctagtgtgccagccacctacgacccgctcgttgatgcgcactgccaccggcctcgcgctccggcgccacctgctaggtcgactacggcgacaatatcagttagaatggaggtgagcgcgcgggagcacagcttgggacgcatggcaggtcgcgtaggaaaaaagggcaggtcgcgctggagggtggagcaggtcggcgctggcacctccccacggcagggctgcttgcctgcttcccaagcatcatggcctttcctgtgaaagccgtcgcagcctccgttcttgttcttgaagcagcaccagtcaacccctattcttgttcatcttcaaaagctgtaccattgtttttttgacccgcatggaaattttgcccc

SEQ ID NO: 25005 - DNA, 958 bp, Triticum aestivum
  Clone ID: PAT_TA_25005
gccggccgggtccgacgttatcctgtccgggtccacggagccgcttcgttatccgctggccgcttgctgctgcttctctgagagtgagcgagtaagaggacggcgacgatggccggcatggcggcgctgcagggcgccatgggggcgctctccgtctcggccgcgagcaccagcgccttctgggggcaacccgctcgccgccaccttctccgccgcgccgtctggggtcagattcatggccaagacaagcccaattgaaatgaggcttaagcgatgggaacggaagaagtgtaagccaaacagtcttcctatgctgcacaagatgcatgttagggtcggcgacacagtgcaagtcatcgcaggccgtgagaaaggtaaagttggagaagtcgtacggctttacaagcacaacagcactgtgatagtgaaggatctgaacttgaagtcaaagcacaagaaaggcacagaggatgaaccgggtgaaattgtcatgattgaaggccccattcatagctcgaacatgatgctctactcaaaggagaagaacgtgacgagtagggtatgggcacaaaatcctcgtaaggatggcaccaatggtccgctacctgaagagagaccggtgaagtaatcgacagcgttggataacctgggtgaaggtgttcaagtgaaggagattctgagtcatcatcgtagtatggaaacgctgcacaatgctctcataccttagctgcgcttattgctgcccacttagctcggcttattggtgccgctgcttgtactatgcagtttttttctagcttcagagcctcttttgtaaattactactactactacaaagttgtcaccatttttgcaacgcttggtccaacaagaaggccttcgttttacatttctgtcattttgatgaatagtaatgattgccccttttacatgtggaaatgcagcaccattgctctgt

SEQ ID NO: 25006 - DNA, 607 bp, Triticum aestivum
  unsure (1)..(607): unsure at all n locations
  Clone ID: PAT_TA_25006
aaacaaatatagtggcgacaaagaataacatttcagcagcaaaacaagcacatttcagcagtataacttgagtaaatttcaacaaaaaacaatagtagatggttcaacagctatataagttctaaaatagaacttatagttcacaaatcactttaaaattggaatcatcatcgcaactcgcaagtgacaccaaaacctccattccctccaccccctcagagtctcctacgttcatggcgacggcggctgcgagtcggcccagcgggcctgtgctgtcgacacccaactgccgctcctactcatccacccccgtcaagctcgccggcggcgacgccacccacttgctgggcaagtccgtcagcgtctcgtccccgtcccccaccaggagccagcactactgcacgtgctccgcgacgaaccacccgggctcgttccgaatgcaagcgtccacaagggagcgcaagcaggtgggccccccgcccggcagcagcaaagcccccatnccccgccgtccatccccggccgccgcccggcgcccgtgancggccggcaggccgcccgcagggccctcaagccgtcacccgcggtncagcagtcgcagcaacnn

SEQ ID NO: 25007 - DNA, 720 bp, Triticum aestivum
  Clone ID: PAT_TA_25007
cccctaaagaacgaggagccgcaatccgccaggaccccccggaaaaacattcaagccgatgaacctgcaccaatcggttatgcttctatttatggagaacttccaaaactggaactgaagaaagaggtttcggatatcccatttatcccatcagacagaccctgggaaactatattcactggatcatctcacgctctcccgcctctcacgaaactgtgttctgttttcttgtcatcattgctggagaagagaccagtgacagacgagtgaggagcacccaccgaagttttgtcgcaatatataatggtatacttgctagttgcagttgtcagtgtagaagcaaacgaacgccgactcgggccgccaaggcaaacggtttatgcccagaagaccgcagtatcatggacatcgacgcttgtcacgcaacccggtgggtgatggcaatgaaatttggtgactggatcagagctccttttgtagtgatatttagtagcgtcagtgaatcagtgtactgatcctagcaattttgcccgtcacagtttaatctgtaatctgaacttctgttgtgataattgagtgttttcagccagtgaagagtttgtggcacgacgatacagtcataacctgtacatcacgcgatgttgacgatgatttggaaactgaaaatctgtcgttattattattattaatatatccttgcacgcatggtgggcttgatta

SEQ ID NO: 25008 - DNA, 489 bp, Triticum aestivum
  Clone ID: PAT_TA_25008
gaagttgatgcaacggccccgatagatgctcaagatgatgcttcagccccaaaagatgctccagatgattcaagcgtgactgaaaagccgaagtcctgggctgattacagtgatggagaagtcgaggccgttcaggttgcgagctgagaaaaggtggtcttctcagcctctcaggtagttacaggaagttttattcatacacagatgagccctccttacgggctataaaagtatgctaatgcaaactgacacgctgctgtttttgctgaaaggaggagatgctggttttctcgttagagaattagttgctttctgatctatttcatggtttctagtacctatttgtttctgccgccctgcacggctgcaccggtgctatggtattgcaagggttcgcattgccatggaactttaaaggtcttccgagtgtccaactgtcatcatagtgaccttgtttcagcttgctttgtcattgcaaaggagcttgtg

SEQ ID NO: 25009 - DNA, 917 bp, Triticum aestivum
  Clone ID: PAT_TA_25009
ctgagactgagagcaagaacacggaggagaagaacaaccatgtggaatgtgaggacagtgaagtgaagcctgatgaaactatagtttctggaggtgctgaagttgatgcaacggccccgatagatgctcaagatgatgcttcagccccaaaagatgctccagatgaccatgtcgaatgtgaaaacagtgaagtctggcctgatgaaactgatggttctgtaggtgctgaagttgttgcaaccgccgcgatagaggtcttagatgatgcttcagccccaaaagatgctcaagatgattcaagcgtgactgaaaagccgaagtcctgaactgattacagtgcaaactgacacgctgctgtttttgctgaaaggaggagatgctggttttctcgttagagaattagttgctttctgatctatttcatggtttctagtacctatttgtttctgccgccctgcacggctgcaccggtgctatggtattgcaagggttcgcattgccatggaactttaaaggtcttccgagtgtccaactgtcatcatagtgaccttgtttcagcttgctttgtcattgcaaaggagcttgtgaagatcagagaggtggtaaacacgccatcgttccccacattttgctcggcgttttcatttcctttgtcgatgaactggacacactgccgacttgacatctttgtacgtagttatttcttttgaattttgataaattagactgttgtaaagaaaatcgatacttccctgagcaggaagtttgtatcaagtgtccctgtaatcaggttgttgctttttggacaattttgcttgtacaagaatcattgatgacgccgatccattttgtgattataactccttgagaacgactcgaggatcaaccgtccctgtaatcatgctgtttcttctttt

SEQ ID NO: 25010 - DNA, 500 bp, Triticum aestivum
  unsure (1)..(500): unsure at all n locations
  Clone ID: PAT_TA_25010
acccagtgactccactccactccaccggtccatccccgccggatcccacaagctctgcacggcgataggtagcgaccaagcttcgcctgtgatactcaagaggctcgccatgtccgctggctcctccgcgatcgtggccgacacggcgcgcgggcactaccacctgaagatcgacggctactcggtcaccaagtttgccctccctaagggagagtgcctcaggtctcaaccattctccgtgggaggccgccgctgggtcatcgaagtactaccccaacggcgaccgactcgtgggccgcgaggtacatttccctccaacctcgtcctcgaacgaacgtcgtccccgggggaaagtgcgtggcgcaaagtccaagtttggctttgagggcaagaccaagggagggaaaataagccctggcgcccctccttttctcaaagaaggcggggggaccggaaccccgcccccntttaaaacttcggcaaaggngggnggcccccct

SEQ ID NO: 25011 - DNA, 107 bp, Triticum aestivum
  unsure (1)..(107): unsure at all n locations
  Clone ID: PAT_TA_25011
nattttgttttgaatctattccggaaactatatccaagtgatggagtactgtatgtagtacgaggttaaagttcaattaatcttcacatgaggatcttgatctaccc

SEQ ID NO: 25012 - DNA, 1276 bp, Triticum aestivum
  Clone ID: PAT_TA_25012
gccacccggacgcggagcctgccccccaaacctacatcccacatcgacacgtacgcaaaaccttcttcccaaatctaaacccctctcttctccaaatggccaagagaaacctcctcctcctcctggcgctaatggcgctcgccacaagcatggaagccgcgtcggctaccacgagcacgaggaagctcatgttcctggtccagcccaagccgaacctcctcacgtaccacaacggcgccgtgctgcacggagagatccccgtctccgtcctctggtatggccgcttcacggcggcgcagaaggccatcgtatccgccttcctcctctccctctcctccgcgccgcgcgcgtccccggcgccgtccgtgtcccagtggtggagcagcatccaccagctgtacctctccaaggcggcggccgtcggcaagcacggcgccggcgccaccaaggccgcccgggtggtcctgtccggccaggtctccgacgaggcgtgctcgctcgggaagagcctgaagctgtcccagctcccggcgctggcggcgaaggcgagggcccgccaagggcggcatcgcgctggtgctcacagcgcaggacgtgggcgtggagggcttctgcatgagccggtgcggccggcacgggaccgtggacgccaagtccggcacggcctacgtgtgggccggcaacccggcgacgcagtgcgccgggcagtgcgcgtggccgttccaccagccggcgtacgggccccaggcgccgccgctggcggcgccaaacggcgacgtgggcatggacgggctcatcatcaacgtggcgagcatggtggccggcgcggtgaccaacccgttcggcgacgggttctaccagggggagcgcgaggcgccgctggaggccgcgacggcgtgcccgggggtgtacggcaagggggcgtaccccgggtacgccggccagctgctggtggacggcgccaccggagcgagctacaacgcccacggcgcgcacgggaggaagtacctgctcccggcgctgttcgaccccgccacctccgcctgctccacgctcgtctagtcgtacggcggcacagtggcagcgacaagtgaagtgagtccaatccgctagctgcccgtctagccaagagtgtattgggtacaactagtactgtaccgtagtgcatatatgtgtgaatagttcgtatatgagcttgtgtttggatcttctcgtgctaaataaaaaaaatgtaaatcagcctttgtactgcacaaatggagtgtacactagtggt

SEQ ID NO: 25013 - DNA, 768 bp, Triticum aestivum
  Clone ID: PAT_TA_25013
gacaaagatcatgttgttaaagtagcagactttggtgtagctcggttccaggatcaagggtggtatcatgacagctgaaactggaacatacagatggatggcgcctgaggttataaatcatcaaccctatgataacaaagcagatgtatttagtttcgctattgtgctttgggaactcctgacgtccaagatcccatatgataccatgacacctctgcaagcagctttaggtgttaggcaggggctgcgcccagtgctgccagaaaagacacatcccaagctattagacttgctgcagagatgttgggaaaccatcccatcaaatcggcctgctttctcagatatattaactgaactagagggtcttctggcagaagttcaggttacttcaggtgaaacgagcaaacaaccgaaggatatctcggcctcgacagactgaccctctgcacatacctgacatactaggatccggaacactgatgttgaggaatgtagcatatcatttttggttttggtttaccttttgttatgtacaatttgaacagtcatcttggggcctaatgtttttttcaggctgtgtttcactgttactacaaagagaatcgaattatctgttgagtatactggtcatagctttggtatgtaaacatgtgccctagaatttactgctttggccatctcttgttgtgaaggatgtttatatctcgtgtatcatgtacaccaagttgtcttttctggtgaatacagcccatcatcgaattttctgtt

SEQ ID NO: 25014 - DNA, 799 bp, Triticum aestivum
  unsure (1)..(799): unsure at all n locations
  Clone ID: PAT_TA_25014
atctgaaggttgttttcttcacaattctggcacggaggcaaatgagcttgcactgatgatcgctcggctttacactggttcccatgacattatttcacttaggaatggataccatgggaatgcagctgcaacaatgggtgccactgctcaatccaactggaaatttaatgttgtccagaccggagtgcaccatgctcttaatccagacccatatagaggcgctttcgggtcagacggagagaaatatgccagagatattcaggaaaccattgactatgggactacaggaagagttgcaggtttcatttcagaagccatacagggagttggtggaatagtggaattagcaccaggatacctgcctgcggcctacgatatggtaaggaaagctggtggcctctgcatcgccgactacgggtcgacgggggttgcgcgcactggaagccacttctggggattcgaagggcagggtgtcatccctgatatagtcactatggcaaagggcatagggaacggaataccgataggagcggtcgttaccacacctgagattgctaaggtgttaacccgcagaagctacttcaacaccttcggtggtaaccctgtcagcacagctgccggccacgctgttctcaaggtactggagaaggagaagctgcaggagaatgcgttcgttgttggctcctacctgaaggagaaacttaacgctctgaaagagaagcatgacattatcggcgacgttagggggaaagggctccttctcggngttgagctggtgaccgatcgccagaagaaaact

SEQ ID NO: 25015 - DNA, 1791 bp, Triticum aestivum
  unsure (1)..(1791): unsure at all n locations
  Clone ID: PAT_TA_25015
ccccggccgaagcaggcaacagacaggcaccggtcgtgaggcagagagagagagagaaccagagccggacatgcagcgcctcgcctcctcccggaggctcctccaggccgccctcgcccccggccgggcgcattccagcctctccgcggccgcggtcgccgccgcgccggagaatggcgccggcgcccccaagatgccgccgttcgcgtacacgccgccgccgtacgacgggccgcgggtggcggagatcgcccagaagcgggcccagttcctcagcccctcgctcttccacttctacgaccgccctttgaacatagtcgatggaaagatgcagtacctgttcgatgaggatggccgccgctacctggacgctttcggtggcattgcgaccgtttgttgcgggcactgccatcctgatgtgatcgaagccatagtcaaccaggcaaagaagatacagcactccacagttctgtatctgaaccatgcaattgcggactttgctgaggctctggcggccaaaatgcccggtgatctgaaggttgttttcttcacaaattctggcacggaggcaaatgagcttgcactgatgatcgctcggctttacactggttcccatgacattatttcactgaggaatggataccatgggaatgcagctgcaacaatgggtgctactgctcaagccaactggaaatttaatgttgtccagaccggagtgcaccatgctcttaatccagacccatatagaggcgctttcgggtcagacggagagaaatatgccagagatattcaggaaaccattgactatgggactacaggaagagttgcaggtttcatttcagaagccatacagggagttggtggaatattggaattagcaccaggatacctgcctgcggcctacgatatggtaaggaaagctggtggcctcctgcatcgccgacgaaatccaggccgggggtcctccctctgggagccacttcggcggaggccatgggcagcggattacccataatatagggtcgatggcaaagctgagatggctcaggtgttaacccgcagaagctacttcaacaccttcggtggtaaccctgtcagcacagctgccggccacgctgttctttaggtactggagaatgacaagctgcatgacaatccgtttgttgtcgaggtcttcgagaaggagaagcttaacgagaatgcgttcgttgttggctcctacctgaaggagaagcttaacgctctgaaagagaagcatgacattatcggcgatgttagggggaaaggcctccttctcggggttgagctggtgaccgatcgccagaagaaaactccggcgaaagctgagatcgcgcaggtcatgaaccacatgaaagatatgggcgtgctggtggggaagggcggtttcttcggcaatgtgttcagggtgacgcctccgttgtgcttctccaaggaggactccgacttcatgatcgaggtgatggacatcgcgctgtcgaagctgtgaagaggcactgctctcatcgataaataagagacgatctgcgaaacagcacctcgttgtctcgtgttctgtcttgcaaatccatgatgcgcacatgcgatctgcgcctcctgaacattagtatgatgtgcagtaagagatctatatgtgctatgtaagtttttcgtaataagatattcagatgtgttattgcagcttttaaaacaaagcattgccacatttacttgtcagaattccaggnattcaaaagaataatataacnnaccattaacatcctaagcaaaaat

SEQ ID NO: 25016 - DNA, 1586 bp, Triticum aestivum
  Clone ID: PAT_TA_25016
ccacgcgcccgcttctctcttctctctgtcacacaccttcactactgcccccaccccaatccaacccaaattaacagtagcccgcggcggcctgcgcgtgagcgatgcccgccgcggcattcgcctccgcgttcgcgtctcctcctcctccgtgggccccacgaccgcctcctcgccacgccagcctccgcctgcccccgccaaggagcagcagcaacaacagcggcggcggcggaggggacaagcccaccacctcgtgggtcagccccgactggctgacgtcgctgtctcgctcggtgctcggccgggggaacgacgactcggggatacccgtcgcctccgccaagctcgacgacgtgcaggacctcctcgggggcgcgctcttcctgccgctcttcaagtggttccgcgaggaagggcccgtctaccgcctcgccgcggggccgcgcgacttcgtcatcgtcagcgaccccgccgtagccaagcacgtcctccgcgggtacggcacgcggtacgagaaggggctcgtcgccgaggtctccgagttcctctttggctctgggttcgccatcgccgagggagcgctctggacggtgagacgtagagcagttgtaccatctctacacaaaagatttctctcagtaatggtcgataaagtgttctgtaaatgtgctgagagattggtggaaaagctcgagacttatgctttgagtggtgaacctgttaatatggaagcgaggttttcgcaaatgacgttagatgtgattggtttatccctcttcgcctacgactttgattccctcacatcagatagtcctgttattgatgctgtttacactgcactcaaagaagctgaggctcgttctacagatcttttaccatactggcagatcgatttgctgtgcaagattgttcctagacagattaaagcggaaaaagcagttaacacaataaggaataccgttgaagagctaattacaaaatgcaaggcaatcgtagatgctgaaaatgaacagattgagggtgaagaatatgtaaatgaggcagatcctagcatcctgcggtttttacttgctagccgtgaagaggtcagcagtttgcagttacgtgatgatctattgtcaatgttagttgctggtcatgaaacaacaggttctgtactgacatatcccatttaagcccaaggttcctaacaagaactacgttggtaagccgaactacctcaacaacacaccatacgatgtcgacttccgtgcctatatgatgtaacaaaggcgagatacttgatcagcctactttatcacaccatgcatcaatacccatgccgccctgtaatagattatgctaggcataagcaatgaccgcgttagtgaagcggtcggcgggacactgtattaaccggtgctcacaccgtattcactacttggatctgtgctttctagtaactacattgctacgcctggagacactgttatgccatatgtgtacaatatacactacgtgctcaagcagaaagacgtcccatacgttatctcgacctcgtatggagacgatgagcaaagcgtacctcggccgcgaccacgcta

SEQ ID NO: 25017 - DNA, 499 bp, Triticum aestivum
  unsure (1)..(499): unsure at all n locations
  Clone ID: PAT_TA_25017
gcttccacggctcgctgccagcgggggtggcgctgcctccgagcctccgcgtcctcgtcctctccggcaacgacttctccggcgagataccgacgtccctcttcaccccggcctcgtcgctcgacgagctcgacctctcccgcaacgcgttcaccggcgcgataccgcctcaggtcgcgtccttgggcgccctgacgcggatggagctgcagcacaaccgcctcaccgggagcctgccgtcgatgggcaagatgcgctccctcgtccacctcgacgtcagcgacaacaagctgtccggcccgctgctggacgcgcccgggcggctgcctccgacggtcctggccgtcgtggcgcgtgacaacaggctctctgggccgtttcaaggccgcgggctttcangccctctccttgaagatgcaagggcttggacctcaacaaacaatgcggtcaaccggcgccggcccgggcgcgggntttngagcaacccggggctggngga

SEQ ID NO: 25018 - DNA, 1667 bp, Triticum aestivum
  Clone ID: PAT_TA_25018
gcacgtctcgcagcggccgccgcgctcaagccggcaaatggcaaagagccaagtacgttggagtttccctagttggaaagactcttgccatcatgggctttggaaggttggctcagaggtggcaaggcgagcgaaagggctagggatgcatgtgattgcccatgacccctatgccccggccgataaggcccgtgccattggagcagagctggtgtccttcgaggaggccatcgccaaggcagacttcatctccctccacatgccgctcaccccggcgacatccaaggtcttcaacgacgaatccttcgggaagatgaagaccggcgtgcggatcgtcaatgtggccaggggcggagtgatcgatgaggatgctctggtcagggcactggactccggtaaagttgctcaggcagctcttgatgttttcactgtggagcccccggcgaaggacagcaagctggttcttcatgagaatgtcactgtcacgccccatcttggagcaagcacagtggaggcgcaggaaggcgtcgccatcgaaattgctgaagccgtcggcggcgcactgagaggtgagctcgcagcgaccgccgtgaatgctcccatggtcccagcagaggtcttgtcagagctagctccgtatgtttccctggcggagaagctggggaggctggcagtgcagctcgtcgccggagagagcggcatcaagggcgtcaaggtggtgtacacctcagccagggatcccgacgacctcgacacgaggctcctccgggcgatggtcaccaagggcatcgtggagcccgtgtccagcaccttcgtcaacctcgtgaacgcggactacacggcgaagcagcgcggcctgcgcatcgccgaggagcgggttctcccacgacaacgccgccgccgaggcgccgctggagtccatccaggtgcgcctttcgcacgtgcagtccaggttcgccggggcgatcagcgacggcggggacatcgtcgtggtcggcagggtcaagtacggcgtgccccacctgaccgtcgtcggggcctacgaggtcgacgtcagcctggaggggaacctgatcctgtgccggcaggtcgaccagcccgggatgatcggcaaggtcgggaacatcctcggggagaggaacgtgaacgtcagcttcatgagcgtcggccgcacctcccgtggcaagcaggcgatcatggccatcggcgtggacgaggagccggacaagaagacgctcgagaagattggggccatcccggccgtcgaggagtttgtgttcctcgagctatgatggacagacagcgggcgctcgctccactcatcgctagaataagtggcatcgcagcagcatcatattggtttgatgccacacggggtggggtgaagtgatccttccacggcgccttggtttggcctccgtttgaataagaacgatgtgtgtgtatgttatgatgctgtgtgtatcaacgtgtgcgcctagcgcttgtttgtggagagtcgtatcatagtagtattatattgtttggctagatataatttgtttgtgtgttgcaaacttgcaatacagacacaaatattctgtatgtaatggtgatgatttacctgtcatttaatttctattttgtttacttataaagacagcaggatgctatattaaaaaaaaaaa

SEQ ID NO: 25019 - DNA, 960 bp, Triticum aestivum
  Clone ID: PAT_TA_25019
cctctgcttacctgtgagttaccaaatctggagactttaagaactcatcaatgcgttaagcaatgcttgttcgcttagagacgacgagcgcctcctggttgctgaggtttacaataggtctctcatgccgctacttggaggatccctctgatgatatctccttgatcagagatggagataaattggttgcatatcgactcccgaaagacaaaaaacaagcctggttacatatgtggacttcccgattcatgatcttgacttgtcgagttatatccgcgacagaagcgggcagatgtccaaccactatcaactgtatgctgtcagtaaccactatgggagcatgggaggaggtcactacactgcatatgtttataatgatgggaaaaagaagtggtatgattttgacgaccgttgtgtctcaggtcttgagaacgaggatagcataaagacgtcggcagcttatgttcttttttataggcgggtacatggtgatactagcttagtagatacagaaacaacaacaatagtagagtctactgattgtacaacatcaggagtagcggcggcgggtgatgacttgtgagcctgggcattgtatagctgattggttaattggggcctggggggacaattggtgctgccaagaaagatccagtgaggacaaatgatggcagcggcatctcgactgacattttgttgtgcggctgcaatgtaaaggaaccgacatggaagggaggccgcggcggtgattctttccaacaccctgacttgaaggcggaggagaagctgataactgcagatatagacaggcatgcaggctggctgttggcttgtattttggttaccgggtgcgtttgaaacccatgattttcttggggtcgagaaatgggggtagataatttatctcatatataccgctgttgttccctggttgtttcgatcatgcactgtaactcctgc

SEQ ID NO: 25020 - DNA, 637 bp, Triticum aestivum
  unsure (1)..(637): unsure at all n locations
  Clone ID: PAT_TA_25020
ggaaccaccaagtaggagtgggacgggagtccatgagcgtgatgggagaggagaagcataactctagctgggtggtggatatggagaagatgctggcagatgacgatcctcagtggaggaggatgcaggcagagcgatgggaggcgcaatccatctaccgggtgccagagtggctcaagcgcatgaacgcaaaggcctaccagccgcggctggtgtctttgggtcccttccaccacggtgactccaacctgctgcccatggaggagcacaaagcgccgccgcgttggtgcacctcatcaagccaagcaaaaagcccgctccaggatttcatctctgccaatcgaccgacgtggcggaggagctccaagcaagcatacgggggtgggacctccatggcaaatnggcgggcccaaccgagaaaccttcatccacatgaatgctcaagggccgggtgcctccccctgccgggtattttaccgcccttttcaagatttacaaaccncatnattctgtctttacaatttncnggnaaaaaaannatacattccaatntcctttcnanattcttnaatnaaaaacacctggcnctgctttnttcccaaaaaattctggggttntgcgtcnaaatatccggggn

SEQ ID NO: 25021 - DNA, 678 bp, Triticum aestivum
  Clone ID: PAT_TA_25021
acatgcatgtcaatctcttcccggagttgcctctgcaaatttctaacatgtggtatttaatcacatatgagaatagtagatcccgtttttatcaagttaggcatacatgtataaattcaaacataagcagtctattcagaggaatcattccaaaaacaattttcaaaccgagcactggagcacaagaagttgtcacaaatcagaaaccaaatgaaagcaggtttatttcaagtgtgaatagcagcagtccaaacgtcaacaccgtagagatgatgaagcaattatgaaaggcactcatttcctgctatcgagcagcggtggaggggcctccataatgctagggttagggtttcgtttcgatcaaagatgggtttgtgttcctatgctgtgtgatgtcaggggaacaagaagaccgacgggagagggagtacggacgtaggaaaaaacaggttgtaggggcagtacggacgacgtggggcgtggggagtcggatgacgtaagatgggagacagagccttgcgtcttttttaagcagtagagatataccgatgtatgcctgtctgatcttgtaacttctttagtacaaataagagtgaaatctgggagtaccttaaaatacttaacctctcaatttcttccctgcttacttaagccccgttcggattccctccaattccc

SEQ ID NO: 25022 - DNA, 699 bp, Triticum aestivum
  unsure (1)..(699): unsure at all n locations
  Clone ID: PAT_TA_25022
cccggccccacctccgccgcccctcccttccctggccccgccacctcgtgctgcccctctctggcgcccacagcaggagccgcccccggctgacgctccagtttctgtcccgtcgccctggtcctcgcaggctctgttccccctgcctgctcctctgtgccgcgcttacccggggccgcgcggctgtgcggccccaacgcgctggccagccggcgcacgtgcgcgggtcgcctccccggctgcacgagccggtggtccatctcagccgctgcttctccccgcgagcggcctgccccgcgccttctcggcgctcgtgccaagcctggccctcctctgcgggcgtgccccgctctgccgccttcgcgtcgcggaccccaatcgcgggcagctgcttcgggggtggcgccttgcgctgcggttgcaacaagttcgaacgcaatggagtccggatcctctatggtcgaatgaaatctctactgtctttgtcaaacaggatcgcattggcggcagcaaataggagggtggcgcctaactntggatctgcctttggctatgttctgtagcggcgatggctctcctagcgaaagaagtgcatgcctatgcctatgtgcatcattaattatccgtcgtcatgtgtaatgttaatgttgtgacgttagttntaaactttgtatcaattttggctgaggctacatgaat

SEQ ID NO: 25023 - DNA, 298 bp, Triticum aestivum
  Clone ID: PAT_TA_25023
taaaattcgctcggccaagctgatacagggcagggaacgccttgtactaccggcagcagcttcagcgccagccccagcagatccaacgctggctccggcagagagctgatacaatcaaccggacgcacagcaaactggcagcattctttcattgatcaggagacaaccattttgtataccaagatcatgtaaagttgaacagagacaaaacatatatgtgtatatagagagataatcgtcgcacatttgcacatgaaaacaattccggtgtctgtgttggtcattgcacaatccgaat

SEQ ID NO: 25024 - DNA, 1417 bp, Triticum aestivum
  Clone ID: PAT_TA_25024
gggttctcgagcttctcaagagcgccgtcgcggcgattgctatcatcgcccagatttccgtggcgctgccggcgaacgcggtcctctactcgccggacacgaacgtgcccaggacgggggagctcgcgctgcgaagggccatccctgccaacccaagcatgaagaccatacagaactcgttggaggacatctcgtacctgctgaggataccacagaggaagccgtatggctccatggagggggatgtcaagaaagccatgcagatagcaactgaaaataaggaggcaatgttggcaagcatgcctgcagaactcaaggaaaagggctcggagctatataccactttgcttgaagggaagggtggtttacaaactctcttgaaatatattaaggataaggacaatgatagactctccgtagcgcttgcttcttctcttgatactattgctgaattggagctgttgcaggctccaggcttatcctttctcttacctaaacagtatttagagtacccgccccggccgccgcgagcagttgttgaattcacagttgagaaaggtgatggctcaacattctatccaactgctggtggtgaacccaaaagtgctgctacaattcaggttgtagttgttgcgtggtcgcccccgcggtctgctggaaacattgcgaaactggttttggatggggcatatgatggtgcaacactgaaatctgtgagccaggcaatcattgtagacagtgagactgggaagaaagggtatactcttccattggaggtcatgcctgctggacagtttgaaccactatacagaagcccgctaagtattcaggatggggaattgccagtccttccaatgtctgtatacggctctgttgccatgtcacatagtgaggattcagatgaatactcgtcaccaacccagttcttcttctatctgtatgataagagaaattctggtttaggaggaatatctttcgaggagggacaattttcagtttttgggtatgccacagacggaagagatgtcctttcacagattaaggctggagataaaattcgctccgccaagctgatacagggccgggaacgccttgtactgccggcggcagcctcagcgccagccccagctgatccagcgccggccccagcagatccaacgctggctccggcagagagctgatacaatcaaccggacgcaccgcaaactggcagcattctttcattgatcaggagacaaccattttgtataccgagatcatgtaaagttgaccagagacagctcatctatgtgttttgtgtgtgtttatccgtcgcacactggctcatcgcacctttgcccgtgtctgtgttgggtcattgcacaatccgaatagaatgcatttcttgtttcctttgatctttaaaaaaaaggggggg

SEQ ID NO: 25025 - DNA, 804 bp, Triticum aestivum
  Clone ID: PAT_TA_25025
acactcttgatagacattgctaactttgaggctatattaaatgcacacctttttgaaggattggatggtgaatatgacataccaaagcagccaatgcaaaaactgttagagattttgatgaaggcctaacccgagtttcatttggtttcaggtcagtagatgattactacagcaactcaagcagctcagattctatcaagaatgtttccatacccttattgtgcatacaggcggataatgatccaattgcaccatccaggggaattcccagagaagatatcaaggcaaatccgaactgcctactgatagtaacaccagagggtggtcatcttggatgggtagcaggcgatgaagctccatttggatgtccttggactgaccctattgtcatggagtttctagaacatgttcacaatgaaacgggctcaaccagcaagaatagcgtggccaatgagccgcagggtgttccaaagacatcagtaccacacttgtccgaacatgtgtagagatagtaacattgcgtttccactcgatgcgcacgttttatacgcatagttaggcttcacttgctgttctgcagctgaaatgtgctacacttgctccaccaacacgaaggttctgaacatcttaaaaatttattggcgtcggtaatccatcgctggctccccattttactgacatttcgacatgaagtatttatttgccatttggaaggcttgctgtatcaaactgcaccatgttgtatagagtatttcgaccgcattcatccatgcatgtacccttcaaaaaaaaaaaaaaaaaaaa

SEQ ID NO: 25026 - DNA, 654 bp, Triticum aestivum
  Clone ID: PAT_TA_25026
tggggggcatccgggcacatatctgtacagctattccatccgcctgtcagttcctgaggcatgcatgctaggtggagtttacttttcttcctgccagcttcactcacgccactggatcatccgatgtaaagacacggttgtttcggatgtgaatggggaaggtgttattgggaagtttcctttacttttaccagggcaggacgagtttgtctatgagagctgcacgccgctgaatggcagtagtggatctgtggagggctcctttacatttgtgcctgggagggtgacccagccagaaggaaaaccattcaacgtcacggtggctccgttccctctgcaagtacccgactacatcttttgagcaatagtatgtgcacctaataacagcgtagtgtcttggtagaaacaccgaacatatctctagtactcttgtctgttgcagcaaagttgctctgcgtggagttgatcttgtcgatgtaatgtaaactaaaggacgcaaatggttgtcgtgcgccgaccttcttccggttttttgctgtggccctaaaggaatctgtagcaggtggagcttgtctgttcatatgtgatgcgaggttgtttgtttcggcgaaacataagaggggattgttccaaggaactcctcttttgtcagtg

SEQ ID NO: 25027 - DNA, 1613 bp, Triticum aestivum
  unsure (1)..(1613): unsure at all n locations
  Clone ID: PAT_TA_25027
ctactctgacaccgccaaaatcccaccgcgccacgctgatggcttcgccgccgacgggacccgcggcgccggcgggtttggagagcatggagggactcgccctcgacactatcatcgccaaggccggcgcgcgccccgcggccgcgctcgcctgcgccagcacgcacctgcgcgccgccgtcgccgaggacgccgtctggcgcagcttctgcgcccgagacctcggcctcgacgcgcccctagaccccgaggaccgcccgctcccctccttcaaggatgcatataaagtttggtcagagtcttttggtatgtatccattacccctggtaaagagagtgaaacttttttggagctcattaaaaggctggatttctgaaaacttccctgaagcactcagaactttgagtaagggtgcttctgaggctcagataagatcagcagaagatgatcttggtttcaagcttcctatgcccacaaagctattgtaccgcttttgcaatggtcaactgcctttcagtagaaaccactttgaggatgtacgcatggctcctcttggcataataggaggctatgtgttttatgatcacagtgtaaatgtgcacttgtcatctcttgagcaaatggtcgaagagacaaaagaatttaatctcgacttggaggaacaaggtcttcccattgggcccaaccttgcattagtggcaagttcatggtatcatcctaaaacgtttattctcaattgttcaagtggtgacctttacgttggcactgccaacttatcagctggagaaatgatgccatgcgtgccaaaatcattgataaagccaactgatagtgatatgccccaagatggattacttttgtggttggaagagcaccttaggcgcttacagaatggcatgatcaagattcgcccgcttaagacgtcgaggtatatctgcttatatccagaagcatccccattgtgttcgtcagcagtgacaaatggtgtaaaggtacgtgcatctgcagtctttgcgccagaacatccttatggggggcatccgggcacatatctgtacagctattccatccgcctgtcagttcctgaggcatgcatgctaggtggagtttacttttcttcctgccagcttcactcacgccactggatcatccgatgtaaagacacggttgtttcggatgtgaatggggaaggtgttattgggaagttccctttacttttaccagggcaggacgagtttgtctatgagagctgcacgccgctgaatggcagtagtggatctgtggagggctcctttacatttgtgcctgggagggtgacccagccagaaggaaaaccattcaacgtcacggtggctccgttccctccgcaagtacccgactacttcctctcagctattgcacctgctcctcttatccgcggagtgtctccgtagactcaccgaccgtcgcgctagtactcccgcctgttgctccgcagttgctccgcgggccgttggtctcgcccacgttcggtttcctgccgggcgcttatggttgtcttgcgccgaccttcttccggttctttgctgtggccctaaaggaatctgtagcaggtggagcttgtctgttnnnnn

SEQ ID NO: 25028 - DNA, 451 bp, Triticum aestivum
  unsure (1)..(451): unsure at all n locations
  Clone ID: PAT_TA_25028
gcagggcaaagaaagaaagctagctaactactttagttttctttatggtgcttatgaagaacagcgtgcaggctatgtgcttggtggctcttgttatcatgtctaccgctttattgcccactcatgtagaaggaagaatcatggatacgaaggagaggagcctcacatcgtgctttctttgggaaacgctgcacaatcgatctatgccggcaaaattgttcagcacgtggatatgctaagagtgaaagcacctgtgattcatacaaagataataaatactgctgctgcgcgacggattgaaggatacagctgtgatggatactacacatcatatccgtcctacatnctaaagtatttcttgcaaatagcaaataatgacctaccggatgggaattgatggttaccanattcaataanacttttaaattttaccaacttaacaaaaaaaaaa

SEQ ID NO: 25029 - DNA, 476 bp, Triticum aestivum
  unsure (1)..(476): unsure at all n locations
  Clone ID: PAT_TA_25029
ctgaacttgaagagttgggaaaagtcccccccccctcccctcccggtcgctcccgcgggcgacgcggaggggaaaccctagccgccggtaacaggcccccctcctcctcgactcctccctcgccgccgccggctcgcgctgacgggcgaagcccggtcagcctcggcggcggcggggccttccttccccctgctcactagggccgacgcgggtcgggatcangcgggcggcggcatggcgctggccgagggcgtgacggcgcggcggcggacaacggtggcggggccggtgcctggcggcggcgtgttgggcttggtgtgctctgttctgccgcgggggcgcctggcgtggtggcggcnggccactggtggagcgcgtcggccccccttcggcgggtggcnnatgcnnntgcggggtgcgccgctcctggccgcgtgggcggcggatcggcggcgagcgtggctggctcnnnngnc

SEQ ID NO: 25030 - DNA, 962 bp, Triticum aestivum
  Clone ID: PAT_TA_25030
gggtcgaccggtgactttcatacaactgaatagagtgcacgctccgaacgtcaatgttccacagagctctgattttgttccattgttaaagaagttaaagtttcgtgctgagcatcgtcgcgcttttgaacaggtttttggtaggacagttatatgccgagacctggaaactgcgaccagagttgcacgcagcaatagtctagattgcatcacacttgatggtgatcaagtagccaaaaagggtggcatgacaggacgcccacgcgaccgtagacgctcaagactgaagtttgtaaaagtaatcagggacaacaaagcagaaattgaaaaaaagacggcacatctagagaacgtgggaaaaaagttaaaagatatagataagaaaattacggatttgattaccaaacatcagcaaatggacgctgaacgtgatcatgccaagtcggagttggaacagtttaaagctgatattgccagtgcaacgaagcagaagggatcactggagaaagcccttgcaaagaaggaaaaatcactcgcgaacatccgcaaccaaattgagcaaatccaatctggcattgcaatgaaaaatgatgagatgggcacagaactgattgaccagctaactttagaagaaagagatctcctttcgcgactgaatcctgaaattactagattgaaggagaagttcctctcgtgtaaaaacagtcgcattgagattgaaacaagaaaggaagaactggagaacaatttgtcaactaatcttatgaggcgtcagaaagagttggaagcaataatttcatctgcagattctaaaactttgcctgttgaagtcgaagcaaaggagcaagaattgaaagagtctaagaggactcttgatgaggcgacgacagtactgaaagctaatgttggtgctattaatgccccttcatgacagatggagcaactggataaacaagggttga

SEQ ID NO: 25031 - DNA, 615 bp, Triticum aestivum
  unsure (1)..(615): unsure at all n locations
  Clone ID: PAT_TA_25031
ctgntttcccattcggtactgacgatcttgacgaagatctaccggggtttcctgggctcatgaatacccctagcatgatatccagtgcgggtaccagcaccacaggattaggcagcatcatgtctaccaggacaagggctgccgcccagtacttcaaaggtatgatgtcttcagccacgtcagaagaccagccagggaaattcagtttaaacagaatcttggacgggaggacaaagaagcaagctgcaagcatgttctttgaaacattggccctgaagagctatgattatatcgatgtccatcaggaagaagcgtatggcgatatttcagtttcggttagaccgtcactctcgagcgctaaactttgaacaactctgtttcccttcagttcaattagactattttcttttgctttcctggcctgtgtaatatcagtcctggtttagaatagtgctatgttattttatgccttctaagctttgtgtaatatttggtgtgtatctcagtttgtctcagttctgttaagaacctggaaatgctagtgtgagtggagctgaaggtgtaatgtttaaaaaaaaaaaaaaaaaaaaccggacatgtgctntgcacctgtgc

SEQ ID NO: 25032 - DNA, 938 bp, Triticum aestivum
  unsure (1)..(938): unsure at all n locations
  Clone ID: PAT_TA_25032
cctggtgccgtcgtgggcgccccacccggaggggctcgcgaaggaggccacgggaggcttcttggtgcactgtgggtggaactccgtcctggagagcctggtgcacggcgtgccgatggtcgcgtggcctctcttcgctgagcagcggcagaggggcgtcatgctttcggggggtgttggggtggccttgcgagtgccggtgaccagcggaaagaaggaaacttcggcggcagtgagggaggtgctgcctggcgccgggaaaggcgcccatgtgagagctaatgtggcggcgctgcagaaggcggccaaggaagctcttcttgaaggcggtgccgccacgaccgctctggatgaggtggtgcgcaagtggacatgcggtgagtattgttagatgtaagcaaacctaccaatacatctcactccttgtgcccgtgtgcatcgtgatgatgatgtgtcattttttaagaaataataaaacatctctcttcttcggcttgatggtttctttttatgtttcaatcaccatcattgcatttgtcctataattattatatattattggcgggctatttgtcctataattatgggtaggcagaacgggtcccacgcatgtagagaaagacattcttattttacatttgtaactgaatgaatgccaaggaaacggccaaggtagtccaggaatgaaagacagcacgtggaccctctctgcagcgcatggtgaccgtatggatgtgcgcgcgtgtgtcgtcacatgaatggaagcagactccgtgcaccactcaaaaaagtgctcgcgtcaagattcgccgcttattgtgtgtatatatatttagctaagtgttcgtgtgttgccacggagacaatcatatttcagtgattccacatcaattactctctccgtaaaaaaatatataagtgtttcactnannaaaaaa

SEQ ID NO: 25033 - DNA, 552 bp, Triticum aestivum
  unsure (1)..(552): unsure at all n locations
  Clone ID: PAT_TA_25033
tgaggcccttgcaatgggaaaaattgttatatgtgccaatcacccttccaatgagttcttcaagcagttccccaactgccgtatctacaacaacgatgaagagtttgtacaactcacactgaatgctctagcagagcagcctactccattaacagatatgcagatgtatgacttgtcgtgggaggcagcaaccgacagattcatggaggctgctgagatgaaccttcctacagcagagccaagaatccagcaagcgtccaagacatacttccccacttttctaaggactcgtaaactgaagcaaagtttggaggatgcatcagtatacctgcaccaagcactctcagggctggaggtcaccccgttgcgcctttggtgctgttccaaaagacgctgcaacccgatgagcagctgcgcaaagatcttggcttgggcttctcccccaaangagaagaaaaagcaaggaacaaaaagctgattgacgtgacactgcaagttcggcccccggcgccccgttgttgtgcatatttgccatgcgtgtacattattcaa

SEQ ID NO: 25034 - DNA, 371 bp, Triticum aestivum
  Clone ID: PAT_TA_25034
ttcgccggtcgacgggtaatacacaaagaaattggcttggttccttctcgttgctcaaggtcggtgagtaatctcaaaagagattggcggatgacaacccttcctggctacctatgagctgcagttgttgatatcttggaatgaagcagtcattctgggcactgtgttctcctggctatcctgaatctttcgctgatgaatgtagatagacttcgcatgttggcattaacagcgtgctgttggcgagatcagtttgtgttgtaagtggagaagaagtgaaatgggactcttttcaggggttccctaacccgggaagcctttcgtacatataagagtattaaattgataaagcatatttatttggaaaaaaa

SEQ ID NO: 25035 - DNA, 770 bp, Triticum aestivum
  Clone ID: PAT_TA_25035
ggcttcttttgatgagtacagggaggagttcccttgcaatgttcctctttatgatgatgttgctggtggtggtggtcttgttcttagtgtgagggagttggagaagaggcggtgtgaggaggagcagcaaaaattgccatggtaaatgatatgatcgaaagattccagtacaaatggttctcaaagcttgaagagtggggactgtctgtcaactcactgtggagcagaatggaaggactctataaggagattgagcttctgaaggaaaatagaagatcaagatttgctaccccagctacagaggaatctctagctacagaagaacctaccccagctacagaggaatgagttccctgacagtcagaggttcagatgtgaatatgactcccagtcactccgctagatgttttgatgtcaacgagcatacattccctctgctggatgactcccagttagtccctaccctctgctgccaccaagagtgtggctgcctattggtacatactgtagcaaggataaatagtttcgcaagtaaccctgcttgtatcctcatgtgggatattttgattattagtgatcaaggccctgtttgtttccttccaggattattagtgattaaggccctgtttgataaatagttctctagattatataatccccctaataatctatgatgtttgtttgcctcccaacttatttaagctggattatataatctcgagggtaaacaaacatggcttaattcaggtgcatttagggtttcttaatct

SEQ ID NO: 25036 - DNA, 679 bp, Triticum aestivum
  Clone ID: PAT_TA_25036
gcctggcgcagcggtggcggagctggtgggcaggtgcgcgcggcggctgtcgcgggcggcgcggcggctgcacgtgcgccgcccgccgggctcatccttcccgtcgcgcgccgtcgtgccgttcctcggggcggccgggggcaaggccaagagagcgctgtcgtggccggcgacgtcctcgtcgaagaaggggagggaggcggggccgacggaggagtggggcatggaggcggacgacggggtgtggaggaaggagatactcatgggcgagcggtgccagccgctggacttctccggggccatctactacgacgccgagggtcgccgcctcggggccccgcccacgccgcgcacgcccatgcgcagcccgctgccggcctccctcaagctcgccgccaacgcctgatcgccccaccccccacgccggcccgccgtcgtcgcagcggctcgccctgcgacttggccaagatccatccatgcctctccctctgcctcactgctgtactgtacatggttctattgccgctctgtttttccttcgctcatctcctctcgagaaacctctgcttttggcgtgcgtagtgaccagctagtgagcaccgtgacaccgtgtaaaagaagttttaatgaacagtgttactaaatctcagtcgatgttatgttcatgagatcttacatg

SEQ ID NO: 25037 - DNA, 952 bp, Triticum aestivum
  Clone ID: PAT_TA_25037
ctgctgcaataatctacttatcactggcacagtttatgggagcacgggctctgcgctagcaagtttagaagcatcgcggctctccagacctggaaacaaggagttggtaatctaagtgttgaagcacttcttggaccggtcgcagaactttgcgagggcggtagggaagacgcagatgcagaagatctgcacatgccttgtagtttgcgctttgaacctgacagatttcatgaagggccacatcgacgcgtcgaagctcaagacccgcctgtttgggcgccttagccccgacgatctggtcagcaggcctcgtctgagacgcggcaagagggatcttagcccggagggcagacgtgggatccaacaagagaggactaagcgtgctgcgcgccatgaggaaccggcgcaccaagctaatgctacgcccagcactgctcgtgttgccacggttatgcgtcccgttcgacattgtcggttcctgggcatccagtctagtggtggcgcgcagtttgcgtgcaagccatggtggccctttaggatcgtcccttcaggatacggctatgggttatccgtccggttgcctccgagagccccccaccctggcccgggaatattggggcgagccccgggtgatctgataacatcgaatagtggaattcagctacctaatcaaggctcacttctcccgaggccattgcgggaaaggtctgacggcatgcgtcgcacgggcagcggcggggacgagcagctccatccagcaccatgagcggagggacggcggagttcttcatattcgcttgctggtctaggaatggaagttttagctcgctgttgtttgcacatatgcttttagagctgtgctgactgccaagactgtattgatgtatccttgggcctcattgtaaatgccttttgggttgaagaaaaactgaagaacatcaaaaaaaaaaaa

SEQ ID NO: 25038 - DNA, 916 bp, Triticum aestivum
  Clone ID: PAT_TA_25038
agcctgcccctccggggacgctggaggcgcgggcgacgggtacctctccgacggcggccttctgcagtcgcccggcaagcggcggagggcgcaggagagaaagaaagctgtcccttggactgaagaagagcataggacatttcttgctggtctcgaaaagctggggaagggagactggaggggtatatgcaaaaaatttcgttactaccaggacaccaactcaagtggccagtcatgctcagaaatattttctcagacaaactaatccaaacaagaagaagcgcaggtctagccttttcgatatgatggcaagcgatttgtcaccagcaccaaattgccccatcttaccaccaacaatggcaaaatttcatgatatggtaactatgactaatcaactccagaacagcagcttggaaggagtatcatcttcgaatgcagctaatctggcaaaacaagttacaagagatcttcctcccccagttccatcttttacggcaacaaatgtggatggaagtctcagcaaaatgaaccacatggattgcttctcgcgggtaccctcgctgttcagaccaattccaatagtccctgaagggacacctccatcagctcccgcgactgccaacacaagtgccctgacatttgaagctaacctgacttcatgtactagcgcattcctgatcccgcgaagcggtccttcaccattgcctcctgcgacgactgcgaagacagatcatccagcagagaacaaggatctggagctgacggttggcctgccgtcccaacaaaacatcaccaacaacatatcttcccagaatgcggtaggcgtgatccaagtcgtttaagctaataattattcttttgggagtcgcattgttgttatagacagttgacagaataaacactagcattttattag

SEQ ID NO: 25039 - DNA, 1426 bp, Triticum aestivum
  unsure (1)..(1426): unsure at all n locations
  Clone ID: PAT_TA_25039
ggtttcgcctcttaagtttcaccattccttcggccccaaggtagcgcactcactcccatactggtgaccggcatctgcggcagaaccaacagatggccatgcctaaggacgtgatccgcacgcgcaagaccattgccaaccttgccaccaccgccgcagcccgcccctccgaggccgattaaggcgcggttaaagggtaaccccccttcctcggcttgctgctgccctctgcctcacagcggtccacgcgcgatacatcgacagctgtcagggcaaattgataagacattagaacacttccttctggactccaggaccgcaggatggcgggagtagaaccttccaagccaacaaatcctgtaataccagctcaaccacttaaatgtcctctgattcaagctaattatttaataaatcaatacgcaacctccacaagaatgtagccctggtgtcccttgcgagattttcgaggatcgtttgcttcagagtctcggaacaacataaggtatggcgcctcccgggtacccacgcggatcggaccaattccaatagtccctgaagggacacctccatcagctcccgcgactgccaacacaagtgccctgacatttgaagctaacctgacttcatgtactagcgcattcctgatcccgcaaagcggtccttcaccattgcctcctgcgacggctgcgaagacagatcatgcagcagagaacaaggatctggagctgacggttggcctgccctcccaacaaaacatgaccaacaacatttcttcccggaatgcagtaggcgtgatccaagttgtttaagctaataattattcttttgggagtcgcattgttgttatagacagttgacagaataaacactagcattttattagtgatattacatgaataaaagcaggaatctgtaactcggtctgtacgctttctgacgtgttgtgctccgtcctagccatctgaattgttgacagcatgtttgatgtgcacagtgttttagcaactggcatgatcattccaacatgatgaagatgaatatgatgaatatcttggtgaggtcacaaattctgagtatggttcctctgacatatcacttccagcatcagatncttgttatccttcttctcttgtaaggtnccagagcaaggtggcggggtgtatgnatgagncttgtggaacttgacggcaccctaacacaatctccagaatcatcaccatcgctctttacactctcagtgtcccataattcaggtgttaagtcatctagggcatcataaaaaacatcacctttaggagagatgctatttaaataatcttgtaagagctgacactctgagtaattccctgagaaccaagaagtgattaaagatgaagcttgattgacactatcgaattcccatctcttcggacgcgtgggtcga

SEQ ID NO: 25040 - DNA, 534 bp, Triticum aestivum
  Clone ID: PAT_TA_25040
gcgtttcgcgggcgtcgtccagggccggcgggtcggggcagtactaccgccggagcggcagctgggtgctgctcatgaggatcttcaagaggctcttcgtcgtcgagaagacgaccatctccgccgggcatcggcgccactaggccaaggcagcagagtgatgcgtacatgcacacagcacacgtacagcatgcacacaatcgcctgaggcatccttgggatgcaaatgcggagtaagttaagttatactatgacggacatgagtaattaagcgttcatcttccttgctactccttttgtttctggtaaaatatatagaaagtcaagacccgtggagattcttttgtatttacccacttgtcactaagccaggagatgtgtcctgtcatgaatcacgatcttgtggtaaattatactatgagttattaagtgttcgtgagtggcgtaagtgtaattagagttcatctgaacaaagaaactcggttatatatcaccaaaaaaaaaaaaaaaaaaaaaaggctagttctagatcgc

SEQ ID NO: 25041 - DNA, 1232 bp, Triticum aestivum
  unsure (1)..(1232): unsure at all n locations
  Clone ID: PAT_TA_25041
ctgtgcggcgctcaggcggcgggtgcaaacgagcagaacagcgaggtaggtgctgattatctatagagagaccgcgtccagcgatggacgacttcaccttccctacaacggccgccgcggcagagcatgcggagccactgttcctacatcaccaccaccgccttcccccattcccccacttcgcctcctcgccgctctggtttcccggcgacggcgtcgccgttgcaccggtggcggccgtggtgagccgccgaaccgccgacggcatggaagagcaagagcccacgtcgtcggactcggccgccggacgacggtccaagggggagaggggaggagaagcggatgaagaaggggcggtcgtgcgcgctaccggcgcggacggcgaggacaagatggacaagctgtgggagaacttcaacgaggagctggaggcgctgcggcgcgccggttcttgcccgaagaagacggcggcggcgtgcgggctggacgagctgtcggacacggagtcggaggcgggggagcgcgggcgcgggtgcgcgccgatgctgcgggcgtcgtcgaggggcggcgcgacggggcagtactaccgccggagcggcagctgggtgctgctcatgaggatcttcaagaggctcttcgtcgtcgagaagacggccgtctccgccgcgcatcggcgccacaaggccaacgcggcagagtgatgcgtacatgcacacagcacacgtacagcatgcacaatcgccctgtgatgcaaatgccgagtaagttaagttatatactagacggacatgagtaattaagcgttcatgatgggtgtaactagagtccatcggatacagaggaattcggcatatatcactccattgttttgcatcatcatcgttccttgctactccttttgtttctgtaaaatatatagaaagtcaaggcccgtggagattcttctgtacccacttgtcactgcccaggagatgtgccctgtcatgaatcacgatcttgtggtgaattatactcgacgggtatgagttattaaggccgcgttcggtagtcatccgctgagcagagcgcacggagcgggctttaagtaactctgtaaattatagctttaatcagctgaattgctgctccgctccggcgcggagccacggagtggagggaatccgaacgcgatctaagtgttcatgagtggcgtaagtgtaattacagttcatcnaacaaagaaacatcacccc

SEQ ID NO: 25042 - DNA, 441 bp, Triticum aestivum
  unsure (1)..(441): unsure at all n locations
  Clone ID: PAT_TA_25042
gaattcggcacgagaagagctcctttcctcctcccccctctccctcctcctcggccttcgcttccttccaatgccgccgcccaatctcgaagcgcgcgactacatcggcctcggcccctctgcggcgcccgcgcccgcctcctcctcctgctcctcctccgcctcgggcgacgccggcccgcacctcgcgctccgcctcggcctgccgggctgcggctcgccgggacgggacgggccggaggacgccgccgtcgacgccgcgctcacgctcgggccgtctccagctaccgctcatgcttcgcacagggggcggcgccaaagcgcgggttcgccgactcgctcgacggctccgctgccagggcttgtcgggggaaggaagaacaagaagaanggtgaggncgnccgccgcnngccggaggncgggggctccgccagcntgct

SEQ ID NO: 25043 - DNA, 725 bp, Triticum aestivum
  unsure (1)..(725): unsure at all n locations
  Clone ID: PAT_TA_25043
ctcgtgccgaattcggnacgagaacgcttctactctcctcggtcctcgcccgcccgcctctccctttcccatctccctccgccttcgccaaaccctcagagatggcctcgacctgcttccgcgccgccgcccgcgccgccaccgcggcatgccgctcggcggcctcccgctccatgccctccgtcggccgctccgccgcccgccgcgccccgctaatctccagggtgccgctggagctggggtgctgcgcgggaatgtcgctgctgccgctgcacagcgcggtggccgcggcgaggctgacttcgcggctgagcacggcgtcccggagctcctccgctctctctcaggagatgggtctctctgctccaaggtgataaaacgcgggaagacctgctcgtgtcgtgcaatcagtctgatagaatttgtagagtagtgaactaaatgaacttcttttggtacggagtaatttatttgtgacacgtacaatcatggttctgctgggcctttccaagttttgagatcatatcttttatcttgatataaatatgcaaggacaaattgcagatgatggctgtgtttgtttacaacagttctgaatgccatttatatagtaatgatcgatgagaaacnatnttaaaaaaggggggccgtacaatcgccnaangatctatacncctaaggcgtcttaaatntacngaaactggtnccactatccttngaatccc

SEQ ID NO: 25044 - DNA, 579 bp, Triticum aestivum
  Clone ID: PAT_TA_25044
tctacagttggtgatcatcttgtgcctgggctaccgacgagctacatggagagctccggcatggtgacatcatcgtccgactctttcgcatcggagtcatacgatggagcacgctgcacgaatgcgagcgtaggagagatgatacagggtggggattgggtgcaagagcagaatcaagggttttggcctgagtcaaaccagactttccagcctcaggactcggagttgtctggatgggttcaagggttctccgagtctgagagcctcgctgagaatttttggagtttggaggacatttggaagatgcaatgatttatgttctatatatgttggaaaagggtacgtgcatatatacgatttatggtcggcatggtggtgtagaattagatgcgtcacttctatggagaaaaaactagagttaattagtttattctaacttgaaaagtcactattttatataaaagtgattaaagttcttttggtttcttttttccttttttggtcacttgttcatcttttcctcataccgactttgttgtccgagaggttaaagggatggagttttcgccaaaacaaaaa

SEQ ID NO: 25045 - DNA, 579 bp, Triticum aestivum
  Clone ID: PAT_TA_25045
ttatccgtagtatatactataacagtgagtatttctaatcaagcaaccaatttcaaaaaaaaatggcaggaaaaatatgttcaaaatacttagtgattgtcttcggaaaaaaatcttaatgatcggctttccatctcaggtactcaaccatgttgtgtactaccatgagccacaacttatgctacatattacacaggtgttgatcatttttcaatcctaaagtattattgttgttcagatcaaaaataaaaataattacttgacaaccctcttctcataaaaagcactgaaaatcagagtgcacgatatcccttgaacaggattttcttggtatgaagatcaattaatcacaggaaaaaatgccatggtgcaaacctatatatagaggtacctcatttagtatcacaaactgggaaggccctgctaattacaatgcacatacctggccccaaatttcagatgtgacatgaagaaactgcacgcacccaagactgaaaactacagaaaaaacttcgaagaagtcgtcgcggccccgtttccaagtatggagttttcttagagcaaaaaaaaaaaaaaaaa

SEQ ID NO: 25046 - DNA, 441 bp, Triticum aestivum
  unsure (1)..(441): unsure at all n locations
  Clone ID: PAT_TA_25046
tgacaccccanacacaagcccgcccagcgcccacgccgcccgcccgcccgccatgtcgtccgccgcgcccgcgccggcgccggaggagcagccgccgcgcccggtgcgcttcggcatcatgggctgcgcctccatcgcgcgcaagctcgcgcgggccatgctgctggccgcgcccgccgccgccttggccgccgtcggcagccgctccgaggccaaggcgcgcctcttcgctgccgacaacggcctccccgcggccgcgcgcctgcacggctcctacgaaggcgctcctggacgacccgggccgttcgacgccggctaccccccgccgcccgcccatcctcgccgtccantgggccaccggccgccgccgtccgccccaagcacgttctcttcgaagaaatccaacgtgcttttggngncctccgaacnttnaanggcaat

SEQ ID NO: 25047 - DNA, 438 bp, Triticum aestivum
  Clone ID: PAT_TA_25047
gggaatcgaaaccctcgtctctcctctcgcccaaccaaggggcgacgccgcctccgccgtcccggcccgacctcctccccgtcgccgcgccccctccaagttcaaccgtcggcgacggcgacggcgagggccccgtgaaccgagtgacgtcttcctcgcccttctcgtcaaccctgcggcgcaccccgccgccgccctccccgtcgccgtctccaagatccaagaagatggaaaataagttgaatatagttcaatgatttctgttgggacatcaaacgctctggagccgttctgtcaactcaaggacaacttggggtacaagtttcaagagtgagtcactgccttcttgtgggagctggggcccgtgtggcttatccaggcactgtctctcgcccgccggtttcgttcagactcaataaaggttaaaaattgcttggg

SEQ ID NO: 25048 - DNA, 529 bp, Triticum aestivum
  unsure (1)..(529): unsure at all n locations
  Clone ID: PAT_TA_25048
tagcgtggtcgcggccgaggtacatgccctggtggcattatctgtgttgggggtgatggagtcgtaaatgaggttgtgaatggtttacttggtagagacgatttgaaagaggcgcttcaacttcctattgggatagttcctgctggttccgataattcattagtatggagtgttcttggcatcagggatcctgtgtcaagcagcaactgctttagctaagggtggtttcacaccgattgatgtgtttgctgtaaaatggatccaagctggagttactcatttcggtttgacggcttcctactgtggttttgtagctgatgttctgcaatttatcctgaaaacttccgcctgcagcttggggcccttcccgttacgtcatncgctggcattcttaaagttttttgtccctgccccaatacaaaatttgnaggtggaatttatcctgcctttnatcaaccangagnaaaaatccctaaacttgggaggtcacccgatttgaaanaatggccaatnggccaagnctttcctg

SEQ ID NO: 25049 - DNA, 837 bp, Triticum aestivum
  unsure (1)..(837): unsure at all n locations
  Clone ID: PAT_TA_25049
ttcagnaactcacttgcctccgctcccttgttgtcgatggttcactcgagtggctgcatgttgtcaactctcctcctcccctgttgaggagtctgaagttggagggaacccttggagagattcctggctgggttggcagtctgatgcatttggtcaagctttacttaaggggcagcgcaataaaggaagaaggtaaagtcatggaaatactagggccacctcccaacctcatgcaccttcgtcttggaagcggctcttatattggggagaagttggcgttcaaaacgggagcattcctgaatctcaagaaacttgatatttgtctggcggaactgagagaggtcaaatttgaggatggcacctcaccccagctggcaatgatacatatccgttggtgcaacttggcatcaggaattattggagtcaaccagcttctaaagctcaaggagatctcacttggttcctatggtcgagtggcgaagcttggtatgctgcaaagtgaagtggacgcacaccccaacagtcccgtgctgcgactgtccaaggaacggagccatcacgacccggggggtgttgttatccaagtgggagaagcaacgggggaatcctcatctctccatcccgagcctgcagctgcaggagagagctcacggtcccaagcggtgggcatggccgcggcaaacatcagccaagatgatgtgctttacacttacaactcctgctgactgaatccgagcaagcctcctaccagttccacttccaccgtgtaacacaactggtacagctcaaattttacactatttcctttttttggtttggctcgatttctagatgcca

SEQ ID NO: 25050 - DNA, 897 bp, Triticum aestivum
  Clone ID: PAT_TA_25050
gtcttcttcttcttctacccgggtctcccagctgggcgccgccagcttggcggcgctgctcgcggcggtgtgcctcctccacgccggcggggcggcggcggcggagctgagcgtggactactacgactgcacgtgcccggacagcttcacgtccagcaaagccgacgccgagaacctaccgggccccttcgacggcctggacgtgctcagagccaagttccggaacgccacgctcgacgacactaccgacctcgtcgccctctcaggtggccacactttcggccgtgtgcaatgccagttcgtcacgggccggctgtacaacttcagcgggacgaaccagcccgacccttccctcaacccgacataccgagccttcctgtcccagcgatgcccacagaacggcgacgggacgtccctgaacgacctcgatccgacgacgcctgacaacttcgacaagaactacttcacgagcctcgaggtgaaccgcggctttctacagtccgaccaggaactcaagtcagacccaggcgcggcggggacgacggcgccgatcgtcgaccggttcgcgggaagccaggacgccttcttcaaggccttcgcgaattcgatgatcaagatggggaacatcagggtgataacggacccctccaagggagaagtccggaagcgctgcgcattcgtcaattgagattacgggggacaccacgtgcggatatacactacaagtgggggtgcggcatgggatgtgcgtgtgatcatggacctaaggatgaattcatctcttgttttccagcaataattggtatgtgtgtcaaccaaatgtaaacatttcatgcatgcatgcttgttgtcggacgtggaataaaagtgtaaaaggtcatttcaatggtttcgttc

SEQ ID NO: 25051 - DNA, 1367 bp, Triticum aestivum
  Clone ID: PAT_TA_25051
atgcatcacttcatcagcctacgtgtccgtcgcaacgtcatgtcttcttcttcttcttcccgggtttctcagccgggcgccgccggcctgttggccgcgcttctggcggccgtctgcctcctccacgccggcggggcagcggcggcggacgctgtgcgtcggactactacgaactgcacgtgcccggacgcgtacaagatcgtgcagggaggtgctggtgcaggcgcaccagtcggaccctcgcatcttcgcccagcctgatccggctccacttccacgagctgcttcgtgcaacgggctgcgaccggcgtcggctgctgctggacaccttccacgggatggagccggagcaggccgcgagtccgcaagcggcttggcggcgcgcggcgtcgacgtcgtcgacgccgccaaggccgccctcggggtcgcctgccgcggcgagtcgtcccctgcgccgacaccctccccatcggcgcagagatgtcggcccggctgtcaggaggacccggggggagcgtgttgcgggggacggctgggcagcttcacgtacagcaaagccgacgccgagaacctaccaggccccttcgagggcctagaaaagctcagagaaggtcacggacgccacgcctatcgaagatactaccgacctctgtcgccctctcaggcggccacactttcggccgcgtgcactggcagttccgtcacgggccgggtgtaaaacttcagacgggacgaaccagcccgacccgaccctcgacgcgacataccgagccttcctgtcacagagatgcccggaggaacggcgacggaacgtccctgaacgacctcgacccgcaccacgcccgacaacttcgacaagaactacttcaccaacctccccggtgaaccggcgcttccgtttcagtccgaccaaggagccccagtcgcagcccggcgcggcgggcgcggacgacggcgccgatcggtcgatcgcggttcgccagcagtcaagcagccttcttcagtagcttcgtcacatcaaggggaacattagggtgataaaggccctcccccccagggagaaggccggaaccgctgcgcgtttgattctgtataattgaaattagcggggggacaggtataggctagatgtaggagtgtcacaggggttgcggctatgatcagttcagtgtgattcaggacgtaaggatgaattgcatcatattgttttccagtaataattggctttgtgtgtcaaccaaatgtaaacatttcatgcatgcatgcttgttgtcggacgtggaataaaagtgtaaaaggtcatttcaatggtttcgttcaaacaagtggaaaagtgtttcattcttaaaaaaaaaaaaaaactcgaa

SEQ ID NO: 25052 - DNA, 1244 bp, Triticum aestivum
  Clone ID: PAT_TA_25052
cccagagggcggaagacgcggagctaccgcgggggaagaccgggcgagcgcgcggccgagccagctccacgcccgccaccccgccgctcagcggccccgacgcccgccgcggcgacgctgcggcgccgacgatccggccccgccgcgcccgggcctcctccgccggcggcctgctccccccggccccccctccgccccctgccgcccccggccccccccccccccggccccagcgccgggccaagaccgggccggggccggggcgtgcgcagtcaggggcggcagctggaggagcggtcgggcgacgcgcagtggcaagaggccgtgggcggcgcagggcgcggccggtggtgctcgccggggaggacgcggccccggaccgcgccggagcgggcgccggggattccggcgtgggccgtgccaggagcctgacggacgacgacctggaggagctcaaggggtgcgtggatctggggttcgggttcagctacaacgagatccccgagctgtgcggcacgctgcccgcgctcgagctctgctactccatgagccagcggttcttggacgagcaccaggcgccgtccaaggtcgaagatttggctccggagccgccggcggtcgtgcctccttcgccggtccagcccatccccaactggaagatttcctgccctggggacagcccagacgaggtgaaggcgaggctcaagtactgggcgcaggcggtggcgtgcaccgtcaagctgtgcagctgatcaaccgcaccgtcaatcaaccaatcctgcggacgcaggaagacgaagccaactcatactcgcaaggcggcaacccaattcatcaggcgacctatgtgcacgagcgcacgccatctgcccgaatcgcatggaaatcacattacattggatcaattcatcgccatcaacacgacaagcagaacgaagggtgcacgcatcatattgtagacttgggatcgcgcctcgacgacgataggaagcgatgaagcgagcgaggaggatgtcactgggcatttctaatgctgcactcacacgttatgatttatgaatcgctgaatttccgttcagaagaagcggtactatgaattcttgatcggcagctgtagctaattcattcatgtaaacagacaacgtataatgtattctcaaccaattcattttggaaataataattgatctcgtgctgaaaaaaaaaaaaagctaaaaaaaaaaaaaaaaaaaaaaaaaaaaaaa

SEQ ID NO: 25053 - DNA, 571 bp, Triticum aestivum
  unsure (1)..(571): unsure at all n locations
  Clone ID: PAT_TA_25053
caactagagcacaagcagaaaatcaaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccaagcaaccacaacaaccatttccccaagactcaacaacccaacaacatttccccaacaaccacaacaaccattcccccaagactcaacaacccaacaacatttcccaagtccagcaacacaacaactttcccagcccaacaacattgcgcagcccaacaacgcaacatcatcccaccacaaggcttctcctcacattctaaaaangt

SEQ ID NO: 25054 - DNA, 778 bp, Triticum aestivum
  unsure (1)..(778): unsure at all n locations
  Clone ID: PAT_TA_25054
cacatatcagcgcctcaagaagctatttgcctggcggggcctcaagcaggccgtggaggaattcgtgcaccagtgtgccgtttgccaacacgccaagcacgagcatatcaagccacccggactgctggaacctctgcccatccctacagagccgtggcatgacctcaccatggacttcatcgaaggtttgccactgtctgagggctgtgaggtgatcatggtcgttgttgaccggttcactaagtacgcgcattttgtgcccttgcgtcaccccttcacagcagcaacagtggcgcgtgcattctgggacagcatcatcaagctgcacgggggtgccacactcgattgcctcggatcgcgatcctatcttcaccagcaaaatgtggcgtgctctccacgacgccgccggcaccaagctcagttactccgacagcatatcaccctcaagacggatggacagagcgagcgcgtcaatcaatgctccgagatgtatctgcnatgtgcggggcatgacaattcccaagcagtggcgaaagtggcttcgccacggttgattctggnacaataccacctttcttccgttcgctcaccacgttccggtctccacggatcccccaacggggtggctacttnggggcccaacctgccgggtgcaccacttctcccccccactcaangaccggcgggccttgggcgcctaaatgggcagcccctttgtnaaatggcccgggccttaaagggggcaagtgttaanttanctttaaaagaaagggtaacn

SEQ ID NO: 25055 - DNA, 491 bp, Triticum aestivum
  Clone ID: PAT_TA_25055
agattctgcaactgccgagccccaaccctcccaccatccaccgcccagcaaggaaaccaaccacccaccctttagctcctggatccgccggcggcggcgacgcacgccggccatgcggtgacggacgcggcccagcgaccacctcagccggtcgcgactccagaggccgaacctgagcctccccgagcggcggatctggccccgcgtgcctccgccgcctccccccgccgggagccctcgcatccagcagttgtacgacggggcacgcgtcgatccaatcgagcgtgcctccaagcgcaaggcccgctgtcaccccggctgacggcgaaggcagccaccgtcgctcctccgggcggaaagaagaggagcaaggagcctgaaggcagcctccatcaccgagctgccgctgcagggcaacccaagggcactcaccaagggcaagggcgatgctgccgccccgcctgactcaaccctcaacttctaagcggtct

SEQ ID NO: 25056 - DNA, 921 bp, Triticum aestivum
  unsure (1)..(921): unsure at all n locations
  Clone ID: PAT_TA_25056
ggacgtgcgctaccgggacccgctcgccccggtggcccggcttcccgaagggcaccaagccgctgctcacgctcgacaaccccttcgccaccaacctgccggacaacctcttcggcgacaagtgggcattcgtgcagctccccttcgacgattgcggggagcaggtggagttgctggagaggaggtacgcgttcggggcggggctcgatttggacctcttggggttcgagctagccgcaaccacactagtccctggggttgccgtggaatctgcgcgcgccacgcctcggcgacaagtgggcattcgggcagctccccttcgacgatgtgagtgggcagggggagttgctggactaatccggacagccggggtttcgggctcgtatgtctactcctggggttcgagctgcgtcaaaccacgctaggaggtaggagcgtgggagacagccttcaaggcgccaagcggcctgcggctcggatgaatgggatagagattcgttcaatggaggttgacaccggcagagcgaacctgatcctggcagccggcgtttctacgcagatacgtgtacgccggctacctgccgcgcgccgcgccgtcgcaggtggcgggcccgcggcaggcggcccagtacgccggcggcggcctgcacttcctggccatccaatgagaacctcaactccgatagttgcgtgggtttctggctcctgctggacctgccgccaccgcctgtatgatctgggtagcgcgtgtgttgtgacttccactgaaatcactgtagtatgtgtagtgccaatcagattttgcagtacaaggtgatttcattttagctcgttgattactgcacagaggtgtactttatggaaagaaaggagaggaaagcgctcgcggccagtttgccccctctttagcngaagtccgta

SEQ ID NO: 25057 - DNA, 690 bp, Triticum aestivum
  Clone ID: PAT_TA_25057
gaattcggcacgagggagattctacttcatgtgttgtcttacaagcaacgaggctggctgtcttccacacaccacaaatgaaggttttggaactccattctccaatagtatcagtgaatcaaacactccaatctctctgaattctaacccacaacatctccgacaccctctcgacgagctgcaattagatcatagctgaggaggcggcaatgaccactgaggttctctttgtggtttctgatattgcggaagctgaatgacaatagtaatgactggtggatccatgtttgcgtttgctgacgacaacgataatgagtttttacggctgcacttgagggtgatcgtatccatgctaccattctgcagtatcttgagatttctacagtggagtagtacacaactacctatcacaagtttgagcttagatgaacaacatgggcaccatcaaacggatagatcatgcgcctgatgggtctcatgatggagtagttgataatggttatatacaaaacatatcttgacagaggtggcaccagacgtcacagagaggtaccgcgttcggtccaacgaggagctccgggcatggtgggcggtggccatggcattggcctcatgggtttactctgactgccgccggccattctcgcaaacaatggcttaggttttgaggaggattagcatgtcaccaca

SEQ ID NO: 25058 - DNA, 818 bp, Triticum aestivum
  Clone ID: PAT_TA_25058
caaaagtaggcaaaagggagagtacatatattagttcttccaaaccatctaagatgggtcatatttagctgtaggcaaaaaaggtacatttctgtagttatatacttatagttgcataagcaccatgcatgcgtatgatggcatcatgacaaaaactatgaaattcaaaagacatttttgtactaattggctcctcagtgaagctagtacagaagaagaggatcgtactgggtatcgttcttatctttctagaaaagaaagggtaaaaactgattcagagctgtctgcggataggcaaatctattcatcttgattaactaacgagtttatatacttattccctcgattttattctgtctagtaggtttccagtagacgtgggtataggttactcaatctgagagtcggaacggtagtgttggagcagatcaaacgactgggccactcaaatgtgattttcatcagttggtcatcatggatacttgactcgcatacttcttccctcgactttgttctgtcccgcgcgtccggcagtagatggaaccaaaagagatgttttgtcctcgatgtgctaattcaaactaaacaatcagaatgaggcatgctctctagagatggaaagcaacgaactgaatgtcccagcaaaacaacaaactgtaccacaagagtgtgaagaatttattggctgcaccattactaatgaagttaacatccacccgccaaatgataatcgatctaggggtaggataaacagaattaaggggaataaagagaagggaagcaaaaaaggtaacaacaataaggcgaaggttcgcaat

SEQ ID NO: 25059 - DNA, 593 bp, Triticum aestivum
  Clone ID: PAT_TA_25059
gggcgcggccggtggcctcgacggtgaaactccggtggtgacgtctacggcgagaggtggcgcatggcgccgatgcgagcctacggggcggtgactggattgatctgcgggacatcccctcgccctgagacggcttccggcggcggactgagaggtcaacaaccccacaacggcgtcctcacggaggccaatgaccagactccactcgccctctcatcggagccatcatcgaagaccaagcttgccgttccacgaccgcatgcgtacagtggcttgactagatttctgacttagatattgattcagtactactcgcttaacttattaggaagtgctgatcacaggtgtgtcgatcttgatcatctaattcgttgtcgtcatattagcaaagtgctgatcgtctcatacgcacggggctttgcagctagataaaaaagatcgaaagcagacagacgtattaggaagtgttggtgctgtggaagacccaaaaatattagtcaccgatcttattgaagcagaagacccaacatgcaatgtgggtcatgactcataagttcaaggtttagtagatcaaaaaaaaaaaaaaaggcggc

SEQ ID NO: 25060 - DNA, 603 bp, Triticum aestivum
  unsure (1)..(603): unsure at all n locations
  Clone ID: PAT_TA_25060
gcacgagggaacaccaaccccgccgccgccgccgtctccggccccgtgtgcgcagctggtctgatctccgtcgcccacgctcctccatgcgcccacgccggctactggtctgaactccgtcgcccacgctcctccacgcccacgccggcggctcgcctccccgcctagactcatcgggttccaccaccgccccaacgccgtcgaactccgccatagccgagtgcacctggccctgcggacaagctcgctgtagctcgccactccatccgccgtagcagtcgtagtctgtgagtagatcgagttgtaggctcttttgcggtgatgcatgtggatttcgtccgtagtttgaagaattttctaagtagatctggccgcatattcatctatgcgcggatgcattcatgcatgtactcgtccatctttaattttgcggtaagctcatcccgtagccttgatttgtaggttccgcctcctcttttttaaacaaatttctactgttttctgtttctgatttgttgtctcgagatgttcccgaatcatctcgtcctttgttggatgtttcgttagatggattagcatactactttggattctgtnnnntcn

SEQ ID NO: 25061 - DNA, 526 bp, Triticum aestivum
  Clone ID: PAT_TA_25061
tcgaattcggcacgagtgtaggtgagcgtaagcagactcctgccctcttgtactgtacaccatggcgatgctgaagaagggcacgagcgtcctgtgtttcgtggccaccgtcatggtggtcatggctaccacccttcttctctcctcctgcgacgcccacaaagaggcagatgagactgctgcgtttcccttgccggcgccatgctactccatctctttcccaaactgtaccgacgacaagtgcaagaagttttgcgagcagcgtaggcaagcggccggcccccaaggcattctgcaatgacaacaataactgctgctgtcctgtcattcaatgtataaagcgtctgctgaagacagccgagctaagaaacaattaaataaaacctatattccgtaattgtttttgatctggggaagcttccagcaatggactgttgccccggactcaccaagatgtttttaaatcattgtaaacctgacttttcgataatttgttgtgttcggcagcttttgtttatcttgtgtg

SEQ ID NO: 25062 - DNA, 1081 bp, Triticum aestivum
  unsure (1)..(1081): unsure at all n locations
  Clone ID: PAT_TA_25062
gtcggtttcttttgcatatgcactttctattgttgttgtcatttcaaaggaggccatagtctcctggattttgtatgccttgttatctggaattggtgaccatagatgtcattccgtagcatagtccgtgatgttagggatggctttggcagcttgtcgaggagaagctttgaggtgaccctcgcaagcatttatggccttactgggcatcacaaagggaagacccagagctcatcacatgttctcgacgactcaccttccataattcgtgaaagtcgatgggcgaatctacctcctgaactcatccgtgatatcatacggagactggaggctgatgagagcacctggccagcgcggaagcacgtcgtttgcttcgcagctgtttgtaggacatggagagaaatgtgtaaagagattgtgttgagcccagagttctgtggcaagctcaccttccctgtgtctctaaaacagcctggtcctcgagatggaaatacaatggtccagtgttttataaagaggaataagtcaaaatccacttaccatctctacctgtgccttagcaatgttgttacttcagaaagtgggaaattcctcttatcagctaaacgacaccgcaaaaccacatgcaccgagtacactatatcaatggattctggcaacatctcaagatcgaaaagaacctacattggaaaaataaggtctaacttcctaggcacaagatttttaatttatgatacacaagccccctataatggggctgtagttcctcctgccggaaggaccaacaggaggttcaactccacaaaatctctccaaaagctgccttcagtcagtncaacatcgcacaagtatcnttatnagctaaatgtccntggcacnaaaggccctaggaggatgcttgcatcaagcatccatacctgcatcatcantgganccaagtgggaacattgccnggacagcaangcaaattgtcctcaactctggggggatcatccgnacanggttcttccgnatcgtccntgnatgctcatcccaatccacangccntcagggtnaaacgnnctttcnaaaccngaaaaag

SEQ ID NO: 25063 - DNA, 1037 bp, Triticum aestivum
  Clone ID: PAT_TA_25063
tagcgtggtcgcggccgaggtactaatggaagtcactgctctcaaattactgacactgtagcaagtccatgtagcaaaaaaccttgttgtattgaaaggtgtcaagcattctgccctgtgcttcacgtatcagtgcagatgttgctcttcttctggaaaatgaaattggttctaggccaggcaagcgaggaaatgatgcagaatctgttcctgggtgcggaggcggaggagatgctgacgaaggcaacgaggcgaagggaaaggaggatgcgctcgcatccagtaggctgctcgatccggaattcaagccctccaagctgtcccaagatcagctcgacaagtttaaggaattgcacaagaaacggctacaaataaaggaaaaaacaaaatccaaaggaaaacctaaaggaagaactggggagaatacaaatgtagccaatgattctaaatttaataataaggataaatcaattgatagtgccgcaatagatgtacagcatacaacatcaactacaggagcccaagcgaatcttgcaccgtccctgcccttgaggaacaaaaggaagttgcattgggggcttgatgttaaagaacggtgggagaggaaagcgaacatgtgaatttctgaagatcgtttaaattctcggagcaaagcaaaccctccatgtaaatgggaaaaaaatttttatgccttcttgatgacctagttgaatgtattcatctttctgttagcaggcagaatagctgggcgaaagccacaagatctaggccacaaatttcctggtttgcagttttctatctgatgccttgtgcaggttatgtagctagatattcctattttaagtacctgtccagatctcttgttgggtacttcaggcccacgccgcgcaggttatagaacatcctgcttagcgagacagggaaggtattgaaaatcctgtttcaaatgttgtgtacgattatgacatgctgctgttgctgcttttacagcaaattataagtttgtcccggtttattttaaaaaaaaaaaaaaaaaa

SEQ ID NO: 25064 - DNA, 780 bp, Triticum aestivum
  Clone ID: PAT_TA_25064
catgaaagtcatcaatgatgcggtacaaagcggcgaacgtgctcttatgctcgccgagttcaagctgtccctcaactcttacttgtctgaactggctacctcacctgttagatcattatcagacataattgacttcaacaacaagaaccctgtcgaggaaaggatggctgaatttggccagagttaccttctgcggtcggaagcaacaaatggcattggtcctgctgaggagcgtgccattgccaaactgaacaaactgtgtgaggaaggccttgagaagataatgcgagccaatcaactggacgcgatcgtcgcacctggcgcatctgctcatagcctgcttgccatcggcggctatccagcaataaccgtcccagctggatatgcttcgaacggcgttccttttgcgatttgctttggggggttgaaaggatcagagccgatgcttattgagattgcttattccttcgagcaggcgacgaaagttaggaaacctccaatattgcagcattctgtcatttgattgtaggtctagctacatatgtttccaggaatcacgctattataaaatgcaatgcatctgcttctttctatctgaaatgggtaatagcgtgcaaaggactgaatttttgttatgcagatcctgaacaccagatgtttcagctttgttacctttttctgtttgattctacacaatcttttaatatcttttgcaataaaccctgatacgttgttttgtgcaaaatgacaagagaattgcttcagcatgcttatttcatc

SEQ ID NO: 25065 - DNA, 677 bp, Triticum aestivum
  unsure (1)..(677): unsure at all n locations
  Clone ID: PAT_TA_25065
attgcggggttgcgaggctgctcgattcgggttcgcctgatgccggnagtcgtccggtagcctctacactgctccagagtgctaccaaagtagcaggtacacagataagtgcgacgtctatgctttcggcatgatcctcggcgttctgctcaccgggaaagaccccgcagacctgtttttctcaggagaaagtggacggggcagcctggcacgatggctccgtcacatgcagcattccggcgacatgaaagaagcgctggacagcagcattgtaggggaggaggtcgacgaggaggagatggtgatggccgtcagggtcgccatcgtgtgcctctcggagctgccagccgatcggccatccagcgacgaactcgtagccatgctcgcccagctccacagcttctaactgccatcgtcgttgctggaaatttctgaacttcagaacacccgtatgatattccatctcgcgagtcgcgagacgacgcagagtggcgcaggatcatcaaccgccgaattcagtgtcctgagctgaattcagatgggagccagcaatgtagaggccaagccaagcaagtgtggcaaaatagctgcccatcagcttcatggcgcatgctggtggttgaatgagcttcatgtaagcatcatgatggtgatgttctggccatggatgagcctgg

SEQ ID NO: 25066 - DNA, 837 bp, Triticum aestivum
  Clone ID: PAT_TA_25066
tttcgtcctctctgtttggataaggctgcgggggagctcaagcggcggagcaggaggcgattctccccgtccatggcgatttcgagaccttctcccactcgagcttgatttctctccccttccccttcgctccccggtgtcgcggttggttgttcctctctctctctctctccccgtcgcgcgcttgtgttgttctgctcttgttcgtcccagatctaggtcagttcatgtcgccctctcgcgcatgtggtgcagccgctagattgctaggcttctggttgttgtggtcgtcccgcgcgcgctgctgtttgtactgttgtagtttgtagatgcagcggctttgtcccccttttgtctgtggagatgtagctgttcatgtagatgagagggcgatctgtagatgttcctgtaggtgctcgtgttcctgtagacgcgagggattctgtagatgtttctgtagatgttcctgtaggtgctcatgttcctgtaggtgagagggcgatctgtaggtgctcatgtacttgtagctgctcatgttcctgtagctgatggggattctgtagatgtagcttggcggatgtctgtagttgtagcatgcgggatgttgtagatgtactggtagatgtctagctcgttcctgctcgtgtcgggatgctccctgatgcttctgcgtgttttcctgctcttgcccctgctcatgtactggtagatgctaggtgctcgtgtcaagctctttttttgtattcaaatgaattaggctcctgatttgttgttggaggtgtagttctcctttgtaccgtgtttgtttttcttctagcaggaatgaattttaagttt

SEQ ID NO: 25067 - DNA, 629 bp, Triticum aestivum
  unsure (1)..(629): unsure at all n locations
  Clone ID: PAT_TA_25067
acgaccacgaataccccgtggcccggggccgtgttgtctgatcgaagccccgtctctctctgctctgctctgtctcctctgctcagctcaccccctttccccagatccgacgcgaatggcttcctacgacggcgaggacgactccggccggcggcgcccgccgcagcagcagcaccgcccgtccggcgggggcagcggcgacctcgccgcgagcgccaagctggtggcggaggcggccaaggcggcgctccaggaccacaacctggggaaggtcgacaagggccgcaccgctgaggctgccgccgacctgctccacgcggcctccctctacggcaagctcgagggcaagcccgtcggcggctacctcaacaaggccgaggactacctccacaagttcggcgccaaggaggggggcggcggaggcggcaagcatcagaccagtggtcacgggggttcaggcggcaggtacgaggaggaggacgagtacaggaagaagcctactagtggtggtgggaggtacgaacaggtgatgatgagtacaaagaagaagccccggggtggggggaggtgtggaggggatgacgagtnnnnnnngaagcctactnnngnnnnnggcgnnnnnnnnantn

SEQ ID NO: 25068 - DNA, 472 bp, Triticum aestivum
  unsure (1)..(472): unsure at all n locations
  Clone ID: PAT_TA_25068
cgctatagctgcttctgtgagtctctataatcttcttcgccatcggttcagtaaccctctcggttctgttcgctcctcttctcccctgctccctgtccccggcattggtcgtcgtggcgcttggcccgcccccctccaagcttnctcngtgcctttgggttactgctaatgcttgggctccctaattgtataggcgagaggaagatacagatgtacctaagattagtaggttcgcatatcaaaagtcaccattcagttagcatgcgcactttagctagcttccaattcacttgtaggtctgagagaaaagagagtgccctaccttctatctagcttccaattaacttgtaggtgtactaagttatccttcaattttcagatcatgtacaacctgattcagtgcacatgtttcaggggctatattcaagtacaaaatgctcaatgaaaaaccctgcaagtactcttattaaaa

SEQ ID NO: 25069 - DNA, 1099 bp, Triticum aestivum
  unsure (1)..(1099): unsure at all n locations
  Clone ID: PAT_TA_25069
gcgcccgcccgggcaggttcaaggctgtaaccgcggagaaggcgagacgagggcaaggtaactcggcgaccgcgagcaggggaagaagtaggtacccgagtagagacagagaggggcgcgcgacggagaaggtgagaggacgggccaccatgaggcgctcctccaagaagtcgtcgtcatcgtccgccgcggccgttcccactaaagcggtttcaaaggaaatagagcggattgaccaacttttctatacatatgctgatggctcatccagcatgattgacccagaaggcatcgaaacactctgctctcatcttgaagttccacatacagatgttcggattctgatgttagcatggaaaatgggctgtgaaaagcaaggttattttactctggatgaatggagaactgggatgaaagctctgcgagctgatagcatcagtaaactgaagaaagcctttcctgaactggtccaagaagttacgaggtcctctaatttccaggatttctatccatatgcgttccgttattgcctaacagaggacaagaagaagtgtatagaaattcctgttgcttgtgagttattgaatctagtgttgagcttgcagttccgcccgcaggttgaaaaacttattaattaccttaagcatcaaaatgagtacaaggttataaacatggatcaatggatgggatttcttcggttctgcaatgagataaacttcccatcacttgacaattatgatgcagaccaagcttggcctttaattttagacaattttgttgaatggttaagagcaagtgaaaattagctctgttgtactgagtggtggtgaagatgcaatccaaatgtaatactcagaaatcaccttggagaattttggaggatgcagatcaagctcgtttgtgactgctctgttcagagtctggttttagaaattatcaatcgccttgtagtttgccttttgctttctttatacttgatttaaacacttcgcagggtcatcatctagaattttacatcgtcattctctatatttgtattattcaatggcttcgtaggtgtgtagttttgagagcatgcaaattttncngaagtcttaaa

SEQ ID NO: 25070 - DNA, 777 bp, Triticum aestivum
  Clone ID: PAT_TA_25070
cggcgcgcgggccgtggacccggacatgccagtcggagtatatactcttcatcttgatagtgggataacgatctaactctgcacatttgaagatgcagaccgcatgacagtccggacagaagatcagaccgtctacactgaagacgacttcagagagtttctatcacggcgtggttggacactcctcagggagtatagtggctacagagttgctgatactctggacgatcttcgccctggcgtgatttaccaggggatgcgctcgcttgtagattggtactgccgaagcaattaaagaggccatcaaatcggcctttggattaagaacaaggcgggctttttggcttgaagatgaggacgaggttgttcgttccttggacagggacatgccagtcggagtatatgctcttcatcttgataatgggataacaatcaaactctgcacattcgaagatgcagaccgcatgacagtccggacagaagataagacattctacactgaagacgacttcagagattttctgtcacggcgtggttggacactccttagggagtatagtggctacagagttgctgatactctggacgatcttcgccctggcgcgatttaccaggggatgcgctcgcttgtagattgatcatgcatcatttgtccgacaaagggcatctatatctggggtatgttggttttgagcccaagttcgccctgccaaggtggggtgttgaaaaagtggatagagagagaggagcagttggtagaagaagaagagaggtaat

SEQ ID NO: 25071 - DNA, 768 bp, Triticum aestivum
  Clone ID: PAT_TA_25071
gccggccgggttgcgcgcagcggacgcgtggccgatccagcaccgccgccgcaaacaccacacctcgagagccctcttcgccggtgaagtagcaagcaagatggctggaaggaagggaggcgacaggaagaaggcggtgacccgctccgtcaaggccgggctccagttccccgtcggccgcatcgggcgctacctcaagaagggccgctacgcgcagcgcgtcggctccggcgcccccgtctacctcgccgccgtcctcgagtacctcgccgccgaggtcctggagcttgccggcaacgctgccaaggacaacaagaagacccgcatcatcccgcgccaccttctgctcgccgtccgcaacgaccaggagctcggcaggctgctcgccggcgtcaccatcgcgcacggtggcgtgatccccaacatcaactccgtgctgctccccaagaagtcccccgccgctgcagagaaggaggccaagtcgcccaagaagaagaccaccaccaagtcccccaagaagaaggtcgccgccaaggagtagccgcccctagcttagctgactcttagttccatatcagggagaagatgaggagacttttggttgattggatcctgtatgtaaatgctagtctgtagtggctcattcattagttcgatgaacaagccagtcaggactgtattttacatgtgatttagtatgcgtggaatggctaaagatgtgacccgttcaatcaaaaaaaaaagtttatccatcgaactgtccacagt

SEQ ID NO: 25072 - DNA, 510 bp, Triticum aestivum
  unsure (1)..(510): unsure at all n locations
  Clone ID: PAT_TA_25072
gcgagcctcacactctctgatcagagtagcactagcttcagctagccagcctctgccactccggtcattttcttgcatccacgacggcaatggccaccgctgatgtccagaacccatcggccgcgctgacggaggaggcgcccgcggtggagaagccggtcgccgccgaggaggtcgcgaagacggaggaagcccccgcgccggtggaggccgaagtcgaggcgcctgcccccgtcgaggttgaggagaccaaggaggaggcgccggcagcagttgaggcagaggagacgaaggagcccgagccagcaactgcggccgaaccgggaaggccgaggcgccccgccgtggtcgagacaagagaccaaaggagggccgtggctgaggcaaaaccggcggcggccgaggaggttaaagaaaaagcggcgcccgcttgccgaggccgaanccggccgctccccctgctgctgaaggaaacaaccggttggaggcaaccgcggccgccggtnggcn

SEQ ID NO: 25073 - DNA, 1008 bp, Triticum aestivum
  Clone ID: PAT_TA_25073
atcggtgctagtgccacaatgagcaggagcaactggctgtccaagtgggtgagctcgtgctccgaccacgcccagccggccttcgccgccgttaccgtgccgcttctctacagctcctcacgtcccgcccctccgactccatcgtcccggccttcgtcctccgcctccgatttcgcggcgcggattcgccctgtgtgggccgcgtacctattcccggagacagtgagctcgtccgtggtcaccctccgtgctcccatatcgcttcaggctccgggcatctgttccgctgatgggttgtgcccgagggagggggctacgtcgaggtgcgtcgtcgaaaggcacgaggccaaggggctcgtcaacgtggtgcttctgggcggggggctcgcgccggtggcacgcaaccatggcttggacccgttgcgtgtaccggttgtgctgggagacaaccgtgacaacagctttaactcccataactgcgccccgctcccggggccggtacatactagggacgttctgtggttcccggtactggccaccgtcgaagataacggatacaagatactaccaacccgacgcggcgctctacgcggtggggatgtcgtgacgactcgtgcctccggcgatgccgtggcaaccaatgccctccgccgttgtgccgagtttcagtcctcttgtttcattgagagtttgtatttagaaccgtggatgaattcctgttccgttcgattttcgctgcctactggcaggcgcttgttaaaaaccacgaaaagcttggttatgtgtagagagcagctgctgagggagcattcattcattcattttggcttcagagctggacaatttttgttctgcttctgcttccagcaagctggctgggagatgtaaggcacagtatattaaaaaaaaaaaaaaacccagggggggccggtgcccatcctcccaaaggatcgacaacgcccacggcgcgccggctccgacccctatcccggcttaccacccaccctt

SEQ ID NO: 25074 - DNA, 1357 bp, Triticum aestivum
  Clone ID: PAT_TA_25074
gtccggccgccgccgtcgcctcccggccgcccacccgcctcatcgttccccccgccccagttctccgcccggcgccggttgcttccgccccgccgccccctccatccccctcctcctccttctgcgccgcccgacccggcacccctgcgcgccccccgctcctccggggcgcgtctcttcccggcgggccggtctgtacggcaggatggcgcgggaccgtgatctgcgcggcccgggcttcctgaagggcgccgaggctccggggtccctctcccgcgcggcctccttccccctcacgcacgcggacgtcttccccagcctggacgccgccggccggccggcgcgcaaggccgccgacccgccggtgcgtgcaatcgtcctctacctggagccggtgttcgccgccgagatagcgaagtctttcatggaagtatttctccctcattttgataaagctatctagttccaaaatctgagcatgtatcacttcagtatgtttcatgcctcccatcatctgcaaccaatcttagcaaccaaggatgagattgaagccgaagtcgatgctgtaaaaggagttactgaggctgtttgtccccttaaaatttccttggatcgagtggttttgacgtcaactggagttcttcttggcctgtggcaggttgaatctggtactgatcctgccgacatccgctcaaaattgagagaagctctacctcgagcaccccaaaagcagttgtatgatcctgttctcctccacacatcctttgcgcgaattctgggacctcctaagctcccacaacaggaggacacatcatctttcagtcacatcaaattcttccatgacctcgttgcacaggttaatgggaaaatccgtggcttccaggcaaaggtatcagagctgtggtatgtagaggagtacgatgtgctagccctagcactgaatggaaagatgagagtgcggaggctccaccttggctgcaatgagggccaagataactgatgacagtaaagagaacaccaccagggtatcagtgcgcaatgcatcgtctctatgagttagcaatgcttgggagtgcctctatgattaacatatactagtgtgtgcctgtagcgtgggtttgtgagccgcgctactactacttcacagtagcattgggtagggatctacctataaggtatttcctcgtagtgttttgcagtgagctgcttattttttactcagcaaaccttttgccgagtagctgacaaataacactcagcttatgtcgttatgcctaccaggagtacgccgagtcctttttgtcgagtgtaacacccgataactttttgccaaggttgaatttagccttcaccgtgc

SEQ ID NO: 25075 - DNA, 742 bp, Triticum aestivum
  Clone ID: PAT_TA_25075
cgcctcaagtacgaagcgtgaagggatagtactgtactttcctctcccttcttctccgtccccggtctggtctggtctgcttcttctctctccgtccttgttccttctctcttcttgtactctccgattttacatttgccctcctccgaccctcctcttgcagctgcttctgggcgtcaatggggagctctgccattttaggagaagcggagatcccctgaattggtcaatcagcattgttagttcagacgattgctcaaactttgactactacagattcttttcccctttattttgcaacgacctttgggtagcccgtaattgattgctagtcttgtggttctgaattttgtttttggtattctgattcagaaactttcgggtttgcttctttggagtctggggggcgacattttttttctagcaaagatcgccttcggttaattttggccggttcttgattctttctggacctcgttttccttggtccgatcgattaccggtgctcagtaatcccctctgtccaatttttctctagagtttgtttggtcgtttgatcatggatccctttcacggcattgtgaaagaggaggaattcgacttcgccggagctgcagcggatggctactcgccgtcttcctggggctcatccccgtcttcctggggctcttcccaatcttcctgggccggcggcggcgccttggcagagctgccgcggccgatggacggcctcggcgaggcg

SEQ ID NO: 25076 - DNA, 215 bp, Triticum aestivum
  Clone ID: PAT_TA_25076
cgacccagcgtccgctgacctgcagtacatcaaagatgatataagcagtgtggagagacataggctagatctgtatcgaacaaaagaaaggtactccatgaggctgcgcatgcttttggatgaacctgctgcatcaaagatgtggccttcgcctatggacaaacctaatagtgcctttgttcccaactctcgggcttactagttctagatcgcga

SEQ ID NO: 25077 - DNA, 483 bp, Triticum aestivum
  Clone ID: PAT_TA_25077
cgatgctttgatggatagcttaaaagcaggaggatactcaaagcaagctgacattttgtctaggatcttggccgagaatggatcatcaacatccaagaggggcaagaagtctgccatgggtgcatagggaggtttctgggttcatgaaatggtcctattttcctttctgaatcgaagaaaacagcagtttgtttgttttattaatgcttgttgggccatctgtcagattgggatttcatcctagaagacaagaaggataggtaaatttacctttctcatgaaatccctgatttaatcatgtgccattttcttggaaaagaaaacatgttcaataatttaggcagatgtacttcttatgaatttagttgagaaattacatccataacatgctgttacgtcgtcatttataagtggctctactgaagagaagcccagaattttgttttgttttggcatgttactaaaggaagaatttgatccccc

SEQ ID NO: 25078 - DNA, 1000 bp, Triticum aestivum
  unsure (1)..(1000): unsure at all n locations
  Clone ID: PAT_TA_25078
tnnncagcatgatggtgcannnnnactnnnnnnnnccagctctgttccagtctgtcatggtggcgcttttcaacgatggccgggttcagaccgcaagcagggtcatgaagagtatgatcgagaagggggttaccgaggacgtggatatggcacataagatcgtggaggctctcttcatgaggggtcatgtggaggaggcgattggtcgcgtcaatctgatggtggaaaatggctgtatgcctgatctggataagttgctagctgccctttgcgagaaggacaaagtgatggaggcacaaaagctggctgattttgcgttggaccgggactttgaagttagcttctcaacctatgacagagtcctggaagccctgtacactgaggagaagacgttgccagcctactccatgctctgcaagatcaagcacaaaggaggcgttgtagaccagaagggttgcgatgctttgatggatagcttaaaagctggaggatactcaaagcaagctgacattttgtctaggatcttggtggagaatggatcatcaacatccaagaggggcaagaagtctgccatgggtgcatagggaggtttctgggttcatggagaggtcctattttcctttctgaactgaagaaaacagtggtttgtttgttttattaatgcttgttgggccatctgtcagattgggattttcatcctaggagacaagaagaataggtaaattcacctctctcacgaaccccctgatttaatcgcgcgccgtcttcctaaagaaacaacttgattaattattgcagctgacggtctttctgttggagttcacaagcaaattactactatgccgttgcctcgtgctgtggcggtggctctccggtggtgcgccctatcggcttgacgcatctcgcgtgccgcgatgtgcttggaatatgttttgcatctttgtttccatgcccattttgatctctctttgtttctttcctcagttgcgcggctccacct

SEQ ID NO: 25079 - DNA, 945 bp, Triticum aestivum
  unsure (1)..(945): unsure at all n locations
  Clone ID: PAT_TA_25079
ggccggccacacatgatttctcctttttctgttatcacttgtggatggccttagaatgggtttgcaatgcaagcctccttgagggccatccacatatgatttctcctttttctgttatcactgtgtctcatggaagttccaaaattttgtaataattttggatgtatgggaacaaaaagcatacgattgtcatttcgccctgtcggcgatactgtgaattaacagttgccagtgccacgggttcattgccacaaagccgaagagcatggggtggcatgtgtcgagttccttgctggcaaggaaggtcacgttgactatgatttggtgcctggtgtggtctacacacatccggaggtggcatctgtcgggaagacggaggagcaggtgaaggcctcaggaattgcctaccgagtcggcaaattcccgctcatggcaaacagccgtgcgaaggctattgatgatgccgaggggatggttaaggtcgtggctgacaaggaaactgacaagattcttggtgtgcacataatggcgcagaatgctggagagatcatccatgaagctgtgcttgccctgcagtatggagcatccagcgaggatgttgcccgaatatgccatgcacatcccactgtgagtgaggccctcaaggaggcttgcttgcaaacccattctaaggccatccacatatgatttctcctttttctgttatcacttgtctcaggaagttccaaaattttgtaataattttggatgtatgggaacaaaaagcgtacgattgtcatttcgccctgtcggcgatactgtgaattaacagttgccagtgccacgggttcattgtacatgccattgaatttatgtttccttcttaggccctactacatctggagtgaggcgctttggatatttnaaganaccttttttttttgctatttacaagttttaggaaaa

SEQ ID NO: 25080 - DNA, 1442 bp, Triticum aestivum
  Clone ID: PAT_TA_25080
gcagacatagcaaggcattgacagactgagaagctctttcttgattctatgggtggtggtgcatggccgttcttagttggtggagcgatttgtctggcatgtttgaggcacaaggcgaccccccttctccaggcagcggaacccatgcaaagagtaggggtatactcaaccttctaatcgtggccctggtgatccgtcaacaagtggagctgaggagttaacctctgaagatgaagtggcacgtttattgaattgcgccgatcactattcggcatttggatttcgcctgtatgaaatcatagatgtatcagtactcaagagagaatacaagaaaaaggctatgttagtccatcctgataagaatatgggcaatgataaagctgctgatgcatttaaaaagcttcaaaacgcatatgaggttcttcttgattcagtgaaacgaaagacatatgacgatgagttaaggagggaggagctactgaactacttcaggcggttccagggtgcttctcaaaagaaaggaggacatggtacattccaacaagggtttagcccctctgaaggtgttgatgaaggaccttctgctctatcgagaagaatagcctgcaagaaatgtggcgatttccatctgtggatttatacaggaagacctaagttgcagggcagatggtgtcaggattgtaaagagtttcatcaggctaaagatggtgatggatgggttgagcagtcatttcaaccggtcctatttgggatgctgcacaagcccgatctgcctcgtgcatttgtttgtgctgaaagcagcatttttgatgtcaccgagtggttcagctgtcagggaatgagatgtccaccgaacacccacaagccgaccttccacgtgaatgccagtttggcaaagcaaggtagtggcaaagggagcacgtcagggccaaggggtggagtcccaaacatggatgcaggagtcgatgaggagttctttgagtggctgcagaacgctatgcagtctggcatgtttgaagcgcaaggcgaccccccttctccgggcagcggaacccatgcaaagagtagtggtggtggtggtggtggcggcggcggtggtagtagtaacaggaaaaagaggaagggcaagaagcagtggtaactcacctggtctgggaaaagataaataaacgacttttgagtgtatcacaaatggccaacttagttcgccccggatgctaaagactggcatgctgcgcgtacgctgagacaccatctcgaacatcccgactcgacttggtaagatttcaaatttcgagaatcgaaattcagacggaaaacaagagcatgtatgtgtatggcaatgctggtggatgtattgttacttgccttacaacgaggcccaaaaatgttaccctaagtacaagaaatatatgtcattatatctggaaacttgtctaaaa

SEQ ID NO: 25081 - DNA, 856 bp, Triticum aestivum
  Clone ID: PAT_TA_25081
ctgttttgctggctttcacgtccacctacgcgggcgtgaggcggggaatccaaacaatggcgctgggatccgcggatctataggcgaggcgaggcgcgggatgggatctgggagcagcaaggccgcttcgccgccggccggcggcgaggccaaggcgcggaatgggaagccgagggggaggagcctgatgcgcctgcggggggctcctgcttccggggcttcacgcccgagtgtgacgcttctgggggggtgccggcgccgccgccgccgctgccgctaggggtcgagtcaagcaagggaggggagacgccttcactcactcacattggcatatcagatgaagatgcttcatcggctcctaaatcgaatccaactgaagtcagaacaattcctttgtcagataccgacagagaccaagatgatgatgtattgcagaatgtcactgctaccaggaccgcagtcgacgacgaccaatcgccaaatccttctgaccggccgcgtccatgctttggtgtcaactttgggctgagtagagctgtcagcttgggatcatcggtggcatgctccattatgtcaaccggcctctcctcttcagctaatcctagtattggaaatatggaccatccttccgatgcgaacatccctcaacaaggtggtgcatcgacttctgggatttattcaagtctggatatgctaagagacagcgtcacaacgcaagctagagcggctcatcaggctaggagaaatttgctggaatctgaagatgctaacttgaggcattcgcacaggaggattggaccccaggaaccttctgaaggcagtgtcaggtttagccgaacacttagtgttggaagac

SEQ ID NO: 25082 - DNA, 568 bp, Triticum aestivum
  unsure (1)..(568): unsure at all n locations
  Clone ID: PAT_TA_25082
ctcatctgatcacccactagctagccagctagcagcttaaggaactagcttgcagctagcgatccatggctcgtctcaacaagcaaggctgtggcggccgccgtggtcctggcggcggtgngtgctgatgatggccgggcagggaggcctcggcggcgctgtcgtgcggggcaggtgggactccaaagctcgcgccgtgcgtggcgtacgtgacgggggaagggggcgtcctccgatcaagcaagggaagtgcttgctcccggcgtgcaaggggggctgaaacgggcctgggcccgcaagcaagcccgggcccgcaaaaggataagccgtgcaagggtgcctcaaaagaagcccccgccaccaagcaatcaaagtccatcaaacatgtgggcaaagggtcctcccgggcgttgggccccggcaaagtgcggggccgtcaagcggtgcccttccccaatcaagccaatgtccaaaccaaacctgcaaacaaattgtcaacctaagttcaaatatataaatcctttccctaaccgtgcaatgcaatgggaccgcgccttgccgttgngnc

SEQ ID NO: 25083 - DNA, 1059 bp, Triticum aestivum
  unsure (1)..(1059): unsure at all n locations
  Clone ID: PAT_TA_25083
ggccagaagagcagcggtgcgcagtgagcccgtgaggtttcgcgatcaagacacgcaacaactctagtaggtgagcttcttcctggtagcaataactgctctagtgctctgtgctctccaccactccatcactcgtccttgagctgagctgaaatacagagctctcacgcgctttgtcttctccgttggggctggacgattccttccttgcatctgcgccgccgccgccgccctgcccctgcgcagcggcgagtgaagctaagcgtcggcaagcttatttttggaagagatttgaggtggtgtcctacatttagtaacttgaagacattgttactgaatgactggtgtgtggctattgacttccgtgcactactttgcattctcgagcattcacctgttcttgagaagctcactcttcaactatgtaagagacaggaatttataactgtgctggcaggtaactgctatccactggaaaaattacctgcaatatccgaacaccttaatactgtggaaatcagatgtagagatattgatgggagggtttgcaggattttaaaattcttgagtcgatttgtcagtgtcacgcagattaacatcaaactgactgcgcaactgtccacatgcttcagtttcgagacatggctctcggcctccccggcaaatggtgatgattattcatgaacgcgaggctaaagtctggtcttttgtctctgcaatgttgcactgttttaaatctttgaagaggcctaatcttaggaacagcgtggaatgagctgcacaacttgtttgagctatctcggccagttggacctggtttatcatagtgacgtgggtcgtgttcttttgcctagatgcatatgttctgctgtctgcctttactttcggtgtagttccttagcccaagaacaggttatatcactgtaacgcatcggatgtttacatctcgtctcactatgtttaatagatttatcatgtaccatgttcctcaagattttttgtgcgccagccatgcatgttgattcaggcnccagtgggtttatggaaggatttacagcc

SEQ ID NO: 25084 - DNA, 765 bp, Triticum aestivum
  Clone ID: PAT_TA_25084
ggtctctctcctcccaatcccaatctcgtcagccatggcatgaccatccccccgacgagcagctccttccatggtgctcgtgtggatcctacctctccacggctgtgacgctcatcaccttgtccgcctccgccggcagctggacacgcgccctctccatggccgtcgcaactagggtgcttcgatcgccatggccaagctgcacccggccccggcaacggcggcgagtttgtgctggaaccgaggggctttgctggaacagggtatttttttgctggatccaccatttttttttgctacaacccctttgctttttgctatcatccccttttgtttttatgaacatcttcgttttttgcgggaacgggtgctcttgtctgctgcaaccagctggtgtatgtgctacaaggttggtgcctcgccagggaagctacatccagcagcaaggagtgttgtatccaacgttgttcgaatgtcgggagctgcaatcgtgcacgccggagctccaaccggttactgggggagctgcaagagaggatggccattttttgttgatgcattttttgctgaaccaattttttgtttttgttggaaccggtgtatttttttgctggaaccaagataattttttgcttcatcggatgcagagctctcaaatgctcatgtcgtttttgttggcacctaagcttgtttttgctagaagcatttttttgattttgcttcaaccgaccaccggatttcgacccagggtgaagttttttgctg

SEQ ID NO: 25085 - DNA, 544 bp, Triticum aestivum
  unsure (1)..(544): unsure at all n locations
  Clone ID: PAT_TA_25085
cnatngagacacggagatgtacctttgntacctttgcaccgggcgcaacccgatgctgatcaggtactgccccatctactgggactggtgccacctcctgtgctacgaccccgacgtcgccgccgggcccgctgcgtccctgcggccggcggcaagcggcagccacggccccgcgcgagacgcacgcccagctggggtgctacgtcatgaagctctaccggaacggcacctacgccatcgtcagccgccacgactgctccaaaatggccagttgcccgcctctcctgcggcggcggcgacgtcgtagtcgccgacgggaaacccttgggcgcggcgccgctgccggttacagcgtcggcgccccagggaatgcagctgccgccgtcgtcgcacgtcgccgggttccagcggtgcggcgatcgggcaatggccctgcctctgcccgtcgccgccgggcccctcctggaggccccccgcgccccccggagcaggcgcgcgtgtccgcgcgcaaaccggcgggcccccttccgacccttttggggac

SEQ ID NO: 25086 - DNA, 764 bp, Triticum aestivum
  Clone ID: PAT_TA_25086
tattccggcccatgctgaggccaccagcttgctactcatggctgcttcatctcctgctccgagcaacagcaccgaccttgcgccgctgctggctttcaaatcccagctctccgacccttcggctaccattgccaataactggacaacttatgcgtccttctgcagctggaccggtgtgtcgtgcagccgccgtcaccaccagcgtgtcactgctttggagctgccggacattccgcttcatggagagctcagccctcacctcggtttgctgaaggaagaggacagggtgaagctccaggcaggtgtgaagagattggcacatgctgctgcggcgctgacggacagatccttccctcgagacaggctgctcttgagagacagagatggtttgcagattggctagatgcgatcagcgtctggcggcttctactctcgcttcccactggggtctgatgcccgctggtgatctgtattgcgactgtttcgcctagtcatcggagtctgatggttgttttggtactttgtatttctgagcaaatggctggtaagtgtcatcaggttttcgtcccatggctggtggtccgttccaggatcatcacgcggtgggtttcctggtgatgcgccaactcgctccccccttttcagtctcatttcacacaaaagtaggtttatatctgttttgagttcggcgatgaacttggataaagactgatgtttttccgttgattgcaaaattaatggaaaggggttgtgagtccggttgg

SEQ ID NO: 25087 - DNA, 1114 bp, Triticum aestivum
  Clone ID: PAT_TA_25087
actccgaaggagcgcagccgaggagaaatcatggccacggcgacgaccctctctttcagcggcggcggcggcggcactaccctgctccgcgggcacgtggccttgacgtcggggcggtgctgcacgttcccgagctcgcggtggaggccgccgcgcttgtcggcctcccgcgcggatgactcctcgccggctccgttcgagatgacggtggaggacgcgctgaagctgctcggcgtcgcagagggcgcgtcgttcgacgaaatcctgcgcgccaagaacgccgtcctcgcctcctgcaaggacgaccaggacgccgtcgcccaggtcgaagcagcctatgacatgttgcttatgcagagcttatcacagcggagggctggaaaggttgctaataaccgcatccgctttgctgatgttaaacctgtaaagagtgcaggagctgggacagtcccacagtggatgcaggcaaccatgaagaatgcacccattacatttgagactccatcttcgagcagcttgggcatccagtcatgtgtttatggtgcactaatggttttcacctatgctagtggaagctcgacatctttgccgtctgcgtacagtagccctgatgtgccaggttttatcctagcaacaggatttggtgcatcactgtattttctggcaaagaaaaatatgaacttaggtaaggcggcattggtcactgtcgggggacttgcagctggtgcgactgtcggatctgcactggagaatttcctgcaggttgatctcgtgccctttctaggcatccactcccctgccgtcgttgtcagcgaatttattctcttctcccaattgctggtatcactgtttgttaggtaggatctgaaaccaagctgtcatcctggcatgtaattaactgaaacggatcgtgttcgatcttcaaagggtcagggaaatgcttgttttccgcacaaggtggaagcagcagctgtgtatagcaaaacaatacgtgggcatctctgtcccttataaagaccacctgtatctagtctagttctctcaagctcaatctcaagtctttcagatagaagcttgtatggattgcagaatgtggaatgtaaattcttggatc

SEQ ID NO: 25088 - DNA, 707 bp, Triticum aestivum
  Clone ID: PAT_TA_25088
ctgcgcccttgtccttcttgtcaccgccgccgccgctgccgtccttcttgccgggcgccaccacttccacgtcccggctgagcttctccctgaggtacgccggcagagcggcgccgtccatggtgccggtcaccttcaccaggtccttggcggcgtcgaacgccacgtgggtcacgcctttgatcttggagatgcggcgcttgatgcgctcgatgcagccgtcacagtgcagccggatcttcagcgtcacagtctcctccttgggcttcttcttctcctccttgggcttgtcggcacccttctccttgtcggccttcttctcgccgccgcccttctccttgtcggccttcttctcgccgctgcctttttccttgtcggccttcttctctccgccggcgccgccgccgcccttctctttgtccgccttcttctcgccgccgtccgctttcttctccttctccttctccttatccttctccttcttgggtgggccggcgccggcggagacgatctgcacgggcttcttcgccctggcctcgatgcgctccttgagctccaccgcgtccgccggaccggtcacgaccaccttacccgccgccatgtccggcgtcaccgactccacacctggggcgtgcttgatggccttgcggaccttgttggcgcagccggcgcagtgcaagtcgaccttcagcacgatgggctgcggc

SEQ ID NO: 25089 - DNA, 707 bp, Triticum aestivum
  unsure (1)..(707): unsure at all n locations
  Clone ID: PAT_TA_25089
tggngtccctgggcgtgctgctgctgcaccccatgaacggctacctggagcaggagctggaccgcctcttccgcttctgggactcccctccagacgggggcgccgagttcctccgtgcggtcgtcggcaacgccggatacaaggccgacgccgcgctcatcgatgcgctgctgtccctcgagaacgttgcgtcctccgtggggatcgaccgcggcgacctcaccaagtgccgcgagcgcgggatccatgctcaccgacgtgctcaccgatgccgtcggcctcgtcatctccgcggtaaggaagatcacgcatggtgaccgctatgtgcgcgccagcttgtggaaggccaagggggactacacgtggcggagcttggaagaaaacattgggcgggccagactaaagaagagcacttttttttttttgaagttctgaatcattagcatgagtgtatgatccaaggttatatgatggagcgaggagatatatatacatatatcccaaaatatagttcaaccatgaggtacatgaagcactatcaagttacctgatacaaaagtgaggcgttagacatcgacttactcacatgctacaaatcaactctccgatacttgcttctaaaatccgcgatgacattttcatgtgctctagttctctagaattccaatttaagcaagggcaatacatgatgttcctcaacttcagtt

SEQ ID NO: 25090 - DNA, 2444 bp, Triticum aestivum
  Clone ID: PAT_TA_25090
gcacacggccggccggggagcgagagagccacagcaaaagcctcagagacagcgcgagattgaggactacgcagcgcggggggtcgaggcagagctgtcaacgcggcggcgggaggtaatcgggggccgtcgtaggcagctcagaagggcgccggagaccgggagcgcgcgtatgccgcggctttgagacgggcccacccggcggctgcctgcgcttggatgcctgcgtcgccggagatgctgcggaggcgttggtgggcggcggtggcggtcttgtcggtggtgctggccgtgagccgggtcgccgctaacacagagggtgatgctctgtacagtctgcgtcaaagccttaaagatgctaacaatgtgctgcagagttgggatcccactctggttaatccatgcacatggttccatgttacttgtaacactgacaacagtgtaatcagagttgatcttggaaacgcacaactgtcaggtgcattggtgtcccaacttggacagttgaaaaatctacaatatttggagctgtacagcaacaatataagtgggacaatacctttggaactcgggaacttgacaaacctggtcagtttggatctgtacctgaacaaattcactggcggtattccacacacattggggcaactcttaaagttgcgattcctccgtcgtaacaacaacagtctttctggtcaaattccacaatccttgaccaatattagcaccctccaagttctggatctatcaaacaacaatctttccggagcggttccatcaactggctcgttttcactctttacccctataaggtgcgctttctccttgtctttcggggccgggctgctccttccgagcctggggacccctttccccttgtccccggtctgcctctaatccacctcggtgtggcccggcctctacccggccatgccctggggccccccctgctgctccgcctcccccattcaatcctccaacaccacccgcggcacaaggtgaccctacgtccggggcaattgctggaggtgttgctgcgggtgctgcattgatatttgctgttcctgcaattggatttgcactgtggcggcgacgtaaacctgaagagcatttctttgatgtccctgctgaggaggatccagaagtgcaccttggccagctgaagaggttctcactaagggagcttcaagttgctagcgataacttcagcaataagaacattctaggaagaggtggctttggaaaggtgtacaaggggagactgacagatggtacattggtagcagttaaaagattaaaagaagaacgtactcctggtggcgaactccaattccaaacagaagttgaaatgattagtatggcagtgcataggaacctgcttcgtctccgtggattctgcatgacacctacagaacggctactagtctatccatacatggctaatggtagcgttgcatcacgtttgcgagagcgagggccaaatgagccggctcttgaatgggaaaagagaactcggattgcactgggatctgccagaggactgtcttacttgcatgatcactgcgaccccaagatcattcatcgtgatgtcaaagccgcaaacattctcttggatgaagactttgaggcggttgtgggtgactttggactggccaagcttatggactacaaggacactcatgtaaccacagctgtccgtggaacgatcgggcatattgctcccgagtacctatccaccggaaagtcctctgagaagacggatgttttcggttatgggatcatgcttctggagcttatcactggacagagggcattcgacctcgcgcgtcttgcaaacgacgacgatgtcatgctgcttgactgggtgaaagggctgctgaaagagaagaaggtggagatgctggtggacccggacctgcagagcgtgtacgtggagcacgaggtggaggcgctgatccaggtggcgctgctgtgcacgcaggggtcgccgatggaccggcccaagatgtcggaggtggtgaggatgctggagggcgacgggctggcggagcgctgggaggagtggcagaaggtggaggtggtccggcaggaggcggagctggccccgcgaaacaacgactggatcgtcgactccacctacaacctccgggcagtggagctgtccggcccgaggtaacaggaaaaaaaaaaaaaaaaaaatcgtctactcatcgacgagctccggctagtggcgcctcgtttcagaatttttagctctcttttgtacatgatgaccgacagatagctggtccctttaattagtgtcaaatttggaaggggaaatgtcagcagcagttcgcagttgtaggctgctcttgactgcaactcattgttgtggtggctaatgctactcctgctgtattgtacttgtacgtgcactacaaaaaaaaaaaaaaaaaaaaaaa

SEQ ID NO: 25091 - DNA, 579 bp, Triticum aestivum
  unsure (1)..(579): unsure at all n locations
  Clone ID: PAT_TA_25091
cacactcttcctcatcgcctgctcagatctaacctgcggcagcaccgacgccaagctcaacatggaagccacgaaggctgctgccgattgactcttccacacgatccacgatttctctgccgacctgaccagcgccccttctcccaccggtcagcatcgtctctctcggcagggcccacccctgctcgccgtgcctgtctcctctttcgtgcctcctcgcccctagcttggagcaacgctggccttcccccgcgcggctactcgtgcgcgccctattccagggcacgccctctaggggggtcacgcttacgcttttccagttccagctcatgctcggggggtctcctctcgttccttccctgctccttgctcttccagctgcttcgagctacaagtgactcncgattccctcgcctgctggaaccatccatttcttgcgtgccctccaacgggcctggcttccaaaaacgctgcctcttgtgtcacgcctaggggcctctggctcctgcagtacgtgccgcttgggggccggcccctaattatcgattgacctgaatttccctgaggcttcaaaagtgn

SEQ ID NO: 25092 - DNA, 508 bp, Triticum aestivum
  Clone ID: PAT_TA_25092
gcgttcggacaattgttcagagtctgcgcgaatccggtgtcttcacttccgccattacagctggccaacctgctgtgaatgccaaactctcacccaaggaaaccaatgcgcagagccaaaatgttaccgcacctgggaacatgacaagagtggtcagatctactgattcaaaggcatctggcagaaagatactgcaagccgttgatcttgccttcagcgatactaatgtaactgctgttccaccgttgtcgccgcccagtttggacgaacacaggcatcatagtgaataataatgtcatacgtatcatatatatattttttgctcggcgtataagttcctaagaaaaggaggaaaagaaagttactgacatcttcgttaagagaagtgctaacatcagcttggatggtcaatttttatgcaatcgagctttatttgtttcattttttaaactaaaattaattaatatctcgaacgaattttgaagaaacatttggattgtggtatatt

SEQ ID NO: 25093 - DNA, 1019 bp, Triticum aestivum
  Clone ID: PAT_TA_25093
gtcgacccacgcgtccgacgggctcaacgtgctctggatcgaccccgccaccggggtcggcactgggttcctcgacgccgtcgccgccctctctgacagccccgaggttgttttgttgctccttaccctcatctttgctttagtccatagtggcatggcaagcttacgtgaaactggtgagaaaataataggcgagcgagcttaccgcgtgctgtttgctggaatatcactacctctggcacttagcactattgtctacttcataaatcatcgttacggtggtgttcagctgtgggatgttaaaggcgtctcaggcgtccatgagcttgtttggctgtcgaattttgtctcattcttgtttctgtatccatctactttcaatcttttagaagtggcagctgtggacaagccaaaattacacatgtgggaaactggaataatgcgcatcacgagacatccacagtttgttgggcaggtaatctggtgcctagctcacacgctatggatcggcaactctgttgccgtcgcggcctccgtcggattgatcggtcaccatgcatttggcgtttggaacggcgacaggaggcttgcgtcacgctacggcgaagcctttgatgtcctgaagaagaggaccagcgtcgtgccgttcgctgcgatcattgatggacggcagaaattgcctgatgattattacaaggagttcatccggttaccgtacatcacgatcgtggctctgaccctgggcgcgtactttgcgcatccgttgatgcaggcggccagctaccggcttccctggtaactaatggtgaatggcaggttgatgatgtatgtatgtcattttgtagtgttacggaaacatgccagccagccaacacaaacaaaagaaatagtggtgcatttgtagtgtgtgtatggtgccccatgagcaaatggatcagctcgccgcacttaggattgtaatacaactactggcctgtttgttcaggcattcatttgtaagtaaaagaggactacgcacc

SEQ ID NO: 25094 - DNA, 2641 bp, Triticum aestivum
  Clone ID: PAT_TA_25094
gtcgtgccggaggcggcaagagcaagttagcaagtagccaagctaccaccaccgagcctaccaaggaacattccgccatggcccggctatctctcgcggcgtgcgccgtcgtcttccacctctgcctcctcgtctccccctccgcccccctccgctggccctcggccaaactcggcggcggcgctcaccgggcggcggtgtcaggacccggcgccgcctaccactgccacgcccgccaaaggaccaggacgaccgatccctacccacccaccgcaacgtgcccgaccgctaccactactcctaccacctacaaccccggccaccgcgacgttgaaccgcctccaccccggccgcggtgccgcgcgcccgtgggcaaccggccctcggggaacgggagccggcagtgggcctggctctacgtcgatcgacgcccgctgggcgagctccggccaagtgctatctgcctcgagcgcttgaggcggctgatcgggcttccacgagtccaagtaagcggcccgtccctcctgtgccgggcacagcacggaacgaaaggattgtcaagatgctcccgaaggcggaagattctggcaagatttgtgtcccgggtgttaaggactctgatagtgttaataccaatgggttgttagtagcacccaggccgtacatcgtgagggtctttggcgtcccagttaacggcgtgtgtttcgaaggtcgtcatcgcctccggcgtcttgcaggtgcacaccgccgtcttcttcagggtgttcaggcagaacgacaagtacaaggtgctcatgtgcaccgacctgtcaaggtcgagcaccagggacggcgtgtacaagccgccgtacggggccttcgtggacatggacatcgaggcgcacggcgggatcatctccctcagaacgctggttgaccactcggtggtggagagcttcggcggcggcggcagggcgtgcatcacggcgagggtgtacccggaccacgtcgtgaacggcaacagccacctgtacgtgttcaacaacggcaccggcgccgtcaaggtgtccagcctcgacgcgtgggagatggccacggcgaccgtgaacgtgctccccgacggcctgatcgcggcgagctcggtgagcaggagctcaggcctattaggatccgggacctgggttttcgctcggtggacggacggatggatggatggccattgtgaatttctacggccgattggatttgcctgcccgattgtggctcaggtgtacaaatggaggctccctcattgtttcccggaacagcacggaagaaggattctaggatgctgcaaaggaaaaagattctaggaagatttgtgtctaggtgttgaagtttttgatagtgttaataatagtagtagtaagtagcacgcatgccctgcatgttgggtatttggcatcaaattaagagtgtatttccaaggtgaaaacgggtgtcatgtaaatgtatgatatccgttgagttgtaaaaaataatattcaaatatacaaggtttattattatgaaaaaaaaaaaagtggggccactccgtgtccgtggacctggtgaactggttcgcgctcgacgccgcgctccagcccagccgctccttcgacgccaacgtccggctggtcgggctccgccaccatcctcccggacggcagccccgtcatgctctacaccggcatcgacgcccgcggcgaccaggtccagaacgtcgccttccccaagaacgcctccgacccgctcctcgtcgagtgggtgaagcccgagtacaaccccgtcatccccgtccccgcggacatcaagcgcgacgacttccgtgacccctccacggcgtggctcggcgccgacggcctgtggcgcatcgccgtcgcggcccgcgtccatgatgttgggggcgccacgctcatctaccggagcaaggacttcctgcgctgggagcgcaacgctgacccgctttatttggcccacgccgccggcatggtggagtgcccggacctgttcccggtgtctgagcccggagtggaggttgggctcccggcgagcggcgccggggcgaggcacgtgctcaagatgagcgtcatggacacggtccaggactactacgtggtcgggagctacgacgacacggcggacaccttcgtgccggaggacgacgacgactgccggagctggcgccgcctggactacggccacgtgtacgcgtccaagtccttcttcgacccgagcaagaaccggcgcgtgctctggggctgggccaacgagtccgacagcgtgtccgacgatctcgtcaggggatggtccggtgttcagactgttccgaggaagatatggctggacgaggacggcaagcagctgcggcagtggccggtggaggagatcgagacgctgaggagcaagcgggtgaacctgctgataccggaggtgaacgccggcggcgtgaacgagatcatcggcgtgatgggcgcgcaggcggacgtggaggtcgtgttcgaggtcccggccctggagcacgccgacgtcctggagcccaactggctgctggaccgcagagcctgtgcggcgaaaaagggcgcgtcggtgccgggcagcgtcggcccgttcgggctgctcgtcatggccttccgcgacatgc

SEQ ID NO: 25095 - DNA, 457 bp, Triticum aestivum
  Clone ID: PAT_TA_25095
gaccctaaaaagaaatcctctttcccattcacgctttcacactcactcatcttgctcttgctcttccccttgccttatcccctttcccactccaaaattgctgccgccggtagctcccatcagcttgattccctgattcagtgccttgagcttgctcgtcctcacctacagccagccccgcagcttgattcatttgtgcggccatagcgtgaccttcgacggcggctggtttgtctcttgatctcctcgtacgcctcctcggtctcctcctaggctggtaaacgtcgatggagtggtaggagggcccaaggtgcagctgctcaagggaggaggcgagatcatcaatctgcacgatgttgttgctgtcaatgtccgtgcaggtgatgttggcgtggatttcgtctcccacagctgctttgatccatctttagtatgaggatggtggagatgttttctg

SEQ ID NO: 25096 - DNA, 1034 bp, Triticum aestivum
  Clone ID: PAT_TA_25096
cgctcttccgcttacccccgcccgaccccctttctcgctcgaaacttgctccccaccggatcccccggcagcttgattccctggttcggccccatggtgatcttcgaccccggctggtttgtctcctcgtacttctcttcggtctcctcccaagctggtaacctccgatggggggttggctggggccagagtgtagcttcgcaatcgtcgagccgagctcatcaatctgcacggggttggttgctgtcaatatccgtgcaggtgatgttcgcagtggggttggtagtccgcagctgctttgattcattttagtatgaggatggtgtagacttattctgcccctggtgcgccggccagacgcatcctccacatccggcaacattgttcgaagtttgaagtgtgttgccctacagcaagaaataaggagaagacacatgaactgggaatgattggacgcggggaaagaaaaaggaaatgttacctacggaaagagaaataaagctcaagcctctagggtaatattggcctgtgtattgtgtgtatctcaagtctaaactctcacctggttggtcttgtaatccccctctagctggctgacagtgggcatgcaacaactctattcacctgaaattgctggcatgcatgaaggataggctttgagaccttcaatcgtatgtatcctgctgatctgctgagttgtggtgcataccatcaatcgtatgaatcctgctgatgtgctccatccaggtgcatgatgtatgataacatgccagctgtctgcaaatacggaaggaaaaataccttataacagctagctgtggggtgaaagcagatgtggttttggagatcagcagtttgcaaatatggaagggaaaataccttatagcagctagcggtggggtgaaagtagattgcaatttgattgcaatattttttattcagttatgtttgcacgtggctgtaccacatcaaaactgattgaaccttcctaatctcgtcgcaattcttttgccctatttgccaaaaaaaaaaaa

SEQ ID NO: 25097 - DNA, 769 bp, Triticum aestivum
  Clone ID: PAT_TA_25097
ggtctcggccccggccgacagttgctgcgtctcttccagcaccttcggttcaccggtgtcctggtggctacgcctcctgcaacacggagctgcgctcccttccggctctgaattgccggcggcgtcggccgccaccctaccacccgtgtccgctctctgccacgcagcctctccaaccccgtccaccatgccagcggttgcaaagcttgtgtttttgtcggcggcaggtgcagccccaccctctgtctgaggtagcgattgacaggcatgttgactccggcatcttcggatcctgatctggtggatatgggattgctcagactcaggccaggcgaaagccctgctcggcttgccgatgctggcagcggcgacactcgcggatgtcgttttgcttcttgaaggcgctgccatggcctttttctgagcccctcttcgagcatcaggggaaaccatagatccggcttgtcggatcggatggcgatggcgtcgcgacgtcgttccccttcttgaaggcgctatcttgctcgctcgcggagtcccggtgttagaattggagatgtttgacatcgtgctcatttggtctgctactttagttttaggcttggtgggtttagctgtgtgtttcttcctgtttgggctgagcaccccttctctctgctccgggtaccatgcgcatgcctccttgtttatgtcatgtgttgtatcttcggttgtactcattctccttctatctatcaatgaaaagatacgcaaactttgcgtattcacg

SEQ ID NO: 25098 - DNA, 1143 bp, Triticum aestivum
  Clone ID: PAT_TA_25098
gttccccaccttggtcctctctctctctctctctctctctctctctcaaccgctgccgcgagcccgtgtgagagagatggggagacgccgagccggcggcggggggcgcggaggaggcagagatcgaggccgaggaggagaaggacggggtggaggagaggaggaggatctgcagctgcacaaggccgcgaggtcgggtgatgcggcggcggcggaatcccctttgcgagtccaaccctctcgccctcaactccagagaccgcctctcccgcaccccactccatctggcggcatgggctgggcatgttgatgttgtgaaatgcctttgcaagcacaaagctgatgtcggggctgcagcaatggatgacaccgccgcaatccattttgcttcccagaaaggtcatttggaagtggtgcgtgagctgctggcgtcgggggcctctgtgaaagcaaagaacaggaaaggcttcacggcgttgcactttgctgctcagaactcccacctggatcttgtgaagtatttagtgaggaggggcgtggacatcacaacaaagacaaatgcagggcaaacggctctacatgttgccgagaatgatgatgtgcgtgctttcctgaaagagtgtgagcagtcactgaagaagggagtggagctaccatccgagaagaaggatgattctgtagctgagaaggctgatgacggcaaggtctcaggtgaagatagaaaagatggtgttgatgcaggacagggcgagaagaggaagagtgaggagattggtgctgggacgaggccgccggaggtgaagaaggccaaagtttcactttcgcatcttgagaacgacatggaagaagaggatgaagcagacgaatagaatcgaatagcctccagaatgccctttgatggtgccaacctgtttgctgtgttatccattgttcttttggcaattttggaatgttggcaagcaagtgtaagagttttagctgtccatgggcatgttatccgtatcatagttgttgaccagcagtactatgttttgatcaagtagcttatgatgatgatttactactgattcccttaaaccaagatgattttactactgtgagtaagcttattaagtgctgtggtttttaattttgatggaatat

SEQ ID NO: 25099 - DNA, 504 bp, Triticum aestivum
  Clone ID: PAT_TA_25099
ccacttcttcctccctcgcgccgttgctcgctcccccgcacacacccgaagctatcgtcgccgcgccatcgtcaccgtcgcggccactgtcgtcgccttcgcgtggtaggacatccaggagatccgcggaggccggcttcgtccgtcccgggcatcagctcaagccggcgcggctcgtacgctcggcatcgccgtcttcttcatcacgtacattgccggcggccatcgtcgattcccaccgttccggtccacatccggcctccccgacgctcgtcatccgcaccacgacctcgtgacgatgccgatgaccctgtgatcgactacgtcaaccgacgacacttcttccttttcaggcaagacgcttcccggggggccgcccccgcctccgagcagccccgccgcccccctctactccccccctcgctgccttcgccttcgtggtgtccgtcggcgaacaagagtaagtaggagggctcccaaggcaagagggcttggcttttcgat

SEQ ID NO: 25100 - DNA, 868 bp, Triticum aestivum
  Clone ID: PAT_TA_25100
gccggccgcgccgggacttgatgggactcgaggtcctaagatctcggatttcgggctcgccaaactttatgatgggtggcagacacacgtcagcaccaaagttgctggtacatttggttatctcgcacctgagtatgccatgagaggccatatgacagagagcccgaacgtgtttgcattcggcgtcgtggtattggagactttagctgggagaccaaactacagcacggaggatgagaacaaggtctatatttccggatcggtgtcggggctgtacgagaacaaccacccgttggatatggtggaccagaggctggaagagttcgacagcgaagaggcgctccgggccatcaaggtggcgctgctctgcacccagggctcgccccaccagcgtccctccatgtcgagggtggtggcgatgctgacgggcgacgtcgaggcgcccgacgtggtgaccaagccgagctacatcaccgagtggcagatcacggggggcaacaccacctacatgagcaccgacgtcagcgggcagccgagctcagcgccgagggccaactcgccgtcgtcccgcacctcgtcgccgttcctgagctccgtcatcgacgaaggccgttgatacaattcggttcgacttcttgtggcacagatttgctgagaatgcatgcatcttatcggatggtgtcgatacaggcagtttttttgcactggtattgatctgtacagtggtagtatatgtaggatgagtagcaggtaaagttgtatgtgtagtagtacgtgtgtaggcgaagctctgaattctttggtctccttgacgcgcgtcaaggctagttctagatcgccttggaccttgacgcgcaaaaaaaaaaaa

SEQ ID NO: 25101 - DNA, 862 bp, Triticum aestivum
  unsure (1)..(862): unsure at all n locations
  Clone ID: PAT_TA_25101
cggtccggaatcccggtcgccccgcgtccgcagatgccgcccccggcccccgcgcccccctcctcgcccccttgctcccccggtcccctcccccgccggtccgctgcgcctcatcggccatggcgaacccgtccaactcgccccggcacggcggctccgggacgcaccacggccgccacaagacagccaggccgggggcgccgggggcagcggcggcggtggagaccactccccgcgggatcaccaggagaggggcgccggcggctgggaccatggcggcggcggaggcgggaggggtggccagagaagccaccacaacaacggcggcaggaggggcggtggcaacggtggcccgggcggcccaggaggtggtggagttcctcaccacggcgggtttggcggacgccggagaggcgggtttgatggtggcttcttccgtggccccgggatgggcatcgggccgtacatgcggggggcgccgccgccgcccccgccgctggccgtcgctcctcccttcatgggccaccctccgcctcccggctcgcatatgcgagcctttgctggaccgatgatggcgtttcatgatatgccatcaccagtgtctcctgtttccccaatgtactatgttgggcctccgccgcttccagaggctcttaggggaatggcattcgcacctcatatggtcggaccacctgcttatccctactttcaacccccggctgaagcctgaagcctgagcctgagcctgagctttgagcctgaaccccgtgggctgagccacattccgcggaggctccagaaggctgcaaaaaccaagttttgagtttctaacttcancaanggacaacttatgttggagatt

SEQ ID NO: 25102 - DNA, 1007 bp, Triticum aestivum
  Clone ID: PAT_TA_25102
ggttagacaaacccaggatcggtcgttgtgcctgtactgtttataatacaacagttggagcagatatatccaacccagcttgggttctggttgcatactgcaaggagactttaacatatggttagcatatttaacatgatgaaggtttcacgcacagcgttcaggtgatcagggttaaatggtcactgcatgcaagggaagagatcttacttgagctgctccggcatttgaggggaagtgccacaatattcattttagagagagagtggcagtccgcaaggtagatgttggaggagcaggaagctgtccgtggccgcttgttcaccatccaggaggttatgcagagcactgttcgtgcatggttacaggacagaagccttcgtatcacccacaacctggctattttcggcggtggcggcatagttctatccataatcactggcctctttggaatcaacgtggatggcataccgggagctcagaatactccgtatgcttttgggctgtttgcggggcttctcttcttcctggggataatccttgttggcgttgggttgatgtatcttgggctgacaaatccagtaaccagtgagaaggtgaaggtgaggaagctggagctccagcagcttgtttcgatgttccagcatgaggcggagcagcatgggaaggtgagggaaggcctgagccggcacggcttgtcgccgagttcagctgcggcttcgggcgatgaaggctacatcctgatttcctgatcctgctaatgcctcaaaactctgaaatagtgtaagcttaggccacgctggggaacctggtgttttgtctttgagtaaaatcccggctatccccatccccatgggaagtaaactgattcctgtccgactggttcatgtgtcctcaacaggcgtatagaaaatgatacacctaacagagtatcttgtgtgatgattgtcactgaggagttggtatagaaatatatagagagatgatcaatgcgatctgagtaacaa

SEQ ID NO: 25103 - DNA, 691 bp, Triticum aestivum
  unsure (1)..(691): unsure at all n locations
  Clone ID: PAT_TA_25103
tacctccgcgcgcgcgtggcggccgtgtcggagctgcgcgggaaggacgccaaccctctgaacgggctggagcggcgggtgcggtacctgctggagtcggacggggagctcctgctggtgaagaagctgtacagcgtggtgcgggactcggcggacgtggaggtggaggtgagccggttccggccggaggggtgcaagtgggagtcggtgacggagctccccgggagggcggtgttcctggggtcggtggcgtcggcggcggcgccggcgacggcgggggtccgggagaactgcgtctacttcgcgcggcgggacgtggagctgatggtgccgcacgccatcggcgtgtactcgctgggggaccgggagacggcggtggtggccatcgcgggcgggcactccgtggaggtggagcccgtgtggatcctcccctcggtcgcctgatctgaccgactccacgcacccaccggcgttcaagaacaaataaaccgagcccatgagttttagaacgctttattcggatgttttggaactgtggattgctgtgcgtgttgttttctctgctttgttcatggggttaattggcgatttgggtttctactagagaggcaaagaccgatctgtctgaattgctgtgcatgttcttctnctttgnccttgttcagttcatcagaagttcagaaaaaaaaaa

SEQ ID NO: 25104 - DNA, 466 bp, Triticum aestivum
  unsure (1)..(466): unsure at all n locations
  Clone ID: PAT_TA_25104
ttcatcctattagctttcgccaccgtcacgccggtccaggccctgcctctgcctgaggccacgctagggcgccgccacccacctcaccccctttgcacacccaatctctctttcagatccagacccaggctgctcatcggtgtcgatccccagccgaagcatgaacatcgatccaggcaggcctcctctccgaattcagccactggggcatggctcccctgcggtttgaatctgggcgctcgtcaacagagcagccagagaggtgagctctggctttggatgcgtggagggtaggggccagagccaccacggcagccacgagagcgacatgggcctgccatgctcgtcaacgacttcctcgagagcggcgatggaggtggagactcgcgcagcagcagcgacggcgagcccgacggtcccgacctcaccacgcattgctgttcacaacatggcttancccccacaa

SEQ ID NO: 25105 - DNA, 573 bp, Triticum aestivum
  unsure (1)..(573): unsure at all n locations
  Clone ID: PAT_TA_25105
caaccacccccccagtcccaacaaccattctcccagcaaccacaacaaatatttccccaaccccaacaatcattcccccaacaacaacaatggatgattcagtcatttctacaacaacagatgaacccctgcaagaatttcctcttgcagcaatgcaaccctgtgtcattggtgtcatctctcgtgtcaataatcttgccacgaagtgattgccagctgatgcagcaacaatgttgccaacgactagcacaaattcctcaacaagctccagtgcgcagccatccacaacgtcgcgcattccatcatcatgcagcaagaacaacaacgaggcgtgcagatcctgcggccactatttcaagctcgcccagggtctggggtatcatccaacctcaacaaaccaactcaattggaggggatcagggtcattgggtattgaaaactccttccaaccatgtgcaacgtggtttgttccacctggactggctccaacatccacacgccaatatgccaacaataanacgnctggtcattgggtgggccaaatgaaaaaaattcaangaagtttatggctaa

SEQ ID NO: 25106 - DNA, 536 bp, Triticum aestivum
  unsure (1)..(536): unsure at all n locations
  Clone ID: PAT_TA_25106
cactgtcctccgcagacncatcccgattttaacctcctcccctcgcactgaccaaaaccatgatttgcctcagagccatcccctcccctcgactcctccacctacccctcccccgcctcgcctcctccccgctccgccgcctcaggccctccgccgtcctctgcgccgccgccgccatgtcctcctccccctccgtcgccgcgcccaccgtagcggcaccggtcgagcacatcgtgctcatcaaggtccgcccggaggccgtggcctcgggggccgccgccgcgatggtctccgcgctgcaggcgctctccacgctcgtcccgggggtctcctacatccacgcgggccccggtgctccgcctccgctcccccggccgccgaggcgctcggccccacccatctcctccactcccgctaagccaccaagggccgactcgccgcctaangccccgcaacccgggccaaagtgggcgccgttgcaagggggcaacgttcgccccaaacgcggctcgaangccaacggccggttggnatgg

SEQ ID NO: 25107 - DNA, 1399 bp, Triticum aestivum
  Clone ID: PAT_TA_25107
ctcctttcacacagatccgcaggccgcttttctcctccggtggccgcccggcgaggatgcaagccaccacggcggcggcggcggcggcgcagctgctaacagatacgaggagagggcccagatgtagtagggctcggccgggagcgacgacgaaattatcctggccaggtcgatttgcagtggaagcttttgcaggccggtgccaaagcagtgctgctactgtcacgcatagattcagtgccatttctcaagctactagcccttgaagaaacgcaaggaggcagtgcagcgatgatcagtcagccctccaagctggatgcagcgaggttaatcgcgatcaacatggttacgacgtgaaccggtttgaggaaatcagccaagaagtttcgaagaaattgcgcgctttctaccagttctgcagaccacacacaatctttggcactatcataggcataacttcagtgtctctcctgccaatgaagagcctagatgattttactgcaacggtactaaaagggtatctcgaggctttggctgctgctttatgtatgaacatttatgtggtagggctgaatcagctatatgacattcagattgacaagatcaacaagccaggtcttccattggcagctggggaattttcagtagcaactggggtatttttagtagtcacattcctgatcatgagctttagcatcggaatacattccggatcggtgccactgatgtatgctttagttgtcagcttccttcttggaagtgcatactccattgaggctccgttgctccggtggaaacggcacgcgctcctcgctgcatcctgtatcctatttgtgagggctatcttggtccagttggctttctttgcacatatgcagcaacatgttctgaaaaggcccttggcagcaacaaaatcactggtgtttgcaacattgttcatgtgttgcttctctgccgtcatagctctattcaaggatattcctgatgttgatggagaccgagattttggcatccaatccttgagtgtgagattggggccacaaagagtgtatcagctctgcataagcatactgttaacagcctatggggctgccactgtagtaggagcttcatccacacacctacttcaaaagatcatcactgtgtctggccatggcctgcttgctgtgacactttggcagagagcgcggcaccttgaggttgaaaaccaagcgcgtgtcacatcattttacatgttcatttggaagctattctatgcagagtatttccttataccgtttgtgcagtaaaatttgtacaagggccagcagatgtgaactatatatacatgtaaaacaaattatattactgatgataccctatccaatgcttggaatataccgtttgtgcaataaaattt

SEQ ID NO: 25108 - DNA, 434 bp, Triticum aestivum
  Clone ID: PAT_TA_25108
gcacggcgccgggcactctccccctgtgtttcgtgggtggcatcgatcgagggagagagagacaccatgagctacccgccgccgggcaccgcgtaccctccgccgggccaagcagcaggcgtacccgccgccgggcaacggttacggctaccctccgccgggccaggagcagccgcagcagcagcagcaggcatacccgccgccggcgtacggcgcgccgccgcccgtcgccgccgactactaccagcccaaggacggcgggcgcgtacccgccgcagcagcagcaggcgtacggcgcgccgccgcccgtcgccgccaactactacccgccgccgcagcagcagcagcaggcccagccgccgccggaggcgcagagccgcggcagcgacggcttctggaaaggatgctgtgccgcaatctgctgctgctgcctg

SEQ ID NO: 25109 - DNA, 1311 bp, Triticum aestivum
  unsure (1)..(1311): unsure at all n locations
  Clone ID: PAT_TA_25109
cgtccgcccacgcgttcgcggacgcgtgggcaaacccttccaacgagccccccaaccccaagcagccgctgccgcgccgcaatcgtccatggcggctcagccgccgtcttccggctgcccggcggcagccggaaacaccaagcgcacctcagcgggcgtcttcaagacaaaaccagccgccccctccgccctaaaccctaactgggcccagctccagtccaagctccccgcgtccacgttcctcggcaagcgcaagcgccccgccccttttccgccccctgggccgtctcctaccccggaagcggcggaactgagtttcaagcttgagccgacctctgacgacaccagcttgacgaaggcgttggcgctggattgcgagatggtcggggttggggccggtggcagcaagagcgccctcgccagggccaccttggttaattcctttggcaacgtagtatatgatgaatatgtgcgaccaatggagcgaattgtggactaccgtacccatattagtgggattagacctaagcacatgaataaagcctaagatttctcgatcgttcagaaggatatagctgagcttatcacaggaagggttcttgttggacatgccttacaccatgatcttaaggtcctgctactaggccacccaaaaatggacataagagacacctcagaatatgaggttttccgacgggagggcaagcggagatcgttgaaagatcttgctgctcaagaactttctgttaagatacaacagcaagagcactgcccgattgaggatgctcgcgcagcaatgttcatttacaagaagcacaagaaaagttgggagaagaacaagaaagagcaattcaggttcaagaacaagcagaagaagcgaggcaataagaaatctgctgaagccaatgagaaggaccccaatgtcccaatagttctactgtaggaaacatagatgtaaggggggccagggccaagcagtgtcgtgcttaacatggatttcacgacgccaaagggtatgccgtgtgggaatttcagatggaacctgtcaagaactcaagatcagcacgccaacctgggaatttctccagatgaaccatgaacttcggtaccatgctggacgggtagatggcgatgccgtgattatatctgttgattctgatttttctaggccgcatatgtttcagggattgattgcaaattgtgtggctgattattcctcacatcacatgtgacgaaacttcacacatgcgtgcaggttctgtaacaagatatttacatgaccagctaaaaaatggcgcagccgnataatat

SEQ ID NO: 25110 - DNA, 575 bp, Triticum aestivum
  unsure (1)..(575): unsure at all n locations
  Clone ID: PAT_TA_25110
ggcaccttttgttctcagacctctgccctcctctcccacctcctggaaaaagtttggcctgagacatagacagcggttttctttccccaaaggccangccaggatgcaaggcgccgccgtcgatgggaggagcagggctttgccggacaaggccgacacgagctccaagaaggcgcggcaggacctgcccgacggccacatgaagcaagaggcggccggtggaggagacggaggcgccatcgtcacggcggcgtacaacccgcgagtggaactcgccgtgaggatcgacaagcaagtgctccactgccccctctgcaccctccccttcaagccccccgtcttccaggtccaacccggggccccccgcctcctgcggcggcggtggcccggcccacctccgcccttccggcctgggcgtcgccccggccccgtggtgcctgcctccctccggtgcaaagcggggcacccggcctgcagcggctgtgtggccctgctgcccttcaggcagtgcaaggcatgtgtggacggcggtggcttcttcgccccctgccctacactggacaccttggtgtcct

SEQ ID NO: 25111 - DNA, 530 bp, Triticum aestivum
  unsure (1)..(530): unsure at all n locations
  Clone ID: PAT_TA_25111
ccaaaaatcttaatcaattttatgggtgttccaagtgatcatgctaatgcgccagtggatgggcaattttgaaataaaaaaaacgccattgtagctacttcaatcctagcattaattaagtttgtaagaagaaatgaggagcacacaaatcctattcctggcatttgccttcttgatactatcgtcagctatggcaacttctaagccagtatgcaaccatatcctcaaaaagggacattgtaacaacaatgattgccgagcgtactgcaaaaagttcatccccccacccggtggcccatctcccaagtgcatacccgagggatgccagtgttatgtatgtggatgactaccaccaaacctggaatctatctagataaaaaattcatatacatggatgtatcacagttgcttgagtaatgaataatgatttgagtaatatagcatagtatgaagttcaatagtgtgataacaatgaaaatttgtnctatgttgcaagacaattattgggtttcaaaangatataatttcag

SEQ ID NO: 25112 - DNA, 568 bp, Triticum aestivum
  unsure (1)..(568): unsure at all n locations
  Clone ID: PAT_TA_25112
aggcctcctgcgcctccacttccatcgcctccccaagatcgcagatccgctccggtgagaatccgtcgccatgtcttccaagcgaggtcgcctgcacccttgccgccctcatcctccacgatgacgggatccccatcacttccgagaagatcgcgacggtggtgaaggctgccggaatcaaggttgaggcctactggcccgcgctcttcgccaagctcctgggagaagaggagcgtcgatgacctcatcctttccgtcggatctggtggaggtggtgctccagctgctgctgctgctgccccggctgctggtggtgctgctgccgctgaaagagaaagaagggagagaaagaaggaagaaggcaaanggaagaagaccgatgaataacatggggcttcaacttggtccggcctacagctgttcttcttgcccnctgctccctccgggggtgcntccaatgacgaacctaagtggcctttaggtgtgatttgcgnnttggaaaggaatccggtgnaancaatanccgngaatgggtnatggnaacaacctgganngccttnaaaaaaaa

SEQ ID NO: 25113 - DNA, 813 bp, Triticum aestivum
  unsure (1)..(813): unsure at all n locations
  Clone ID: PAT_TA_25113
acaaccccttctcccccagcaggaaagagatagctactactcaaaaaaaaaaaaaaaggaaagagtagctcgaccgagcaacccaatccatggcgacggcggcgtgttctctccctcaccggtgtcggctcccgctccacctggccggcctcgctttctccccctccgcggcctccgcgctcgcctgctggcggcggccccggcggcccaggcgtggacgggggagatccgcggccgcgtcgtctgcgacgtctgcgccgactctgccatcgggcccgaggaccacgtcctcgaaggcgctgaggttgctgttctgtgcatcacgaaatctggtgaggtcatcaactaccaggcgttcacaaactacaagggcgtctacagcgttgcagagacaatgcctgagagcgaccgatgggattcgtgcctggcaaggcccatcagcagcttccaccagcattgcaccaggaggggcgacgcacactctggggtcaagttcacatacaacaaacagtcagggagctcgcacaacgtcaagacgttcctctacaagcctgccaacgttcctctgtactgtagctgaaatctataggatgggttcatgcccgggcttgatgttgtaagatctgaatagggaaagtgttggtcgacccgtatgcttgtaacgatctgcccatctagagttattgcccatgtcagtcatttgaagggggtcggatgttgaatgtgtaattattgtaaatcactataatatgtttctcagccatatacatataatcaataaatatgtacaagtagttttattttcaaaaanan

SEQ ID NO: 25114 - DNA, 577 bp, Triticum aestivum
  unsure (1)..(577): unsure at all n locations
  Clone ID: PAT_TA_25114
gtcgtccccgcgggcgacccgaggggaaaccctagccgccgcccctcgcacttccatccgcccctctccctcctcgccgccgtccgcaacgccgccgggcgaagcctggctggctgggcggcggcggggctcctttcccatccatctcgttctggctggcgcgggacagtggggacgaggggagcgccgggctaacgtggggttcggcggcgcggcggcgggtctcccggcgatgtcgtgtggcgccgtggtggcggtctgcgagttgccaggtggtggctgcgttggtactgcccggtggtcccgggtgtcgccggatccggatcggatccatctggatcctgggcttccggactcccgtccggccgccgcggggtgagggtgggtcatcaactggcnaacgtccggactgctggttttgggcgttctggagatntacaaacggggcttctcgattcccctttccggggggcccccaccagctttgcatcctcccacctcccggtgcttgggggncccggttcgccccaggcgcgggatcgtggatggtggggtcggtgggaattggccgcgaagc

SEQ ID NO: 25115 - DNA, 874 bp, Triticum aestivum
  Clone ID: PAT_TA_25115
cagcggtacttcaatgaactacgtgtggttgtttgtgcgggtttgattgccgggggtggtgccttcgtggtcaaacctgcaaaatcgcatacggaggacatgaatatagcaaaggcgtagcggagcgcgccattctgtctagttcattttcgtatcatatggttactgtcttcagttttttgctgttgtaacttgctaccttgctctgttttatatctctgtttttggatctgtgcatgctatttcctttctggatcacatcccatgtcttcttgagcaatagtaatacactgatgcaatgaggagacacactgctgactctcactcgtttgttccaccattgatgtttgttccaagcttgaccgggagcagtgggttaggttggaccaatgacagaagtggtgaggcattcatgtggaagtttatctcattacactggactagagtcaacggctgttaacatgcttcttgatgtcgcccgttccgaagaagcaaagccaaacaaattcctgcctccccttgggcatctaagacctgcatgcgttcttgtcgagagaggattgagtatgtagatatttatagatgtagaatagtaagaaagagtcgcaaaaaaaaaagcgaggaaaattatgaggtggaaacatttaagaacctagatgcacataagtaattagaggtactgctccgtcaaaactttactacgagactttgggcatgataggtaggctgcatcaaccgatcaggaatgtcacacacacaagctatgactgtctggttatctgtatgcgcccaccatatgttaacatgagttgctccattgcttacaatgactactctagacgaccgtatattaatatgagttgctccattgctt

SEQ ID NO: 25116 - DNA, 1031 bp, Triticum aestivum
  Clone ID: PAT_TA_25116
cgcgtcaacacagcaaaactagccagaaacattacgcagggctgcctcgttcggctctccagacgcgttcaagagaatatgtcagaagaaatgtcaatgttcggacgcgccggtgtaggtagagattcggcgcaccctggacatcgagagatccctattgagcatgctccgcaaacctcgattgatgagttgttgaaggtaataaaaggagccaatggcatgccggtgctgttcatgcccaccagcgacggccggctggcagcagtggccgtagacggccttgagagtttgatgcccgccaaacgcgagggcagcgaccctgtcaaaaagataggaggaggatttccgtgcctggttgtttgtcctgacatcactggttgctactgtcaccttcgccgcacggctcactccaccccggtggcttctgggcggatgacaacgggtacgtggctggtaccccgattatgcgagataaatttagcagaagactttgtagtagtttgttttctgagcatgggaattagctttatcgccggcacgtggaacagcaacgccggccccacacaactgtggcctgccatttttgtccttgcaattaacattgtgtacatgacgggggatccggattaaggaaatgttttccggtatataatctagtaatagctgtgaggactccccgaatccggtgcttaagagatctgctcagtactatgaatgagtaatgctaaagaagaagcttcgcagacttaagtatgcactcatggactcgatggtacttgtagtgaaccctggtatgtgtattgtatttgtaaccccgtgagaacccagcttctggtactcatcttctttgtaactcctggtttgtatattgtatgtgtaactgagtcggtggtaattatgccctcatcgagtcattagtaacccctattttgtcacttgaagttgaagttataataagtattcctcctctaaaaaaaaaaaaaaaaactcgagacctgcccgggcggccgctcgaaatcactagtgaattc

SEQ ID NO: 25117 - DNA, 1005 bp, Triticum aestivum
  unsure (1)..(1005): unsure at all n locations
  Clone ID: PAT_TA_25117
agctggaattgttatatgtttgctggttcttggtgcaatgtttgcattctttgtgatcaagaggaaatcttggaagttgtcccgaggacaagaccccgaacagaaagaacctctaagtccccttgcttcaggatttaaacagatgaagtccatcaagatcatctcaacaactggcaaggatcaatttcaaaagactgtttcaatgagcttaaaacctccaacaaaaattgacttgcacaagtccttcgatgaaaatgatctcacacccaagtctgttacaaggaagataagtttgtcttccatcaaaatacctgcatacacagttgcagacctgcagatagcaacaggaagcttcagtgctgaccatttcatcagtgagggatcatttggacgtgttttcagagcacaattcaacgatcagaaggtcctggctgtaaagaaaatcaacttttctgcattcccaggctatccttctgatttgttcattgagttggttgcaaatatttcaaggctaaatcatccaaaccttgctgagctagttggctactgtgcagagcatgggcagtgcttgttggtatatgaattctatcaaaatggttctttgtgtgacttgcttaacctagtggatgatcaaagcaaaccgctgtcctggagtagccgtgtaaagattgctcttggatctgcaagggcattagaatacctacatgacaaggatgtccagcagcgagagctacacccggcgcgaccgcgaatccggtgactgcgcggtataagcgtcacactgttgtacataggcctgaaagtatccagagcagagaacttttggtgggtagtaacagttgtacaaatttacagttttgttgcggagtcttagggtttattcttgttcatccatcccagcagcaccgagtagatgctgtccgccgtagctgtgtagtactagtaatccagtgacagttttnctgccgcgttatggttcttctttgaaagaaaaattccttgtgc

SEQ ID NO: 25118 - DNA, 701 bp, Triticum aestivum
  Clone ID: PAT_TA_25118
agatgcatatcatcaaaaaattctttttttgactaaaatttgcataaacaccagccacgtactgcacatattctcaggcatagcagaactttgttctcaggcattacatcaagcaaatacatcacatgtcaccaacaaatcaacaacagcggtacaatcatccatagaagatgaactaaaaagcacacacaagtgagaccctgttcttccatagcttggtctacttcgactagaacggacaacccctttttttgcaaaaaaatctccattgtttatgcacgggtagcttcctacttgcaccttctagctcaccagcatctgcaagatggaatggatattaagaataatgcaaagaatatgttggagaagaagttctcgggagaagagggagacgtccatattgtgtcagaggtgcgccatagaggggaggacgggcggcgcgcatgggggctagcggtggatgccggcgctgatgtgcgggagggaggaggggggtagggcggtggtgcggtaccgaaagtcgactgatggcgggcagcagtaggaggtggcagcgtgtgttgacggcggctggatccggtcgcgggggcagcacggcggccggatccaagggcggcgcagcgaccggacccaggatcgggtggcacaaggggtggatccatgcgaggagggcggtgcgtgcgcggagatagaaggcagca

SEQ ID NO: 25119 - DNA, 988 bp, Triticum aestivum
  Clone ID: PAT_TA_25119
ctagatgtgaagagattgttgtggagggcctgtgccgaaggattggcaaggtttctcggtcaagtttgccgagtcccttaaagcttgctatgcagataggtcgtactacggccctccggatttcttgtgccaatactgtggtgcctccttatggtttgctgagtgttcaaagtctaggtcatcctggacacaatgtaagatggtttataatcgctattgtaaaggcgctaaggtcagacgccttctgatagggtggatattgttgttagggtctatcacatgaagctcatcgagtacttggacgagattaagtgaggccgggcttttggccccattatggctgtgttttataccgttgagttccagtggtggggacttgctcacgtgcatataaaacacaggtggaggggcgttttggatgggcatgtctaatatgtatgctcttcttgtggggaacaagatcccgaacatccatgtgtatgtttcccgtctgtagcagcattgtggatccactgaaaacgttcctatcaaacacactgacatggtccttttgggtctgcaggtctaacatctatgctgggcatggttagaaactagtgcctaagttcaattgagaaaaccacatccatgttgtttcttggcatgggcaaccacatctatgctgatattggttagaagctcctgggctcctttataggtctcttgctgtgaagcttgtggttggcatgcctttcagccattcaattcttatgagggtggagtttgaaacagtggggcgttagagcatggcctattgcagcgtccatgacctcctcgggcacggccaatcccgccagattgaccttctagcatgcaaccatttttggagggactcaagtttgaactgactgatttcttctagcattcaattcttatgagggtggagtttgaggatatggggcgttccattctaagctattgcagcgtaactggctccctcggtcatggg

SEQ ID NO: 25120 - DNA, 641 bp, Triticum aestivum
  unsure (1)..(641): unsure at all n locations
  Clone ID: PAT_TA_25120
gcgacgacgacgattacagcggggagnaanaaggggcaggccccggcgcccgccccggcggcgatggaggtgaaggccgacaccggcgccgaggcccagccgcagaaggtcgcggaggggcgcgaggagatgaacggcgggaagaaggccggcgtggtggtgggcgtgttctcggcggcggcggtgctgtgcctggccggcgtggtgtaccggaagcggcaggccaacatccggcggtccaggtacgccgactactcggcgcgcctcgagctcgtctgatcggcgaccgctccgtccgtcggtccgtccaccggagatgagcgctaccgcgtatggtatggagatcgacgactggagatgcgatcctggctctgtgatctgtcaatgtggccggccggcagggccacacacatacagtattattttgatctgtgttactctgattaattagattcatcttggcttggggctcggagattattacataaatacttattctttgattagtgggaggttgagatgtatcgaggagagcaataaccattgatgtggtggaagagaaaatgatactgcttactagagtttgttctctcttttttgtatactacagatacagatacagaaattacagacattgcatt

SEQ ID NO: 25121 - DNA, 215 bp, Triticum aestivum
  Clone ID: PAT_TA_25121
cgtacctgcagctctcgcttctgaagtcacagggtgacgtgggactgaattaagctgcatcgatcaccagctcatggtggtggtaggagaactaggcgttggggtttcagtcatggggtggttcctagcgcctcacatcaccaagctcatggagattgcacgggagtgcgcagcctccaagtgcatgctctacggggacagcacggagatgctgc

SEQ ID NO: 25122 - DNA, 482 bp, Triticum aestivum
  unsure (1)..(482): unsure at all n locations
  Clone ID: PAT_TA_25122
gtggcacccgancgaacgcgggaacacattttattgattggttccagcagtgacaggcgttcaacatcatatgatcccatgatccacagtttcttcagctctttattttgaaggttacttggcgttaattattgcccccacctcttgttgcactcagctatacaatccgcaacaccttgtgcataggctggtgccaccaccgggccgcagacggaatccgtgctgcagaccatgatgcacgcggcaagggagtcctccctgtcgccaacgtcgcagttgccaagcacagttgacgttgcagagccaccaaggggtgctatgcctgcacccggggtaagcactgctggtaacagctgcagaaggacatggtggacacccgctggctgggatggcactgacatgatgaggagcatgcaaagggcggcaatggtggccgccctcttcttcgcctccatctctccttcgtcgaatgagaagagaag

SEQ ID NO: 25123 - DNA, 1315 bp, Triticum aestivum
  unsure (1)..(1315): unsure at all n locations
  Clone ID: PAT_TA_25123
gcacgaggctgagagcagcggcaagatcaacatcagacgttaaaccagaggagtttgcaatgttggtgagagatgttcctgttccacctcctaatcaaactataaaggactcggtggactcgtatttccgagcacttcatcctgacacattctacaaagcaatggttgtgacagacatcacgaaggctgatcaaattttccaagagattgaaggtcacagacacaaaattgctcatgctgaagctgtctatgcagaatcgaaaacatcaaacagacctgagggcacgaggcctactcataggacaggattccttggccttatcggtaaaaaggtcgacacgcttgagtactgtaatgagaagattaaggaattgctgcccaaactggaggatgaacagaagagcacccttagtgagaaacagcaacgggcggcctttgtcttcttcaacagcagagctgccgctgcctctgcatctcagactctccatgctcagatgtttgatgaatggacagttacagaagctcctgaaccacgtgcggtaatatggaccaatcttccaaggaaaatatatgataggcaaaccagacagactgtggtctacctcattgtcttcgtcaccgtggttttttatatgattcccattactgctatctctgctgttacaacgctggaacaactgaggaagaagctgccctttctgaaggtggttgtggaccaacctttacttaagacagtcttacaagcttacctgccacagatcgccctcattgttttccttgctttgctgccaacacttcttgtgttcctgtcaaagtcagaaggaattccttcacagagccatgtagtaagggcatcatcaggaaaatatttctactttattgtcttcaatgtattcattggctatgcaattggttcctcattgttcagcgctttgcaaaaagtcatcgagaaccctactgggattgttacgacgcttggctccaggcttcctggaaatgcaactttcttcctcacatttgttgcactgaaatcctttgttgggatatgggcttgagctctctcgtttggtccccctcatcaatttccanctgaaaagaaattactatgcaagacagaggatgaggtgaaganccggatgggctccaagagactggggtataacacncgggttcnaatgactgctaacgtgancttgtgatgtgcncncgtaacgcccctganttgcaattgggtgctanttgcccggtgggtaaagaaaaacagtcgaagttagtccaatntaancaaggcaattggaaaatccaangttatggg

SEQ ID NO: 25124 - DNA, 975 bp, Triticum aestivum
  Clone ID: PAT_TA_25124
gccgtgcacttattccgcatccagaccgtcattctcattcatcgaaggctaccgcagaggagatgaaaaaacgttcgagggcggcatacccacctctgtgtgataatctgtggcgtgtaaggctctgtgataagaatatccgagctacataagacccttccatgttaaaagcgcataccggacgtgtgcgcttagatggcatccagatcgtcatcatggctcatcgaaggctaccgcagaggagaaattcaaacgatgcagtgcagcataccagactctgtgtgatagtttggctactgcataataatgtgatgagaatatccaagctccattaattccttccaccagcagacatcaacttcgtagctgcaaattctggaggcctaccacttgcagaccaacttcatatctgcagactctgctgtgcacaagcaagaatgccaaaagttgcttggctctctaaaggaatgggctcaagccaaacttgaccagataatgtcaaagtactgtaccatgtaacatctctaaactaggcattgatttaattttaaagacaggacattatttataccactcaggattttgtggtggctgggttatctcaccccaatatagtcagtttacttattgttttggtgggttttgtgcttagtaaacagttgagtacagttttggtccttcagcctttgttgctgttacacaatgggagttctccaaggaaatgttccttttcggacgtggactttctgttctgatctcaaatgcaccctcgtgaacagtgaaacagaaacaggttgtaattttttttcccattttttgtattttggaatgttatgaattaaaattttgcttgtgttgcttgagcttagctagttttgactaggatttcatgccttagattttatttggagttcaaaaacatttagggagttatttagaacccgaaatttatttaatagtgaatatttatgtaat

SEQ ID NO: 25125 - DNA, 1050 bp, Triticum aestivum
  Clone ID: PAT_TA_25125
ctcgcgcgccgcaccacaacagctaggtaaaggtgaacagttagacgccggccgtcggcaccaacagccggagctcctccgttgcatcgctggaggtggcatagcgcacatggaggggagccatggtaaggaccaccacaacaacggggaaccgggaggtgatgccggtgatacaaatggcgctcgtcgatgaacgccggtgctgcaatgcaccaacgcgtccatggtcgccgtactcgagcgccggcggcggagctacaatggagctgctcggctcaggcggcggagctccaatggagcgctcggcgtaggcggcggagctccaatggagcgctcgacgccggcggcagagctgcaatggagccgctcggcgcaggcggcggagctacaatggagccgctcggcgtaggcggcggagcttcaatggagcgctcgacgccggcgacggagctgcaatggagcagctcggcgcaggtggcggagctgcaatgaagctgcaagtcgccggctacggagctgcaatggagcgctcgtcgacgcctcccccctgctccgatgcaccactcccgcgactggtcccggtgctccagcgctgcacttgtgagtggctcggtgcagcgtcgttggcggctcgtgggggcagcccgttgcagtgaagcgctgctgccatgcctagagtctatggtgttgccacgaccggcggcggtaatgtgtttgcaaggtgaggaacgagctgagcagagcctggtgctgcgagcgagcgcggcatggcggctgcgactgcgagctagaccagggccgctcgctggagctcaccgcgtctatctcaggaatcgcgtgtgcgtggggatttttttgaattggatgcgacgcgaggaagacgaggccacgcgcggcgttctattgtatcaggctggtcatagtgggagtaacatagacgcgacataagcaaaaatgatgatgtggcaagtagttaatgaggaaagaggcaaatagagtaacataatatgttaccatcacatagcggtttccaatgcataatgagtctac

SEQ ID NO: 25126 - DNA, 1090 bp, Triticum aestivum
  Clone ID: PAT_TA_25126
cttctctctctctcctcccattcggtcctccccgcgactcgctccagccacatgccactgccccgtgctcgcctcgccgctgccattcctccccacgagctgccgtgctgatgatggacgacccgccgccctcgctccaccggcttctcctgccgccgctgcttctagtgctgctggtgctggtatccgtctcctgcccgctcgcccacggcagcccagcgactggaggaggactcggtgccgaggaatggaccgcgaggacggatgccgcttccgttcaactcagaaattcgcatccgagaagactgctgcaggtaggcggtggaaaccaccttccaccacagttcctgcagccgaggcacaggcaccacagaagaacacactcgcccgctccatcgcccgcgccgttcaccgctccatcaccatcgccttcagcatttcgcccatcgctagcccctccacaattggcctggcctctgccttccaccccacagccaagccatgatcctcaagttggtgccccagtcaaccctttgcataagcattcctggagagcctacggtttggtctcggcaggtggtgcggctctccttgtcatggcagcggcgtttgctgtatactgccgggcgaagaaagtgggtactgtgaggccttgggtcacagggttaagcgggcagctgcagcgagcatttgtgacaggtgtgccttccttgaagcggtcagagctggaagcagcctgtgaggatttcagcaatataattggttctacggctaactgcatgttgtataagggaacattgtcaagcggagtcgaaatagcggttgtgtcaagtttaatatcgtctaagaatgattggccaaaagaatgtgaatcccagtacaggaaaaagatctcaagtttatccaaagtgggccacaagaacttcatcaatctgcttggctactgtgaagaagaaaatcctttcaccagagctatggtgtttgaatatgctccgaacgggactcttttcgagcatctccatgttagagaagctgagaatctggactggatggcccgacttagaatatcgatggggatagcatactgtct

SEQ ID NO: 25127 - DNA, 291 bp, Triticum aestivum
  Clone ID: PAT_TA_25127
aagaaccctcgacacgtgcctcatgctgaagcggcacctgtggaccagtgggagcgcagcttcagagccgcgtcgtcgggcggtggctgctcatgcgacccttgattggcactcgtccagaggtggtcgaacactcttcctggggaacctgctttcgtaatcctgctgcatctagtttgaagctgaaacagcgatggtttcgattttgatcgttatggccatttcgtgactctttggacatttgagaaccggcgtgtatgtgctaccagcaaagcagtgagagtttctttt

SEQ ID NO: 25128 - DNA, 708 bp, Triticum aestivum
  unsure (1)..(708): unsure at all n locations
  Clone ID: PAT_TA_25128
tttatcnttnnttcttttttntgtcttcatctagtagacactgttcaggtagaagaacagggccgccaatgcaacgattccaactgcgataccaataggcaaagctttccccacggtctcgtcctttttgagctgctccttcctcgccttccgggcatcagtggcgttggcgttcttggccaccggtggttcgtaaggcctgaatcttctcttgggagcggcacagacagggcagtagtagtcatcggacagcttctcaaacggggtcttgtccttgtatatgtacccgcagtcccggcagatgtaggcctgcttcgtctcaacgcggccgaaccgcatcgtgatccgcgccgccgccgcggacctcgccctgcccggcgctggcagccggacccgcacaagcagcggcggcgcgcagaacgccgaccggagccgcgcggggctccccgccggcgcgcgcgtcagcgacggggcctgcatctgcagtgccattgctgcagctctctcccggattcttctttacggcctagcccgtggaggcaacggctgatcgacgcacgatctgccaagagctgctgatcgagagcgatgaaatgcacgcgggaaagcactgcgggaggagggtgtggggatggagaggaagaatcgaggggataagagtcggtggttggaccgttggtgctggaagcatcgcaccggacgcgtggg

SEQ ID NO: 25129 - DNA, 500 bp, Triticum aestivum
  unsure (1)..(500): unsure at all n locations
  Clone ID: PAT_TA_25129
ggacaaacaggccagaccaagagcgccgcgtccaccaccgccggcaccaccaccctcggcgcgcgcgcgcggggatcgatccctgcccccgaactcgcgcccgcgcgcccggtagttgtgcccgctgcatctgcgctgactgggaccccgtcgatccggccgacgcgtggggtttggttgggtttgggctgggttggtcccttcccgaggatccatttttagttggattcccgggtcccttcgcgggggctactaagattccccgggggaagcgggatggattttggcgtccgtcaaacgaggaggctcccccaagattcgacggggcaaattcgcccgacaatcctttccgcgcaatttgcaaaaatnggggttccaaaaaagctccaacaaagatttaaanggatgcccaaaccgnccnggggcaaaggcaacttccaaaaaagttaatggacaaaanngcgaaaactgnanaaagggntttatccaaaaattttgaa

SEQ ID NO: 25130 - DNA, 671 bp, Triticum aestivum
  unsure (1)..(671): unsure at all n locations
  Clone ID: PAT_TA_25130
ccgcctcgtagggactgacctctgcccgcgggtttgctattaccctcggtacgggggcggtttctcgcttacctccgcccgctggtttgcgattggcgtgcctaggctgtttaggatgttagtttagaagtagaatttggcttggtggttccttcactaccgtgttcggtgtagactgcgtggttagcctctctgttctggtattggatttagatgatgtagtctgttttgatttgaacccatctactactgttgtcaaactactgttgtcattaagctactgttgctgctgttgtaggagaagaaggagcacgcctaggagaagaaggagcaagcccaggagaaaaacaacgagcaggagaagaggggagcaagcccaacttaaactattgttgtttatgttgttacacgcttgttgaaccgtcagactccacggctgctccgcatcgtccacacatgtcatttttattatcaaaatctgaattgtagtagtcataatattgggctgttgggagcctcacctttttgtgcacaatacatttagcacacatgtccacactgagtgcttatgaaatagctatgtgtcctacacaataagtgcttgttcatgtttggttttcncctaaactttgtttgtatgcttgagagcaaatttagttgattttttgatg

SEQ ID NO: 25131 - DNA, 445 bp, Triticum aestivum
  Clone ID: PAT_TA_25131
ccaagatcagaaacatcaattccaagcaagcattcataaccacaaatcaaacatgaagaccttcctcatcttggtcctccttgccatggcgacgagcatggtcactgctgctaggccgctaaaccctagcgaccaagagttgcaatcaccacaacaacaatttccggaagaacaatcatatccgcagcaaccatatccacagcaagcatttcccataccccaacaatattccccgcatcaaccacaacaaccatttcctccaccccatcgtccgaccccccgccgccctcaacggccgggcccccggcggcccaacctcccacggccatctttgccccttgcccctacatcgaggccccttgcttccccaactgcccttttcccagcccgcgacagcacgggtccccccccatcctccgatttccaatgccccgggggtttgctc

SEQ ID NO: 25132 - DNA, 613 bp, Triticum aestivum
  unsure (1)..(613): unsure at all n locations
  Clone ID: PAT_TA_25132
agcctctcaggcgatcaaatccatctgccggttacgccatgcaccttgatcgcccgccttcgtttctcaagaagaaccttcacaggctccacgtcctggttctgaacaccgggcatcactggaacaggggtaagctgaaggcgaacaagtgggaaatgtacgcctcaggaccacctaataacaaccgagagatcgccggcatgtggaaggcgaagaacttcactatacaccgtgtatagtgaagtggctaagatgcccagcttcctagatatccccacctgaaaggtattctacnaggtcactgtcaccaaggcattttttcaatggggaagtgggacaaccggganggcacnttgcgaacaacaacggattcctttnggccaangggtaccagggtagtttcagaatccctctgctgatgccgacggcgagggagtggtcaaaggcactaggatcaagctcttggatatcaccgcgctttcacggctacgggacgaagggcacatatcaaagtacagtatcaagagctacaccaggggtccaagaatgcctgcactggtgccttcctggtggtccagacacatggaatgaaatactgggccgctcaactgta

SEQ ID NO: 25133 - DNA, 388 bp, Triticum aestivum
  Clone ID: PAT_TA_25133
ccaactgattttctcctcttgcagttgggttcggtcgatgaagactccaccggctcgctctggcaggacaccctcacaaatggcaccctgtagatgctcgatccttcaatctctggtggatgctccatctgggattgatactcccatcaccgctccctcacgatcggattcggtgaatgtgtttgctccatggcccagaggagcagctctatgtactccggcgcgactccctccgggtgtatcgccgccttttcgctctgttgcagatatttcgccatggatgtcgccgtcgccgctagttggtccttgttgtcaaaccaagactgtatctccaacatcctagctagcttcacagggtcgccggtctgcgatcctcatgtatccgttg

SEQ ID NO: 25134 - DNA, 804 bp, Triticum aestivum
  unsure (1)..(804): unsure at all n locations
  Clone ID: PAT_TA_25134
aaaccacacatctccccgttaactctcactagatttgctggcaggacacctcattacaatgccactaacccaccacacgttcaagctcaaagccacaaccaacttttcagtacaaggaacaacaaagcaaaccaaagaatccatcatcacaacagggggaaaatggactggactgccgaagggattcaccattcaggtagcctcagcagacatgatctcaagctcagcccaccacagcggcgacaccttcggggtcgcgccctcaggccccaccgctgtgatctccttcatctgcgccgccacctgcgccatccgcggtctcttgctcgggtccgggtcgatgcaggacctcgcgacgtcgcacaacgcgcgcgcggtttcttcagggaaggagcccaggctcgagtccatcagctctgcaagaggcatcttgccttcaaaatagatggacgccaactgttcaagtggcaggtcttgctcagggaagggtactctcccggttaatatctccagcagtataatgccatactgatgcacgatgctctccgtgtccaacatggtgcagccgtcggtgacggaatcggatcccttggtgccattccagaaatcaagatctgaaacctttgcggcgaaatcatcggtgaggtggatagttgttgagctgaagctccctggtgccgaattcctgcagcccgggggatccactagttctagagcggccgccaccgcggtggagctccagcttttgttccctttagtagggttaanttcgagcaagggannnaaaggtatanannnacncnc

SEQ ID NO: 25135 - DNA, 814 bp, Triticum aestivum
  unsure (1)..(814): unsure at all n locations
  Clone ID: PAT_TA_25135
gcttcagtacaaggtcccaaccagagaaatatggactctgccgttccgatacaagtgaaaactcaaagatgggggcaagttgagtgtcccaccaaatttatatctgcacaagacaatttcagacatcagctggtaccaaataatcagatgtctggtgtctctttttcccaaagaatgcatgatgctgtagggctgaaggctggaaaccctttgcgacagtctactgatagccagagagatgaaatgagtatgatggaaagaatactcacggaggaagtaaagcagctgcgctcacaggtcacggctcttgcagagcaatgccagcagaaagatcttatagtcaaagtgtacaaacaaagacttgatgaaacatggctaattgttagggatgaggctgcaaagtgtaaagctgccaaagatgtcataaaggttctgactaatcagtgcaatgccttgtcagcgaaactttcagttggccagcaaccagagaactcaaagatgacacctaatagcatcccggaacaagcaccgtcaccaggtgccacagatagatcattcagtcatcaaaatatcgccagaacattcgaccgtgatggctacaccaccgaagcagactccgtggncactcctgttgagggtgttatanagcagattgagcgaggggtgtatgtcacacttggccgtatcccctggtggnaggaaagacataaaggcggataagattcaagtcgggnagnattttggcgagaaggcaacctcaantgccnggtgggaaagaagaacaangagcaaggtntatgcnaattataaccag

SEQ ID NO: 25136 - DNA, 449 bp, Triticum aestivum
  unsure (1)..(449): unsure at all n locations
  Clone ID: PAT_TA_25136
ccgccactcttccgtggaggaggccggccgcgctctcactcactcactcgcactgccacactgcccgcccgctgatcattccctcccctctgcccgtcctcctccctgccagagaatctccccgctctgccattccgcagagaaacatcatggtacagtccaagaagaagtttcgcggcgtcaggcagcgccactggggctcctgggtctccgagatcaggcaccctctcctgaagaggagggtgtggctgggcacctttgagacggcggaggaggcggcgcgggcgtacgacgaggccgccatcctgatgagcgggcgcaacgccaagaccaacttccccgtgccgaggagcgccaacggggagatcatcgtcgccccggcagcggcgacgggaagggcgcggtggcgtcggctcgtcgtcctccggcgcgggcggggcccgcaagan

SEQ ID NO: 25137 - DNA, 600 bp, Triticum aestivum
  unsure (1)..(600): unsure at all n locations
  Clone ID: PAT_TA_25137
cccagccccagcaaccacaacaacaatttccgcagccccagcaaccacaacaaccatttccccagccccaacaagcccaactaccatttccccaacaaccacaacaaccattcccccagcctcaacaaccccaacaaccatttccccagtcacagcaaccacaacaaccttttccccagccccaacaaccgcaacaatcattcccccagcaacaacaaccgttgattcagccatatctacaacaacagatgaacccttgcaagaattacctcttacagcaatgcaaccctgtgtcattggtgtcatccctcgtgtcaatgatcttgccacgaagtgattgccaggtgatgcaagcaacaatgttgccaacaactagcacaagattcctcgccaagctccaagtgtgcaagccatccataagcgtcgtgcattccaatcggcatgcaagcaaagaacaacaacaaggnaatacaagattctccgggcaactggttcaagctccgtccaagggcaaggggatcatccaaccccaacaaccaggctnaatatnaggggggtnaaggncatttggttnttgnnaacccttccaaaacaaagttg

SEQ ID NO: 25138 - DNA, 383 bp, Triticum aestivum
  Clone ID: PAT_TA_25138
ggaggtaccggaactgcctctggttgcacgagaaagtgaggagcttgatgcatgttgagctccttgagtggagcttgaaccgtgtgtgtgtctgtataaaacctatctatgtatttatatagatagcacctggaaactctagcagtattggggtgcctgtagaatgaactctacctgtatgggtgtcgctgggaaccatgggtgtgcggcatgttatcgtttgtggtgtggtgttggcgtcgttgaaccaaccaacctacctagcttgatctttgatggtctgctaactagactaagacttgggtggagtggataatcagtgtttgaaccatgcctgatggtattgtgggatcatatctatatatatctccatcctttagtgt

SEQ ID NO: 25139 - DNA, 414 bp, Triticum aestivum
  Clone ID: PAT_TA_25139
ggaagttgctctgctcatggaaaaaacaaagataaatgaataaccatgagaattaatcaattaagcagaaagaaaagttagaaagtagaaataatctcacccaagtagggaatgcaattatttagctacagcagagaggacttgcgcacatgtgttgtgccacgcaagagatagaaaaagacattatcctgaattttaccgagagtaaccagtagtaattcatgctatgataataatgttgctgatcgagggcctggccgtcctcgtcccccgtctcctaattcgtcaagccatcagttgccccgtcgttgttgtaccaggggcagcgaggtggtagcaaaaatgttggtcggggtcagcaccaatgatgatacaggaggcagacgcatagtacgtatgcagttctaattcttc

SEQ ID NO: 25140 - DNA, 261 bp, Triticum aestivum
  Clone ID: PAT_TA_25140
cggacgcgtgggtttgtttatgctggatggctggacgattgtgtgggaacagagggggtttgttccttgtgattagctggagagaaaataaacaaagaaaaggagaaaccgttaagagatcgtcaccttaattacaatcttctctcccacaggagcaccgccacgcaatgatcagcgaaatcttgccaccatgtggtgcaactcataagccttctgcccatttagatcttccaggtcacgacgactagttctagatcgcga

SEQ ID NO: 25141 - DNA, 753 bp, Triticum aestivum
  unsure (1)..(753): unsure at all n locations
  Clone ID: PAT_TA_25141
cggacgcgtgggtttgtttatgctggatggctggtcgattgtatgggaacagaggggttggtttctttgtgattagctggtagagaacccagggctaaaaatgatctaacattattttgatgcaaatcnccaccnanttcattcaatagagacgcagcagacgaggaaacatggtcgaatcaaacggaattcagatggctctggtttattttctccccagctaatcacacggaacaaaccccctctgttccgacacaatcgtccagccatccagcagaaacaaaaaaaggagaaatcgttaagagatcgtcaccttaattacaatcttctctcccacgggagcaccgccatgcaatgatcagcgaaatcttgccaccgtgtggtgcaactcataagccttctgcccatttagatcttccaggccacgacagcgtcgttaatcgacatttgggggcagggaccgcgaattcgcacgataaaacagtgcatttcaatcccactcctagcagttcatcagacgtcccagtgaacactcatcattgtacccttttctgttgaaaggcaacaacagtttgggggaagccatggcttcgtccctaaccacgccagctgttttgcttcttggcctcaaaggtggctccgtcgttgagcatgtcctgtgcatcggtttccattccaagctttgagagagctagggcttggaggtagaatgcagtaggccattcgggcatgcagacctgggcctgcattgcg

SEQ ID NO: 25142 - DNA, 1894 bp, Triticum aestivum
  Clone ID: PAT_TA_25142
cccacgccgtccggagatcctccgctcatccccttcatcggccgcatcgcgccctccgacacctaccgcatctgttagcgcggggccgcgctgcgggccgacatgacgctcgcggggttggacggcttccgcatccagcgctccgaccagacgttcctgttcctcggcgatggggcgcggccggaggatgctgggggtaaggagctgctgccgggttctctgatagtgctgtctcataaggataaggagatcactgatgcgttggaaggggccggcgtgcagcctacggagtcggaggtggctcatgaggtggcattgatgtccaagacgaatatgtatcgccccgggatagacgtcacgcaggcggatcttgtgcctcacatgaattggcgccggcaggagaggactgaagccgtggggcaggggaaggcaaaggtgtatgatatgttgaatgtcctggtcaccgtcaagtcgagtacgggtccctggggcaatgacagacgaggagctgtttgcgatggatggggaggagaagaatgggaggagcgcagagcttgaaaccgagctggatgaagtcttgactgccgaggagaggaagcagcttgattctgcgttgagggggaaccaggaggaggaatccgacgatagggccgaggaaggtgacaaaggggctgatcatttggatgcaaacggtgccgggaaagacaagaagggatggttttggaacggcaagaaaggtgccaagaatgatgagaaggcacccaaggcagtgagcaaggatgaatcaggtgatgccgggaagggaaaggagaagggcaacggcaagaagaagaagggtggtgtctcatctggggattctaataaactccaaagtgagtacaacaaggggttaagaccagtgtttgtgggtgacaccggatttccctttgaagacggatgagctgatccctttgcttgatgtactagcaaacaaagtgaaggctgttagaaggcttagggaactcttgacaaccaagctgcctacaggcacatttccagtcaagattgcttcccctcgtggcccaacaatacgggtcattgtgacattcacaaagtttgaggaactacagcctctagatgagttcgctaccccaccaacgagccccacgcagttccaggacgccaagtccaaagattcggaaggatctgcgtcatggtactcgtgggtcagagggggccgcggtgcgcagtccagcgacagcggcgatagcaagaactggaaagacgaggtcgacccgttccacataccttccgaatacacctgggtcgacgccaccgagaagaagcgtaggatgaaggcgaagaaagccaagggcaggcgcggcacagcccggaaacagtcgtcgaaaagcacctcctcggaagggggccagcaccctatgatggacggcttcgagtaaaacagtgttacatcatactcatagtaaggttgccccctgcgtccgcccataagatgtttatttaggtgccgacggcggggctggggcagcagcccctcctggcgcagacggatgatgccgtccgagacaacgccgcggctcggtaccctgaggaaagtacaggatggatttttataccctgctgctagtctgtaattcgattcttttcttttttgtccccgccgccgctttttcttcatgttggatgtatgtttgatgatgaatgatgatgatgatgatacggccttgtttgttgttgttgttgttgtttaaaagaagatgtgtttgatgacagatggagggggctgtagtgttcctccctccccgctgtatgaatacttggaatatgcagtcattttttctgtcttgcaacgaggaagctccgtaccaaaaaaaaaaaaaaaaaaaaaaaaaaa

SEQ ID NO: 25143 - DNA, 515 bp, Triticum aestivum
  Clone ID: PAT_TA_25143
gagggaggctgagaggaaggtgttggaggccaggaagaagaaggacgctgctccgaagaccaatgcggcttacttgggtgggtttgcgatgcccaatgacccagctgagcagctcaagcataggggataccatatggttgcaggtgcagtggacattggttgttccggaaggcggcattggaggatgtcaagcggttcaaggaggcgtcaatggagattggtgaagcagagggcgaggaggaggatgagaaggaaaatggatactggagtgaatgagcactgagcttagctcactggggaactggtgatgatttcgtttgtttgtgttctgaactgaaacttttagggtctccattttctggactttggtgtactcttgtttagtcgatgatttgggttttagggagcaaatctgtttgggcaccttactgttcccatttgtaggtggtaattggtgagtacctaataaagagttggattttagtgaaaaaaaaaaaaaaaaaaaaaaaaaaaaa

SEQ ID NO: 25144 - DNA, 515 bp, Triticum aestivum
  unsure (1)..(515): unsure at all n locations
  Clone ID: PAT_TA_25144
gcacgaggcacctcccgagtcccttcttctcccaaatcgagcgacgatgtccgggcgcggcaagggcggcaaggggctgggaaagggcggggccaagcgccaccggaaggtcctccgggacaacatccagggcatcaccaagccggcgatccgcaggctggcgaggaggggcggcgtgaagcgcatctccggcctcatctacgaggagacccgcggcgtcctcaagatcttcctcgagaacgtcatccgtgacgccgtcacctacacccgaagcacngcccgccgcaagaccgtcacccgccatggacgtcgtctacgcgctcaagcgccagggccgcaccctctacggcttcgggaggctagatctgtagtggtgccagcagcggtgcaacttcctcgtttgctctctgntgatgtgtgctgttgggtagatgaagacttactgggttgcacgttgttgttgtggtaccacagaataatgatcatactcactgccgnnnnnnnaaannnnnnnn

SEQ ID NO: 25145 - DNA, 732 bp, Triticum aestivum
  unsure (1)..(732): unsure at all n locations
  Clone ID: PAT_TA_25145
ccggcaaaactcctggnatccccacctcttcccatctccttttaatcctgcctcatgtgccgtctgctcctcgcgcaggccgtcgagctaatttttgccagcgggagcgccgttccctatttctcactgcttttcttgtgtgcagggacgcgcggagcggtcaccgcctgtgctatgaaccggcgacgtcttgctgctacgagcggtgaccgacgaggtgcgggacgaccagcggcgacgcgaggtgcggcggtgctccaaccgcatgcacgcaaagctggaaccggcgttccgaggtgctacaaccgtcatgcggccatgctacaatcaacgcgcggcggggacgaccactactggcgatttgctacaaccgcggtgtcgacagttgcaaccggtgacaagaaatgctacaaccggccatccatttgctggaaccggtatcagtttttgttgccgtcggccaccgatttgctggaaccagatgcgtgctcatcgtcaacgtgcgatatttgctggaaccagtgtatgtttttgctggaactagcttttccttttgctacaatcttttttgtttgctacaatagaaccaattcgagtctcccttcagagttattttgctggaaccaacgttttttttgctggaactagcaattttttttgctacaatcaaccaccgaagttttctttgttgaggttaattttgctggaaccggtgtgtttttgctggaacct

SEQ ID NO: 25146 - DNA, 418 bp, Triticum aestivum
  Clone ID: PAT_TA_25146
gcggcatggccacccacgcgtccggcaagacctcgctctaccccggccgcgagggcgccggcagcatcgacgccgagctcacgctgtcgcccgacaacatggcggccctcgaggaggacgacgagttctgggccgccgtgaccccggacgcgcccgtgccttcggcgccggagaagaaggccacttgaatcatcgtccatcgatgtcaacaccgtacctctactcttcttgattctggttggtgccgatcaccaaaatatgctggccgattttcattttgttcgtgtgattgattaacccaatagcaatatgcattgcctaattcttggctttgaatgacaacaagtgaaagatgttggatttgtgacaaagaaatttgctctgattgaatttttttaattttttttgccgagaagca

SEQ ID NO: 25147 - DNA, 836 bp, Triticum aestivum
  unsure (1)..(836): unsure at all n locations
  Clone ID: PAT_TA_25147
gnaaaacatcttgcagttgcttcccagtttagatacacgacagtaagccatctcagacgaactctagctaggagcttcctagctagctatggcttccacggcgagcttcttggccgcgatcatggtgtgcgcggtcctctccagcaacacgtgccatggcacacgcaacttggccgacactactcctccggcttcccctaccgctgctcctgtccctggcatcccagcggtgccgaccttgccggcagtgcccacggtgccggccgtgactgtgccgcaggtgacactgccgcctatgccggctgtgcctgttcccacggtgccagctgtgaccgtgccacctatgtcaaccatgcccaccgtgccgcaggtgacactgccgcctttgccggttgttccttccgtgcccaagatgacgatgcccccgatgccttccattgtcgtgccaaagttgaccatgccgccgatgcccgcaattgttgtgccgaaggtgacaatgccgcagatacctgccatcccgagcatcaatgtgcctatgccgtttctggcgccgcctccgtctgcataggcgcctctcagcacacacgacggttcttttgccatgtcgatacttggcgcacttcatgttgcaatggctacatcactgtggttgttactgctaccacagagtatttgttcttttcaagtgtatgtcttacattttaagccttaggttttttaattctgtatacacgtcgacatatgtattgttagtttccattgatggttgaggttgtcccattgtaggtatgcaacatttctacgtgtatatgttacatttacatcacattctcatc

SEQ ID NO: 25148 - DNA, 289 bp, Triticum aestivum
  Clone ID: PAT_TA_25148
gttatggacgataccaaataaaggcaaatgttatggacgataccaaataaaggcaaatgttatggacgattgcattactggagaatcataggaattcgaccggtttattgatgtaaagcattgttgtctgtctgattgcaaacatgtgaagcgttagcagcaaatttctgcatctctgttgcatacaatcaacattgttagaatgccatgtttgcttcaaaggccactgagaacctgaaacagttttgatggtggccgctggggtttcggagtgaaaattctttttttt

SEQ ID NO: 25149 - DNA, 620 bp, Triticum aestivum
  Clone ID: PAT_TA_25149
tgcatgacgttaaacaatgaatcagttgggattgtggatcacaagttcctgtcagctttgaaaaagggatcatatctcatcaatattgccagaggacgcctactggactatacggctgtgtttaatcaccttgagtcaggtcatttaggtggtttgggcattgatgttgcttggacggagccattcgatccagaggatccaattctgaaattcccaaatgttattataacaccacatgttgcaggaatcacagaatactcttacagaaccatggcaaaggttgttggtgatgtcgctctcaagcttcacgcaggagagccattcaccgaaatagaatttgtgaactaggcaaactgagtagatggcattattgttgatttaatttaagacgtattactagtgaacagaattaccaaataaaggcaaatgttatggacgattgcattactggagaatcataggaattcaaccggtttatttgatgtataaagcattgttgtctgtctgattgcaaacatgtgaagcgttagcagcaaatttctgcatctctgttgcatacaatcaacattgttagaatgccatgtttgcttcagggccaaaaaaaaaaaaaaaaaaaaaaa

SEQ ID NO: 25150 - DNA, 2167 bp, Triticum aestivum
  Clone ID: PAT_TA_25150
gcacgcggctcgagtccttggcgcgcccgcggcccgcccccgggcccccgccgcggctgccaccacgccccgccccctcccccgccccccccccgtcccccccccgctctccgccgccgcgcccggcccgcccccgccgccgctgccctccgggccgcccccccgccccgccgccccccccccgctccgcccctccccccgcgccgcgccgccccgcccccccctccccccgcgccgccccgccgccctccccccccccgtcctcggcgccgcgcccgcgccggggcccgcccgcgcgcgcgccgcgcccgggggcggggccggcgcctgcgtctaccgcgccggggccgggctccgcgtccccaacggctccggcgccggcctcggcggcggcacggtccacctcgagacaacgaaagcacatagctggacttgcatggatctgtatgtgtttgcaactccataccgtgttacatgggattactactttctaggccgtgagcatacccttgaaatcaaagaatgggaaagcaaggccgaatatgactatgtgaaacataatggagtgtccatcttcctcatgccgtcaggaacaatcgggacactcagagcactctgggatgttttccctcttttcacaaatactggatggggtgagaatgcaaaccttgcatttctcaaaaagcatatgggtgcgacctttgaggaacggccaaaaccgtgggtttcagaattaaatcctgatgacatccaatctggagattttttggttttatcaaaaatccgtggacgctggggtggttttgaaacccttgagaagtgggttaccggagcttatgcaggccatactgcagtttgcctgagggactctgaaggaaagctgtgggttggagaatctggtcatgaaaatgaggagggagaagatattattgctgtcttgccatgggaagaatggtgggagtttgaaacgacaaaggatgattcgaatcctcagattgcattgcttccattacgtcaagatttacgagcaaaatttaatgagacagcagcttggatttatgcgaagaaaatgaatgggaagccttatgggtatcataatatgattttcagttggatcgatactataagtaacaactatccaccaccattggatgctcacgtggttgcatctgttatgactgtgtggaacaagcttcaaccagactacgcggctagcatgtggacagaagcccttaacaagcggctgggaacgaagggtcttgatctacctgaaatcatagtggaatcagagaaacgtgggatgacatttgacaaattgctgacaattcctgagaaagataattgggtctacactgatggccaatcagcatcttgtgtggcctacgtcctcatgatgtacaaggaggctggactctttgaaccaatttccagctctatagaagtcacggagttcacgataaaagatgcttacatcctgaacttctttgaagccaacatgacacggcttccgtcgtggtgcaacaaagacgacactgtgaagctcccgttttgccaaatcaagggcagatatcgaatggaactgccaggatacaacgccatggaaccatacgctcacatgaatgaaaggtgtgcatcgctgcccccggactacctgagggatgagaactgctgagtactcatatttaaccgtgcgcccatgcgatttgattgtactcccttttagtcagtacttcagctgtacatatcacggtaggtctggaatatttcccatgatgcacgccggcttgccacgaggtatgatcaacttcctcgaataaggaaggccacggtggcacaattgtatagtaaaaaagctctgcatctggcgcgcagctgctgtcatgttctgaaaacattcatagtgtttttgtcagaaaatagatacacgtttgacaaagatgtatgtgcacagttgtattcagctgattagaaatggttgaaaacctatgtacaccatgtagaagtgctatttggtttggctcgtattgttcaattgccatcctatgagcggtgtaaaagctccaagttgaattgttggttgctgttttgtcgtaattgatacatcaatgtacaataaaaaaaaaaaaaaaaaaaaaaaaaaaaaaaaaaaaaaaaaaaaaaaaaaaac

SEQ ID NO: 25151 - DNA, 406 bp, Triticum aestivum
  Clone ID: PAT_TA_25151
aaattttgtgctataaaaagaaaggatcaagcacgtgctttggatatgataaagagtgatccagagttgatgggattgaacataatgcaagcacctctcgtggacatggaaattagaggagttcctgctctcaagtttttgggtgatatagtgtggaagtgaccttatttttgcgggaaaatgtgataacttcgggtggaactacttggtcgatataactgtttatccaatccaagttctctagagctactgggtagaatccagcttagcagatgcccatccctaacgtgagtaaatagcacataaaaccagagggtttcactgagctagcatatgggatttgctatacttttttttatgagaaaagggatttgctatacttgacagtaacactacaagattggtt

SEQ ID NO: 25152 - DNA, 471 bp, Triticum aestivum
  unsure (1)..(471): unsure at all n locations
  Clone ID: PAT_TA_25152
nctttcgttcgcacacccccgccgccaacctccagctccggctcgcgagacaccgccaccaccctcccgctaaccagccacagcctccccaacgcccctgagcgcgctgccaccctgcgtcccctgaccatcgcgccatcgttctccgacctcctgccagtcaccgccgtcgaaaccaaccacgtcgcctccctgaccaagaccacgacgccgccgcccctcagcacgcggaacgagacactcgtcggtttgaatttgcgccgccccagtgcagtccagccccaatactgcatcgatctatctattngtgctcccgtccgcaacggcagtggcgacgatgaagattgagaaagcaaatgcangacatctcaacaacttcgaagttctcgacttcttacggaaaanaagtgcaaaaaactgatcgatgggatgtttgggggccgttgctgcatcanagtgtaaggtatactn

SEQ ID NO: 25153 - DNA, 483 bp, Triticum aestivum
  unsure (1)..(483): unsure at all n locations
  Clone ID: PAT_TA_25153
acaacctggagtcctctgctagcagcgtgctgcgcaccgctgctgggacggtgagcagggggaggcgcagccagcgggtgcccgccaagaccggcgagtccgggtggtgctcctactgcccgaacatggtgggcgccacaaaggagaacgcccaggcgttcaacgccaacctcatcaagcgcgcgctctccggcaacgccggcaccccgtaccgccccgacgccgacgtctccgcgtacatcttcgcccttttcaacgaagaacaagaagcccgccgacgagcagaacttcggacccttctacccggacgggcagccggtgtaccggtcgacttcggcccaactctgccccgggccctgccacgggcanctggtccttgcgaacccgggcttcggnatccccgctncangcncgctggactancntcaacaacgggcggactgaacgccatcaacccgggaaacctnctacaaccaacacttn

SEQ ID NO: 25154 - DNA, 487 bp, Triticum aestivum
  unsure (1)..(487): unsure at all n locations
  Clone ID: PAT_TA_25154
gcacgcgccacctcccctcgcccccccgcccgcgtgctcggatcagagagagccccacccaaaccccccgcgcgtgctcccctccccaaaccctaaatccccaacggtctcctgcttccaaacccaccccgctcccgatttcccgcccaatccccgccccccaccaccgcgcgatcccgccgcgtcgtctcgcgccgaccgaattcgaatcccgccgggggcgcgagctcgaggcgggcgggagggcggtcgggcgcgcaattccggcgcgcggctgcgtctagctccccccggctcgccctggatggtggcgctggacggcgtggcccgagcagagatctaaccctagctccggttctgggaccgccacgcccgccaaggtgctcgacggtatgaccggtccggagcggcgggaggacaagagggagcagtatgagtgaccgcgcgggcagcagcggcagcggcagcggcagcggtnccgagggcg

SEQ ID NO: 25155 - DNA, 384 bp, Triticum aestivum
  unsure (1)..(384): unsure at all n locations
  Clone ID: PAT_TA_25155
cgcagcagcagcagcttccaatcccgtccctcccgtgaagtgctctctcgccgccccaacatcgccatggaggccgccgccgagctcaggacccagctccaagcccacctcaccatgatgtacgccacgggtgccgtggacgcgtatttccaggagctgcaggagctggacgagggcagtgcaagcacgggccacgtcgccgaagtcctcaacatcttcctcaatgacggcgacaggattctcaaggacatcgacaagcctggctgaacaagcccctgcacaaggtgttctccccaaggtgggacgccctggtgcagcanctcaaggggagcaactccactgttggggctaaaaaaatgaatctccccttgcatggggnttcaa

SEQ ID NO: 25156 - DNA, 614 bp, Triticum aestivum
  Clone ID: PAT_TA_25156
caggaagcacatcgtgaatgaaacatctgtaatccaactcatctgatgctgagactaaaactgatgtccattcaactggagatgatgtaccccatgaagaagaggcgcaaagtgatggatccgctaatgcaggtcagatcgatgcaagcggcaatggctcagatggagagcaagctgagaaaaaggcgcagtggagtctcaagctgactctgggtccctttctgaagataccaaggctggaacaggtgacgagcattccgctgagactcttccagatgaaacaggcaacataccagcggttcataatgcaaatcctcaaggcgatgcagcttccagtacatccgatgcttatgggcatagcaacagtgagactgttcatatagaggttgggtctgaacatgaaggggcaacaacatcatctgtgaccacatctggtgatgctgagaagggtaattctgtggagactaatccatctgatagcatctcagtagaagaaaaggctggtggtgatggcgacaagggttcagaaacgagtacagctaacgaggcgtcaggtgccaaagaagcaaaccctgaggaaggcaatgctgcagcagaggttcgcgctgaccagg

SEQ ID NO: 25157 - DNA, 480 bp, Triticum aestivum
  unsure (1)..(480): unsure at all n locations
  Clone ID: PAT_TA_25157
gtctattcccaatttcaaaatttgattacacatgttccaccctaggatcatcaacaaagatcatttcttcgggtatgtgcatgccaatcaccattcattgacctttttgcgggtatctcaagtcctaatgctatgtacaccagccgagaagcaatatcgacaatcatacacactccacaaatatgaacagaacgaaacttaacactggaacacatatataagacgctgttggcatgctaaacatggactcaaccatattttccagtcaagacaaggaccatgggcagcatggcccataccnaggnttcaaggatagnttcaaggaaccacttcacaagattanacncctcgaggtnaacaatcnggnaacgntttgaggtccnggacaatanngcccnaacctaattganncccttcggnaaaattncngttgggaaaaatcttgggngaaaaacgagtttttcnccaggcnccnttttt

SEQ ID NO: 25158 - DNA, 541 bp, Triticum aestivum
  unsure (1)..(541): unsure at all n locations
  Clone ID: PAT_TA_25158
cagtcctcagcattcccatcctccacttccccagccttggccatggccagtgcctgcacaaacgccaccactaccgtgcgttctgtgcggctgttcaggatcgacggtttcagcttggtgtccagcaccatgggccacgacgagtgcttcaaatttaggtgggacgtcgatgggtacgagtgggaactccattgctttccctcgtatttttcggcggtatggctcaagcttatgttcctcagtgatgccgacgccacatgcaacgtgagggcgagtctgggctatctcctcgtacatccagggctggatggattatcccaagagaggcgaacgtctgatgtattcaagcgtccaaatgactgcacacaacaagtctacctcgtgaataaagtcgatctaccagtgcctagccgttcgagtgacgatcatttgactgtgcagtgcaccatcacaattctgaaggatctgccggaagtgccaacctcagtgcccgtgccaactcgaacttgcacttgcactccggactccgcggatggnacgg

SEQ ID NO: 25159 - DNA, 553 bp, Triticum aestivum
  unsure (1)..(553): unsure at all n locations
  Clone ID: PAT_TA_25159
ctcacactctctgatcagagtagcactagcttcagctagccagcctctgccactccggtcattttcttgcatccacgacggcaatggccaccgctgatgtccagaacccatcggccgcgctgacggaggaggcgcccgcggtggagaagccggtcgccgccgaggaggtcgcgaagacggaggaagcccccgcgccggtggaggccgaagtcgaggcgcctgcccccgtcgaggttgaggagaccaaggaggaggcgccggcagcagttgaggcagaggagacgaaggagcccgagccagcaacctgcggccgaaccggaagccgaggcgcccgccgtggtccagacagagaacaaaggaggccgttggctgggggcaacccccgccggccaggccgtggaggttgagcggcgcctgctgcccccggccgcccggcgccccgccccgcccgacccccatccgttgaggaaccncggcncgtngcaactcaacttttagngcaacccccggagaagactgctggtaactnaacggggggccnttgtccaatgga

SEQ ID NO: 25160 - DNA, 915 bp, Triticum aestivum
  unsure (1)..(915): unsure at all n locations
  Clone ID: PAT_TA_25160
gttcgccgcgggcgacgtcctggcgcacctgccgtgcggccaccgcttccatggggctgcgcgctgccctggctcgagggcgccgccgccgcctcgcactcctgcccgttctgccgcgccgcggtggacgccggcgccggctcgcacgccgcctcctagcgacgccccgctggccgggccatcggttcgacgcccgcgcgcgcgccacggcgtcccacgatgccgtgaccgaccggcccgccgccagcatatgatgcatgacctgccacggcgaagaaccacttgtattgtaggatgcatcgccggatcgatggcagacacttgggaacgcgtacggagagaagacggccgtgaaagaaatcctggccggcgccgagttgcatggttttgggcgcgtccgtgcgcggtccggttctgccatttcagttcttttccggcgagcggtggccgatgaggttgtgtttggcgggcatgtacatgcagcggttgtcggttggcaatgtcagtccgatgtgttacaccatcatcctctggtcaagaggaaaaactgtatattaagagcttagttgtagcaagggtgggactttgtgcatcagcatcagctgttgaaactgaagaaggcgtggctgccgctgaacctgaccaaactgaagaaggcgtggctgctactgaacctaacaaaactgacgaagttgtggttgttacttgtagaagtgcatgctttatctaatgcaaccaaaagatcgatctgatggaagagactaggcagcacattatacgtcaacacttcttctcacgtgtggctccgtcaggcctaaacatggatcgaaagtggctgcnnnnnnnnnnnnnnnnnnnnnnnnnnnnnnnnnnnnnnnnnnnnnnnnnnnnnnnnnnnnnnnnnnnnnnnnnnnn

SEQ ID NO: 25161 - DNA, 2324 bp, Triticum aestivum
  Clone ID: PAT_TA_25161
gcggaaggcaggttcagtcggtagaccgcttccacgtgttgaggccaagatcgttatggatgatggtactgaaactaaacctggagtcggtcagctctgtattaacagtccgtcccttttcaaggacgtactggaacagaccggaggttacagcacactcaactctccttggtcgcctcttcggctcgggcaccacggcctcccctgcctcagttgacaacaccagacagagttctcgcacgtttatggaggttattcgagaagtctttaagcagggctctgcacatggtgcccgggcggctataatagctgacgacaagagttacaggcttgtccagcttatttcgcctgcactggatgaccacaatattttgtgcagaaaacatgatggtaaggagtcttcggacaatggggcaaaagcgactgcattcctttgtggtgcccgtataggcatggtagcttgaccctctgctgaatttgttgctgagatatttggaaccaggctttctggtggggtcgcagtaccccttgcacttatgtatcctgtagttgaactgctgcatgtcatgaatgactcggacatgtcataggtgttaagaacaaaagagcatcatgacattatggaaagcatctctaacaaatgttccactcgttattctcttcttccatctgtggaaagtatacctccaaagatagatgcccaagaacctttaagtagtgtagtgacttcatcagtttctagcttaatggctgagattgacactttaaagaaaattaaaggagatgatcctgctcttatcctttacacaagtggcacaactggtaaaccgaaaggagtagtccacactcatgaggggatactttctcaggttcaaattctgacagaggcatggggatatcaaagtgaagatcagtttctccactgtcttccactgcaccatgtgcatggtcttttcaatgctctatttgcgcccctctattcaggatcagtggtcgagtttttgccaaaattcagtgtgaggggagtatggcagagatggcgtgagtcatatcccaacgacggcagtaaaaatgatgaggctattacagtatttactggagttccgacagtgtacacacgcctactgcaagggtacgatagtatgaatcctgatcaacagtctgcctgttcttatgccgcaaagcagctgagactaatgatgtgtggatcatcagcacttccttccccactcatgaaacggtggcaggaagtgacaggccaccgtcttttggaacgctatggcatgactgagtttgtcatggcactgtctaatccattgcatggtgcacggaaagaaggtacagtcggtaaacctcttccgcgtgttgaggccaagatcattatggacgatggtactgaaactaaaactggagtcggtgagctctgtattaaaagtccgtcccttttcaaagagtactggaaaagaccggaggttacagcagaatcatttattgatggtgggttcttcaagactggtgatacggtaaccgtagatgaggacggatactttataattctagggcgcacaaatgctgatatcatgaaagttggtggttataagttgtcagcgttagaaattgaggcggttctgttagagcatgacactgtactggagtgtgctgttcttggcttgcccgatgaagcttatggggaggctatatgtgcaataattgtgcctaaggaggatgcaaaggaaaaggctgaacaggcttcaaagccagcactaaccttagaagcattgacaagttggtcaaaagataaacttgctccatacaagattccaacaagattgcacttatgggattctcttcctcggaatgccatgggaaaggttaacaagaaggagcttaagaaattattagaggtgtagctgtagaagtgcacgctctagccaatgcaaccaaaagaccgatctgatggaagagactaggcagcacattatacgtcaacactccccttcacgtgtggctccctcaggcctaaacgtggatcgaaagtgggctgcaatttaattgcgccagctgggtcttgaactcaagacctcttggctctgatatcatgtagaagtgcatgctctagccagtgcaatcaaaaaaccgatttgatggaagagactaggcagcacattatacgtcaacagtagccacatttacattgatgtacctatttttccatctcacccttctacgagggagacatatagcagtgtcagctaataattttgtcctggacaacaataatgataatttagagcaactgtgcaagtaaatagtgcacactatcc

SEQ ID NO: 25162 - DNA, 572 bp, Triticum aestivum
  unsure (1)..(572): unsure at all n locations
  Clone ID: PAT_TA_25162
aagtagagcgcatcatttaagccaagaaagcagtgctcaatacaaatccaccatgaagacctttctcatccttgccctccttgctattgtagcaaccaccgccacaattgcagttagagttccagtgccacaattgcagccacaaaatccatctcagcaacaaccacaagagcaagttccattggtacaacaacaacaatttccagggcagcaacaaccatttccaccacaacagccatatccgcagccgcaaccatttccatcacaacaaccatatctgcaagctgcaaccatttcccgcagccgcaactaccatatccgcaagccgcaactaccatatccgcagccgcaactaccatatccgcaagccgcaaccatttncgaccacaacaaccatttccgcagtcgcatcctctccattccccaacctcttcgccccaattccgcatccgcgccccaagccacttccccaccccatccatgtctcaaccgncaccaaccacttgccaccaccaacccgattccctcaaccagcattttggcaaacaaacaaantggatcccatgcnnggg

SEQ ID NO: 25163 - DNA, 534 bp, Triticum aestivum
  unsure (1)..(534): unsure at all n locations
  Clone ID: PAT_TA_25163
cacatggctgaaacccggcgcaagcagatgacaaatgaacaatacaaccaggcataacagcacaatgccaatagagatcaattgtacttgaacacaaaacgttgctcccaaagtcaaaaaccatcacgggtacagaactagttgctaactaagataagaaccccatgataggatcactagccagaaccataaattaaactggggaacacccattgggttactcaagtagaccgcagtcgggagggaatgacataccatagaacatggggtgaattgcgttctccggcactagctgaccaagctcagcagaagtccaagtttcatcaaggatattcaagatagctttgcaaaataaatgcantaccctttcctccccatctttccggggctcatgcaagaaaatgtaggatccctccctatcaaaggctaacaaacaaggcatattttccaacttctccacttcaaccactttagcgggttcaacagtgaatcgatccaaaagacttaaaggtgagcatccaaccgccagagtta

SEQ ID NO: 25164 - DNA, 1048 bp, Triticum aestivum
  Clone ID: PAT_TA_25164
ggtccggattcccggtcgcccaccgtccgcagtacactggataactggactcgcaattcggtgctagcgctttactacggaacccggctggaaaattgtcgaattacctgttgagagctgaatattcccgaatcccggttagtaccactcggcacgccgggcaagtacgccaatgacccttaatcgtgggccgaaagacggcggtgttgctgcagttgttgacgagatgccatgcgttgagatcttcctgtcaacccactgcaacttcagaatagtcggtcaggagttcacgaaggagggatggggatttgcattccagagagattctccccttgctgcagacctatcaaccgccatccttcaactttcagagagtggccagctccagagaattcacgacgagtggctcacagatccgacctgcggcgatgatgacagtgggttgggagcagtcaggcttggtctcggaagcttctggggccttttcctgctgtgtgctctgatatgcgtctttgctctcatggtttacttcgcaaggatctgctggcagtatagcaggtactccagctccgaacctcccagtgagccaagcgactctgctgctgccgtcaccactgccaccattgctcaaatacggccagagaagccaaagccgacgcgccttggcagcttcaaggaactgatacagtttgcggacacgaaggaggaggagatcaagaaggtaatgaaacggagattgagcgaaaaagatactcgggccaccggatctgcgcactcggtctcttcagcatagaagaggatctttcatttctggtgacacagccccaggttcttcttacacagccaagatacgtagcatatactgaagtagataacagcggtatacttgacacttgtaggattcataaatccattttttttttgcggtcatttgaattccgtctcggatatgcggtatatatgcagcaacattgtcccaacttttaattttccgagaatctttttcttgaccgacaaaaattatgggggcgaaaaaaaaaaaaaaaaa

SEQ ID NO: 25165 - DNA, 541 bp, Triticum aestivum
  unsure (1)..(541): unsure at all n locations
  Clone ID: PAT_TA_25165
accaagcaacactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcagcaacaaccaccattttggcagcaacaaccaccattttctcaagcaacaaccaattctaccacagcaaccaccattttcgcagcaacaacaactagtctaccgcaacaaccaccattttcacagcaacaacaaccagtttacctccacaacatcaccttttccacaacaacaacaacaccaacagctgggtgcaacaacaanccctgttgttcaaccatccattttggcagcaagctaaaccatgcaagtatcctcccagcagcatgcagcctgtggcaatgccacaagtctggctagtcccaatggtccagcaga

SEQ ID NO: 25166 - DNA, 703 bp, Triticum aestivum
  unsure (1)..(703): unsure at all n locations
  Clone ID: PAT_TA_25166
cgtccgcggacgcgtgggctgctacagttgcgaaggaagcattggaagggcattgcatctacgatggtggctactgtaagattcacctgtcatactctcgtcatactgatctcaatgtaaaggctcatagtgacaagagcaaggattacacaataccagaaggagcacaccaagcagcaccacagccagccggtgtaccacctacaactgcaggatggcaaggtaattctcaagcagctggaccatacggaccaccaggtgtcgccggtcaaaacccggacaccaacggacaagtgccgaattggaatcccggcaactcagggtacccaccagctccaggccagtatccaggccatatgtactcagctccaccacagcagtacacggcgacatcagggggcttctccgcccctccgccaccgccgcctcatgagatgcatccttcacaccagatgccacctgctcatcatggaaatgagatgcatccttcacaccagatgccacctgctcatcatggaaatgagatgcatcctccacaccagatgccacctgctcatcatggaaatcagcagagaccggcaagtggtgcccctggaactggccaaccacctccgtattaccaccattaagtgtgtgtgtaccttcgccgccatttctgattagtttatggagttttgccactccaacantacggctaccccat

SEQ ID NO: 25167 - DNA, 843 bp, Triticum aestivum
  Clone ID: PAT_TA_25167
ctccggtggtaggctctgcataatgctcttcttgtacagactcagattcacaatcccagtaaatgcacacagtgacacgacccagccttacgctgtcccaagcaggaccgcaccaagcagcgccacttctcaaccgggtggaccctacgaacccccgattgtcgcggctcacacccgcagctccaccatacggatgacgagttggcaccgcgccaactcagagtaccaacgggctagtgccgagtagccatcccgtctactctcggctccccccacccacaagccagtggccacatcatggggcctcacctcccccccaccaccaccccctgatgtcaggcggctttcccacccctccccacccgctgcttcatgagatccgccctgcacaccaagaggcccccctgtcaccggccaaccaacatcctttcatcaccacaaaatgcacgtacctaatcattggagttatgtgactccacaatactaccaccctcctgcgtttcacttctccgcccagaaatggtatactggtccacaacggcacatccagcattctttggtcaatccgcgccattgatgggactcctctcgagatgcatccttcacaccttgatgccacctgctcatcatggaaatcagcaagagaccggcaagtggctgcccctggaactggccaaccacctccgtattaccaccattaagcgtgtgtgtaccttcgccgccatttctgattagtttatggagttttgtaactctacaataccgctgcccccttttgtttatcatctgtcctacaatgaaataacagtcaataaaggcccatcaaaaaaaaaaaaggggggg

SEQ ID NO: 25168 - DNA, 1174 bp, Triticum aestivum
  Clone ID: PAT_TA_25168
cgtccgcggagccgtgcaacgatccagcgcacgcagcagattaagcggcgacctccttcgatcgaagatgagccaggacaaggccgccggcgagaaggcggcggcggagcccaagaggcagaccttgcggctctctgagcgcctcctctccatcctctcccccaggccccgcgcgatacacttccaatttcgcacatcacatcggatcaaatcaaatcgagcgctaggctgtaagatccatccatggctccttcacagcaagtcgccgccaccaaggagccatccgccaacggcacggccgcaccagcccccaagaccaagaccccggcgctgaacgagcggatcctctcctccatcacccgccgctccgtcgccgcccacccgtggcacgacctggagatcggcccggacgcgcccacaatcttcaactgcgtgatcgagatccccaaggggagcaaggtcaagtacgagctggacaagaagacggggctcatcaaggtggaccgggtgctctactcctccgtcgtctacccgcacaactacggcttcatcccgcgcaccctctgcgacgactccgaccccatcgacgtcctcgtcatcatgcaggagcccgtcgtcccggggtgcttcctccgggccaaggccatcggactcatgcccatgatcgaccagggcgaggctgacgacaagatcatcgccgtctgtgccgacgaccccgagtaccgccacttcaacgacatcaaggacctccccccgcaccgcctcgccgagatcaggcgtttcttcgaggactacaagaagaacgagaacaaggaggtggccgtcaacgacttcctgccgtcggaggacgcctacgaggccatccaacactccatggatctttatgctacttacattgttgagggcctgagaaggtagaaggaggatgctggtctggtgctgccttgccacttgctgcagaacgatgttgacgaaaaaattatgcctcataaacatacatacaatacattcttgttttgttacatacatatagtagtatatgatgatggagctacacctcatctaaaacagccttgatcaagtcagtagtagccagataaagaaagtcactccttttccatctagcttctgtaatacgttttccctggctgaatatgagatgttggtatactgt

SEQ ID NO: 25169 - DNA, 1146 bp, Triticum aestivum
  Clone ID: PAT_TA_25169
gccggccggtttgggaccacacacggcacagccgctgagtccacagcagagcagagcagcattcttctcttccattctactcaacgcaaagtctcccggtatctcagatcagatcagatcagatcgagcgctaggctgtaagatccaaccatggccccctcccaggaagtcgcggcccccgccgccaaggagccatccgccaacggcaacgggacacagggcacgcccgcagccgcccccaagaccaaggccccggcgctgaacgagcggatcctctcctccatcacccgccgctccgtcgccgcccacccgtggcacgacctggagatcggcccggacgcgcccacaatcttcaactgcgtgatcgagatccccaaggggagcaaggtcaagtacgagctggacaagaagacggggctcatcaaggtggaccgggtgctctactcctccgtcgtctacccgcacaactacggcttcatcccgcgcaccctctgcgacgactccgaccccatcgacgtcctcgtcatcatgcaggagcccgtcgtccccgggtgcttcctccgggccaaggccatcggcctcatgcccatgatcgaccagggcgaggccgacgacaagatcatcgccgtctgcgccgacgaccccgagtaccgccacttcaacgacatcaaggagctgcccccgcaccgcctcgccgagatcagaagattcttcgaggactacaagaagaacgagaacaaggaggtggccgtcaacgacttcctgccgtcagaggacgcctacgaggccatccagcactccatggatctctatgccacctacatctgcgagggcctgagaaggtagatgatagatccggtgacgccatgccgcttgctgcaggatcgatgttgacgaaaaattactcgtgtcgagagcgttacctagctcatacaagtcataaacatacatacatacattcttgttttgtgttacctacctgcatacacaaatacacatactagtatatgatctgatcgcccaaagccttgcattaaggcagtagcagccagataaacagggcattctttccccagctaccttatgtaatacgatttcctggctgaatgaatatgagatgttggtatactttttccctatttttgc

SEQ ID NO: 25170 - DNA, 1613 bp, Triticum aestivum
  Clone ID: PAT_TA_25170
cctcgcggctggctcgccaccatccaacacccgcatttctcttatacactactcaccttcgactctctctctgacaggacacagccctcggcggccagagcgcggcgcagccccattcgcagaagcccccctcctccgagcagatccccccccccctccggccaaggtccgccgccggccacccctgccaagacctagacatcggccccgacccagcggagcctctcagcctgcaggcgccggctcgcccacggcaagccagggccactacctgcacgacaacacgaccgcgatcaccaccgtcgaccgccccatcgacatgcccaaggctctcaccgcacagatccggctctccaccaagcgccgccccctgcagggggaccgcggaccccgatcagaaggtcctcatccgcccaagcaccggatcccgtcctccccggtcagcttcctccgggccccgggcccacgtgccccacgccaatgaggagaccaggggcagcgggatggatcacaaggaccatagccgtctgccgccgccgccccacagagccacaatctgacgcagcccacgcgacgactctcagcatcgcccacgggcaggtccgccggctgaaaagcgggcggcggagcccacgtcacaggcgccacggcaaaacgagcggatcctctcctccctctcccggccggcccgtcgccgcgcacccctggcacgacctcgaggtcggcgctggcggtcaggccatgttcaacgtggtggtggagatcaccaaggggagcaaggtaaagtacgagctcgacaagaagaccgggatgatcgaggtcgaccggatcctctactcctccgtggatgtaccctcacaactacggacttcggtcccacgcaccctctgcgaggacaacgaccccatcgatgtcctccgtcctcatgcaggaaccagtcctccccggcaccttcctccgggccagggccatcggcctcatgcccatgatcgatcagggagagaaggatgacaagatcatagccgtctgcgccgacgaccccgagtaccacaacctcaaccatctcagcgagctctctccccatcgcctccaggagatccgccgcttcttcgaagattacaagaagaatgagaacaaggaggtggctgtcaacgacttcctccaggccgatgatgcccgtgctgccatccagcactccatggatctgtacgcggaatacattatgcacagcctaaggcagtagagtgtgtactattactatttttcctttgcccttcctcctatgatgggatgcaaagaagatcccctcggaacatttggggtctgatgaacaaccaagcgagcctgtatttctacattcttgctttgtattagccatattttcccattactgtggcactatgtatctcaaatttgtattcgagaccttgtggtttggctcgtgtattatcttcagttcttactggacggacaataatataacaatttatcacattgatgtctgagatactgtggtaatgccatatctcaaatttgtattctagacctcgtggtttggctcgtgtatcttcagttcttattactgaaggaacaataatataacaatttgtcac

SEQ ID NO: 25171 - DNA, 608 bp, Triticum aestivum
  Clone ID: PAT_TA_25171
cccgtccccagccaacctcccatctccgtctcgcgtcgcggcggcagttccactccctcgccatgggcaagattaagatcggaatcaacggtttcggaaggatcgggaggctcgtcgccagggtcgccctccagagcgacgatgtcgagctcgtcgccgtcaacgaccccttcatcaccaccgagtacatgacctacatgttcaagtacgacaccgttcacggccactgggaagcacagcgacatcaagctcaaggacgacaagactctgctctttgggcgaagaagccagttaccgtcttccggcgtcaaggaaccctgaggagatcccgtggggttgaggctgggtgccgattactttgtggatccaccggtgtcctcactggacaaggacaaggccgctgctcacttgtaagggtgggtgccaagaagtgggcatctctgccccaagcaaagatgcccctatgtttgtggtggtgtcaacgaggacaattacactcagacttaaattgtctcaaatgctactgcacactaatgccttgctcccctaactaagtcattaatgacaactcgtataatgagggttgatgacacggtcaagccacactg

SEQ ID NO: 25172 - DNA, 554 bp, Triticum aestivum
  unsure (1)..(554): unsure at all n locations
  Clone ID: PAT_TA_25172
gaaagaatccccggaatggcattcatgtctcagctcatcccctcggccgccgtcctcctcgccgtactcgccgcaacctcggccaccgtcgggactcagtgcgttccagggtcggacattccatacaacccgctacaagcctgccgcgaccttttgtccactaaaatatgcagcgtaggccccgtgtacgcctccgccgggatgttgaagaggcggtgttgcgaccagttgtcgcgcgtcccagcatactgccggtgcgaggcgctgcgcatcctcgtggatggggcagaaactcccgcaagggtgcgttcgagggcggcccctcctgcccatgcccggccgccgaggttcaccatgggctacgccacccccctcggcgccccggtcgggtgccacccanggacagcccgcgcctcgcccccccgccctgccctatccgggtcccggtccggtggtgctgttactttataaccactcatngtgaataacgtgctgcatcatngatggataaatgaataatgatcngtgccatgtntnaaaaatgaaaatncncn

SEQ ID NO: 25173 - DNA, 555 bp, Triticum aestivum
  unsure (1)..(555): unsure at all n locations
  Clone ID: PAT_TA_25173
ttngtttatgtngtttaatatgattgggncatgcattctacatttactccgtgtcctaatattgtctttttgngtttcaagtggatgcactntggtgatatgacatattttagagtgtgattcactcatttgtatgtatatgtcgcttgttgaatctctaaaagactaatatttaggaacngaaggagtatttttgattcgtgtcatgcatggtttggaaaaatagatgcactatacttattggattgttgttgtgttcatgtgtgggtgtcatttgcattgaaaaacttagcagggataccatgaaatgtgaaatccacgttgagatcactgtatcacatactcactctaattcaacaactcgtcataaatcaattaccacgttgtattgtaatacacatagattcgttcagcaatttaaaaggttcctttcgtattctcgaatggtaggacccaatggcgtaccagccagatcttggctcgtgttgatcctaaaaaaataaaaaataaaaaaaccaggctcgtgtccttctggtggcgtgcgtggtacgcaca

SEQ ID NO: 25174 - DNA, 683 bp, Triticum aestivum
  Clone ID: PAT_TA_25174
ggctgcaggcaagtttataataagctcataaagggtagtttcgacttccgcggccgcgtcggcctttctccttttagatcccactcatggcgatcgccgtaagctccttgacctccggatccttgccgccatacagtccggaggtttctcggcaacgacggagctcacttgtgtctgcatcgcctcgtcgccggcaagccctcgccggcttggccatcaagtcgcggggcatcaaccgtgtccagccgacgaccagaggagcaacacagatccccgcagccgcagctggtccaagctccggagaccgagcaggaggaaacttcccagttcccaacgtgccttcatgggtcaagttgctcgtcggtgtcttctttgccgcagtacctctttacagacagatgagagccctggaagataaggtggagcagacggcagaagtagcaattgaggtggtcgaaaaagtggctgaggcggctgagaaaattgctgacgatgtctctgaagcatttcccggtaatgataacctcaaaaaggcagcatccaggatcaaggccgtcgcagatgaaattgagaaggacgcggagaaagccgagggcctaattgagaagggcgatgagatagagaaagagatggattccgtactgggttccgtgaataaataaggctggactgttcgtttccct

SEQ ID NO: 25175 - DNA, 707 bp, Triticum aestivum
  unsure (1)..(707): unsure at all n locations
  Clone ID: PAT_TA_25175
ctccccgctccccccgatccccaccagtactagtactcccctcccccagcantccatcctcattcttgcccgcacgcatcccctccccttccattcattgctccgtcctgggaggatcgattgattgcccggcgctcctttgactggctcgctcgccgggtgggttgaccccaagtggaatgatcggccagtgantcgatccatccgcaaagcttaagccaagggatcgcggacgcacggccaggtgcgngcagctatggttaacatcggcggcggcggcgtgctgcggcacagcaacagcagccgcctctcgcgcatgtccttctccggcgaggacggccgcggtcgcggcaggcccgggccgcccccggcgccggggcggaccggccgatggtcaccttcgcgcgccgcacccactcgggccgctacgtgagctactcgcgcgacgacctcgacagcgagctggccaacagcgagctggcgggcggcggcggcggcttctcgccggaccgggaggagttcctcagctaccacgtgcacatcccggtcacgccggacaaccagcccatggacccggccatctcggcgcgcgtcgaggagcagtacgtctccaactcgctcttcacnnnnggcttcaacagcgtcacccgcgcccacctcatggacaaggtcatcgactcgnnnnncagcnacccgcagatggccgg

SEQ ID NO: 25176 - DNA, 614 bp, Triticum aestivum
  unsure (1)..(614): unsure at all n locations
  Clone ID: PAT_TA_25176
aaaaatgnggtttgtggggantttancanggagaggagntcccgtcatnttngggagttatttgcctcanctccaggtgtccaatcagttgaagttntctttcatnccnccncaccaaggcgatctgctggctatgcatttgtttccttttcctcgaaagaggaggcagaggcggctatttctaccttcaatggcaaggaattgatgggacgatccattaacgtgatgttcaaagaggacactgtcaaaaagaacaagtnttntgattntgaggaanagaagttggaggaggcagaatcatntgaggagagtgatagctaagaatggattattgtgagaaccacagaaagaagttcaatgagttgatctgcaggactataatgctcttttgctaggttaccaagctcctggttgatttcacccgtcccataactcttgaattgtcaaacaccgtgttctgtaagttcccctcttgatatggatcacatttggaggttagcttgatgctagagtacacgaaatctgtgagctgttgaaatctgagttaatttattgtagaatataagtgttaatgatgaatttgagtgcaaaaaaaaaactcgagacctcgtgcc

SEQ ID NO: 25177 - DNA, 730 bp, Triticum aestivum
  unsure (1)..(730): unsure at all n locations
  Clone ID: PAT_TA_25177
tgctgctgctgctgcagcaaggtcgttgggctgaggcgcagccctctcccggctactacccgagctccaaggtgagctcaatgcccttctcgcagtggtacagcaacctgtggggcgcccagcaccagtccctctccccggaccagacctccctcaccctctggatggaccgcagctcaaggagcgggttcaagtcgaagcgggcgtaccggaacggctacttcggcgtctccatgaanntccagcccggctacaccgccggcgtcaacaccgccttctacctgtccaacaacgaggcgtacccgggataccacgacgagatcgacgtggagctgctgggcaccgtccccggcgagccctacacgctgcagaccaacgtgtacgtccgcggcaccggcgacgcgcaccccatcgtcggccgggagatgcggttccacctctggttcgacccggccgcggccttccaccactacgccgtgctctggaaccccgacgagatcgtcttcctcgtcgacgacgtgcccgtgcgccgctaccagaagaaggtggaggccaccttcccggagcgcgagatgtgggcgtacggctccgtctgggacgcctccgactgggccaccgaacgggcggccgcttcaggtccgaactaccgctaaccaaccccccgtctccggccgcggtgcactgcgacgtccccggctgctccgccccgcgcccccgggtcttgcggccc

SEQ ID NO: 25178 - DNA, 463 bp, Triticum aestivum
  unsure (1)..(463): unsure at all n locations
  Clone ID: PAT_TA_25178
cttccccctcggcccccctcccatcctccccttctctctccactttgagcaaaaaaataatcgaaaacccccgactccgccgagcgagcatcacctttccgccgctcctcgccgcacgccggcccgccgaccgagaccctcagacccgccccccctctagcccgcccgcccgcccgcatggccgccgatcgccggcccggcgtctgagggagcgggcggctggcgctcgggggccanggccggcgggcgcgattggaagctgtccgggaaccccgggacgtgggagcgggccccccgctgcggctggggccanttcctcttcgccgccggngtccgtttgccgtcatgtcctcccgcgattggggtttgccaactaaaacgcctttttgntacttgnatngatcaaatgggactaaaaagcaactcttggangcnttnggaaattgnntttttctgnnngggt

SEQ ID NO: 25179 - DNA, 692 bp, Triticum aestivum
  Clone ID: PAT_TA_25179
gtgcccatgacagctgaggtgacattaccggtactggcaccggcgagcgcgacaccggccatgactacactcggcatggagaagccgggagtgaagctcaatggtaagaagtctcatactgaaatgatgcagatcatggatgaagctagtgaacttctgaagaaaggcaatgacttcctctcgctgaatgaggagaacgttaagcctttgttgagtatggatggatcagctgatgcatggtggcttgatagtggtgctagtaaccacatgactggttcacggtgcaaattcaaggagatggatgaaagcatccgtggccatgtgaagctcggagatgggtctactgctctgattaaagggaaaggttcagtcattgttgaatgcaagagcggtgagcagctgcatctgacagaggtatattttgtaccaagtttacctagtaacataattagtcttggtaagctggcagaggatggcaatcgtgtagtgctagatggtacattcttgtgggttagaggcaggtctggaaagatgcagatgaaggttaagagatcacccaaccggctgtacaaggtgctactcaagacagccgttggcgcttctcatgtgtcatcaacaaagttgagcccagaatctttcagacaccagcagcagcagcctcacatgtatggagatgccaacaagaaaggggg

SEQ ID NO: 25180 - DNA, 859 bp, Triticum aestivum
  Clone ID: PAT_TA_25180
cgtccgcccacgcgtccgcggacgcgtgggtgggttttcagtgttcatgggcttttcagttccacagtacttcaacgagtacacatccgtcgctggatttggccctgtacacacacgcgcaagatggttcaacgacatggtgaatgtgctgttctcgtccaaggctttcgtcggtggcattgttgcatacgtgctggacaacacgctacacaggcatgacggcgctgtaaggaaagaccgcgggtaccactggtgggacaaggttccggtcgaccggaccggccccaaggggcggggggtttactcccttgcggttaaccttaaccaggtctttcccttgggttggacaaaactgggataaatgcaacaaggaaagaagggtacatgtaccttctatctgcctctcccccaagttctctgaaggtggaaactgttgggctgaactgtcttggtgcagggaaatcctatgcccttaatcagggtccgaaccctatggtataatcggagtttcggtgtctcgctagaactatgttccgtatgttaggttaccgctgtatatttgataccctattcggggcaacgactaggaagttttgctactcatttgcatatgggaagggtgcgctagttcttagttcttacctctagtagtttatctcattctgaaacgaggtcactttattgactgccattgtggtgctactacttagcagtgaagctagattctgtatgttgtaggctttagcagaacaatcgaatggtactctacctgttatgctatgtatcagtggatttgcggtatgacactaatagtaatgttgtcgggtggtgaatgaaatgtcggtcgttatgggtgagc

SEQ ID NO: 25181 - DNA, 864 bp, Triticum aestivum
  Clone ID: PAT_TA_25181
caccaaggacctcagttgcagtggagaatgttggtttacttgctgtgacacatgttggcagcaggagagtggtgcaaatatctgccggcttcatgattttctttgctgtcctaggaaaatttggagccctgttcgcgtccattccactgcctatatttgctgggatgtactgtgttttcttcgcatatgtcggtgcgtgcggtctgagcttcctccagttctgcaacctgaacagcttcaggaccaagttcatcctgggcttctccttcttcatcggcatatcggtgcctcagtacttcaacgagtacgcctccgtctcgggccacggcccggtgcacacgggcgctagatggttcaacgacatgatcaacgtgcccttctcgaacaagccgttcgtggcggggctggtggcctacttcctggacaactcgatgcacctgcaccagagcgcggtgaggaaggacagaggctaccactggtgggacaagttcaggagcttcaagaaggacgcaaggagcgaggagttctactccctgcccttcaacctcaacaagttcttcccttcggtctaaatcgtcgcgggaaagggcgctgtcgatccccttgttcgtgcattggctgaacatgaatgggcctgctagcttgatctgtcgagttttcgtggtgccgctgtgcgtcagttttgtgtatttatgggcgagatggactgattggaccagtggggacgctatgctagttttggatcaacgtctcgtaagtcatagcctgttgttcatctgtggatgtacatgcggtttccctagcccaggaaaaaagatcatcattactaaggtggctttgctataatttatttcctagtcctag

SEQ ID NO: 25182 - DNA, 722 bp, Triticum aestivum
  Clone ID: PAT_TA_25182
gccggccgggttgggatcgcctctgtctagatctccaccccagccaaacttttctcgccttcgaagaagaagcagccgccgccagcatccatggcccccaaggctgctgagaagaagcctgtggagaagacccccgcgggcaagaagcccaaggcggagaagaaggtgccggcgtccaaggagggcggcgacaagaaggggaagaagaaggccaagaaaagcgtggagacgtacaagatctacatcttcaaggtgctcaagcaggtgcaccccgacatcggcatctcctccaaggccatgtccatcatgaactccttcatcaacgacatctttgagaagctcgccggcgagtctgccaagctcgcgcgctacaacaagaagcccaccatcacgtcccgcgagatccagacctccgtccgcctcgtcctccccggcgagctcgccaagcacgccgtctccgagggcaccaaggccgtcaccaagttcacctcgtcctaggctcctcgtgcattagttcttgtgtttctttcctcttcgttgtctgatgaattctgtagctagctgtgtgtgttctgacagcgtcatactgtaacaatggtgctgcctgaataaatagtcatgttgctgcttgaatggacgactgtcgccttggaaaaaaaaaaaatataaaaaaaaaaaaaaactacaaaaaataaaaaaaatatcaaaaatcaaatcaaaac

SEQ ID NO: 25183 - DNA, 2519 bp, Triticum aestivum
  Clone ID: PAT_TA_25183
gccccgctcgcggctccccccctccaccccccccaaacttctctctcgcctttgtagaagcagcagccgccgccgtagcatccatggcacccaaggcctgctgagaagaagcctggggagaagacccccccggggaaaaagccctaggccgcctagaaagtccgcgggtccaaggaggggggccccaaagagggccaagaagaaggccagtagagaggagcgccgcggagaatccgcccaaggcagaggagaaggtacgggcgcccaagcagggcgggctcctccaggggcagatgcaggccaaaatccttgtgcaaacgtacaatctctaaatctgccaggtgctcaggcaggcgcgccccgtcatcgaacatcgcctccaacgccatctccgtcatgcacacctcccaccaacgacatctttgcggagcgctcgggagagcccgccaagcccacgcggcccaaggcggagcccaggttcacgtccccggaggtccagaccgacgtgctcctggtgctccctgccgagctcggtttgcaggctttctccgacggcatcttggcggtccccaagttcaccccatcccaaagtggtctcgtgtagaatgttgtgtttctcttgtcttcctcgactgatgaaatctgtaacaagctctgttgtgttctcgacagtgtcatcttgtaacaatggagctgcctcattacatcccggggtttccgcacctacgtcagcctcgtcctccccggcgagctcgccaagcacgccgtctccgagggcactaaggctgtcaccaagggcacctcgtcctaggctcctcctgcattagttctagtgtttatttcctctccctcgtctgatgaattctgtagctagctgtgtgtgttctgacagcgtcatcctgtaacaatggtgctgcctgagcaaaggatcatgttgctgcttgtatccaacggtcgctaaatgtgttaagtttgttccgcctgaactgatcctcttggtgatattagctgtgtacctgcaccatactatacatatgatgacgtctatcttcgacctgggtcctgttctattcattataccggtagtgtggtttcatgcatatctgcatgtggttggatgagcttacagcgttgtttgacggattacccattttcattgccgcactgaccggtctgtttaaataggtggtgccacaatgaataggggctacatatcccttccagtggggagctccaacttttgatgctggcgaagcttttgccatgatggctgcatcatttgttgctctggtggagtctactggttccttcattgctgtttcaagatttgcaagtgccacacctctcccaccctctgtacttagccgtggtgttggctggcagggtgttggtatccttctggatgggttatttggaactggaaatggatcttctgtatcgattgaaaatgctgggttgctagccttgacacgtgttggtagccgaagagtagtgcaaatatcagctggttttatgatattcttctctatccttggaaaatttggagctgtctttgcatcaatacctgcacccatctttgcagccctctactgcgtcttctttgcatacgttggttctgctgggcttggcttccttcagttctgcaatctcaatagcttcaggacaaagttcatccttgggttctctgtgttcatgggcttttcagttccacagtacttcaacgagtacacgtccgtcgcggggttcggccctgtacacacgcgtgcaagatggttcaacgacatggtgaatgtgctgttctcgtccaaggctttcgttggtggcattgttgcatacgtgctggacaacacgctacacaggcatgacggcgctgtcaggaaagaccgcggataccactggtgggacaagttccggtcgtaccggaccgacacaaggagcgaggagttctactccctgccgttcaacctcaacaagttcttcccctcggtttgagcaaagctgtgattaatgcaacaaggcactaaggttacctgtactatctgcctctcccccaagttctctgaaagtgccaaactgttgggctgaactgtcttgctgcagggaaatcctatgcccttaatcagggtccaaaccctatggtataatcggcgtttcggtgtctcgctagaactatgttccgctatgttaggttaccgctgtatatttgataccctattcggggcaatgactaggaagttttgctactcatttgcatatgggaagggtgcgttagttcttagttcttacctctagtagtttatctcattctgagacgtggtcactctattgacagccattgtggcgctactacttagcagtgaagctatgatctgtatgttgtaggttttagcagaacaatcgaatggtattctacctgttatgctatgtatctgtggaattgcggtatgacactaatataatgttgtccttatggatgattaataatttcctacacacagtttgcagctaaaaaaaaaaaa

SEQ ID NO: 25184 - DNA, 785 bp, Triticum aestivum
  Clone ID: PAT_TA_25184
cccgctcgcctctctgccacctcctttctgccgcccaaaagagagaggaagttttcgcctcgggatgccgctggctgcctttccgctgctagtctagtcccttcctgcgagtagcctcctccctctccagcgagcttctcttctcttctcttccctttccttgcagcgagggagaagggaggaggaagagagcgtgcgcgggggagcgtaaggtggctttctggggggatagattccattcctctccttggaggaggaggaggaggagaagtagtagtggggaattgggtagctaggccagatcaattgctttctctcgattctctgcgccttttctccaactttactctcccccgtggttggttggttggttgttccttgcttgcgagggggttctcggttcttggcagaaaagaacgacagatcagtcggtcagtcagtccagtcccctgttcctgtgcgagtggcgagtgaagtgacgggcgtggtttcttgggagtttggagccggaggaagaagaagatggcagccgcgccgccgcccaaggccgacgagctgcagccgcatccgcccaaggagcagctgcccagcgtctccttctgtatcaccagtccgccgccatggcccgaggccgtgattctaggatttcagcatttcatagtcatgctgggcaccaccgtcatcataccaagcgcgcttgttcctcaaatgggaggtggaaatgaggaggaagctcgggtaatccagacgctccttgttcgtcgccggcataaacaccttactgc

SEQ ID NO: 25185 - DNA, 485 bp, Triticum aestivum
  unsure (1)..(485): unsure at all n locations
  Clone ID: PAT_TA_25185
ggtagagcgcatcatttaagccaagcaaggtgtggtcaatacaaatccaccatgaagacatttctcatccttgccctccttgctatcgtggcgaccaccgccacaactgcagttagagttccagtgccacaattgcagccacaaaatccatctcagcaacagccacaagagcaagttccattggtacaacaacaacaatttctagggcagcaacaaccatttccaccacaacaaccatatccacagccgcaaccatttccatcacaacaaccatatctgcagctgcaaccatttccgcaagccgcaactaccatattcgcaagccacaaccatttcgaccacaacaagccatatccacaaccgcaaccaacagttattcgcaacctacaacaaaccaattttcacaggcaagcaagcagcaggcaagcaatcaacaacaagcancnaggaacnaccaacttcttcaacaaattttggcancaant

SEQ ID NO: 25186 - DNA, 457 bp, Triticum aestivum
  unsure (1)..(457): unsure at all n locations
  Clone ID: PAT_TA_25186
gtgattcagttgagtcccagtgctcagtgtttctctcttcccttctttttgaaaactataccgagattacatggtgctgtttggcacaataaaaccaaggaacacatacggtgtgtgcagaggccctgtcgctagcggcctcaagattgaaactttaaacaacttgacgctcgagacgattttcttcaacttgtgcaaagcttgtcaaatcaaaagcatggcttcaattccaccctccgcgttctctgctagccgcatccgcgacacgcaagcgtgatatgaagatatccaataagaccaaagggaatgaatctaccaagttttttaacactacgttcaaggagtggtcgccattgaaatacaacaagcaatgctaatgaacagtatctggggtctggtataaccgatattctccacataacgtgaangaaaatcaaccgatgctcacgaccccaag

SEQ ID NO: 25187 - DNA, 591 bp, Triticum aestivum
  unsure (1)..(591): unsure at all n locations
  Clone ID: PAT_TA_25187
gtccatgacctttaactggagctattggagttttaattttagtcacaggtatagtaaaatgatttcataattttaatataaatttattaattttaggatattttattgttattttaacaatatttcaatgatgacgagagggagggcgagagggaactttacaaggtaaacatacaattttagttacaaagggactccgatgaggaataattttatttattgtatcagaaattttcttttttgtatcttttttttgagcttttttccatagaagtcttgcccctaatattgaaattggagcaatttgacccccaacaagaattatcccatttaatcctttccaaatccccttattaaatactattattttaattagttcagggggatcctgtaacttgagcccatcatgcaatttatagaaaataataattcccaaataactcaagggggatttatcacaattatattaggaatttattttactattttacaagcatatgaatattttgaaagccccttttactattgcagatagaatttaagggatnaacattttttataagcaactggattccatgggcttcaatgttn

SEQ ID NO: 25188 - DNA, 566 bp, Triticum aestivum
  unsure (1)..(566): unsure at all n locations
  Clone ID: PAT_TA_25188
ccttagtcttcacgaagactttgtaaaataaaacctttatacacaatatctgtgttgttcacaaaacgaccgcaagcaacacagtattttgtatattgccaaaaataagccatttaatagatgagataaaccgattcctggggaatattagttttagggcggtcattatgggtcgtggaaatcgatccaacaggggtagagggcgtagaaatttcaccaatcctatgccagttgctacagtccctgttaacctccgaccatcattttgcgttccggttacagttaatgtctcgtcaactggcagtgctactgtcggaacatctgtaccgtcctccttggcgggtaaagcgtggcgaagtaacatctatcgccgttaccctagcccttcagcgcagccgcaagcgaccggttattattaaggttgcacggtaattccccagctgggaatttaataacgatncaaagccgtcctatcgttggcgctgttggacatcangaggttaggatgcgcaactcccgacacgtaaaccaagaagattggtaccgcttcaaatttaatttatttt

SEQ ID NO: 25189 - DNA, 500 bp, Triticum aestivum
  unsure (1)..(500): unsure at all n locations
  Clone ID: PAT_TA_25189
gtcaaagaaagcttgaccatgaagcaaatagttgctaatcaaaaagtgaagatccctgaggggctcactgtgcacgttaaatcgcggttggtgacagtgaaaggaccgcgcggagtattgaagaggaacttcaagcacttggctgttgacattcgcatggttggcccgcgagtcctgaaggtagagaaatggttcggttccaagaaggagctcgccgctgtcaggacagtctgctcacacgttgagaacatgatcaaaggtgtgaccaagggattccaagtacaaaatgcgttcaagtatacgcccatttccccatcaactgtgtcaccattgagggcaacagtgtcattgaaatccgtaacttccttggggagaaatacatcaggagggtaaagatggcacctggtgtgaccgtcgtcaactcccccaagcaaaaggacgaagctgatcattgaaggcaactcttttggagggatgtgtccanctcaactgnccttatc

SEQ ID NO: 25190 - DNA, 658 bp, Triticum aestivum
  unsure (1)..(658): unsure at all n locations
  Clone ID: PAT_TA_25190
gcacgagggtatcattcaagccaagcaagcagtggtcaatacaaatccaccatgaagacctttctcatcctttccctccttgctatcgtggcgaccactgccacaactgcagttagagttccagtgccacaattgcagccgcaaaatccatctcagcaacaaccacaagagcaagtttcgttggtgcaacaactacaatatccagggcaacaacaaccatttccaccacaacagccatatccgcagccgcaaccatttccatcacaacaaccattgccgcaaccgcaaccatttctgccacaactaccatatccgcagccacaaccatttccaccacaacaaccatatccacaaccgcaaccacagtatccgcaaccacaacaaccaatttcacagcaacaagcacaacaagcacaacaacaacaacaacaacaacaacaacaacaacaacaacaacaacaacaacaacaacaacaacaacaaatccttcaacaaattctgcaacaacaacaactgattccatgcagggatgtcgtcttgcaacaacacaacatagcgcatgcaagctcacaagtattgcaacaaagtagttaccaactgttgcaacaattatgttgtcaacgtttgtggcagatnnnngngcagtcgcnntgccaan

SEQ ID NO: 25191 - DNA, 890 bp, Triticum aestivum
  unsure (1)..(890): unsure at all n locations
  Clone ID: PAT_TA_25191
nctagttctagcttgtaaggccttcttgtcacccatcatagcttctatagtgtaggtccgatcagcaccagcaaatgtctccactcttgatttcctgcctggaataactggtattgcagcttgctcataagcaaatttggtatatacatcaatcatctgcatcgcctccttctctgcctcttcaagggttgcatgagctgtatgaccttcttgccataaaaattcaagagttctgatgaatggcttagtcctcatttcccatcttgtcacattggcccactgattaatcatgagagggagatcacgatagctctggatccatttagtgaacatgtgatttacgatggtttcacttgttggtcttaccacaagtttttcctccagctcctttcctcctccaatggtaactactgcaagctccgggctaaacccttggacatgactggcctccttctctataaacgagtacggtatgaactgagggaagtacatgttgctgtgccccgtctccttgaactttacattcaaataatcctgtatggcctcccagatggcgtagccgtaggggcggatgaccatggtgccccgcactggcccgtagtccgcgagctcggcggcagcgatcacgtccgtgtaccaggcgttgaagtccgtcgaccgcggcgtcacctgcccctccctgtcgccgccgcgtgtctccatcttaacgggcgctgccgaggaagcacccgcggttgtagcggcagggaatagcctcgccggagacgtgtggaggcagcggccccggtggcggagcagggccgccggtctggccgccgccggcacgagtagcgaggggaggcgcagcagcgagccccgcggccgcgatgtcgagttggattgggggtgtg

SEQ ID NO: 25192 - DNA, 561 bp, Triticum aestivum
  unsure (1)..(561): unsure at all n locations
  Clone ID: PAT_TA_25192
cggacgccgatgtgcaggggggcggagccgctggcgcggttcagggagcaccggctgtcggcctcggcgtgctccaacaggacgcaggtcccggcgtgcagcatgaagctcaagtacgcgccgtaccttaagctgcccggcggcctggggctgcagggcgcgaccctggtcgtcatcaagccctccggcgatggggctggtggctgtcacgttggccggaaggagactgatgcttttgtctcgggcgcgttcgatgggcctttcaggttcgcggccaaggcgctgatgaagcggcgcacctatctgctggagatgaacgggttctagatgccgttgaggtgtttgtggatggacatcttgcttttgcagtgcttctcatggacaactgttttctgctcgggcaaatgcagcttttgaattgtagtgttgcatataatctgctgcattactagttgacagatgggtttacatatatgctcatcagctcatgggcagagtgctggcgtcttatctgtggcgtttgggtgcnngctacacaccngagaaaaaaagccaggggcg

SEQ ID NO: 25193 - DNA, 384 bp, Triticum aestivum
  Clone ID: PAT_TA_25193
cggacgcgtgggccaggaggaggtgctgagtagccgcacccccgggagctctgccctgcacagcgccgccgcggcggcgacggcgcctacttggcccgaccagggagacgtgacgtccacccggcaatacggtggcaccgttagctttggagagtaccttgatgactatgcgtccctcggggacctagtgtcgtacgtactcgatcattgatcggtcgagctgtggaccgggaggcgcccaagcatcgatcgactcggcgcgtgtaaatcgaaataatggctgcgcggatcctcgatcttcctgagcacttgagcagcaaccactgcgcgtcgtagtttagtttgaagtgcctctgtaaagaaatataagagcgttgggagtac

SEQ ID NO: 25194 - DNA, 972 bp, Triticum aestivum
  unsure (1)..(972): unsure at all n locations
  Clone ID: PAT_TA_25194
ctcgactttctccgacagctgccacctgcccttgccttgctggtccagaagcgcgagcactggtggtagacggtagtggtgcgcgcgcgagcgaggtagctagagcaggagagtgtccgagttcagagatgtccatggcgccgtacgagaaggtgatggatgacctggccaaggggcagcagttcgcgacgcagctgcagggcctcctccgggactcccccaaggccggccacatcatggaccacgatcctccacaccttctcccgcgccatccacgccgccaaggccgcggccgcggccagcgccagcgagagcgaggtcaccgatggcgcaagcagcggcgggaacgaggaagtccgccgccggtggaggaccgcgcaaggcctgtcgggcaaaggacccaaggattccgtccgtccgtgacgaagaacatgaagaccttggatggacgggcagacctggcgcaaaataccgggcacgaaggagattactgaactccaaggactcaaaggcctacttccgggtgcacgcacaagtacgaccagcagtgcctggcgcaggcggcacgcccagcgctgcgacgacgacccggacacgttcaggggcaaccacatcgccgggcacacccgccgcgaccccgcggcccgacggcgccctggcatcccacacgcttcacctcgaccgccgccgacggcaccaccaccagcaccaccacaacctatgacaacgccaccagcaccagctcttcgacgacgaccggcctgctacggcgtcgcatgaagcttgagggcggcgacccccaggaggtgctgagcagccgcacgcccgggagctctgccccggacaaagggactcacntcaacgccatagtggcgtcctgcttgaaaatcttgtttcatggtaccgttttcagactcctgctaaattcacattgttgncacttgtttgangttacctttaccacntaanatt

SEQ ID NO: 25195 - DNA, 661 bp, Triticum aestivum
  unsure (1)..(661): unsure at all n locations
  Clone ID: PAT_TA_25195
gcacgaggaaaactcgaggaagcagcacgctatgagttgagatacagacacaaaaatagagccggaaaagctaacacaaaaacagcttctaaaccagaggatgtaatacttagtgaacttcttggaggtgatagtgtgcaaggtcagctttctcgtagggaatctctgggttctgaggttcctgggagaaccgtaagcactgccagtgcatccagttctggttccagaaaagccagtatggatgggaatggtgatggaagcctttccactgaagcacaaaattatgaactcaacaacactgcatccatttttactccggaagaactgcgtcaacaagcagtagaggagaagggaaagtacaaaatactgaagtcagaaggaaaacctgaggaagcactgcgggcgttcaagcatggtaaagagcttgagaggcaagccgcagcacttgaattagaattgagaaagagcacgagaatggcgacaaaagctcccaatgttaagtgccgtttgttgggtnacccagaaagattgaggatttatgattgacgctgtaaccgaaaaaaggctccaaaggtggggaaaaaggggttaggaaaagaaaangaatgatcttgcttctgaactcaaaggtcttancgcggcgtccagatgcaaaatnttt

SEQ ID NO: 25196 - DNA, 349 bp, Triticum aestivum
  unsure (1)..(349): unsure at all n locations
  Clone ID: PAT_TA_25196
gcagagcacaggcctcctctgaaggctgaaggtgacgaccacgcctcaggcggcgccattgccatggcggacaagatctccacggttgtcctcaaagttgaccttgaatgcacgcgatgctacaggaagatgaggaaggtcctctgcaagatccaagacaagatgaacatcaagaccatctccttcgacgagaagagcaactccgtgacggtgtccggggccgttcgaccccgacaagctgtgccggaagctctgctgcgaggccggccggggtgatcaaagaaaattcatgnaaatggncaagggagcagaaaggcgggacaanggaccggcggtcgncnggctgccg

SEQ ID NO: 25197 - DNA, 513 bp, Triticum aestivum
  Clone ID: PAT_TA_25197
gcacgaggatctccctcccaacctgtagccaggcgacatcttcaacagaagaagcagcgagcaagccaagatggaggcgctgaagcagaaggcgaaggacatggtcaccacgcgcgagggcgcgctgggagccgtggcggtggtcgccggcgccgtgggcgcctacttcttctggcctgccggtgtggccgccggcgccatgatgaaggccccaaggcgccgccggattcctcatctcacgcgcggccttcctgggcaacccgcaactctacttccatctcctgcgcaacgccggacccaaggcagcggccgccgcctgcctttactagggaagcgcagcacatgcatccatgcatgcatgtccctccccactggctacttcactctccgcgccatctaactgcgaggtctggtcgctgggtccctgtccacctcatgttactggtccacggccccgtatctggtcacccccctctacaaagatccttctgtcgatcctaccgaagttccatg

SEQ ID NO: 25198 - DNA, 1164 bp, Triticum aestivum
  Clone ID: PAT_TA_25198
ttgagcggccgcccgggcaggtcgaacaaaccgctggttgttacctacacaggacttattcaaacttgcatagatagtggaagcatagaaaatgctaatacatattcaaagaaatgtgcaattactgtcacctaataatgtgacttgcaacattatgctgaagtcatacattgatcatggaaagtttgaagacgcgaaagatctactggagaatattctaaatggcaggataaggaacaaagcgggtttgggtcaacaagcagttgcagacaagtttactttcaatagtttcttggatgcttgtgctgaagcaaaaaagtggaatgacttcgagtacgcatttcgtgaaatgttatctaacggctaccattttgacgaacgaaggcacctacgtatggtacttgatgcctataggagcgggaaggagcagctgctggaacacgtatgggactacctgtgtcacagtggccgggttccaccggctgccatgataatggaaagattctgcctaaaactgagacaaggccatacgacggcagcactctcctgcatcagcagcttcgaggagagcaagataggcagcgtttcctccaagtcgtggtcgaatcttctgaaccggaacgcggacctcctcgaggaggagagcgtcgccaagcttgtccatgaactcgatgacttctcaaggccagggagttcctgcccttccttgtacgaaaatattctgagcagctgtacagaattccttggtggttctggtggaaaggcagcttctgatggacggatgcctttgtgtaattcttgaccgctatgttagcctcctatcctttcgccgttcaaagttcggttatcagtgggtagggaaccactggtctgcttgtggctctcatgctcttttccaagaagaccaactttgatgatattactactgtaccagagtaggagtagcattttggttgggttggttgctggtaattggcaaaagcaacctttggcattcccatcgtcccccttggcgatgcgtggcctaagcatgtttgcgtgttgtttcctcctccaatgggtggtaacaagtggacagagcgaaaggtttcccggatcccggtgaacagggatacatggccttattatagctatatgttccgcccccccaaaatttcctggtcc

SEQ ID NO: 25199 - DNA, 1771 bp, Triticum aestivum
  Clone ID: PAT_TA_25199
gcgagccgctgcggctgtccgtcccggcccgtgctgctgagctgggagccctaccggacccgcctcggggggcgctccccccggcggctggcggcggcgccgcggatcaccgggcgcgagtccaacgcctgccatgaccggcatccgccgctccgcgcttcatacgttgcattaaaccaaagaatttgcagctccctgccatttacggacaagaacttgtgcttcaccaactgaaatgctgcggggttcttgaagttgtgcgcatttcaagatctgggtacccaacgagaatgactcatcagaagtttgctcggcggtatggttttcttcttcttgaggatgttgcgtctcaagatccacttagtgtttcggttgcaattcttcatcaattcaacattttgcctgagatgtatcaagttggctacacaaagttgttcttccgaactggtcagattggcaaccttgagaatactcggaatcgtactctacatggtgttttaagggttcaaagctgtttcagaggggatcaagcacggcgccatgcaagtgaacgaatcagaggagttttggtctcttcaatcattcattctgtgctgagaatgcaaggcaaagttattcatctctgttgaggaaacatagggcagccactcttgtgcagaaaaatctaagaggctggcgtgcaagaagatacttcatcaagatacggaaggcttcagtggttatacaatctggtatccgcggctgccttgttagaagatgcgccggcaatgtcgatctactgaacgtgttgagagaattcgagtcgaaaaaggaggcagacggcgaccaaatcttgatcaaggcgtctttcctggccgagctacaacggcgaatccttcgtgccgaggcgacagttcgagagaaggacgaggagaacgagatgctacaccagcggctccagcaatacgagaaccggtggctagaatacgagcagaaaatgaaggcgatggaggagatgtggcagaagcagatgcggtcgctgcagtcgagcctgtcggtggccaagaagagcctggccctggacgagacgcctcggatgtccgactcgtccgtggagcagagctgggagagcaacgggaaccacgtcggcgggggctcctcccagcagctggccgcggcgccgcggatcaccgggcgcgagatgaacgccagcatgagcgtcatcgggcggctggcggaggagctggagcagcggagccaggttttcgccgacgacgccaagttcctggtggaggtcaagtccgggcaggcggacgcgagcctgaacccggacgtggagctccgcaggctgaagcagaacttcgactcgtggaagaaggacttcggctcccgcatcagggagaccaaggtgatcctgaacaagctcgcgagcggcggcggcggcggcaacgagtcctcccccaactcggccaagcggaagtggtggggcaggctcaacacctccaagttctcgtgagtgtatggtgatggtgacggtgtagacgcgccggcattttacacgccggcgctagtcctagagaggtttgtgagtgctgctgcggagtccagtgttttgggctggatgagtatgtatgtgattcgtggagggcgagttgtatagttcttccactggggggctgcttcttttctaggccacccatgaaccactgagttgtgatgtaattacttgctaagatataccactacttgaaggggagagattggggattgattgctcagttctttttctttt

SEQ ID NO: 25200 - DNA, 1292 bp, Triticum aestivum
  Clone ID: PAT_TA_25200
ccgttgggcgcggtcaccggctcccacggctcccacgtgcaactaagtgcgcgtgctcaccaagtgctggacgggcgcgccgttgggcgcggtcaccgcagcgtggaagcccaggggcggcgcgaacgcgcgtgtcgccgtcgtggggtgccgctgggggacgcgggctccctcggctggcggcctctggctgggagcggccggatctgacgggcctcgccggccggatctggcgctatggaggccggaggcccggaggtggctcggccggcgactgtttgcaagcggattgcgtggtggcttctagtcgggatggtggtctggggtagcgtggtctgggcagtgccttcgggatgctctgggcttgcgctgccggcggtgctccggctagttttgggcggtgcagcaagtagcatctgctgctccgatctggtggtggtgtgttggagacgtcgtcccagcataggtgctcggttcctgacgaaagtcatgctcaactacggtttgggctgatggcgaatgatgcctttgggtgtgattttccttgttgaaggcgccatcgaggggatctgacacctctccttgctctatgttcttgtctcccggtgaaaaccgtgtgcaatggtcgcgccagtggtgtcattactttgttggaagcattgccttggaggcaaatctggtgtgaggagcacttggtcagtggtggtgtggtggatctggagcgggcagcgttttggtgagcttggagcttttggtggtgcatccgtttgcggctggtcgttcggtcaacggtgagagcaacaagagcaaccttcacatgcaagttgcgccaggcgagctatgtctacttgcctcgcgggatcggagcggcatatgtatcgctctttcggacatatcgttcctctccggtgtcctcgatgtttgtagatatgctcgtggcagcccggtacaagacgacggttgtcggtgtgcattttggtagcagcgaaggcgctcgagtgcccgcccgggtgtgttgtggggttttggctttccggcgcttttgtatgtgttgtgatgctttagacctagtctaactaggcgttgcttggtttttgcccggttttccttaataaaccgagcagtccttttttcgttctttttttttagcactcgtctttatgcggtgcattcctcctttgagggtgttcttgtaatacctttttctgatcaacgaatttggcagttctcctgtcaacgttcaaaaaaattaatgttaaaaaacaaaaaaaaaaaacggactgggcggtccg

SEQ ID NO: 25201 - DNA, 415 bp, Triticum aestivum
  unsure (1)..(415): unsure at all n locations
  Clone ID: PAT_TA_25201
agcatcaaatccaagtnagtngtatttaacgcaantccancatgaagaccttactcttcctaacantccttgcgatggcannaacaatcgccactgccaatatgcaggtcgaccctagcagccgagtacattggncacaaagatgcaaccacccccccagtcccaacaaccattctcccagcaaccacatcatatntttccccatgccccattcaatacattcccccatcagccacaacaatgcatttccccaacctcaacaaaccttcccccgtcgaccacaacaacaatttccccagccccagnaaccacaacacccatttcctcagccccaacaaccccaactaccatttccccaacaaccacagcatttcattccncccagcctcaacaaancccatnagccatttcccca

SEQ ID NO: 25202 - DNA, 997 bp, Triticum aestivum
  Clone ID: PAT_TA_25202
cgtccggagcaaggaaggctctgcctgccaacaagagccttccttttacagcgcctgtctcttctgggctccttctatgacccaagtccccactcgcgtccggtttctttccattctcggcaacgcacaccaccaccaccaccagagtagtcgtcttccagtgacagtataaaatagagactctcctcaccctcctcgtagcgagcgagcgagcgagcgcggcaacaggcaacaagagcagaggagaagccagatccgaagccgccgcctccgtcgaacccggacaagaacagcaatctcgccaatggatatggagctcgacgccgctcgccacgggttcgccaagatgggcttcgggtgcaagcactaccggaggcggtgcaggatccgggcgccttgctgcaacgacgtcttccactgccgccattgccacaactactccacgaaagacgggcacgagctcgaccgccacgcagttgaatcggttatatgcctcgtctgcgacaccgagcagccggtggcgcaagtgtgcagcaactgcggcgtgtgcatgggggagtacttctgccgggcgtgcaaattcttcgacgacgatgtcgacaaggagcaataccactgcaaagactgcggcatctgcagagttgggggcaaggacaacttctttcactgccacaagtgcggatcgtgctactcggtgaccctccgggataagcatgtctgcatcgaggactcgatgaagaacaactgcccgatctgctacgagtacctgttcgactccctgagggaggcgtcggtgctgcgatgcggccacaccatgcacttgcagtgcttccacgagatgctcaagcacgacaagttcacttgccccatgtgctccgtgtccatctttgacatggagaaattcctgagggccttagatgccgagattgaggcgaagttcttacacatgggaaagggatggatcgtgtgcaaccactgctgggacacgacccgggtg

SEQ ID NO: 25203 - DNA, 1188 bp, Triticum aestivum
  Clone ID: PAT_TA_25203
tcggcagcaggtatgcaacacacttattactaaatgccttgggctaagcttagatcgcttggccaggttgtcctggtcagcggctgggtagcgagcgcaggagaagagatatcgctacactggttccccagggacagccccgggaggcggggcgggcgggggcgacgagggccgtgggggtggagggggcgcggatggggggggagatgcggacgccgatgccggaggacctcatgcacgcgctggcggtggcagaagcgggggtagtgggtctgggtatagcggtgcgaccgatggcggtggtgcctccggcaactcaagccaatgctacttgtaccaggggggagcgcagggtgggaaaaaaggtgggagcccgtgcggaggcggagagggtggctgggggggcggggacgatgcctgcagccatcgaggctcaataagcgatgggctagagcccgccataggatcgggctcgctccaggctatgaatcaagtttgttctttcttcaccattgcagatggtttcgtaatacttggcgtccttgccggggttgcagatagggaacccggagatgtggaagtacatggacacgattagattggcgcaactccttgaagcttcttcgtgcaatcaaaacagtgcaataggccaagctattgtcgttcgcttttttccatttgctcttgtatttttcctatgtttccatctattagagacgagtgttcatctgacgcatgacaaaattcttcaaaaataatatggagacggggtattacactgtgaaaaacttcggcatctgactcctaaccgtattggacaacttcttacactgccacaagtgcggatcgtgctactcggtgaccctccgggataagcatgtctgcatcgaggactcgatgaagaacaactgcccgatctgctacgagtacctgttcgactccctgagggaggcgtcggtgctgcgatgcggccacaccatgcacttgcagtgcttccacgagatgctcaagcacgacaagttcacttgccccatgtgctccgtgtccatctttgacatggagaaattcctgagggccttagatgccgagattgaggcgaagttcttacacatgggaaagggatggatcgtgtgcaaccactgctgggacacgacccgggtgtatccgggcatgacgggacagagaaag

SEQ ID NO: 25204 - DNA, 989 bp, Triticum aestivum
  Clone ID: PAT_TA_25204
tcgcgatctagaactagcgaggttgaatcctcgccgacacagcgcggctccatcagggcaccagccgccggaggatggcggcgctgcccgcgagccgccgcctcctcctcctgctccggccggagctggagccgtgcctgcgctcccgcgcccttaacccctgctccggccgggcgaggtgggcgggcgggctccggcgcgcgcctccgctcgtgagctgccggcgaggtttctccgacgaggggggcgcgtacgccgcgaagaacagtgctccggacgagcagttcctgcagctctcgttggacgagggagaaggcgatggcgtggtgcctggaatcagcgaaagcgtgctgaaggatgcgaagaagagcgccatcgaactgcttgctgtcagggcatatagtgtttctgagctcaggaagaaactatgtggtaagaattattctgtcgacacagtcaactctgtgattgctgatttcaagtcaaggggtctgttgaatgatggttattatgcggaatcattttcacgatcccggtggcaatcatcaacttggggtccaaggcgtataaagcaggcgcttcgccagaaaggggtgccagaggccgaagtggaccaggcgacgaggagcgtgttccaggacgaccgtggtgacgaagaccaggcctcacatggcctctcagaagcttccatggatcatctctttgctcaggcctcgaagcagtggctgcgagggagcagcttgcccctggagaagcggcgtgcgcgcatcgtgaggtggcttcagtacagagggttcagctggggcgtgaccaactccattatcaggaagctggaggcacagcaccccccctgaccttagccttctgctctacattgttttcgttgtaagttagtgcggtgtggcaagcatctgctgctagaagcaacctctgtctgctcaatctggttcctgattaacatgatattgatataatgattgctttgcacc

SEQ ID NO: 25205 - DNA, 434 bp, Triticum aestivum
  Clone ID: PAT_TA_25205
gttccatttgatccgtttgagagtgcctatagttacctcagttttcgacttatgtcttctctagagcatggtacaaactcgtccttgcatgtaagaattaccttttctcacaaaggatttccctaattattcctgaacatgtactcatacaaactttccatcaaatacattgctatcccattgcttggcaactttatttgttgtagctagagttttttttacgacggagctggaaagtaacactttatccattctgaagtagaaggtgttttaggaagtcttacatcataatacttttcacatcgattccaaaaaatgatataggctgatggcatgcgggggaatttgtttgattatatttggtcgcatgaaatatattcagagtgtaacttttttaattggacttgtggtttgcaatcctcaaacaaaaaatt

SEQ ID NO: 25206 - DNA, 871 bp, Triticum aestivum
  unsure (1)..(871): unsure at all n locations
  Clone ID: PAT_TA_25206
ngaaactagtgcttgcatgaaaagtatgagcaaaaaaccacaaagcttttgcgtagaaacatcacctccattcatgcgcagtacatgcttctcctgccgccgcgccacctggatctaacgaggctacgtcacactggccccggatccgcccgcttccaatgaggttgcgtcacccgccggcgcacctctgcctcaccgtgggcagtggatgctcctccgcagctcaacctcctggtagcgggtagtttgatgctccctgtcgcgctacgatcagcgctccctcgagctccacaagaaattctttccggctgcgtctgcacctctgaaaagctcacacactcgaaggagggatcattgtttcttattggagaaggcctggtgttcagttggtgtatgtgtggtacctacaccagcattttccatcaagacctccagaaagagagatcatctcaagatcatgcaagttcaactatataaccgcatgcatgtctcccttagtccgactattgctgctgcttcaaatcacaaaatttgattcagccagtaagttggtgctagtggatcaagtccagagcaactatttttatgttggttgttacaatattgtttgagtgaagaactacatggaagtatagcataatgtaggagcattgatttaccgacaaacttttaagaaatcgtgtttggaatcaaatgtgaccgtattcaaatttgtttttaaaacgtaaggaattagaaaaacattcaatatgaaaatgttgcgcattttccatagctttccaacgccatatcacttgcgtcatccgacaaacaattggacaaaatgtgaaaatactttcaaccaagaattcacantttcaattaaaaaaan

SEQ ID NO: 25207 - DNA, 970 bp, Triticum aestivum
  Clone ID: PAT_TA_25207
gtcgaagatgactactttgccgctccgcaaaggccgccccccgctccctggtcccaccttccctgtccgctcccatggctttgtacgctggtcgcagtgtcctcgggcgcttctcagctaaattacctcaacaaggcactggatacctttgatttagctatggtttccccagtttattatgtaatgtttaccatccttacaatagtggcgagttcaattatgttcaaggacggggctggacaaagcttaagtagtattgcttctgaatgctgcggcctggtaacaatcctttctggaacaattttgctgcacgcagcaaaacaaaaagaagttgccagttctccagcatccacttggcctttggatagagggatatcttggtatatcagtgtaggcagcgacaatcttctgaggaacgtcgaagacgactacttcgccgctccacaaatttcgccaaccacaccctgatcatacactcggagttaagtccaaatactttgaccggagaagaaagtcctcggacacttgtaaagaggaaaccgtgtgaattgctgcggagtcttagcagcgccagcattctggcggttttggttgagaagatgaagatttcgtcagccattctttcgccgtacgtacataggaacctgtctagatttctcaaaccatctcatactaggaacctgtctagatttctccagtttgtaagttgttcgtcgatgagcggtgagtgggctgaatttgtcggcctgcctgttgttgttgtgcattacgcagaatatttctccttgtgattaggcttcagagtggaacatcgatgcacaattcgatttcgatgccattgttcttcttccgagagaaaatttcggtttcagtgttgagcttagttagttttggttgagcagatgatatggttaccatatgagctgcaggatgtatacatttccagtggaggctgaagcctgcctgttaa

SEQ ID NO: 25208 - DNA, 648 bp, Triticum aestivum
  Clone ID: PAT_TA_25208
ggcacggcggtgcctgcaacctactaccagcaggcatccccagccagctcttcttccaccgattcagctgctgatcgtggtagcatcggtgatcatcatgagggctgcagcaggacatggcgcctccttcctcgcgctgccgctgctactgcttctcgtggtgtcggccgaagcccgatctgcggcggcggccgggcggcggaaaggggaagggactcggtacagcgtcatggctttccacgccgccggggacggcaagacggatgattccaaggcgttcgaggagacgtgggactcggcatgcagagacagcggcggggcgacggtgtacgtccctgaaggaaggaccttcctgctgggagagaccaagttgcagggaccctgcaagtcgccgatcaccatgcaggtggaccggggacaattcgtggcgccaaagctccccccggggccccctgtcgttcccttgccccctgccctccctcggcctggcctacctggcggtggacggcagcgggcagatcgacggccgaggcgcgccgtggtgggactgctacaacaagaagaaatgccattaccggccacagctggtgtcattctcgttctgcaacggtctacgggtgaccaacatacgcctcaaagacagcgccg

SEQ ID NO: 25209 - DNA, 486 bp, Triticum aestivum
  Clone ID: PAT_TA_25209
gttcctttcaagtctccgagggcgaccctctctcttcttcttactccagctccagtcctgtattggtagttattggtgagtgctacgttgctagtgtggggtgtggcagcactgcactccactgcacggcgaaggccgagcacggtggttcgtgtgagtggcatgaggaccggggggatgctgtgccggtcacaggcggcgacggcggtctgtgtgccgggggacgcacggtccatggtcgtcgggcgccgcgccgaccggacaatcgccgaggacgcgcgcaccctgcacgacgtcaggtacgtgcgccttggtggccgacggagccggcgccgcgcgtgtctcgtccaggcaggtggcggccgcccagccgccgcccatgccgaaggaggcgccgagccccggtgggccgtgacccttgccgatggggaccaagagccccgtggggacgccggcgagggacactgcggcggctaagcggacatc

SEQ ID NO: 25210 - DNA, 482 bp, Triticum aestivum
  unsure (1)..(482): unsure at all n locations
  Clone ID: PAT_TA_25210
gcgagcctcacactctctgatcagagtagcactagcttcagctagccagcctctgccactccggtcattttcttgcatccacgacggcaatggccaccgctgatgtccagaacccatcggccgcgctgacggaggaggcgcccgcggtggagaagccggtcgccgccgaggaggtcgcgaagacggaggaagcccccgcgccggtggaggccgaagtcgaggcgcctgcccccgtcgaggttgaggagaccaaggaggaggcgccggcagcagttgaggcagaggagacgaaggagcccgagccaacagctgcggcccgaaccggaggccgaggcgcccgccgtggtccaagacagagaacaaggaggccgtggctgaaggcaaagcccggcggcggcccaaggaagtgaaaggaaaaaggcggcgccggctggccgagggccgacccggcgctcccgctggtggttgaggaancaccgggg

SEQ ID NO: 25211 - DNA, 835 bp, Triticum aestivum
  Clone ID: PAT_TA_25211
gaattcggcacgaccacgaaacctgcgtcggtcggttcatggcgtgcagcttctccccttcctccgccacgcggctccaggcggtggacgcggcggccgtgaagaacgcaagggttcccctcaaggcgtccgtctcgcccgcgccgagatcgctgggcggctgcagggctgcccgccaggaattcgagggcgcgacacaggatccaagcgtctcagtttcttcggcacgcacccagttggatctcctggagcaactgacgtcgtcctccacacctaatggcaccgagaatgacaccgctacggaaacccgtgtgctcactaccatccgtgagcagctggtagagctgtacggtgacaggggaggcgaattcacattcaccctcccgttgggcaagaggctcaggggaaggcctcaagaccctcaacaccctcaccgtctcaccagagaaagaagatcaagcagcaagcgatgctcaccaaggttagcgggaggaacgactcggtcttcttcgcgactgtcggtgcattcgtcctcgtgcctcctatcgccattttagccatagctgtcttaactctttatgtccagctcttgccatgaatcaagaggtttttaggtggtcatcttcagaccttttcatacacatgaaggcactttggcttcgccagagaattgtatgtctgtatatatagttagaatttgtatatggagcatgtaggtttttttcctttaagcagcacagctggcatggctttcgtttgtcctttccgcacaaggaacatcaatacaatattaaactcaacaaggagggtcaaaaataagattaaaaaaaaaaaa

SEQ ID NO: 25212 - DNA, 1025 bp, Triticum aestivum
  unsure (1)..(1025): unsure at all n locations
  Clone ID: PAT_TA_25212
ctcctgtctcgccggcgccgccnacggcgaacagacgggccagctgaccgtgttctggggccggaacgccggcgagggcacgctgcgcgaggcctgcgacacggggctctactccaccgtcgtcatctccttctacagcgtcttcgggcacggccgctactggggcgacctctctggccaccctctcgccggcgtcggtgccgacatcaagcactgccagtccacgaacatcctcgtcctcctctccatcggcgggcccgggaacggctactccctcccgtcctccgcctccgccgcagccgtcgccgacaacctctggaacgcgcacctcggcgggcgccggaacggcgtgtaccgcccgttcggcgacgccgccgtcgacggcatcgacttctacatcgaccagggcgcccccgaccactacgacgagctggccagccgcctcgacgggtacaaccggttctaccgcggccggaagggtgtgcgcctgacggcgacgccgcggtgcgggttgcccgaccgccgcctgggggcggcgctccggacggggctgttcgagcgcatccacgtcaggttctacggcaatgacacatgctcgctggggaagggcgggacgtacggcgtggtagagcagtgggagaagtggacggcggcgttcccaaggacccaggtgtacctgggcctcgcgccggcggagagcggcgtgccggagggggcgcagggcaccgtcgccgtttacctcaagtacctctactacgacctgctgcccaaggtgcagaaggcgaacaactatggcggggtcatggtctgggacagattcgccgacaagaagacacgctggagcagcgtcgtcaacggatgggcctgatcgtttatatcgctagctggtttacagctacggatccgagtatatactacttctanctgtgtatgcgtgtgtatgaataaaacggcatccatatgataatgatatatggatgtgaactcaagttgtttcttgttctagcaatgaataaggaatagtc

SEQ ID NO: 25213 - DNA, 494 bp, Triticum aestivum
  Clone ID: PAT_TA_25213
cggacgcgtgggcactccagaaccatctcactgccaacctccgcctggcgttccgacgccctctcgctctccacccgctcgtgatcgccttcgtgctggtctcctgtctcgccggcgccgccacggcgaagcagacgggccagctgaccgtgttctggggccggaacgccggcgagggcacgctgcgcgaggcctgcgacacggggctctactccaccgtcgccgtttacctcaagtacctctactacgacctgctgcccaaggtgcagaaggcgaacaactatggcggggtcatggtctgggacagattcgccgacaagaagacacgctggagcagcgtcgtcaacggatgggcctgatcgtttatatcgctagctggtttacagctacggatccgagtatatactacttctactgtgtatgcgtgtgtatgaataaaacggcatccatatgataatgatatatggatgtgaactcaagttgtttgttgttac

SEQ ID NO: 25214 - DNA, 612 bp, Triticum aestivum
  Clone ID: PAT_TA_25214
gttcgccaaaagaagctctcatcccggccaccggcgtactcttccaggccgtcatacggatctcactactccttcgccagaaggagaagatctcatcccgggcgccgccgtactcatcaggccgccgcgtataaggctcctttgagcggcgcaatctgcaagtagccatgtccgactcgcccagcttcccccatgtcgccgcctcctctctgacgccggcgccgccttcttcccccatgttgtgctggttccacatctgaagcttggttttttgcggggcggcccaacgaggcgtccatcccagagggcccctggccatagcagccgactccgctcctccctcctcgcatgcacctagcacctcgttgagtgaggagttcttggtgttcaccttctacaagctggtgcccgtcgacgacgcccgcgcacacctccacttcgtgcaggttaggaagattacttggatgcttttcaggcttctccagcattaaccgagcatgctctcagtacaaacaatgacttattcagggaaattactggagtagctggcatcagttgatcaatttcatcagaggtcatgttcagctgcagaaactgtgtttggcacacatc

SEQ ID NO: 25215 - DNA, 644 bp, Triticum aestivum
  unsure (1)..(644): unsure at all n locations
  Clone ID: PAT_TA_25215
acgggcagatcgaggcaggcacaggcgccgtagccgagaccgggaaccccaacgggccaagcaccaccaccaaccctagctagccactcccccgtggtcctccttgacnggccaccatgcagcgtccagcgtgccgccgccccgcgctctgacgcccgccgtcggacgccggtcgccgtcgtggtctagcgaagcgagagagcgtttctttcttggtgcagggtaggcgtatagatcgacatatatgggcgtgagcctgctgaggaagcagcactccgtcggcggcggggggctcgagcggcgggtcgtcgatgccgcccaaggggtgcaatggcggtgcgcgtggtggggccgggcgggccgcccggangaagaangaaaagttcgttggtgcccggtgggctacctcaagcaacccggctcttcgtggggcctactcaaaaggaagggccgaaggaggngtaacnggcttccaacancaangggggccatcaacatncccctggggggggtccnanaaacttccngccggngttgnaaaggcaacaatcnnacgggnaaancgggaacggggggggtcccgggttnccgggcgncttcgtntccggggggggcaacaaanaacaaagggtccnccccgnngg

SEQ ID NO: 25216 - DNA, 834 bp, Triticum aestivum
  Clone ID: PAT_TA_25216
tcgcgcccgcctccacatttccaggatgattttcctgtagccatgcagatctctcaaaagtatggccttgtctatgtaattacgaagcttgggctgctgtttgtatatgacttggaaactgccgcggcagtttatagaaatagaatcagtccagaccccatattcttgactgcagagtcttcaacaaccggtggattttatgccattaacagaagagggcaggttttgcatgccacagttaacgatgcaactgttgttccttttgtcagtggtcaattaaacaaccttgaacttgccgtgaatcttgccaaaagagccaatctccctggggcggagaacttggttgtgcaaagattccaggaactgttcgcacagacaaaatacaaggaagcagcagagttggctgcagaatccccgcagggtcttctacgaactcccgagactgttgccaaattccagagtgttcctgttcaagctggacaaacacctccactgttgcagtactttggcacattgcttactcgagggaagctcaatgcttacgaatcccttgagttatctcgacttgttgtcaatcagaacaagaagaaccttttggaaaattggttggcggaagacaagttggagtgcagtgaagagcttggagatcttgtaaagacggtagacaatgatcttgcgctaaaaatatacataaaggctagggcaaccccgaaagtcgttgccgcttttgctgagaggagggagtttgacaagatccttatatactcaaagcaggttggaagagcttggagatcttgtaaagacgtcgacgcggccgcggtcgacgcggccgcg

SEQ ID NO: 25217 - DNA, 791 bp, Triticum aestivum
  Clone ID: PAT_TA_25217
gttgaacaaaagcaatggcaactgacgaacggcccattgatccttcctgtccatgtatggtctgcaaaaacttacccgtgcatacttgcattgtctggtcacgaaagatcctatgggttctcaactgctgtcatatcacaatttatcatttatggcgcggttaagtagagatctccacatgtcgattcttgaagggcgatttccagaattcgtgagaggattcttgagggtgcagttcccaaagggcgacgtgccaaagtgggttcacaatgcaatggaggttgctggcatcgacatatcggagtgctgcaccccgaccaactgccagcacgacgcaatggaggctgccggcgtcgacatttcggacttctgccctcccaccaaatgcccctgacgcggaacgctcaggggcattcattatggataccatgataccggttgacgataggggagggttgtcgcgtggaagtgatccctcatacttaacatgacgcgttttcacgaggttttttttgggtcatagactgtaggcctggctctcatccattgcttcagcatagaattttccaacagtatgctgaagctagccgcccataggttttgatagtctccaaggtgttatagtacgtatctgtcattgattgtttgcaagctgctgcaaatgtttttgctgcaaggacagtccacgggaagttgtaacagcatcattatttatacccacgaaaattgttactgtgacgcaggtcattttgtttcactgaacatggcttctcgagacttcaaaaaaaaaa

SEQ ID NO: 25218 - DNA, 1100 bp, Triticum aestivum
  Clone ID: PAT_TA_25218
acgagccccctattcctgggcaaccttggttccgtcctctcgcatccgcccgcctactaccggcgccgtcgccggtggcctctccagcggggcgcctccgagttcccgacgcaggccacctcactgtcgaacatggcctcgccggcgccggttccggcctcgccggggtcctcctctcagaaaaaacgaggtgcaacggaatcaattggcctgtatgctgtccagtgttgtgaatgtcataaatggcgtacagtttcaacgaaagatgaatttgagacaattcgtgagaacttcactgaagacccatggttctgcagtaaaagacctgagtgctcgtgtgaagaccctccagacattgagtacgacagcagccgcatctgggtcatcgacaagcccaacataccaaagcctccgcccaagaccgagagacttgtgatcatgagaggtgatctgtctaaaatggacatctactatgtcctgccaaacgggaagcgtgcaaggggcatcggggacgtgcagaagttcctcgacacaaacccagagtacaaagaccgcatatcagctgaaagcttcagttttacggtgcccaagatcgttgaggagaccgtttcgcagagctctttgtggaagactaaaaaggctaaaaagcaggacaagataaatgcttcaagcagcaagaaggacaaggcaaatgcttcaagcagcgagaactagccatggcagcaaatgcaaaactgtcgcctgctgcttggatgatcctacctcatctaccttgaagttagtcatcaagtcggttctctctctctgcgatgttactctgagcgctccaatgcactgaatctcttcgtttttatgcatgagtttctggtaaaattctgagatgctcgagaagggctgtagctttttctcttctaataaaaagatctagttacaggggctgtagacttgtccactcgccgtgatacgttgttttaccagatggccatatgcgtagagatctcattagaaagcagccgaattggtcaatacgtcataagctagggtgttaattctgcatcgttgattgattacatccgcacgcaaactataaaaaaaaaaaa

SEQ ID NO: 25219 - DNA, 1468 bp, Triticum aestivum
  unsure (1)..(1468): unsure at all n locations
  Clone ID: PAT_TA_25219
ngttgatacgccgcccccccttccaccccttccttcccccccatccccgcgcaccttcgttcccatggcggctgaccaccacagggacagggccgtcccaggcgggggtgctccggtagtgcccctccctccacacgttccttccttcgcatggctgaccaccacagagacaggggtgtcctaggcggcggcggcgccttcggcgaccgcagtggccatggaggctacggcggcgaccaccacgagcagcaccagcagaagcagcccgcgctgatgtgcgccctcaaggccgcgacggcggccacggccgccgggtcgatgctgctgctatccgggctgatcctggcaggcaccgtcatcgcgctcaccgtggccactcccgtgctggtcatcttcagcccggtgctggtgccggcggccatcgcgctggcgctcatgtccgccggcttcgtgacgtccggcgggctgggcgtggcggcgctctccgtgttctcgtggatgtacaagtacctcaccggcaagcacccgccgggcgccgaccagctggaccacgccaaggcgcggctcgcgtccaaggcccgcgacatcaaggacgccgcgcagacccgcatcgaccaggcgcagggggcttgaagatgaggtgcgtgccccgacgcgcggccgatgcgtgggtgatgaacgatatagcgtacgattgctgatccgtgcgcgcgtttgatcgccgccgtgcccgccgagcgagcaagtcgacgacgtttaccacctgttgtgctatccgaccgagtgcgtgtttagacttttgttgcgaactagttgtcctagtagtgctctagcagtatgtttccgtggtcgaagtctggagagggtctggatgctggatgtactatggtgtgtgcttgtggatgtctccgcgtttatgatgaataaattgccaagtttgggcaagtgtgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaggggaaaaaagggggcgccctttttaaagaaccaaatttaactaccccgggtttccaaagaaaaattttttttttagggcccccaaatttaatttcctgggccgggttttaaaaacgcgggaatgggaaaacccctgggtttcccaaattaaatccctttgaaaaaaatccccttttccccagttgggtaaaaaaaaaaaagcccccccccaatcccctttccaaaaatttgccccccctaaatggaaaagggacccccccctttaccggccctttaaccccggggggtgggggggttccccccaggggaccctttacctttgccaggcccttagcccccgctcttttggttttttccccttcttttttcgccactttggcgggttttccc

SEQ ID NO: 25220 - DNA, 765 bp, Triticum aestivum
  Clone ID: PAT_TA_25220
gacacaagttcgcctcgtcctcctccagggcaacaccgtgcaggtctacgtcgttgacggccagaccacaactttgccacatccacatcctgagaaacaacatgagtgtagaaatccttgatggcaagaccgtccagagcttcgtcgaggacgaaggcgccttccattcatccgtggacagccggtttgcggccctcgacaccaaccatgatggcctgctgtcgtactccgagatggcccaggagctcatgagcctcagggttctcgagaagcactttggcgttgatgagtccgccatgagccgtggtgagcttgtcgagctttaccgtggcctgtttgcgaggttcgaccgagacggcaatggcacggtggaccttgaggagttccgggctgagatgaaggaggtgatgctcgctgtggctaacgggctcggcttcctgccggtgcagatggtggtcgaggaaggcagctttctgaaggtggctgtggaccgggagctggccaaagcaacttgacgaaactgcttggaacgacttttcagaatcaggaggctgcatgttcacgaattgtaacttttattctgccaattttgttgtgttacaactacaccggtgctagttatttgtacttaataagtgaaacagaagccacaacatcagtttaatttacaaaatgacaagctatttatgtaaagggaaatgttgtaaatctatgtttttggatgcctacatgagaaatatcacactagcagttttaaaaaaaaaa

SEQ ID NO: 25221 - DNA, 2203 bp, Triticum aestivum
  Clone ID: PAT_TA_25221
gtgcgaccctgcccgtttactcccatcgcaagcctctctgcccacctggcttgcaccgcaggtttcgagtccctctcttggggggagtgcactggcatcaaggacgtctgctctgctcctgcacagctccccgtttccagatcacttcggtcccttaccatcaagcagtgcccaggattcacagtcgcgagctcggccgtgggtggcatgatctgccctcaccttgagaatcttgacctgagcggtcttggtgcagtcaccgacgatggcctccttccattgatcaggtgttccggaagtgggctggtgcgtgtcggttctaatcgcttcggcaatctcacaggatgcagcggtttctgcactggtgaaggccctcggcgctgcttttcctcctctgagcctgtacggggtaaagtcggacacatgccgcaccctcgctcgcctttccgcggttggcgagaggggtttttgcggcatggcatctgcccttgggctgcagaagctcagatgtatgagcatcacttcctgcccaggagtcaccgagctggcacttgtttccattgccaagttctgcccgagcttgaagcagctttacctcaggaagtgcagccaaatctcagatggtcttctcaaggatttcgcagaagcagccaaggttttggagaacttgcagattgaggagtgcaacaggattactctcatgggcatcctttctttcctcctgaactgcagcccaaagttcaagactctctctttggtgaagtgtactggtatcaaggacatctgctctgcacctgcacagctccccgtttgcaaatcacttcggtcccttaccatcaagcagtgcccgggattcaccgacgcgagcttggccgtggttggcatgatctgccctcatctggagaatcttgacctcagcggtcttggtgcagtcaccgacgatggcctccttccattgatcaggagttccgagagtgggctggttcatgttgacttgaatggttgcgagaatctcacagacgcagctatttctgccctggtgaaggcgcacggcacttctcttgcacatctgagccttgagggctgcagcaagataactgatgcgagtctgtttgccatttccgagagctgctctgagctcgccgagcttgatctttcaaactgcatggtcagcgactatggtgttgcggtgttggcatccgcggagcggctcaagctccgtgtcctctcactgtcgggctgtctcaaggtcacaccgaagagcgttcccttcctgggaagcatgcctgcgtcgttggagggcctcaatctccagttcaacttcatcggcaaccacaacattgcatcgctggagaagcagctctggtggtgcgacatccttgcttaagaggatctccagatgcaaatatacgaccgtaggtagtacttcttcagtcaagcctcatagcagagtcggttcggttcgtcggttgcgcgtttgagtcatggtgggcttcctttgtcttagggtcggttgttttccgggggacgctttagccaagcgctcgttttttgcaggcctcctctcgcgaggatgcctgttccttgagccttcggctgccattagcgtggcaccctgtccctctacccccaacctatgcccttgtgattacagtccttacaccatgcttctttttttctccttaaagtcctgtgtgggagctcaaatattgtcagttgtgtcttcttttccagtattctggttccagagttctgggacatcagtacttctggtttcaattccatagcaagttctatttgtcggtgtgtgcctgtcgtagaagcttagctccggttctttgatccgtgtctaggtgtctgctacgatctctttcagtgtgtggttgttccagttccagtgtcttcacggtctgtagtgtgtgtgtgctgtgcgtgtgtgtcgtcggcggtggatggttgcttttctgcagcatctgtagggtttgcctgatgtccccggggatctggccttggcaaggtgcaacatatcaaagggcccttgccatgacaaccttgtgtggttgttttttgtctccagatccctggtttttgcaggcgtgtgtttgagtgctgtaacctttgcaatcatcctgggataaataaaatttgtttccgtccaaaaactaagaagggcccggcccccaacccccccttttgtggctct

SEQ ID NO: 25222 - DNA, 531 bp, Triticum aestivum
  unsure (1)..(531): unsure at all n locations
  Clone ID: PAT_TA_25222
ccctcctatatacacacacccccgcccaccccacgtgtccctcctccctctcctcctccncccttctcaccacacccaatcgcccgctcgctccctcggctcggcgtccatcgatctctccttctacccgagctgctccgtcgtccggacggcgtcgtcgaccgcgtgcttgccagatctgaagtcaaagcaggagaggacggacatgcagggagcgccggtggacagcccgggggcggcggaggcggctgcgcggccgagccggtacgagtcgcacaagcgccgggactggcacacgttcgggcagtacctgcgcaaccaccgcccgccgctggagctctcgcggtgcaccggcgcccacgtcctcgagttcctccgctacctcgaccagttcggcaagaccaaggtgcacgccgcgggctgccccttcttcggccacccttccccgccgggcgccgtgccccgtgcccgcctccgccaaggccctcggggcagcctcgacgcgctcgtcggccgcccgcccgccgcctt

SEQ ID NO: 25223 - DNA, 546 bp, Triticum aestivum
  Clone ID: PAT_TA_25223
gcgtggggccgccgcaactcctccaacaagcgccctgacgccatacgttgtcagatctgtggaaaacccggccacacagccaaagactgttggtacaggttcgatgacgacggtgattcgtcctcggatgaaaaggtggccggggcagctgatggctcatatggagtagacacaaactggtatgtggatagcggtgcaaccaaccacatcaccggtgaactcgagaaggtgaccatgcgcgagaaataccgcggcaaagaccacatccacactggcagtggagaaggcaacgaagaaggtgctttatcgaggtagatgcgttcgtgggctctaccctttgattccggagattagaaggttcaataaacaagttttcagtgccaccaagctatcttcaacacggtggcacgatcgattagggcatgcagcttttcccttagttaaacatttgcttaggaaaaataaactctcatatgttggagagcacaatgtcgaaacaatttgtgattcatgtcagaaagctaaaagtcatcagttgccgtattc

SEQ ID NO: 25224 - DNA, 449 bp, Triticum aestivum
  unsure (1)..(449): unsure at all n locations
  Clone ID: PAT_TA_25224
anatcggcatttccttccacccgcactccgtcctccgcgggctggggggcgtacgtgccgcgcccccacccctccggcgtccggcgccccttgccgccgcccccctccccgcggccccccgtcgcccccgcccgccgcctcgccgtcctccccgccccgctcccctccgccgcctccctcgtccccctccccttgcgcgccgccctcgcggtgacccgcatcgccgtcgcgatggcgctcccatacaagtacgccacgctgatcctcgccgccaccggccagtcgtggcgcctccgcggctcgccgccgccgccgccgtcgtcgcgcgggcagctctacgttgtgcaaccaccggacgctcatcgacccccgtgtacgtgtccatccgcgctgggccccgccccgcgccccgcgtcctacagcctgagncgggtctcgggagctcatct

SEQ ID NO: 25225 - DNA, 1198 bp, Triticum aestivum
  Clone ID: PAT_TA_25225
tcttcttctactagtcccactcctccctcccgtcgccgtcgccgccggcccaaaccaaaccctagccgccggccggcgccatggaccgcaagcgcatcaacgacgccctcgacaggcacctccgggcggccacggagcggtcgtcgccctccacctcccgcgccgccgccaagcccaagccgccctccgccgccgcccccaaacccaaagagcagctggattcggacagcagcgaggggggcagcgccggcgggccctccgaggcggacgacaccttctggatcaactggttctgcgccatgaggggcaacgagttcttcgccgaggtcgacgacgactacatccaggacgacttcaacctctgcggcctcagcgcccaggtcccctactacgaccacgccctcgatctcatcctcgacctcgagcccgtccagggcgatgtgtttgccgatgaccagaatgagctgattgtcgcgtccgcggagatgctttacggtttgatccatgcccggtacatcttgaccaccaagggcttggctgccatgctggagaagttcaagaactgcgactttggaaggtgcccccgcgtgtcctgctctggccagccctgtcttccaatggggcagtctgatatccctaggtccagtaccgttaagatatattgtcccaagtgcgaagatctctactaccccagatcgaagcaccaagccaatacagacggagcatactttgggacgacgtttcctcatattttcatgatgacccactcacaactgaagccacagaagccagcacagcaatacgttcctcggatattcggcttcaaagtccacaagaaaacatgacggtatcttggcggcgaactgccctgtgcttgttttgcccggtccgtcatcaggaatggtgatgatccgcactagctgggcatgagaaatgctatagccgattcaagacgacaagacaccaatcaactatgccacattctttcttctgtatgaaggcctgctctttggaaaagaaatatcgaggagctgtggtcaacctctgccggattcatgccatgtcatgttgggtattcagacgatatgatcccggcgaaatgggaatgagtttgtgcgtctgctgaatctgttgtgtatccatgtatttcactcttcattctgtggtggcaagaaatcggatggctgagactgtggag

SEQ ID NO: 25226 - DNA, 1306 bp, Triticum aestivum
  Clone ID: PAT_TA_25226
gctccatctactcgtcccactcctcccccccgtcgccgtcgcctccgcctcgaaccagaccctagccgccggccggccccctggaccgcaagcgcatcaacgccacgctcggcaggcgcctccgcgcggcgacggagcggccctcgcggtcgacctcgcgcccggcggcgccgcccacctcccccgccgccaccgccccgccaccccccgcccccccccccgcccccagcagccagctgggttccgcccgcagaccctccggtgccgccggcgcgttctcgattaccgcccacgcccgcaggaccaaccccatatacaccgagcaggcctacgaacgctgcgtccaggtcgattcctactgccccacccacaactccaacctccgcagccaccacagcaacctcttcctcggccactacgcctcgaacttcacaagcgaagtatgacccgatcatgggcatcggattgccgtgggcttgtttgacctggttcgccattaggaagagatgctgtaccgcttgatccgcgcccggtaaatcctgacgccgaagcacttcgacaacacactggtcaacttcaagaactgcgtctttggaaggggcccccgcgtctttggcactggtcaaccctgtatccctagggggcatcccgatatctctagggtccagaagtgtgaagatctattgtcccaaatgcggagatctctactaccccagatcgaagcaccaagccaatacagacggcgcatactttgggacgacgtttcctcatattttcatgatgacccactcacaactgaagccacagaagccagcacagcaatacgttccccggatattcggcttcaaagttcacaagaaaacatgacggtatcatggtggcgtactgccttgggcttgtttcgcctagtatgtcaccaggaatgatgaggacccgcactatagctgggcatggaaaatgctatggccgattcaagacgacaagacaccaatcaactatgccacattctttcttctgtatgaaggcccgctctttggaaaagaaatatcgaggagctctgatcaacctctgccagattcatgccatgtcatgttgggtattcggacgatatgatcccggtgaaatgggaattggtttgtgcatctgctctgttttgactttggatgcgcgtccagacggggcatatgttgctgaatctgttgtgtatccatgtatttcaccttttcattctgtggtgacgagaaatcggacggctgagactgttggagaaagtcctgtttcgggttttacaaaaaaaaaaaaaaaa

SEQ ID NO: 25227 - DNA, 1270 bp, Triticum aestivum
  Clone ID: PAT_TA_25227
gccgctcgaggccggccggggaggacgaaacgccagctcccccttgcgccggcggcaccctctcccgcggccccccccccgcagcgaaggcgccagtgcccaaggcccccccccctcaccccgggccccctcgcccgcagcctcgcccgcgcgcgtgccgcggaagcccgtgcctgcagcggctgatcgggcccaggtctgcctcatgcatctactgttgtggtagaggacgaggagaaggtgcaggacgccgaggacgaggacatggatgaggacaaggacaaggaataggaggagcagaatctgtttgtgggtccgccattgcgagcgggtgctgataggtcggttgatgatacatcaagaggggtacaagggctcaggagatgaactggaagttgacaattaggccgaggacggacctgtccatgctagttctagggaagaggagccaagctaaggtgcatatcaagagggcgaaagactatcccacaatccccacgggagggttaatttatgactacaggagttcgttaaaaccggttatggtggaggcattagtttgtggtgcaagttatataaagggtgctcaagttgacttgtagctggtgccgagggatgagaatgaagaggatgatgttgaaaccaccaagttacccatcgtggaggagatcaacgattgacactcatcatgtggatgttgatcttgatcttgctattttggagacgaatgtcaaagtgatctttctcatgggaaggctacttttgcatttgggttatgttcgaacttgtaagtcatgaactgtgaaatgtcacaactagcttggagatgaacctctcatttgtgttatgttcaacttgccaattgacatggacttgaaattgtcattgcaagtttgtaatcgtgtcgttcaatgatgataagacattatgcttgtggatgtgaaaaaaaaaaaaaaaaaaaaaaaaaaaaaaaaaaaaaaaaaaaaaaaaaaaaaaaaaaaaaaaaaaaaaaacaaaacgaccaataaaaggagcccccccccctgcaacgaatccattccaaacctatctaaaacatcgaatctaacggagggacccgaacgccattcaacccactctaagtcgaaatataccccgctcctgggccgccctttaatacatcactgatgggcaaaccccgggggggacccacttaaaaaactctgctgacatacccctttcgtcacccagggtaatcaacctagaagaccccgccgaatggccctcccaa

SEQ ID NO: 25228 - DNA, 628 bp, Triticum aestivum
  Clone ID: PAT_TA_25228
cctccctgctagcagctcagctcatcgctttgtgctaatagctaacgagcaggttggcaatgccaccatccccttcaagcccccgccatcccctctccaccacggttggtcgttccgcatgccgcggacgccgctccggtgacctcttcgtccccgtcttcgtcttcgtctccgtcgtcgtctcggttcttccgcagggcaaaggcatggaggcatccatgcaagcttagctcagaaaaatggtggagagttttgtattggcatgcgggaaagccaggcaatttttttccctcagttccgacttgtttccgctttcctctccttgctaattgctgtccttgttctcgctgctttaggtcgcttcgttcgaccttcagactatttgtatctcgtttcgttgcgaattttaaggccatccgatccatcgatgttatatatcatcgagagatcgatatggccattcagattctatataactatgtgtaattaaattcatcctttagcatgcatgaagattaactagctacgtgcagtgtttgtatgttcaaaaaaaaaaaaaaaaatccaatgcatttgcaaaaaaaatttagtcttcggcagctatataatattggaacgcaatgcagat

SEQ ID NO: 25229 - DNA, 1480 bp, Triticum aestivum
  Clone ID: PAT_TA_25229
ctccgggtcaaagcctggtcggtgaccgtgcactggtgccatttctcgaccgccctctccacatacctctcctagctagctacccatcccctcccactttgccatttcccatcccacatcctgcttgcttccggagctcatcagcatcgcttggcctaaggctcgcttcaactgcctgctcttctcagctcatcccctgcctggagctgatgttgagtctcgcaggctttgaattggatcgcccagagccaggcttaagggagaaagctccgtggaaagagaagcgctgcctcctctcccgggtctaaccccgtacacacaagacgggagcctgagaggcggcccccgaggccagggggggttacctggacaaggttgcggccgcaacgcagaggaatgagtggaggcagagcttggacgcccaagcatcagagtgtgggaaggcactcgcagcggcgcaaagtgaaacgaccgtgcgtgagaggaagaaagcgttctgtcccccgtcaccaccaacacacgccccgcctgctacacctgcgcccaacaccggcaacaggccgcgggtccgggacacgggggcggccgctccagtggtctgctggcctccaatccggtcattcaggagaaaccttgcaagcactagtgcatccaaacagccccctgaaccgcaaatcggtgaagccgatgccaaggccgtgcttgactgcaagaaaagccctcttgtaaaaatcaacatggatgggatccccattggaaggaaagttgatcttgcagcatgtgacagctacgagagactttcattggctgtcaaagatctcttccacgggtttcttcaagtgcaaagggacccgtctaaggttgaacgtacacagcaaggagcagatgaaaaaatattttcgcagttgctagacgggtccggtgaatatactctagtttacgaagacagtgaaggagacaggatgctggttggggatgtcccttggaatgtgtttgtctcaaccgctaaaaggctgagggttctgagaagctcagagctttcccatggtctgattggagctactcctgagagagcagcaaatggctgaaatggtgacacctttcaaaccatttggaatgttgctcactgaagccgcaaactaaaagaactcctaagaagcaggggagacctaaatcctgtggtcagtttggagatcgttatcctttttgaggattagtagttcagtaccctttttttttcttgtagtgagatgaattagcataccgcagatgcatggagatatcctgcctattttgtaaattaggctaccttgtatttaacgctatagttcttgattcagttacatagatttggcgccgactctctctgccaaatttgtaccctgacatgcaaatctgttcaggacaaaagaggaccagcacctggcctgtcctgatagcatcacaccaccgaacgcatatataggagtagcaacttcat

SEQ ID NO: 25230 - DNA, 554 bp, Triticum aestivum
  unsure (1)..(554): unsure at all n locations
  Clone ID: PAT_TA_25230
gaagtgaagagacgaggaaagtgttggcggtgttggcggtgtgctcgcgccattcccatcccctccccgccccccggtccagccggatctcgccgccgtcggcgccggctccccctgggcggcgccgcagccgcgcccccgcccatggtcgttgcgcccgcgtgggggactcggagcgcgtgagtaggcaggcgccacgtgccacggggcgcgtgtacactcggcggcggccatggcggacctggcttccacctgcaaggataaactggcatactttcgaataaaggaactcaaagatatcttgcatcagttaggcctaccaaagcaagggaaagaagcaaggatcttattgacagggtattggcactgttatcagatgagcaaggtcaaaggcatcatgggtggggaagaaaaaattctttcacaaagggggcagtggcaaaaattntcnatggtatatacancangnaaatgcaaatccaatttgctcccnatntaaacactaagtccacactgggttnaatttntttcccggctaaaaattaaatcaacca

SEQ ID NO: 25231 - DNA, 437 bp, Triticum aestivum
  unsure (1)..(437): unsure at all n locations
  Clone ID: PAT_TA_25231
acatctattccaagcaagtattagtaatcataaacccaacatgaagaccttcctcatcttcgtcctccttgccatggcgatgagcatcgtcactgctgctaggcagctaaaccctagcaagcaagagttgcaatcaccacaacaattatatccgcagcaaccatatccacagcaaccagatcaaccactacccccgcttccccaacccctactttctcacccccatcaaccacttccccagcttccccggcggccatttcccctgcanccgcaacaaccatttccccaacaaccaagcacaaataattgctcangcaacctcaacanccatcccctctacaagancanctagtcccccagctccagnagccattatcccagcaaccanaanaancatttcccaacctcatnanacattcccccatcatccacagcat

SEQ ID NO: 25232 - DNA, 934 bp, Triticum aestivum
  Clone ID: PAT_TA_25232
caaaaataagttattgccgacataggaagattcaaatgcatgttcggtctaacggtgtgaaaatgtagcgaaaacgtaactttatctttagcaaatcattccagattataggtccctctccaatcaatcctctgaatatgttcttctaatgtaccatccaataggatgatgaatacctcagctacaggctagacatgagatagtaagcaaactcctcctagctgacagactcggaatgctctgtacataagcacaaaaccaccacactaattgggtgtgccaaatctccaaggagcctcatgaacccaaggagtgtcctgctagcacgcgatattttcaagataggtagcctcctccagacatgttgcctgggccctgtggcgcgatctttccttgcatcatctgcaccgcccgaccatgcccctgcatgaattgttgctgacccatccctgtacccaccatctgcggctgctgctggagttgttgaggctgctgctgctgctgctgttgcatttgctgcatctgttgctgctgctgctgctgctgctgctgctgcatctgctgctgctgctgaatctgctgctgctgctgctgttgctggtgttgctgctgctgcatctgttgttgcagctgctgcatctgctgctggtgctgttgctgctgctgctgctgctgctgcagctgcagcatctgttgttgctgctgcagctgctgctgctgcatctgcggttgctgttgatcccgctgctgtggctgctgctgttgctgctggtgttgctcctgctgcgcctgtcgttgctgctgctgccgctgctgctgctgctgcggctgctgaagctgctggccttgaggctgcatttgcatttggtgctgttgtagttgctgctgttgcagttgctgtaattgctgctgttgctgctgtatttggtgctgc

SEQ ID NO: 25233 - DNA, 885 bp, Triticum aestivum
  Clone ID: PAT_TA_25233
gcacgagggcgagacgccccgactctagggttccgtcggcagccgcactccatccttccgatcccggcaacccttgccaccctctcccatccccagtcaccatcgtagtccctcgacaccggtcaatatccttgacgaagcctcgcctgccggctccttgcagcacgccgcccgccggtggacaccctaattgtgcgcgaacccgccggggagtcacctcgtcacctccatgcctttcgcaggatctccgccaccgccccgtgctgctgtgcgcaaggataccgccgcctctccctggcaccgagagctacactcccccggcaaagggcccgccggcttatagccggtggtagtcccgggcgaagtgaacacggcagcccctagttccgccaagcctcctccgttggtggcgcacgacgagcagctcggcaaacggaacacccgccccacgataccgctgacgggggacctggagttggccctgccaccttcgctcctccgtccccgcagggcggtcggtgccctcccctgcttctcgcgttcgggcgtgggcccgctggctcccccgccccgccttgcgcgccgccatcggccgatgcgcacgactcgccccgctctcccgcgagtcggagttgggatcaaacgtgcgcgcgcgtaacatactatgggaaactgtctgaacggagggtatatctgaagattgtgagaagtggaccttcgggcggataagacaggatatgttactcatgtgcgacgatccccttccacagtaccatcattggaagacagtggcctagccgccacagcgaatcaacagtagcgaatgtcgtaccggcagtcatcgtcccgccgcggccggctcacacgaggccgaagcccggtgtc

SEQ ID NO: 25234 - DNA, 737 bp, Triticum aestivum
  unsure (1)..(737): unsure at all n locations
  Clone ID: PAT_TA_25234
atggccatggccgcgctcagctgccgcctgcacagtggcatggcgaaccgtatccacccgatggtttcggccatggaggagatggggcttatcctcctcatcaaaattataataacccctatgcgcagggaggcaatttcactgattacgatctcgtcagaaggatgccacctccgccgatgccgtttgataggtatagtgccttagattctgttggaggatctcangagaagtatttcgaccaccatcaccatcatcagtttcaccatcattcccacctgatgccaaacgcaaatgcctcctccgcccccgccatttgtgagggggtagatttcgtacatcggcaacaatcggagcagcatctgggggatagaatgccaacacaggacaaacattcttttaacaatgtggaagtcaatattgttaatgcatgcgacttgttcaagcagccccttcgcgcttcacgccctgatcatattgttatcatcctgcgagggcttccaggtagtggaaagagctaccttgcgaaggcattgcgtgatcttgaagttnaagagtggtggaaagtgcaaccagaattcactccatggatgactaattcatgattgagggtgagaaaaaggtccaagacaacgaanggtncaaatccttccactggatccaaaggacgggnaacagttgaccaaagaaagtgnttgnatattgntatgaacctgaaatggngggagacctacagg

SEQ ID NO: 25235 - DNA, 418 bp, Triticum aestivum
  Clone ID: PAT_TA_25235
ggttgccacgctcctcgccttcctccttcagatcccgccgccggctagcccctatcccgcgcaggtccctacctccaacctcggcgcccacgcgcacttcttccgctgcccatggctgcagattccttccgccccggcgggccggagttggatctcgcctagtactcgccctaacctaaacgagggcctagttattttgttcgttctctcaaagcccaaagccgacacacacccactttcccccaaatccccgaactccatggtggcacgggcgagctcaccggcggccgatgccgcgccgcttcccccgggacgattctcctccggggagatattcctgcaacctcccgccaagaagccgatctacctccttcggcggcctccatccgtatgcaagcacttgggcgcgggcctttgt

SEQ ID NO: 25236 - DNA, 864 bp, Triticum aestivum
  unsure (1)..(864): unsure at all n locations
  Clone ID: PAT_TA_25236
ggntttgagcaggacaacagaaaagaagacaaagggggattgagaaggtgctgctgatggcagagactatcgggcttaaagttattgaggcgtcaaagcatgacctcaacatggtggtggataaccgtccacatcaaggtctggtgcttgatgcatcacccttggaaatggtgaattctaaggagttggaacgagtcagggttcgtggtggcaaggcaccagtctggatagctttggatgaggttatggaccctcagaatttgggagccataattagatcagcctacttctttggtgcggagggtgttgtcttgtgcgctaagaactctgctccattaagtggagtagtgagcaaagctagtgcaggctcgcttgagttgattgagctgctttcgtgtaggaatatgatgcagtttctgtcttcatcggctgaaaatgggtggcgagttcttggtggtaccgtcgctccaaaagctatacctctccctggattataccacaggggagccaacaattctggtgttgggcagtgaaggcaccggtctgaggcccctggttgagcgatcctgcacacatttggtcaaaattgctggtaacgctgatggatttgttgtagaagaagaaatagatgccacagatgcagatataggggaagaaggtgataattattcaggtaatcaagatatgaaatcattccttgcagtagagagcttaaatgttagcgtggcagcaggagttttgctttatcatctggctggaaagaatgcccaccctgtaactgagaagcctagcatctctcctgtgtaaggatgttccatgtttcatccataccatagttactaatatttgttttcttgtactccc

SEQ ID NO: 25237 - DNA, 826 bp, Triticum aestivum
  Clone ID: PAT_TA_25237
ccccaacgccctccccccgccctctatcccccgacctgccgccgccgcctaccccccgcctctgctcgctcccacaccgctcgcagccgccgccgccgctccccgccgccgccgccgcctccccgccgtcggccgctacgagaaccccagagtaaaggaagatgccttcacttcagaaaagctttacctccagaacttgccgataacgcgcttagattataccgcgaatgcttaaggagggctaagttcatcggtagtcagcaacataatacagggcttcttgtttccatggtgaggcaacagttcaagaaaaacatgcatgaaactgatccagagaagatacagaaaatgaaggatgatgcggcacggggccttatcaatcacataatatatgaatccgagaagatgacaggacgtaaattctcaggttaagaaagttgaaagtagacttttggcaatatgctgtacgagttgaacagcgacttgatcctatggctgttgaattatttttctcctccgacacaaggaccatctaatgcttttctttgttgttgacttaataaagcagtgttttttcatcagttgcattttactgtgcttctggatgtaattgacccacacatgccaagcgttagctgttttgttaaggtgtaaatcttcagcaatttcaagtgctccaatctgtgtgaaagcggatgtgttgcttgaattttcttcttctctatgatgtattgaggcagtttcaacatgttcactggttccatttcccatggagctgaattgttcaaaaaaatgcaaaactagaaatatccgggccgtctttttt

SEQ ID NO: 25238 - DNA, 1339 bp, Triticum aestivum
  Clone ID: PAT_TA_25238
cgggtcgaccggctcgaaaaggtcttacgagagcggcaaagagccttcatcagaagcttagcaagaaactcttgttacaaagtagtgttccaacagctgtgctctatcatggatcagtaacagattttgattctcgcttatatgggtttgatattggcacctgtcttgaggtgattgagcatgtggaggaggaccaagcaagtttatttggcaacgttgtattgagttcattctgtccggcggtgctcattgtttccacacccaactacgaatacaaccctatcctccagaggtcagctttgccaaacaaggaagaggagcaggaacaagacgctggaccttgcaagttccgcaaccatgaccacaagttcgaatggacgaggtcccagttccagcgctgggctactggcctcgctgcaagccacaactacagtgtggagttctgtggcgttggcggctcgagcgacgaacctggctatgcttcccagattgttgttttcagaagaatggcgagagatcaaggtgaatcttcccggaacgaggatgattcgcatcaaccttatgaagtatctctgggaatgccccgacccccctgccccgtcgctgtgactttccgcggtggtgacactgcctctctctccctcgtccgtcccgtgctcctgagactgtttgttactaacttgtcagttcgatactccaacccagagtgtgttgctggatatctaccgcgttgaactaaatagttgcagtagctgctccgaacctatccgttgcgatggctctaatccctgtagaaaactgaatattcttgtactgggcaaaatgactatttgactatttttcgcagcgtgcttttgcatgatgaagaaagagtagacatggtgcctcgagcaaacggagggcgcttggcgtcggttgatcgatcggtctccctagccgtcgatggcagctgcgtgtatgctcaggatcgtaggtcccgttcgtctctcgccacacaccatgccgcgattttttttcctccagctgttatgtcgcccgtcgcagcagcaccatccgcagtcgcaacatcggcttgccgctctcagcagagctccgcgcttgcttctttggcattttcgacggtgctcctccatcaattgttacgttgcccatgatttgtcatcgcaacagcaccactcgtggtcgcaacaccgtgggttgttggccatgatttgtcatcgcaactgttttaactagagaaagagaaagacaagagatagagatgtaaagtgaatggttattctcattgacgatgggattacacatatatatagcccttgaagggggtgtgtccgaaggg

SEQ ID NO: 25239 - DNA, 619 bp, Triticum aestivum
  Clone ID: PAT_TA_25239
ggaggtgagctacggcgtggagttcaccccggacgccgagggcggctacacggtcatcgtgcagaagactcggaaggtgcccgccaacgaggagccaatcatgaagggtagcttcaaagcgagcgagcctggcaaggtggtgctcatcgtcaacaacccgacgtcgaagaagaagaagctgctgtgccgattcaaggtgaagagctccaccgaatcctccgcctgatgaggttccagctgctgatacaaccgccaaccaggtccataccaccgccaccatttgaacatgtcgcatgataggggagagcaaataagattttagtagatggccgttttcgtgtcgggttctttgatttgttggcttgctgttttttgggggtcggatttgtatgtgtgtttactcggaaccaaagtgggcttgttctatgaatgagataggtactcctggctgggatcagaaggtggggaaatattgagatagtgatggttcaggaggggccgaagaagtgttgctgatctgtataaaaaaacctgtctgtacatggtgtccatggattctctttcgtcggcatgttgattttgtttagaaattattcatgtttggttggtcccccccccc

SEQ ID NO: 25240 - DNA, 2310 bp, Triticum aestivum
  unsure (1)..(2310): unsure at all n locations
  Clone ID: PAT_TA_25240
ccgaggaggaaggcaccaaaaccgtggaggccatcgaggagaccgccgtccccgccgcgtcggagccggaggcagcgcccgctgccgagccgaaggaggagctgatctggggcgtgccgctggtgggcggcgacgagcgctcggacacggtgctcctcaagttcctccgcgcgcgcgaattcaaggtcaaggaggccatggcgatgctcaaggcggcggtgctgtggcgcaagagcttcggcatcgacgcgctcctgggcgccgacctcggcgtgccggagctggagaacgtcgtcttctaccgcggcgccgaccgcgagggccaccccgtctgctacaacgtctacagcgagttccaggacaaggacctctacgagaaggccttcggcgacgacgagaagcgggagcgcttcctcaggtggcgcatccagctcctcgagcgcggcatccgggagcagctcgacttctcgcccagcggcatctgctccatggtgcaggtcaccgacctcaagaactcgccgcccatgctcggcaagcaccgcgccgtcacccgccaggcgctcgcgctgctgcaggacaactaccctgcattcatggccgcgacggtgttggtgaaggcgccaaggtggtagcttgcggcaaacaacgccacgagcccgttcctcacacagcctacaaagagcaaattcacgttttgcagcccagccaagcccgccagagagcctcttcaagatacatcgcgccggagcaggtccctgtccaattgggcaagcagaagaagaaggaatgatactgcattcttcgcttcggactggggttccccgagctctctggttttacgttctccctaccgaaattgttgaaattcctgataatgagaaccccacggtcgtcttggttctccgtgtgctcggatggggaggtgagctacggcgtggagttcaccccggacgctgagggcgggtacacggtcatcgggcagacgacgcggaaggtgcccgccaacgaggagccaatcatgaagggtagcttcaaagcgagcgagcctggcaaggtggtgctcatcgtcaacaacccgacgtcgaagaagaagaagctgctgtgccgattcaaggtgaagagctccaccgaatcctccgcctgatgaggttccagctgctgatacaaccgccaaccaggtccataccaccgccaccatttgaacatgtcgcatgataggggagagcaaataagattttagtagatggccgttttcgtgtcgggttctttaatttgttggcttgctgttttttgggggtcggatttgtacgggtggtctccgcgccccgcggcggccgcgccctggggcagggatccgacctcctgaactcgccgcccatgctcggcaagcaccgcgccgtcacccgccaggccgtcgccctgctccaggacaactaccccgagttcatcgccaagaaggtgttcatcaacgtgccatggtggtatctggctgccaacaaaatgatgagccctttcctcacccagcgcaccaagagcaagttcgtgttcgccagccaggccaagtcacccgagaccctcttcagatacatcgcgcccgagcaagtccccgtccaattcggaggcctcttcaaggaagatgaccctgatttcaccacctccgactctgtcaccgagctcactatcaaagcttcatccaaagaagccatcgagatccctgtcaccgagaactcaacgattgtatgggagctgcgggtgctgggctgggaggtgagccacggcgcggagttcaccccggacgccgagggcgcgtacaccgtgatcgtgcagaagacgaggaaggtccccgcgaacgaggagcccatcatgaagggcagcttcaaggccggcgaggccggcaagatcgtgctgacggtcagcaacgcggcgtcgaagaagaagaagctcctctacagatccaaggtgaagagcagcgccggcgagtccctctgaggcctacagtccatgacaccgccattggagtcagtccccgatgatgatagaagaagaagaagaagaagaagataaaccgcctttttggttttcgttctttaattccattggttttgtggtttttggttcgcattcccgcatttgtttaattaaaattaaaattaaaaacccaaagtgagcttgattttgcgacgctacagtagctgggagaggaaggttgggtatggnntngatgatataatggcatcgtttgatggttgtgttgagggtanggcagaggagaaaaatggatgatacaatctgctgctgctgctgctctgn

SEQ ID NO: 25241 - DNA, 849 bp, Triticum aestivum
  Clone ID: PAT_TA_25241
ggagggcaagcgcaagtagctagaaaccacaccgtattcatattcatattcatatcggaggtaagctagctagccactacggctatggccgcagcaaaactcgccctcgtcatcctcgtcgccgccacggtcgcctgcaccggcaacagccaggtgcaactgtgtgactacgagtttgttgcctcgacgttcaatgaaaattgggcgggcacggactcagatctcacattcaccgtgttcagcaccgaggtcgtgggcggcgtcgccatgaaaaccctgcaaagtgccgctggttccaggttcgacgtgggcagtaagaccaagttcaccatccagggcgggccatgcgtgaagccatgcggcctccgcctggaggttcacaaaacctggtggctggagatcgggagcgactggaagtgccgctccgtcgacctcttggtaaagcggaacggggcggtgcagtggcatttttatctcattttcaatcagtgggtgaccgacggctcccccgtggaatacaagccggcgcagtgcccgatcctctagcacggcgacgccatgcatgaccaggacgcgacgaccggccggggtcgcgagtgcgtgcgtgttgaggtacggtactcgtttgtggccgcgcgtgactgttttgttttgtttggttttcttccggcagctcccatgcataagctgtgtcttgtcatgtgtacgtacgtgcccggtgtgtgtgtgtgtgtttggctatctagctacaggcagccgggctcctcgtttgtctttccatcactgttgtttgtgtttcctttcctcacattattaataaaataagaccacgacttgctgtttaatttt

SEQ ID NO: 25242 - DNA, 896 bp, Triticum aestivum
  Clone ID: PAT_TA_25242
gcggtatccataagcgcatctaactagcaactcatctatccatccatctatagactacaccgttttcatattcatatcggaggtaagctagctagccaccgcggccatggccgcagcgaaactcgcccttgtcatcctagtcgccgccgcggtcgcctgcaccggcaacagccagagcccggtgcaactgtgtgactacgagtttgttgtgtcgacgttcaatgaaaattgggcgggcacggactcagatctcaccttcactgtgttcagcacggaggtcgtgggcggcgtcgccctgaaaactatacaaagtgccgctggttccaggttcgacgtgggcagtaagaccaagttcaccatccagggcgggccgtgcgtgaaaccatgcggcctccgcctagaggttcacaagacctggtggctggagatcgggagcgactggaagtgccgttccgtcgaccttttggtaaagaggaacggggcggtgcagtggcatttctatctcattttcaatcagtgggtgaaagacggctcccccgtcgaatacaagccggcgcagtgcccgatcctctagcacggcgacgccatgcatgatcaggacgcgacggccggccggggtcgcgagtgcgtgcgtgttgaggtacggtactcgtttgtggccgcgtgtgactgttttgtttagtttgcttttcttccggcagctcccatgcataaactgtatcttgtcatcagcagctcccatgcataagctgtgtcttgtcatgtgtgtccggtgtatgcgcggctctctagctataggcagccgggctcgtcgtttgtgttttcatcagtgttgtgtttgtttcctttcctcacattattaataaaataagaccctgccttcctgtttaaaaaaa

SEQ ID NO: 25243 - DNA, 824 bp, Triticum aestivum
  unsure (1)..(824): unsure at all n locations
  Clone ID: PAT_TA_25243
gcacggcgtcngagtcgatcagcagaaccggccgcaggacctgctgctggactggttcttccaccccgtgctggtgctcaaggaccagatacaggtgctgaagatgaccgagcaggaagtgaagttcctggagaagtcgactcttttcgtcggtagtagttctgctactgccagtgcggatgtgtgggataatggcgccgagaccccccgagatcctgtgcggaccgcgcagacccaggcgaccggctggcaggatggtggggatagtgaggagcatgtccaagttcccgacgtaccgcaggcgatacaggcatgtggtgaagctactggtggcgtacgcggtggagcgggaagggtcgttcgggtcgtcggcgtcaggtccgtcggtctccttcgaaatcacacgcctcgaagtgtagataatgccgtcgtcttttgcttctttttcgtcagtatataagtaggtatcgcacgccgtttttgtctgtgcctctcctgtttcaagtctactaggagcttctgtaattttgtgtggtggtagtactttttttttttccctttaggtaatgggagtgtgtatagttgttgtgttgtgagatgatgcgcgtggcatgatcttcagctgtgctgtaaattcttgtatatacattttcctagggaattgtttggttctttaggtgttatacattgttgcatctttgcccggccggctgtgtttactgtggagagctggcatgatggtaacctatatgagcgagaattcctcgagtttgacggggccaaaatctgaaaaatcttgaggggaaaaaaaaaaaaaaaaaaaa

SEQ ID NO: 25244 - DNA, 620 bp, Triticum aestivum
  Clone ID: PAT_TA_25244
cttgaccctttctctagaagttccaaatcgtgggctcggattcaactatcgtccctgcccgaatcctgcccagaccccggggagtcactcgtagtgccatggcgtcgcctaccggcagcagccgctcctccaaaatcccggagttcctggcgggttccggcggccggccggtgccggccctggggatcggcacggcgtcgttcccgttcgtggcagaggacgtcaagaacgccgtgctcgccgcgttggagctcggctaccgccacctcgacacagcctcggtttacccctccgagcacctcgtcggcgaggcagtggcggaggcggggcggcgcggggtcatagcgtcccgcgaggaggtgttcgtgacgaccaaggtgtggtgcacgcaatgccacccggatctcgtgctcccttccctcaaggaaagcttgcaaaaccttcaaatggaatatgttgatttgtacttggtccactggcctatgagcgtaaagcccagcaaaccacacttcccaatgaaaagggaagacatcgtccagatggacttgaaaggcgtatggcaggcaatggaggaatgtcatcgccttggccttgctaagatgattggcgttagcaattta

SEQ ID NO: 25245 - DNA, 606 bp, Triticum aestivum
  Clone ID: PAT_TA_25245
gcctcctcggtgcgacacctgctacctggtcgtggacgtggtcaatttgagtgcattctcgttcttgatctcatagttggttcaattcagccagactcaagttgacaacatagctgacctggaacgaaggtttgggtcttctcattaagtacagagtgtagctatgcttgaggcatcagccaaggagcttgaggcgttgcatgttgaacaaaatcaagaaacacatcagaggtgatggactgtgtactactgtattttcggaaatgtgtgtacacagaattggattctgaagtagcgatggagctgaagattgtgtgcttttatgtttggcagttaatccgtgttattggagattgaagaattttaacaagaattatttgtgtccgactagctgccttgaagcagtggtgtagttttggagattaaaatgagctagtagtacattttctttgaggtcatgttacttgatttttgtacaaaatgcatatagtgcttactagatatgcttgtgatgttttttctaaccagacaagattgttggaactttgtattggcatgtgaacaattgctattttttgaatgaatatgatttggttgtcgtgctgt

SEQ ID NO: 25246 - DNA, 933 bp, Triticum aestivum
  unsure (1)..(933): unsure at all n locations
  Clone ID: PAT_TA_25246
gcgttcgcccagcgtccggnctttggcnataccgtatgggaagaggtgactgaacggagggcggaccaagctgacgcaggagatcgtgtgcggctgtttggcgagctttacttttattctgaattttcattatgatggcagtggtttagtgccatgtgggagaaacatgttacattatctggatgttgttgttgcaggggaagccagaggcggagaacagccggttagcacctgaaggatgagctagggcctaggggtgtgagattacagtgactgacaggaggggcatccatcgaatgttgggtgtgaaagaaatgaagatgtaccgtggttggctagcaagatggtgaggaattttttatccgctttttgtggaagaactttgcaaaccagataatgaagttgactaggatttcatccgtaagatgatggacaccaagctaatgggttacaagattgagtggctaaagaagtttatgttcctggtacacttcatgaagcaaaaagagcaaatttttgggaatgtagttggactaatggtctgttggcatggaggagagtggtgtttgcattgtacactacatttgcgatatcaatgggctttacctgacgtctcgactcagtaggatattgtttgatcacctgtggagaagtctcgcatatgagatcgtgactgtgaggggggactaggctgacatgccaactttcctgtacttcaaaatcatggactggtgaatgaagcgtggttcagaatagttgcagggcggacctatcttttgactctgtggtgcgtgtgttgttgtagtttgtcacttttggtttgccacctccgaatcaggacaacaaatttgaatttgtattgtcggacctaaagtactggtcgaatgttgaagttgcagcatttccataaacttgttgctggggggcgtcagg

SEQ ID NO: 25247 - DNA, 540 bp, Triticum aestivum
  Clone ID: PAT_TA_25247
cctcccctctcttcgctccagcccccgctccagctccagctccagttcccactccctcccccagcgccattgcggccggccattgccaggtgttccactgcaacgctcctagctgctacaggcacggcacctccgctcttctcccccagcactctcgcctgagtcgcctcgccccgcgcgcgatcggtgctcctgctgcttccctggccgggcctcctggacgcggcggcggcggtgttgcgcggctgctctgccggctacggtctctccgttcctgagggggccttcgcatctctctggcgcctctcacccttggcacgcccggccacggatcgccggcctgacaccatccggcagccggccccgcaccgccgctatcgccggccgagccgccgcggtggcgtgagggccggcgtcggagcacggccgccggcggggagatccgcgaccccggccgcggccggcggccgctccgtccaccgccccccggcggcgccgctccgctggtgcaaggggcccgactcagtgtgcagaagaaga

SEQ ID NO: 25248 - DNA, 999 bp, Triticum aestivum
  unsure (1)..(999): unsure at all n locations
  Clone ID: PAT_TA_25248
ggccgcccctcggcccggcggcatcgacggcgacgggcgacgccgcccttccctcaccacaacggacgcaggcggacgggtctcccctggtttctcgctggacgacacaggcagagccccactgtcgcaagaatggacaaggaaaaggggaaggagaggaggaggagaaggagaaagagaggagcttggtctccattatgaagactaagccgcctgccctaggaaggagaaggggaagggcaagggctgtgtcgctgccaaggaagcgggccaaggattacggcaatgtccccccccccgggtggtttttccgggtaaaaaaaattcccccgccctggccgccccccggccccgccgacgccagcgggcgtgccaccatcgcccctgccaacggcttcgcaaacgactccgagagggcatcttcatcttcaccggtatggttgtgccaaatatgcgtgtccaagctcatgcgtttgctgtttttgctatccaaaggtgaaatatatgtgtgtccaagctcatgtatgtgttgttttctgtatccaaaagtcaaatataagattgaacaggctcatgtatatgctgtttttggtatccaagagtcaaatatatagtttgtacaagctcatggatgtgctcttcttgctatcaaaaagtcaaacctatgcgtgtccaagctcatggtgtgtgctgtttttctgtgctaggcaatggagcatgataagcaagcagagaaggattatgaagaggaggangagaatgaggacgacgaggatgtgtacgatactctgtttgaggaggaattctcattttgatgtcaaagcactaggtgttgcgccatgctgcatggcggcgtctggctgtcatcgtgccgtattgtcgccgtggactgctcaatcgaggagctggccatactccagcagctttgatgcccaattctttcttagtcatatttgttcaatttgtacactttccatagaagaaagcttattttcatca

SEQ ID NO: 25249 - DNA, 498 bp, Triticum aestivum
  unsure (1)..(498): unsure at all n locations
  Clone ID: PAT_TA_25249
ctccaatctgcgaaaattgaatcgctctctccgcctccccttcgtccgctttgctcgcatccgctcccacgcactcctagctccccatggcggggggctcgccgtcgccgagccaagccggagcaacgcccaaccgcctaaagcgcaaggcctctgcatcttccgccgtcgcctcctcctccacctccttaggggcggacgaggcggcggacgagggggacattgaggagctgggagagggatgtggcccgatcttgggccgccgggatactccgagcaccgccgttgacgccgccgcccgcttcatagacgccacagtatcgcgcctcgntcgccctccgcccgcccgcctgcgtnagaattccaaagtggatcacaacctgccgctgggggtccgcacgccgaagctngaacaaaatataagtgaaaactaaagatttcaaatcttaagaccgaggaaatatctgggaattcccagnactggacaaaatgaacaat

SEQ ID NO: 25250 - DNA, 716 bp, Triticum aestivum
  unsure (1)..(716): unsure at all n locations
  Clone ID: PAT_TA_25250
cgggcgcatacgacgagtccgtcttcagcccgcgtttccagtacgactacctctactgcggctcctcgctttacggcaacctcagcgccggccgcatgcgggagtgggtggcgtaccacgcgcacttcttcgggcncaggtcgcacttcgtcttccacgacgccggcggcgtcagcccggaggtgagggcggtgctggagccgtggatcagggcggggcgggtcacggtgcaggacatccgggcgcaggccgagttcgacagctactactacaaccagttcctggtggtgaacgactgcctgcaccggtaccggcacgccgccaactggaccttcttcttcgacgtcgacgagtacctctacctgcccaacgggcaggctctggaccaggtgctcggcaggctctcggggtacacgcagttcaccatcgagcagaatcccatgtccaccaagctctgcgtcaagaatccgaggaatgattactcaagagaatggggattcgagaagttcgtgttccgcaactcgatcacgagggtccggcgcgaccgcaagtacgcgatccaggcgcggaacgcgtacgcgacgggggtgcacatgtcgcagaacgtgtacgggaggtcgacccacaagacggaggccctcatcaggtactaccactaccacaactccatcaacgtgctgggggagccctgccaggagttcgtgccgcggcccggc

SEQ ID NO: 25251 - DNA, 846 bp, Triticum aestivum
  unsure (1)..(846): unsure at all n locations
  Clone ID: PAT_TA_25251
cgcggccgcgtcgaccaaccagaacaatccagcgtccggcacgagggaacaatccagcaaactcatcgcacgaggatcagcagcagcagagagaaggaaagcggccggcgggcgagatggcgcaggagagcctgaggctggtgtgcccgccggtgtcggcgcacgaggggcggctgccgcggcagtacacactggaggggcagggcgcgaagaaggacatctcgccgccgctggagtggtacggggtgcccgacggcacgcggtcgctggcggtggtggtgcaggacgtcgacgcggacgagcgggtgccgtggacgcactgggtggtcgtcaacatctcgcccgaggagaaggggctgcccgagggcttctccggcgccgggggcaacgccaacgccggcggcggcgacggcggcgtccaggagggggtcaacgactggaagcagcccgggtggcgcggccccgtcccggactcccacggccaccgcatccagttccggctctacgcgctcgacgacgtgctcagcctcggcaacaaggtgactgtgggacaaggtcatggaggccatcgaggggcacgtgctgggggaggccgagatcacggccgtcttctaaggagttcttgtggattttgacactcggctctgtgtgtgtgtgtctcctgcttgttacttctgtgcgaattgtgtgtggtctgttctgtagcgtgcctgtatacgcatggccacgagcagcctttgtaattttgatccaataaatgaagtgacttcttatcagccgggtacggttgcccgacaaaaaaaaaaaaaaaaaaaaaaaaaaaggnngggaaggaaaaaaaaaaaa

SEQ ID NO: 25252 - DNA, 630 bp, Triticum aestivum
  Clone ID: PAT_TA_25252
cacagatcagtcagtgcaacgaactcatttacgtacgatcctagctagagcttggacgaggatgtgcaactgcggtacggtaggaccttcagctacgaccggcagctgcacatccatgcccaagctctacctactgtcgtcactactgtagctgctccacgctcagcgacccctgcgccgcgcgtgtgcccatggcgacggaggtgaccctgcgccgcttcgacctctcggacgtggacgccatgatggcatgggcgtccgaccccgaggtcgccgccttctgccgctgggcgcccttcgcgtccacggagacggaagccctgctcgcccacatccgggacaccgcgctctcgcaccagtggtaccgcgccatctgcctcgccggcgacgctcgccccgtcggctcggtgtccctggagcccacggctgacccgtgccgcggggagctcggctacgtggtggcccgcgcgcactggggcaggggcgtggccaccgccgccgtgagggccgcgctcgccgcggtgttcggcgaggtggaggggctggcgcgcgtggaggcgctggtggacgtggacaacgcggcgtcgcagcgcgtggcggagaaggccgggttccgccgcgagggcgtcc

SEQ ID NO: 25253 - DNA, 393 bp, Triticum aestivum
  Clone ID: PAT_TA_25253
tctatcgccgcggctctcccttttttccctgttttctctttctcaattcatttgacagcatttcaaagcagaataatatggaatcatgcagaaatatgacagttcatcatctaaacacactcaagttcatcatcgtcatctaaacatagtcaagttcatcatcatcatctaaagatcatcacctgcggaagttcatgaacataaaagtagtgcaagacatggaacatcataaaagtagcaacatgaaaggcatggcacgatggccacatgcacggaatcatcatcgacatcaagcaagaccacctccgccaaaaccaccaccaagaccacctccgccaaaaccgccaccgcgaccaccatcactctgccagatcggagtgactggggtcgacc

SEQ ID NO: 25254 - DNA, 864 bp, Triticum aestivum
  Clone ID: PAT_TA_25254
atgcagaaatatgacaattcatcatgtaaacatactcaagttcatctaaacatactcaagttcaccatcatcatctaaacatactcaagttcatcacatcatctaaagatcatcaccgacggaagttcatgaacataaaagtagtgcaagacatgaaacatgataaaagtaggaatatgaaaggcatggcacgatggccacatgcacagaatcatcaagcaagagcacctccaccaaaaccagcacctccaccaaaagcaccacctccgccaaaaccaccaccaccacctccgccaaaaccgccatcacgaccaccaccactctgccagatcggagtgactagggtcgacggagaaggagttgagccaccggtccccggaccatcactgcctagtgccacccattcatcgaacgtgggcacatgtgggggttctcccgcaggtggtggtgggggtcccatttgtggtggatccgtgcgattagtccaagacgccaacatagccgtcatcatctgacggttgtaatcatcgtttgccttcacttgtttcaagtactcccgcacctcgagattcctatgctcgacaaactccttatatgcagcatgctggcgggctacgggagtctgtgaatgcccccttcactcgttccaactactccctggtagcgagattcctatgctcgacaaactccttatatgcagcgtgctggcgggctaagggagtctgtgaacgccccgtactctctaactggctcgggttggtagcccgaaactgtgtgtacgagatcgaaggagttatcaagccgtcgaaacacggataccggccattcttcttccccctggatggccaccaccgccgtgtcgtc

SEQ ID NO: 25255 - DNA, 692 bp, Triticum aestivum
  unsure (1)..(692): unsure at all n locations
  Clone ID: PAT_TA_25255
atttccccagcaaccacaacaaccatttccccagactcaacaaccccaacaaccatttccccaacaaccacaacaaccattcccccagactcaacaaccccaacaaccatttccccagctccagcaaccacaacaaccttttccccagccccaacaacaattgccgcagccccaacaaccgcaacaatcattcccccaacaacaacggccattcattcaaccatctctacaacaacagttgaacccatgcaagaatatcctcttgcaacaatgcaaacctgcgtcattggtgtcatccctctggtcaataatctggccacaaagcgattgccaagtgatgcggcaacaatgctgccaacaactagcacagattcctcaacagctccagtgcgcagccatccatagcgtcgtgcattccatcatcatgcagcagcagcagcaacaacaacaacaacaaggcatgcatatctttctgccactatctcaagcagcaacaagtgggtcaaggtctctaatccaaaggccaaggcatcaatccaaccacaacaaccaactcaattgggaggggttnaatcattgggggtttgcaaanccttccatccaatgtgcaacgtgtttgtccaaccggatgctccatccatgagggacattngcaacatatcccnggattggtggcaatggaaaacgaagac

SEQ ID NO: 25256 - DNA, 420 bp, Triticum aestivum
  Clone ID: PAT_TA_25256
tcgactgcggagtgcgagagattggcttttttagacgcctattccgggtatcatcaaatccgtctgtatggacctgacgaaatcaaaacagctttcatcagtccattcgggtgcttctgctatatcaccatgccattcggtctcaagaatgccggagccacgttcatgagaatgattcaaaagtgtttactcactcaaatcagtcggaatgtggaagcatacatggatgatatcgtggtcaagtcacgaaagggttccgacctgttgactgacctagctgaaacatttgccaatctcaggagatatgatattaagctcaatccatcaaagtgcacattcggagtgcctggcagaaagttactcgattttctcgtttcagagcgaggaatcgatgctaacccagaaaaagttagcaccata

SEQ ID NO: 25257 - DNA, 576 bp, Triticum aestivum
  unsure (1)..(576): unsure at all n locations
  Clone ID: PAT_TA_25257
ctgaacgtactttattttactctgacaatccaggaattctttagacaattgatcaaatacattgtcaaggaggacctaaaaataatatgaatgaacttgctcagtaagatggcaaggattgcatcttactgggtatgcttttcttcttccagaatacatctgcacatttgcagggtgcaaaacttcacttgtctgaatggaaaacacctccagcagattattgcacttgaaattaaaatagcgagaagaggttcattaattgcttctatggtacgactagcagctcctgaagcacataatcatgcatcttcattctgaagcacataatcaagcatcttcattcgtgacgccgtcgtagaccgctattgccggcgtagagcggtgcagccccgcaacactgcctcgaggaacctagagagttcaccacacagccgaggccaccactgccaccgagcagcacgggctgaaacttcaacgccatcaccaaccacggcgccgcccaagacctaggcagctgccccacctacccatggcaccgccgtgcgccaccgatactgccgatacggttcgccacnc

SEQ ID NO: 25258 - DNA, 532 bp, Triticum aestivum
  unsure (1)..(532): unsure at all n locations
  Clone ID: PAT_TA_25258
gttgcccttgtcctggttgttgcttttgtcctggctgtcctgtttgttgcccttgtcctagctgctgtagagaagttgggtaatgcccttgttgcccttgtcctggttgctgcagagaagctgggtagtgcccttgttgcccttgtcctggctgctgctgagaagctgggatttgcccttgttgcccttgtcctggctcttgctgagaagctgggtaagtgcccttgttgcccttgtcctgggctgctgctggagaagctgggtagtgccctttgttgcccttgtcctgggctgctgctgagaagctgggtagtgccctttgttgcccttgtcctggctgctgctgaagaagctaggtaatgcccttgttgcccttgtcctggctgttgtagagaagttgggtaatgcccttgttccccttgtcctgattgttgccattgtcctgggttgttgcccttgtcccaacctgttgtggaaatttgggatacctccctccttggccggggcccccttgtccaggttcnccctaant

SEQ ID NO: 25259 - DNA, 1558 bp, Triticum aestivum
  Clone ID: PAT_TA_25259
cccacgcgtccggtttgcatattcaaatgccaagacagaggacttgtgggctgccctcgaagaggggtctggtgagccagtgaaaacattaatgcactcatggacaaagcagcaaggttatcctgttgtcagtgtaaaactcaaggatggaaagctagagctggagcagacacagttcctgtcaagtgggtctgaaggagttgggcaatgggtggttcccatcacactatgctgctgttcatactcagttcagcaaaagttccttttccgtggaaaacaggacgatttcaatttgtcaggtctcgtagaatgccaaaagaaagatgatttctggattaaacttaatgtcgatcagactggtttctatagagtgagttatgacgaggaacttgcatcccgacttaggcatgcagttgagaccaacatactgagtgcagcagacagatatggtgtacttgatgacacctatgccctctgtatggctggtaaacagaagctggtcacgttgctgcatttgattgctgcgtacaagaatgagactgagtatactgtgcttgcacatgccatcaacacaagcctgagcatatatgagatgatggctgttgctgcacctgaggagttggttaatatgaagaagttcctaattgacttccttgagccattcgcacagagagttggctgggatgccaagagtggggagggtcacctgaatgcactgttaagaggtaccctcttatctgctctagcggaactaggccatcagtctaccatagacgaggctgtccgtcgatttaatgtctttctggaagacagagagacgccactcctcccaccagatgtccgaaaggctgcatatgttgcactgatgcagaccgtgaacaagtcaaacaaaagtgggtatgaatctctcctgaagatttacagggaaactgatctgagccaggaaaaagtccgtgtgcttggttctttggcatcgtcccctgaccctgacgttgttcgtgaagcgctgaatttcctgctatcgtctgaggtaaggaatcaggattgtatatttgtgctccgcggagtgactgcagcagcgcatgaggtggcatggacatggttgaaggaaaactgggactacatagcagagaccttcactggacacctgctcacctatttcatcaccgtcactgtctcaccgctcgccacggacgagaagggtgacgaggcagaggagttcttcaagagcaggaccaaggcgagcatcgcgaggacggtgaagcagagcatcgagagggtgaggatcaaggccaagtgggtcaagagcaccaagggcgaggccgacctcggcaatgttctcaaggagctcgctcacaagcattgagacggctagtctagaaccctaggtaggcggagcacattcggccctcctccctgtggtgctggtttgactgagcactccagatgtgtactttagaataatttggtaataaaagggcggttatatacttgatttatataaagttgattattgttgtcatgttgatgccgtggtttagcaaatgcgtttacgtcc

SEQ ID NO: 25260 - DNA, 436 bp, Triticum aestivum
  Clone ID: PAT_TA_25260
aataagtattttcttagagttgctgactggatggatggctctgtttacaaaggacagtggggactattcaatgcacgctgagcagcataagtgaaatctcagtgaattttatgggaagagcagtatgcaaactctacatgataggttaaacatgacacccatcaggaaggagtggcttatacaaggtgaatggatacactggtggactatgcaatatcgcaacgcacaaattgtgatgccaagtctcaaagagggaggcaattcaagagtataaaggaaatggctggctttcaatagctttcgacaacatggatggctttctttaccaaggactgtgggaagcgaataatgcatggtgagtgccataaaaagaaccccctccttggatcttattggagcagaacacctgtgcaaacccttacatgataggttgaaa

SEQ ID NO: 25261 - DNA, 918 bp, Triticum aestivum
  unsure (1)..(918): unsure at all n locations
  Clone ID: PAT_TA_25261
gtcattgttactaatgcagcaactgggcagccaacagggtccgcctatgtcgagtttttacacacagagtcggctgaaagagctctgtcattgaatggcacatcatttatgacgcgcattctaaaggtcgtgaggcgaagctcccatgaagctgctcacttttatggttggcctggtagtggtcgatcatcatatgctaggggtaggatggcatacccaaggggtgttctccctggtagctcatttagagggcgtactccgatgaaagcaggtgccaagaagttttcagtggaaacgtgagccttcaggcaccgagtccaatgcaggtgcaaaacccgacatgagtgtggcattggcttcagctgagcaggtgcttccaccagccacataggggagattatgttatatttgatcatagtgagaaccaattggtgtcttccagttgtccagcatgtttaaatgagaacaatagggccaataagctgacaacaagatggttgctccaaaaggctgcttcgtaaaaaggctaaacaggaaaagaacataaaaaggggaaaaaaggaaagaaaaaaaagggaaagggacccggagtccaaattcccataaaactgtgantgcgcgggntacttgggagatggttgtcccttgtcgatgatcagtctgtcataccaagcagttttcatcaagtcatctgaaaggggcttactcagactccgaaataagttacagctttgaggttgttttggggggtgcctcagtgagggactgggttccggcctttnccaaaaaggaggganccggntttccgncattnntattccanccncgttttnccccttntccaangttaaccccccccgggnnaacaancccaattnntctgttcccaacccccctggngcccttcccaaanaaaaa

SEQ ID NO: 25262 - DNA, 775 bp, Triticum aestivum
  unsure (1)..(775): unsure at all n locations
  Clone ID: PAT_TA_25262
aaccgactgagctaanaggagttcgccgagnaactagccgtgcgtagcaatggtgaagactgcggcagctgggagcactggcgatggcgccgtggcagcgaagcagcagcagcttggcggcaagatgaggacgtacaagggcgtgcggatgaggagctggggcgcgtgggtgtcggagatccgggcgcccgggcagaagacgcggatatggctcggctcccactccaccgccgaggccgccgcgcgcgcctacgacgccgcgctgctctgcctcaagggcgcctccgccgccgccgacctcaacttccccgtgcgcttccccttcgacctccccgccgccgccatgtcgcccaagtccatccagcgcgtcgccgcagccgccgccgccggggccagcgctaatgtgttcgacttcgccgctgccgacgacagtgccagcgctaatgccgtcgacttcgccggtgccgacgacagcgccagcgcggtcacccccgagtactgcagctccttcttccagtcgcccaagtgcatggagtacgccatgatggacccgtgcagcaccttcttcgctccggcgccgatagcaatggaggacgagtgcagctgggaggaaggaggcgacattgcgctctggagctactgaaccggagtccgggaagccggagaaccgaagaaactgacaaatcgttactcaagcgaaggccagaactggccatgcatggtgataactatccttaatttcatatatgtggtaaattaattcgattcattgtac

SEQ ID NO: 25263 - DNA, 1157 bp, Triticum aestivum
  Clone ID: PAT_TA_25263
gcacgaggcacgactccatcctcctcctccgccgccgccgcctcagccgccgtgcgaatctatctccgggttgggggagatggcggacgccctggacatgtccctcgacgacctcatctccaagaacaagtcctcctcccagcgcggccgtggccgccgcaacccggcctcgggctcgggctcgggctcggcgtcgggaggacccgcacccgccggtcgccgcttccaggctcgcgccgccacccgcgctgccgccgcgccctaccaccaattcaacttcccgcccccggcgccggcggcttttgcatatgctgcccagcaggcccatgcccatgcccacgcccaggtgatggccatggtggcgccgccgaccggggtcgaaacgggcaccaagctgtacatctccaacctcgactacaacgtctccaacgaggacatcaaggaactctttgctgaggtgggcgatctcaagaggtactccattaactacgacaagagtggaagatcaaagggaactgcagaggttatattttcaaggaaatcggatgctctagctgctctaaagaggtacaacaatgtgcagcttgatggcaaacctatgaaaattgaggtcattggaacaaatattgaggcaccaccaccaccacctgctatttttactttgaataccccgacgataggaaacttcattccttcctacagtggcggacgtggaaggggcggtgatggtggtcggggatggcctcggggcagaggtggattcggcgggcgtagtgctgctgggcgtggtcgagggcgtggtgatgttgggcgtggccaaggaaggggagggcgtggcagtcagccagtttctgccaatgatctagacgcagacttggacaagtaccactcggaagcgatgcagaccagctaaatggctttggccctgccgcacctgcatcccgcacagccattagccttgtgtaggaatagatgcggccatgtattttagattgtaatttgtgagacaaatgaagcgtctgtcttttgttgtgtgatgatcaacgtggtgcgttccattgtagctctagtttctcttcctctgagttgtagcagttgagacggttggactaagatgagatttttataaagggtgatcacaagtgttacatttaaaa

SEQ ID NO: 25264 - DNA, 1318 bp, Triticum aestivum
  Clone ID: PAT_TA_25264
tcattcacaaaagtatcaggattgggaagattcttttcagactctttactacatgttccggaagaatctgttgaatatcttctatgtttatgcggcacaatttgttgctctatttatcaacgaaactgtttggagaagcagtcctgtaatgcctacttatcacaatctacacgtggcatgaggtcactactacgaaaacagggtgtctgcttttctatgcccctttgcaaggccaaagtggagcaggctactgaagtccgcctcgtcgaattctcaaaaatccgaacactcaacctgggccagacacttcatatagatgctttatctgaggtggacaacactacagagtcactcctttcatttactggcaataagagcgttcatggcttatatgatgtcttgttgaactacaagtcctttctgaattcattatctgccacagacgtcccagtgttatattcaccggtgccatttcaaaatggttgcctccatattccagaggtcatatgcagggagatgaggaaagctgatactggcctgtcctcctctaccggtttagatgaagaacctggatcagtgtttgctcctccgccaggcaacatgtgttacagcatggaaataaaggatgtggttatcccaccgtgggttgcctccggcatttgtgccgcgatgagctcagacacggatcgctttgatttaacaatggggacggaaccctcctccatgggcttaaacgctgctttcacctccataggcgtgagcggccagtcaaaggctccttcagagtcctctcctgaaggctgcgaggccattggcattcccagcgctgtcttggtccgctccttgcactccgcctcgctccggcgcctcagttacaaccacggcgaataccttgcgcacacaaccgtgtgagttgcaacgccttggagcatacctgcgatgcaaggccggtgcttctttacggccacttttgtggtgctaggatcctgtgtatcctccatgccaggaagcccggcgatacagagagaatccggaagagccttgtatgaggcgtcaaccaacgcctcagcctctgcagagcactctagggagtgcgtgtgtggagggttgtaccttttgagcctgtgctgtgtagttcacaggacatgtacccttgactggtaactttaatggagtttctggttatgtaaaacgaagggagaaaacaacaacaacaaaagggacatttgctttcttattacttgggttatattgaatgctgcgtttgaacaattttgtgttggactggagtgggtgttactactgtgatccttaccag

SEQ ID NO: 25265 - DNA, 532 bp, Triticum aestivum
  unsure (1)..(532): unsure at all n locations
  Clone ID: PAT_TA_25265
catctctccacccaatcatcactagctaatacggtgcactgttagctacagaccaagaagtgatcatggcccgcgctcaggtaatgctcatggccgtcgccttgggtgctcatgctcgcggcggtcccgcgcgctgccgtgggccatccgactgcggccacgtttgacagttgggtggagacccttgcctggagctacgttcaagggcggccccgccctcctgggcaattgctgcggcggcgtccaaagctcccataaccaggcgcgatccccagagcgattttgccaagcccgctttgcaactgcctccaaggggatttgctccctggcatccacatctcaaacgaaggacaacgcccggagcttccccccccctaccgcggggtccctccctccccattaacctccaatcccactagatcagtttgttcatggcgtcattgcgtccttcgtcggcccggcgcatncatcacgttgattttaancncgcaactctanccctatgtattanggcactaattttccaatttnn

SEQ ID NO: 25266 - DNA, 1063 bp, Triticum aestivum
  Clone ID: PAT_TA_25266
aaacaaaatcttccccattctccttcttccgccgctacgctgtgtcgctctccccattccccattcagttccgccgccggggatggttctgatcgagcgcacgccgtgcgcgggggcggcccccttcagtccgctccagagatccactcctagggcttcgcgggaggcgtcgccgccgtccgaccccatcctcccctacctcaggtctatcaagaaggccattgatgagatcagggcacacccagaatgttatcacgcagcacttgaacagctcaagatttatgtcacagaatgcattgataagtatggggacgattatcagtactccactgacccccggctcctgaagatctggatcctctatggggatgcagtttctgattttgacaaggtgtatgcacatttggaggagaaaagaatgttcttagaggatgcactgctctatgaatcatatgcactgtttctgtgtgctcaggggagagcgctcgaggctgataaggtctatgggattggtatttccagaaaagccgagccccttgatcatttgaagaagatgcatatcaacttcttaaaacaattggagggtattgtagaagaatctgatgaggatgcacagcccaaaccatctaaaatacaaaaaaggagtttagtgtgggtgatccatggtcagattctaccatgagcaatttgctaacgaaaattaatggtggcctcaagaagttaacaggctatcataagagcaacaagatctactcaggaaaggtgcccctaacttcctcacataatgctttaaaaaataaagtcgtcgagttaggtggcaagaaatatcacatcaaaggttcttctggtactggtgcttttgctaaattatacaaagctagtgttgatggtaacacggaagaaatagttgctttgaaggttcaaaagcctgcatttccttgggaattttacatgtaccgccagcttgatatgcggatatctgatattcagagaccaagctatggctatgcacatgaagtgcatgtctttgctgacgtcagtgtgctagtttgcaatttcctga

SEQ ID NO: 25267 - DNA, 436 bp, Triticum aestivum
  Clone ID: PAT_TA_25267
ccacgcgtccgcccacgcgtccgcggacgcgtggggaacattgagctgctagtgactacgagaatcagtgttctagccaaacgggatactttcttaaatgagttggtggagaagcgggtaacctggtaccaggaaggaaaatgccaatctccttgcattgcagctgatgtaggccaggagaactgtctttgtactctgcacaagtcataagtttgtcaggagacactctctgtgagtgatacttgagtatttttacattggttggtgtcgtatttaccaccttccaatcgtgcatcctttattgttcatttaaatttagtcctcgctctatgtctttatgagacagatcttagcacggtagcatgctgagctttatgtgttgtattcatcgtctgtcttcatctgttcttccaataaagttctgtgcaaatgatgt

SEQ ID NO: 25268 - DNA, 1317 bp, Triticum aestivum
  Clone ID: PAT_TA_25268
ccccgcgagcatccggcgggagcacctgtgccgtacacgctatgcaggtgctccgcggggtcttgggttggtttgctcgcctttgggacctcggaaaggatgaatattggggattcgttacgtgagcgtgtctggtcacaaatttgttggatgtcctttgccgaggggaagttttccctgatgggtgcttctatgccactcgtgttctagcctagttggtgttctaggtagcgaaaatgcaaaggtcagagtgcgtaagagtggtcattcttgtatcttgctatggtacaccctcaacaggtgggactatagaggtttacagaaggaagttcacaagtgcttgaaaaatgcacattagcacaaagatcggctcaaggattgatgatttagcgctatgcataaagacctcagtagtacagtagttttagagaggccttagtacgaggagtttgtgcgacctgttgggagtgtgcttgtgattggtaatatatgcacatgtggtggtctttcccaagcgtaaatggagattagctgggtcactttcttaatttagtgggttggagaagccggttgacctggataccacggggaggaaacatatccaatctccttgtatcaaaggtgggtgtaggcctacgcgagatgtcattatactctgcacaagacatgagcttgtcccgagacactcacggtgagtggtacttgagtattgacattggttggtgccgtatttaccaccttccaaatcgtgcaaaatgcacattacctgaatgatcggctcaaggatgctggaattagtgcgatgcttaacgagctcagtagtacagtagtttttgagaggccaaaggacgaagagtttgtgcgacggtggcagcttgcttgtgagggaagtatatcacatgttgtggtaatgcccagcgtcactgttgataagctggatactttcttaaatgagttggtggagaagcgggtaacctggtaccaggaaggaaaatgccaatccccttgcattgcagctgatgtaggccaggagaactgtctttgtactctgcacaagacataagtttgtcaggagacactctctccgagttcaaacgttggatacttgagtatttacattggttggtgtcgtttttaccaccttccaatcgtgcatctttcattgttccttgttgtcacggactcgtataaatttagtccttgctttatgtctttatgagacagatcttagcacagtagcatgctgaactttatgtggtgtattcatcgtctgtcttcatctattcttctaataaagttctgtgcaaagatgtatcc

SEQ ID NO: 25269 - DNA, 757 bp, Triticum aestivum
  Clone ID: PAT_TA_25269
gcgccaaggaaaatggtgtgccttcagatacgtgtcacttcaggcacaacggataatcagcacactaattcgaagcgcatcaagcacgacaccgtcagcactgtgagcggtgacgccacgccaagcgccaacggacacagcaatggccacgacacgaggggtgctgctgagcagtcctcaaaggagctggagtctctgaaggagatgaacaaggcgatgcagcaagagctgaacgagctgcacgagcggtattcggagataagcctcaagttcgcggaggtggaaggtgagaggcagcagctggtgatgacggtgcggacgctgaagaactcgctgagatgatcgatccatggctgctgcctgctcagtgctcactcacccacatgtagcttcaggattaggtgatgatacccgccctccccaaaggagggttttgtataggcgagcagctggatggtgagttgtatggagcatcatcatccggagacttgcagaggccaggcaagtgccctggtagcagggccctctggcctgtcacaatacacagcatgtagatccgttcccccacacaataatgtttctgtgttttttcctcttcggcattgatgtgtgcaggatgtgtcagttgttgtgcctctagagagagcccagtgtgtgtgtgtgcgtgtgtgtggtgttgtataattctccctgatgtttggctgtgctggaagaaagaaaagtgagagataaaagaaatgaagggacaatttgaacc

SEQ ID NO: 25270 - DNA, 433 bp, Triticum aestivum
  Clone ID: PAT_TA_25270
cccacgcgtccgactaactagaagaagaagaagaagaagaagaagcagaaacgatggcgttccgacgcccttcatgtgtaatactaggagctcttctcgccgtctccttcctcgccgccacggcagccgcctgtgaccacggcctgacggtcttctggggccggaacaaggacgagggctccctcggggaggcctgcgacaccggcatctacaacaccgtcatcatctccttctacagcgtcttcggccacggcaagtactggggcgacctctccggccacccgctctacggcatcggcgccgacatcaaacaatgccggggcaagggcatcgtcgtcctcctctccatcggcggcggcggcacccagtactccctgccgtcatcacagtccgcggccgacgtcgccgacaacctgtggaacgcgcacctcgg

SEQ ID NO: 25271 - DNA, 506 bp, Triticum aestivum
  unsure (1)..(506): unsure at all n locations
  Clone ID: PAT_TA_25271
tttcgcacgnnaaccaagcactctgcactactcactcagcacggttataccctggaatcgtgcagttagtcctatggcgagcggcggcgggaagacgacggcctcctcctgggcggcggcgatgagcgtgggcgcgggcacggtggaggcgctcaaggagcggcacgccgggctgtgccgctggaaccaccaggcgctcccgtgcgtcttccagcagcgccccggcacctgggccgccgggaacggcgcctgcggcaagggcaaggcggcgaccactgccggtgggatggcggcgaggaggaaggcgaggcaggagcaggaggaggagctccggactgtcatgtacctcagcaactggggacccaacaactaaactaactagccgattagtcatcagttacagacctctagatcttcttatcagatggctagattggtttgtcctagctgcaccagttcgtgtggcagtggctggatgatgttagctcagcatgcagactcactct

SEQ ID NO: 25272 - DNA, 603 bp, Triticum aestivum
  Clone ID: PAT_TA_25272
cgcaggcctcagtcgcgcacgacccaatcagcaatcctacacttggtcacgtggcgagcggcgggggcaaggtgaccgctttgtcctgggcggcggcgatgagcgtgggcgcgggcgcgggcacggtgcaggcgctcaaggggcggcacgccgggctgtgccgctggaactaccacgcgctcccgtgcgtccagcagcacaccggcaccgcggtcgccgggaacggcaagaccatggcggcgcccgctgccggcggggccgcggcgaggaggaggaaggcgaggaaggaggaggaggaggaggaggagctccggacagtcatgtacctcagtaactggggaccgaacaattagctagctgattatttagtcatcagttatctcctctgttcttcttagatggccagaatggtgcactagctgcaccagttcgtctggctggatctggacgtgaacacagcacgcgcattctcgagcttgggtaagacacggtacggtgcggtagtgcatacctccatccggcaggatttcaatacatacggtcgctctgaaaatacagaaaaaaaaaaatggacgtcccttccggcctccaccaggctcaact

SEQ ID NO: 25273 - DNA, 980 bp, Triticum aestivum
  Clone ID: PAT_TA_25273
attcggacgaggcgggtttctcgccccgggcgcgacgtgaggaatcggcaacgtacgcggcgcccctacccaccaccccacgcgccgcatcacggttccttcctctctctctctctctctctctctctctctctcaggccaccagccagggcctctggccgaacaaatcctgcggtccagctcgcagattcccccgcgccgtctatatatgcgcgcaccttccttccagatcccccaccacattcctatcctcctcctctccaaccagactttctccgagcgctaccagcttccttccatcctccttccttcgccgccgaggtttccttcgatcgggagcggtggcgtgttccctggttatccgtgcgtttccgtttgcatggggctggacgtcggcgagatcgggatgcccctcgacctgggcctcgacctcaagctcttcgtcgccaagaccgccggccggctcgccgcggccaaggaggcgcccgccgtcgacgcctgcatccgcggcctcgaggaggagcgccgcaagatcgaggtcttccgccgcgagctgccgctctgcgcccgcctcctcgccgacgtcatcgaattcatgaaggaggaggcggccaagaggagcgagcgccgcgacgccgacgacaacgacaagcggaaatggatgagcacggcgcagctctgggtcgacacccgcgccaccgacgccgccgatcccgtcaaggagcagaagaaggagagctcgctgtccaagccgatgctgctcggcggtgccatcggtgcgccgatggcagtcagctgccgtgcaatgccgccgccggcggctccccagtatttcggcagggacgacaagattgttggctcacaaggcctgcttgctctgcccatgatttctccggctgcgaacaggcagttttctccccctgccgacgaccgtcatcaggccttcgccgcaaaatttgctgcccccatgccacctccgg

SEQ ID NO: 25274 - DNA, 529 bp, Triticum aestivum
  unsure (1)..(529): unsure at all n locations
  Clone ID: PAT_TA_25274
gtttttttttttttttttaacaaaaactcatgcaagattttgatatcaatggcataatgacaattgaaaaggttcaattattttcttataaagaacaagctcacaaaaactacaatcagtgtattgtgtttggaaaaccataatctgcagatctagaaaaaagccttttatatgagtaacagacacaaccttatgttgagaatgaagtgctgggtaccaaatagcatacctcacaggtccggctgctgtggcaggctcccgctcagcagaagtgacttccttcgctgtcacaactgcttgggggcctgggggctatattgctagcaacatcagcaacctcaacggggggaactgagagcatcttccctggaaataaacaccaaagacctccctctccggtacaaacanctgggcggggggactgaaacactacattgangtccttttnggacttcaacggnagtacttccttacctcacnggnacattgattcancanctactccaaacaatgacattnctgccccaca

SEQ ID NO: 25275 - DNA, 518 bp, Triticum aestivum
  unsure (1)..(518): unsure at all n locations
  Clone ID: PAT_TA_25275
tcgcagnaaacagcatggggnaggagcatagcaaccatacattccaggagtcctgatcgcaagctgtgctcctgccatgttatcggtgcctgagcaccgtgcgagggcgaagcatgtcgccttgatcaatgtggcttgcatgctactatctgttgccgagtcctctgtatattaaggcttaagagtgttttgtttatcaagtggattcttggccgtcctgtatagctaagtccttccagtaagtagtaatacagttcgttccagcaccaagttatttggtctggtgtgtagttttggggctgctgtgttgccatatcccttttttaaaactgggtccgccaggggatttgatcactggttccctggtcgaacctctggtctcgatggtttggcagagagaatgcgatcacaaagaagatgcaaacacatacagtatgcacatgtctacatgttccttatgccctgtacaatgcaagttgctcagggaaggtgctttaagaaataaatcatttttccat

SEQ ID NO: 25276 - DNA, 1196 bp, Triticum aestivum
  unsure (1)..(1196): unsure at all n locations
  Clone ID: PAT_TA_25276
cggccgctcgacgcccggggcgcgccgccattgaacaaacccctcaacccagatcggaaaccaatccgccgccatgtcctcctccaacgacgcccccgtcagccctcgctcccagctcgtgctgagctgcttcgaggagctcctcgacttcgcgcaggcggacgtggcgtcggaacggcaccggggcgcgcgcctacggcctcaaccgcatgcgttgccgccgacgagctgtagctccgtctttgggccgctcgcgtcgccgggtaccacgccgacgcagaggactctggcacccgctgggtcgcgggatgctggcagtacatgggcacgccggtcgttttcgggccgacgcaccccgccatcgccgcagtcgtcgtcgactgcttgtactatagccgccccgtcgtcgcgggccgctcagccccgcacctcgagaagtgcatgggcaaaggccgcaaagctcgcgcaaagaccacgaggagcagcacagctggacggaacagaaacagcaacggggaggagcatagcaaccatacattccaggagtcctgatcgcaagctatgattctgccatgttatcggtgcctgagcggcgtacagagggcgaagcacattatattgatcaatgtggcttgcatgctctatctgttgcctcgagtcctctgtgtattaaggcttaagagtgttttgtttatcagtggattcttggccgtcctgtatagctaattgactaattccttccagtaagtaatacagttcattccaacaaaaaaaaaaaaaaaaaaaactcgagagtacttctagagcgggcgngggcccatcgattttccacccgggtggggtaccaggtaaagtgtacccaattcgccctatagngagtcgtattacaattcactggccgtcgttttacaacgtcgtgacttgggaaaaccctggcgttacccaacttaaatcgcctttgcagaacattncccntttcccagcttggcgtaaatagcgaaaaaggcccgggaccggaatcgcccttttccaacaagntggcgccagccctgaatggncgaaatgggagaatccaaattttttaaagnngnattaangggggttaaaacctactggattctaaattggnnnggggggnttttaanaattccaanggcccaanggnntnattttnagggccccttantccttnaaag

SEQ ID NO: 25277 - DNA, 576 bp, Triticum aestivum
  unsure (1)..(576): unsure at all n locations
  Clone ID: PAT_TA_25277
tccgtaaccttctcaactttttagcacatgctatgtgggtgaaatgatgataccatgccaacttttaaccttttcagagttcatttgaaatgcttttcaatttcagggtcttatagctcaaaataatcagtaaatgcatgaaaatttaatagcaaaaagaattatcataaaataaaataaataagtaatttgaaacaaaataatacaaactttaataaaatatataagtagaaacaaaacaaaataaaataaactttaataacataaataaaatttatgaaactaaaattatcaaagtattttctgttcaaaacattataagcaacctctagtattattgaaacttaaattatataaaattggatgcaactaaaattatcaaagtattttctgttcaaaatcattaaaagcaaatagaatttttataaagaacttttttggttagaaactttaatagcaaaaataattatcataaaataaaataaataagtaattagaaacaaaataaaataaaacaaataagtatttggggtagtggagaaacaaaanganataaataaagcaaannaaanaaca

SEQ ID NO: 25278 - DNA, 874 bp, Triticum aestivum
  unsure (1)..(874): unsure at all n locations
  Clone ID: PAT_TA_25278
gnagtgtgttcccctagnagacctagctgcagagttcaggatgcgaacccagnactgtatcaatcggattgttacctctggnaaagcatggataggttatctggtgtgatggatgaccgtgggaagttcatctacatctccactgaagagatgaaggcagttgcagagtacatcaggaagcaagggagagtgagcatatcacatctggccaacaactcaaaccagttcatcgatttggagccgaaggcccagtacgaggtggagagcctgcaggatgacagtgcagaagcaggcacagaagcatgagaattccttgtgacctggcaccatgtcatgtttccgcgctcaatgatgttttgtagtgtgacttaacatggtttgagttgggcactggccgtataatatatgcagtagtcggtataaacatacttgttctgacatgctagataccattaccccatgcagagaactcaggcttttgttctatcatcatgattgaaaatcatcggttgaccttggtggtgttggggaggagggaggtggtgtttgagtctagcagcaagagatttggcaatgattctgtagatgacaaagactttgctcggagacaaggcagacttgtagtcaggttcacaaatcgtcctattagtaatatatagcctttgcagtgccggttgtgttcttttatgtgctttcttttcgtgctttttactcaatttattgttgggaaattgggtgagggtaagaagcgaagacctcggggatgagagaatttctaggggttcgcgtttataggcgtacacttttaccctttgtaagctagggtatatttctgaatattccatcacagataaagagcatccaagactttttc

SEQ ID NO: 25279 - DNA, 921 bp, Triticum aestivum
  Clone ID: PAT_TA_25279
cttcatacattactttgattataaacacttatgacacgttgtgtgtttcctctttattgtgcctaatgattttaccttaccatgttgcagctcatggtggcacctctgctagcatgaatcctcggtctgacccaaaagaaaagagggtcaataccgtacaagctaaaggcaaagaaccaattggagagaagatgtccaagcaaggcaaagaagaggataatgcggagactaccaagcaaggcaaagaaccaattagttcagagactaccaaacaaggcaaagaaccaattactaccaagcaaggcaaagaaccaattagttcaggcactaccaagcaaggcaaagaaccaattagttctgagaccaccaagcgtccaaggggcaggccacggaaaataccaaagcagacgaatgaaacaactttagattgcgcaaagatttcagacaaggaaactacacatatcgaaattgcttcaaacaaggagccgaaaaaggaatcggatactgaaactggagagaaaatgtcaaaggaaaacgcccctgaggataatgagatggagaagcatgctatggcaacccaaaaagtggacaacgagagcgaccttgcaaggaccctttcgtcgctgaggaggggaagcatggattcggaaatgcgtgagcgagaaaatggcgatctggctgaagctagtgcaaggtcagcatcctccgcggtcaagaaattttacaagagaagaaatagcaaccagagcttcaaaaaataatgtaaagcagatgccgatcgatcacctgtgacttgatcaatcagaggtagtagtactgagttgtagatgaaaccagataataaaaaggtgcaagagatgcacgccagtttgtgtgttcctgaataatgaacattggtttatgtgacttaacatttgtgtt

SEQ ID NO: 25280 - DNA, 1967 bp, Triticum aestivum
  Clone ID: PAT_TA_25280
cattcagttcaaagtttccaaggtatcataaacactgttcaagctcatacaccaccaacaatgctccatcaatccaatgtttatcaccaatcccatggtgcatcgatgcaatcgtatcagtatagtcctgctggtatgaatgtgcattcaagtcatttgtcaacgcagaatgtgtggtcgtcggtatcaagcacaccaattcccgaggccaccgccgcaggcagatccatccggacgtggtttagcataccaccagataatggagcggggcggactgcgatcgggcggaggcacccgccgccgggcgcggccgccgttcctagtacaggtcactgccgacaggccgcaatccgtcgtcctccggccgcgggaactcgccggcagccgagttgattggggggtgccagcggccgcatgcatggaggaggaggcgtccgcagatccgacagccgcctcgtcctcctgcgtctaacctctctggatgcgtgatctgctgattcgcccttacgcccccacgggtgactgcctgggtcttccgtactgccggcaccttgaatggggttcgcgagcacgagagccgggaaggtgttggggcaggggcgggggcagggcagccgttcgttgtccggagcaaggtgaggatcctcctctgcgacagcgacccagacagctcacaggctgtgcttcgccaccactgcacctgctcctaccaagtgacctgcgccaagtctccacggcaggtgatcaacgtgctcaactgcgagggcgctgagatagacatcatcctggccgaggtcgatctggcagtctcgaagtgcttcaagttgctcaaagtacattggcaggaacaaggaactgcgccacatccccatcatcatgatgtccaatagagacgaggtttctgttgttgtcaagtgcttgcggctcggggcagcggagtacctggtcaagccgcttcgcatgaatgagctgttgaatctctggacccatgtctggcgaagaagacggatgcttggtttggccgagaaaaacttcttcattgacaatcttgagttggtgctgtcggaacctagtgatgccaataccaatagcaccacactcctttcggatgagacagatgataagccaagaggaaatagaaatcatgaaacaattacctcgagtcaacatgaatatgagtctcctgccatggacccccccaaaacagactaattggaaaatttacctagcattgcagaagatgatgataaagcatcatctccaggaggaatgttttcacgcccaataaagactaatttgaggatagctgaatcatctgcatttctagcatatgttaaatcaagcactccagcaaacaatccattggataatgaactacagagaaagggtaatcagattgatgttatggatcaccagggtattttctctggtgcgaccgagagaacagacactaatagtggtataaatactccgtatgaaaacgctgtggacacgcctgggccctgtcctgtcgtctgctctccggaccgctgttttgacaagaaggtgaggtatgttaatcggaagaaagttgctgaaacaaggccgagggtgcggggtcagtttgttaggcaggcaagcaacacagatataattagcactggtgatgatatatctgaatatgaagacgatgatccatcctccagggacgttgagttggtttcttcaccagagtagctgaaaggtcgtattatatgtgaaatggtgtgcggatgatcattgcttactttgcaactcagtactcatatgcaatacattattcctgctaatagcaatgcatcattttgctttcacaatacatcctcaacccccaacccctcaaaagaacttgtggcatatgtatggatattattgtggacattttgagcaattgtattttgacaatataagttagtatcactagtcagtgatacacatggcattgtgac

SEQ ID NO: 25281 - DNA, 195 bp, Triticum aestivum
  Clone ID: PAT_TA_25281
gggcagcagcagctccacacccagccactcgcccacggtgaactgcggctgatggcatgccgcagatgcacgccggtaaaagcctgccgcagcgtgcaaccggcgcggccccgtggcgatgatggccgcatcccccaggcccagcggcagcaccatggggcgcgattgcatgcgcgggcgctgctcggtcatcac

SEQ ID NO: 25282 - DNA, 799 bp, Triticum aestivum
  unsure (1)..(799): unsure at all n locations
  Clone ID: PAT_TA_25282
gagcagatcctggntgacgcctacaacaagtacatgtttgacgacgtgggcctgcccagtggtttgccgaggatgagcaagagcacaccgtgcccatgaagccgatcacgaaggaggaggtggcggccatgaaggcgcagttcagggagatcgacgcgcggccatcaaagaaggtggcggaggccaaggcgcgaaagaagcgggtggcggctaagaagctggagaaggcgcggcagaaggcggacatcgtggcggaccagagcgacatcaacgagcagtccaaggccaagatgatcgacaagatctaccgcaaggcggtgtcgacccagcggcccaagaaggagtatgtggtggccaagaagggcgtgcaggtccggaccggcaagggcaaggtgctggtggacccccggatgaagaaggacaagcggagtgccggctcgggcaagaagggcggcaagggtaagaagggcgctggcggcggtcagaagaaaggtgggaaggctggtggcggtgggaggaaggccggcggcggcaaaggggggccgcgttgagtagtttgacgagaggcgtatggatgagcagctgggcatgtcgcgcctgctgaaagttggatagctcgctctctgctgccgaaatttttgcctgtccgggtagctaagctggttttgctatactataatacgttgatgctatgagagctgtttcagtccgtcagaaaagttttgtaagttacgcttgtatcggacgaattttctggataataatttgtgattgtggttaaagcctgacagtaacntaa

SEQ ID NO: 25283 - DNA, 679 bp, Triticum aestivum
  unsure (1)..(679): unsure at all n locations
  Clone ID: PAT_TA_25283
cccagcgtccgcggntacgtgggccaccgcacggcccaccgtcgaccaccagcagcaacacaccaccacaccgaggccaagcgaagatgtcgggccgcggcaagggagggaaggggctgggcaagggcggcgccaagcgccaccggaaggtgctccgggacaacatccagggcatcaccaagccggccatccggcggctggcccgccgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggacgcaccctctacggattcggcggctaggccacgcgaatcgacccccccaccaccagatttgtgctagtagctagctaatggctgtgtagtgttcgtgggctttggtttaatggccgcatcttgctgctgtatgtcctggccttgattgctgtttggatgtagttctggggtggaattgaaattgaagtggtttaccttgaaaaaaaaaaaaaaaaaaaaaaaaaaaaaactcgcgagggggggccngtaccaatccccctaatagtgatcctattacncgcgcnaacggccgtcgtttanaangtctg

SEQ ID NO: 25284 - DNA, 859 bp, Triticum aestivum
  Clone ID: PAT_TA_25284
ctctgcccccgcccagcgcgttccattttgaagcaggaaacagccgcgcacatctcgtcgcccctggttcctcgtccgacgaggaagaggcgatggagcggcggagggctgcgtgggccgcggtgctggtggcggtggccgcgtgcgcggcgctgccggcgacgacgacggcgaacaagatcaaggtcaactggttgcccaacaccaactactccggctgggagcaggagcacggccccttctacaagggcgactggctcgtgttctactacacggcggggcaggcggacgtggtggaggtgaacgagtccgggtacaaccggtgcgacgccagcaacgccatctacaactacagcaagggccgcagcttcgccttcgagctcaacgagaccaagacctactacttcatctgcagcttcggctactgccccggcgggatgcggctggccatcaagtcccagaagctgccgccgccgtcgccgccgccctccgcgcagcaccaccgctccgccgcgctcgccgggccgcgcgccggggtcgccctctacgccgccgtcgccgtcctcgccgcgctgctcagggcggtctagtctagccgatctggtctggtgctagttccgcggtcgctcgcttggggggttgtgtgggtgttcccccccctctgctcgtccttggtgtgtgttcctaatcctaggctaggagagtggtagtgccacgggcattcttggttgactagcggtgtggatttgcggaaccaaatggttaccggcggattgatttatcaagtgtgaagagtgcactggactggagagaaagaaactgtttctacgctactgattagtttaaatctatgttcatt

SEQ ID NO: 25285 - DNA, 586 bp, Triticum aestivum
  unsure (1)..(586): unsure at all n locations
  Clone ID: PAT_TA_25285
ggcatgctctctaacgtgtgtccgtatgtattacagacagccgcattgcaagtccgcaagcagcgaaagatatcctgaatgaatgatgaaccaacaaaagaatttgagctctagtcaaaatgttgccgttgctagcctctccaggtcttgttttgtgagatattgcgcggcattggcctcgccgcgaaacaaaacacccgtgtaacctattctatgatgtactagtatcatgcgccagtacatgagaaaataatccaccaatctcatgcttgggtccagcgtgcactactttatttctctctcactctcagggatgaggcatagcaaaacaatcactccatgctagctatgttcaagactacaggccaaagaatgtctccaagatgatcatcacttctcctgagtccgaggtggcaccgctgtaagtgtcggcgtcggcaccgctgtagccttcggcgtcggcgttggccggggcttgcatgacctgcagtcagctggtggccgagtggagctggcgtgcgtctgcgactgtcacctcatggtctggcgctccatctcggtacaacgtcaaggatgggtcatanat

SEQ ID NO: 25286 - DNA, 734 bp, Triticum aestivum
  unsure (1)..(734): unsure at all n locations
  Clone ID: PAT_TA_25286
cggncgcgtgggcggncgcgtgggcgcccgcagnacagtacactacactggtagcggcagcggtaactgaagcgggaggatgaacggctaccgcaacctggcctcgtcccctccggcgcccagcggcggggagccggagccggagccggccccgcccccggccgcggcgaaggagggcaagtgggagggcgcggcggtcggcgcggcggccatggccaggaacctctcgtcgtcctccccgcgtccggcggccgtggagcggagcaagtccaccggcggccaccgcggcggcggcggcttccaggcggccgtgaggcgggccttctccatgcggaggcagccggcgtccggcctctcggaggggtactggcggatccacgacggcctggacgacgccgaggacgaggcagaggcgcccgaggaggtcgacgcgcagaagaagactcaggtggcggaggccgcggtgccgggagacgccgcggcgagcaacgacgagatcggccaggaggagacgaagaagaagaagaagaagaggggccacatcttcaaggcgtgcaagaagcttcttgggttcaaacatgtctagtctagtctagtcaacaggaagcttcttggattcaagatccatggacgctcttgatgcgcctccgttttggatcttgttcttgtctcgttcgtcgtcgtttggagtaaataaagagcttgggttcgttgacttgaaaaaaaaaagaaaa

SEQ ID NO: 25287 - DNA, 702 bp, Triticum aestivum
  unsure (1)..(702): unsure at all n locations
  Clone ID: PAT_TA_25287
ggnagccaatagagtttgcggtaatatgtggtacacgagaagagttgagatcctatttcctttaacttctcgtattccgtctgtacgtgattggagtgtcaatggaataatatgtcacgcatactcattgccagggcaaaagttctatgagagggggttggaaagggacaccgctagtttgaaatttcaaggaagaaaggcactcgagagaaaggattaccattctgcaattgaactatacattaaggcaatgggccttgattatgaggatgcgaccctgtactcagataggagtgtctgttttctccaaattggcgagggagacaaagcctttgcggatgcttatacttgtagaatgatgcgccctgactggccaaaggcctgctatcggcagggagcatctctaatgctgatgaaggattatgaaaaggcctgtggtgccctttttgatggtttgaaaatggacccacggaatcttgagattgagaacgctttacggcatgctatatctttcatacaattttactgcacattgtattttattcaagatgccaacagtgctacactagcagtcaccagagctaaaaattctttgaaacacgacccccaaggccttttttcaacttgttaacatcatttggttagcaactgctgtggaagacatgaaaaaacagagataattcaaaaagtggcatactctcg

SEQ ID NO: 25288 - DNA, 1002 bp, Triticum aestivum
  Clone ID: PAT_TA_25288
aaaatgtgtgaagctactaatccaggctggtgctgatgtaaatggtgtgggtatataacccccttaatagctgctgttgggttaactgagtgcatgaagtgcttattggaagctggtgctgacccaaacgtccctgatgaatttggcaggatgccaatagagtttgcggcaatatgtggtacacgagaagatgttgagatcctatttcctttaacttctcgtattccggctgtacgtgattggagcgtcaatggaataatatgtcacgcatactcattgccagggcaaaagttctatgagagggggctggaaagggacagagctagtttgaaatttcaaggaagaaaggcactcgagagaaaggattacctttctgcaattgaactatacactaaggcaatgggccttgattatgaggatgcgaccctgtactcagataggagtctctgttttctccaaattggcgagggagacaaagcctttgcggatgcttatacttgtagaatgatgcgccctgattttctgcaggcctgctatcggcagggagcatctctaatgctgatgaaggattatgaaaaggcctgtggtgccctttttgatggtttgaaaatggacagacggaatcttcagttggagaaccttatacgtgtagctagagattccctgattggccaaaggcctgctatcggcagggagcatctctaatgctgatgaaggattatgaaaaggcctgtggtgccctttttgatggtttgaaaatggacccacggaatcttcagattgagaacgctttacgggaggctatggattccttgaggatatctcgtgtctctgctaagactgtatcgaagtgcccataggagcttgtttaccgcctgcctgcacgagtctgcttgcttctgcacgattttttccgagttctgtccatatgcttttatattgtagatagagaagcagttagattgtgtgcaagtgtgggttttccgtagtagtcgctggctg

SEQ ID NO: 25289 - DNA, 455 bp, Triticum aestivum
  Clone ID: PAT_TA_25289
gtgactttgaaaattgttacgacatcaaatttcaaaaaggtcatgaatttggaaaattaaaaaaaaggttacaaatttaaaaattgttcgcaagttaaaaatttaaaattcatgatcttgaaaaaacttaatgagaatgtcgcaaatttccaaactaaaaatgcttcacaaatttttaaaaagttcactggtacgaaagaaagttcgtgaaaaataaaccaaaaaagaaaaagggaagagaaaaaaccgagccaaaactatgcatgaaaaaaccaaaagaaaaatcgcccacaaaaccttcctgaaccagaaccggaaatgtatataacaagtagcggaagagccgaagaggtatatcgatgcacagcaggaaaggtcttcgaggtggtagctgcggttggaattgaacctgttggtttagagattgattcccaggaaaagaaaaggaaaaagga

SEQ ID NO: 25290 - DNA, 449 bp, Triticum aestivum
  Clone ID: PAT_TA_25290
ctggcccaagcccaagcgagatccgacgacggccgagcgagccgatccccaatccgggagaacgccggcgattccgtccatcctccgtcgctccatagccgtacgatccacatagtgccgcggcggagtggccagccggccggccggccgggggactggcaacgagagaggatgagggagaatcagcaaacagatcgaggggctcggctggctagcgccggtcgaataggaagcctgaataaggtacctgactgtcagataggaagcctgaacatgtactacttgactgtcagatagcaaggtagcatcttcctactggagcgctctagcagcaagcacttctatcatcggcaaaaaccgactccgcattcgacagttgcttttaatgaaaactcccctgtgggtatttgtgctctgaagcaccaaactagtcccgctaaattgtaatt

SEQ ID NO: 25291 - DNA, 822 bp, Triticum aestivum
  Clone ID: PAT_TA_25291
gtttgattccaaaccccgttggatgtacaacatgcaatcctacatcgttgtgaaatcacttgtatctttagatgtatataaaaaggctggcattgtgcgcagaccgaaacagcaagtaggctgggaattgaagaagtggaaggcatgggaggataagcgtcgtgaggcagaggatatacgatgccgtgtccacaaacacgagcatgccttatttggaaatgcagaaaaaatgggtaaaatgtatcagtctttgcaggataagccacatgatgtagcagaacgtctacgcgcagaactcaatcaggtgttgcaggacatgccggataatccaagtcagccaaagtccccccggaggcttaattgggtggagcagaagcaggactatgagaagttgatggcccgttcagtgaaactgaaagaaagggctcaggtcatgaagcaggcacatgataacatccttgagcatcattgcaagttttaagtcggataagggtaaatcagctgctggcgcttcctcctcctccatcgcccgtcttgacctgtagaagggggaagacaaccctttaaactgcacttagctatctggagcacttcttgttatattgtctctatttcatcctgagagattctgtaacctctgccaaggaggctcttgtccccttcgattggatgtgcgcagcagttgttcgtagtcggatttagcctctcgctccgtcagttgcttgttgtcattacattgcactttcaggtttctagtttctataaatgttgagcgcaaattgccgcttggccgagagatccaacaggaacgatggtcttgcc

SEQ ID NO: 25292 - DNA, 948 bp, Triticum aestivum
  Clone ID: PAT_TA_25292
tccgcccgtccgccagctggaagagcgcgtcgcccgcctcgaggtcgactacgagaggcagaccgcgcgcatcttcgtcgagatcgatcagaacaggtgacgctcgagctgaagctggacaaggcctcgttcgaccagtacaaggaggtccaggccgggctgaacaatctccagggcaggtgcggcacttcatctgaccagatccgggctcttgcggtcgcatcagccgcacgcgacatcaaggtggacaagcagcacgtccagtgtcttctacagatcaagaagaacacatggaaagttgcctgtaccgtcctcctgggcgcttctgcggtagcttttggggtgatgaacgtagtgagcgcccactcaagagatgacaacctcaaggctgcagatgccctgttccagaagaagatcgctaagcttgagaaggatttcaatgccaagcttgactccacagcgaagctggctgtcggaggttgtgctggcccaagcgggcactgcaggagagcaacgaaccggaccagcctcctccgggcactggcggcacctcctccagaggctcaggcggctccccttagttagctaaggcggaaatgggactcgcaaacaaacgcgggtggctgtatcatcttagttttgcctcacaaacaaacgctggtggttgtatcatcttagttttgcctctttttgcaagcatactatctagacattcttatgtgaatgtgtcattttgcttaattagcttctggatggtgcaatgtgtgatgacattgttgcttgttataaattatggtctatctgcctgcattagtatatgctgaatgtcattgttaatacactagacttgctttgtatgggggagaaccttagctagatttccatataacaagtatggaattgggttttctttcaatgctggaaaggaaactaaaccacattcaagag

SEQ ID NO: 25293 - DNA, 621 bp, Triticum aestivum
  Clone ID: PAT_TA_25293
ttttactagttagaccatgacacgggcgtgtattttcattttcagatgatacaacaaggccacgagatgtggcaagatacatacatagggaggtagaagagtagataaatatcgcagaggcattctggcgacgaaatgcacacctcaggatgagcacagggaggccttctgctttgtcagcagctggttcagcttgaccagcagctgatagttgctgcacatgtaatcctggaacgatctccggaggctccggaggtcgcctacgtggttcccgttggagcccgggttcagcagcgtggtgaagagctgcttccacagcgcaacgttccagtaccttttaaatgacaatttcggttggtacatgtagcttccacctgttccggccaccttaacgatgctcatctcttccccgtgcagcatcatgtgtgcaaccacgcacagaccaaaagtgtcaacttgatatgtccagcttctctcttcttgcatttcgatacaactgaaccctgaggttccacaatccccaaggaactccgtgccggctgggaagagattcacatcaatgccacggccccagtcaataagacacagcccctgattctgcccgcttctcgtttcgctcct

SEQ ID NO: 25294 - DNA, 520 bp, Triticum aestivum
  unsure (1)..(520): unsure at all n locations
  Clone ID: PAT_TA_25294
caacttcgctcctcataggccactgaccaccttcttctaccctctgatgtccgatccaagcggcaccatcactgcccgcccatctgcaactagccggccaaccttgagctccaacagagtggctaggtttctcctagctggatccctagctctggccagtctgatcggggaacctacacacaaggcaagctgcaagctagcttcctcttccacctctgcctctgcctcaccccaggctagaagcttctcttctctttagcctcacntctcaccgtcaccggcacatactctgcggctgtaacgaccgagatggtcggatggccatgagctcatctcctcttcgggcgttcctggcggccatgctcctcaagcttcctcctcggagctgcgacgacattcagccgcacacgccgccgatgccctccgcttttcagaacctggcgggagggcaagtcccggtcggggcgccgccgccgaagtgcaaaaaccggtgnaaaagtgnaaccctggaagccgggga

SEQ ID NO: 25295 - DNA, 502 bp, Triticum aestivum
  Clone ID: PAT_TA_25295
cagatacagagtatgaagctaatggggcctgatgggtacgacaagagcgtgtcggacgacacgagtacgagtgaaacctctagcatctccctcggtcagatcctgaacaggaggcaggcaatcttgacttatagcagtgatacaagtgctaacaacaaattctcaggaaagaggaagaagtttgccttcactgggctttcagttttcctggctaagcaggctaagagcaagaagaagagagggtcagatgagaactgatgttagaaattctccggcaaaggggaagaagtttgccttcactggcactttcagttttcttggcaaagcaggccaagagcaagaaaaagagagggtcagatgagaactgatgttaactctgccagaacactagctagttactgagtgttttgacaccctctttccatgtcttgtgttcctgtataatgttcctaggagtatatgtttctaggttaatgaggttctgatatttccaaaaaaaaaa

SEQ ID NO: 25296 - DNA, 539 bp, Triticum aestivum
  unsure (1)..(539): unsure at all n locations
  Clone ID: PAT_TA_25296
cattgacgtagcacatgctcgccggagggatcgcgcggtgcctctgaggcagcaatggcagcggcagcagagtcggacaacgggagcgaggtgggcccgaccggggactcgggggcgttcgcttcgccggtgaaggcgagggagagggcgccggagtcggaggccggcgcctcggcggcgacggcgtccgagtcctcggagacgagggtcgacgacggcaacatccaggaggccgagtcctcgctccgcgagggcctctccctcaactacgaggaagcaagagctctcctcgggagactagaatatcagagaggaaatgtagaaggcttgcacttcgagtatttgatggaatagaccttcaagctgctattcagcgtttccaaccgccgcntttcagaaaaaccaatcttccaagcgggataacaaactacggccagattcaccgatttcaggatcacagcatgctgccagccttgttcttgaagccatttacttgaaggcaatgtctcttnaaaagttggggaaagcaatagaggccg

SEQ ID NO: 25297 - DNA, 1044 bp, Triticum aestivum
  unsure (1)..(1044): unsure at all n locations
  Clone ID: PAT_TA_25297
cctttcctctccccccttctaccccaattctcacctttcctctccctcggtcgtcgccttcgcctcccgggaaatcgcctgccgcctcgtctcctagaaactcgccgccgccgtccgctgccatgaatcccgaatatgactacctcttcaagctgctgctcattggggactcgggcgtggggaagtcttgcctgctgctgaggtttgcggatgattcatatctggagagctatatcagtactattggtgttgacttcaaaatccgcaccgttgagcaagatggaaagacgataaagctgcaaatttgggatactgctggacaagagcgatttaggaccatcacaagcagctactaccgtggtgcccacggcatcattgttgtgtatgatgtgactgaccaggagagcttcaacaacgtcaaacagtggcttaatgaaattgacaggtatgctagtgaaaatgtgaacaagcttttggtggggaacaagtgcgatctagctgagagcagagtggtttcttacgaggctggcaaggcccttgccgatgagattggaataccattcctggaaaccagtgccaaggatgcaacaaatgtggagaaggcatttatgaccatggctgcagagataaagaacaggatggcaagccaacctgctggaaatgccagcaagcctgccaccgtgcaaatgcggggtcagcctgttgctcagcagaatggatgctgctcgtcttgatcaacactcggagatcacagtagtgttcttgcaaaactcaattggttgttcttcccctgtaaattaagtgtactactatcatgccgcctgttggaagaagtgtcatgtcccctaactacaacagtgcagcagatgctgtggcctgttttagctgactgttaatatccgccactttaatgtgtttcgtttaatattcaccttcatttggttaatgtttcatgtttcccatgctttgaagttcaatgctggtgacagtattgcgacgatgagcgatcataaattcacctggcattatatgtcagnggaagac

SEQ ID NO: 25298 - DNA, 1300 bp, Triticum aestivum
  unsure (1)..(1300): unsure at all n locations
  Clone ID: PAT_TA_25298
ccgcggtcccctttcctctccctcggtcgtcgccttcgcctcccgggcaaaccgcctgccgcctttcctcgaaatcgcctgccgcctcgcgcccccgggaaaaatcccctgccgccccgtctcctaaaacactctccgccgccgtccgctgccatgcagtcctgtatatgactacctcttcaagcggctgctcattgggggctcggggcgtggggtaaagtcctgcctgctgctgaggtttgcggatgattcatatctggagaggctatatcagtactattgggtgttgacttcaaaatccgcaccgttgagcaagatgggaaagacgataaagctgcaaatttgggatactgctggccaagagcgatttaggaccatcacaagcagctactaccgcggtgcccacggcatcattgttgtgtatgatgtgactgaccaggagagcttcaacaacgtcaaacagtggcttaatgaaatcgacaggtacgctagttgaaaatgtgaacaagcttttggttggggaacaagtgcgatctagctgagagcagaagtggtttcttacgaggctggccaacggcccttgccgatgagattggaataccattcctggaaaccagtgccaaggatgcaacaaatgtggaaaaggcatttatgaccatggccgcagagataaagaacaggatggcaagccagccggctggaaatgccagcaagcctgccaccgtgcaaatgcggggtcagcctgttgctcagcagaacggatgctgctcgtcttgatcaacactcaaagatcacagtagtgttcttgcaaaactcaattggttgttcttcccctgtaaattaagtgtactactatcatgccgtctgttggaagaagtgtcatgtcccctaactacaacagtgcagcagatgctgtggcctgttttagctgaactgttaatattgctattttaatgtgtgtcgtttactattctttgaagttcaatgctggtgacagtattgcgacgatgagcgatcataaattcacctggcattatatgctcagggaagacatatttgcttctatccctggaatgctgctttttgaacaccaccttacgttccagctgttatgtttggcacctgcttgtcagatgattattaaacagcaaatacgtatctcccgccttccctcaaagtgcttgcgtaagtttggnactgttgcagtgatataacacaaaaaaaaagggggggccgtaccaatcccctatatgagctataccgcccacggcgtcnttaaactctgacgggaaaccggcgt

SEQ ID NO: 25299 - DNA, 657 bp, Triticum aestivum
  unsure (1)..(657): unsure at all n locations
  Clone ID: PAT_TA_25299
ccgatagcgagaagagaagaggagcagggcccagtgagtggtagttggagctcagtgacacttcagttcttgagtcacttctctgacatctagagtaattgataggtctggggaagaggaagaaacagagcaagaaagagatcgccacaatgccgatggagcaggccttcatgcactgcgacaaggacaccctcaagatggccatgctcaagcatgaagagaccttcaggcagcaggttcacgatctccatcgcctgtacagaattcagaagcttctgatgcgggacctcaagagggagatcaagagccagcagagcgacctgtccgcctcccccaacggctccccggggcgccgagtacgaccaccgccgcagggcgagcgcgctcgacgcgtcctcctacgagcagcactggcagtacggcgccacccgccgcggcagccacgcggcggcgactccgcgcgccgcgcagctgagccccggaaggcgaccgacgacgaagaagccggactggagctcacgctccccgtgggncagcggnggcaanaagcgggacagcgacgggcactgctcccccggggagagcttctcgtcgttcacgacggagtggacacgcncacgggcggccannaattgcagcaggcgcaggcgcanacca

SEQ ID NO: 25300 - DNA, 660 bp, Triticum aestivum
  unsure (1)..(660): unsure at all n locations
  Clone ID: PAT_TA_25300
ctcctacctccgtcctccttctacctctagctataaaggccggagctctgtgtgccatgtgagacccctcctcctcctcatcttcctcctccttctctctcgcttgcgttcgagctcggttcgtcctcctgattcggctgtccggacagcccgtagatcaagaaatggggttcccggcggcgtactcggagatgcccaggctgctgctcaacctcctcttcctcctcggccacctgcgccgcctctcctcctggctgctccgcctcgtcggcgccggcgtcgacgacgaccacctcaagcttcgactactcggacaccgccgccgtcgcctacttcgccgaccaccacctccgagcacgcaccaccaccacgcaccacggccacggcctggaggagctggaggagcactccccggccgtgcgcttcgacgcgctcccgtccgacggcgacgacgggacggcgccgctgctgccggagggctgcgcggtgtgccccggcgacttcacgggggccgcncggggtgcgccgggcgcccgggtgcgcaagtccttcaacggcggtgctcaacgctgggcggccaacgcaacgaactggccggtcnggcggggcngntccnacgccgggccggggtnttnanccttctccngcaatcccttcggg

SEQ ID NO: 25301 - DNA, 371 bp, Triticum aestivum
  unsure (1)..(371): unsure at all n locations
  Clone ID: PAT_TA_25301
gcgctctaaaacagggatcccgggctgcaggaatcggacgagtgccttcattantgagggagtctcaactcagcctcggcagggattttgatctacatgtccctggtggaccttctagcaacgcctcgcgccgaccccggcccgcggacaaatacaaagcttcagctgatgacatatcttgcacttttcctaggtgcagggatgatgtccatgcttgccatatgggcatagagatcttcaaagcaattgccaaatttgcacttgtatttcctgctaaagttgaagtatgcattgtattcatccaaggagttctccatttccccaaaataatacacccttggtgaaaaattaaccatattcaaancacgaaa

SEQ ID NO: 25302 - DNA, 2819 bp, Triticum aestivum
  Clone ID: PAT_TA_25302
gggaggtgtgtcaacaagacaggtgcaccaagagcgcagaaggtcattctggcctctgcatctctcatgggggtgggaggcgttgccaatttccagaatgtgcaaagggtgcacagggaagcacaaagttctgcaaggcgcacggtggaggcaagcgctgcactttcttgggctgtaccaaaggagctgaaggcagcaccccttactgcaagggccacggaggaggcaagcgctgcttgtttgagggtggtggagtgtgccccaagagcgtgcatggcgggacgcagtactgtgttgcgcacggtggtgggaagaggtgcgctatttctgattgcaccaagagtgctagagggcggacggagtactgtgtccgccttggtgggcgggggttgcaagctgttctgagttttctaacctagtagaagttcataaataaagttatgataccaggaagtcagtcaactggtggttcttttcatttactaattgggtgatgtttccgaattggaatggacaaaacttctcatggccttggatttggtgatagcatcaactcgttaaacacttctcagtaccagagtgcagttgaacatactgctcagcatagagacactacacttgattccacatcatactccagcttttcattcactaacacaaaagccctgaaaaggaagtggggtactatggcgggagcagaaggtactggggatgcattactcactctgggtttaggccgttcaccaagttcatctgacgatagcaaagtaagctctgccacagcttgtgcaatgtctccatgctcgctaaaggaggctgatgaggagtcatctgttgatcttagcttgaattttgagctttcccttggcaatgatgttgcacacttccaacggaaatcctctgctggtttggtggccaaatctcctaaactggatcttcagttgagtttatccactggctcacctgaatctgctgtcacttgtacaaatatggtgtcaccaaatattcatgatggcttggacataccagtgacctattcattaccagccattatagggaatgggtcagcaccgtctagttggggttttgagcactctgtgatttcatcatcatatgcgtctgaagcaacatatgcctttccattttcgaagatacccagacaagagaatggtactttgtcttcgccagtcatatcgtcaactctgccagcaagtgtgaagagctcggttgcctgtacttcggtggtaactaaccctcagcagcgcaatcttaacactaaaacctgccaattccctggatgtgggaaaggggcaagaggtgcatcagggcattgcatagcccatggtggtggcaggcgatgccagaaacctggttgccagaagggtgctgaaggaaggaccatatattgcaaggcccatggtggagggaggagatgtgagtttcttggatgtacaaagagcgctgaagggcgcaccgaccactgcattgcccatggcggtggccgccggtgcagtaatgatggctgctcccgtgctgcccgaggaagatctggcttatgcatcaggcatggaggtggaaaaaggtgtcagcaggagaagtgcaccaagagcgcagaaggtcattctggcctctgcatctctcatgggggtgggaggcgttgccagtttccagaatgtgcaaagggtgcacagggaagcacaaagttctgcaaggcgcatggtggaggcaagcgctgcactttcttgggctgtaccaaaggagctgaaggcagcaccccttactgcaagggccacggaggaggcaagcgctgcttatttgagggtggtggagtgtgcccgaagagtgtgcatggcgggacgcagtactgtgttgcgcacggtggtgggaagaggtgcgctatttctgattgcaccaagagtgctagagggcggacggagtactgtgtgcgccatggtggtggcaagagatgcaggttcgacggctgtgtgaagagtgcgcaggggagcactgatttctgcaaggcgcacgggggaggcaagcgctgctcatggggcctgccggactcgagcttcggtattggcacagagcagtgtgataaatttgctcgcagcaagactggcctctgttcagctcacaccgctctagtccaggaccactgtgttcatggtggtggtacattaggccctgtgatccaccacttcgccacagatgttaaacccgacgagatggaagttgctgcagcagtgaaggttgatcctgtttcgatgcagtcggagcctccattgccggagggcagggtgcatggcggcgggctgctggcgctgctttctcgcggcggaaaccacacaggccctgttggtaactcggagaacggggcctctgtcatgatggcgtggatgtgagtgggcggacattctcatcaagaattggttgcttcaagttttgatctgtttccagagctaatgctgtggcgggatgaagttcaacatttcaccaattgttgtcctagttgtttggaagtggtaggacatatatcctccgtgtagaataaataagggagagcgttgtgggcttctctgttattgtaattaattaattaatgtcgtcaaactgcccttgctttgtgtttattacaatttgtgtaatctgatactatttcacagttcctacttggatgtcatctcttcaaaaaaaaaaaaaaaaaatgtttctggtaatagtgcagcatgtagtacgatatttttggtgggtagaagtctgtcttatattgatcggatgagggttattttgttatcgattattcatcagataattcttct

SEQ ID NO: 25303 - DNA, 746 bp, Triticum aestivum
  Clone ID: PAT_TA_25303
atgtcatgttttatctatcagaaataagcccataatggaagagttaagggtgtcctctttctcatgccttgccattcgacgccttattactctaccttacatagcagcctacctatgcgctttttggactgtactcccagtgataataaagggaccctggatgaatcagaccgtttcctcatgaacccacttgattttgtgggtgaggtttttggaaatctatcttccttcagtcacattgtgttatttgaatctgaagaaagacatgttattcagttgcttctgcacgattcctttcaagaggttaggaggtttttccattcccacttcaagattgatagagaccttcagtcgtctgttgttgtatattcacggagggatgtgctatgattgcttttgccgagaaaagcttgttaccccatctaacaacctctgattgtgtttcacagtgttttagtttgttatttctgaaattagctgtaacactattggatactagaacttggcaatctgttatggttttttacccctccgacatgttgtgcctatcctttttgtatgggtcagattttgtataacaacatggaacatgcataagaaagtctccatatccatgatgcatttctaagacgaaaagctagaaatggcagtgtttccttgcagcaatgactgataacaagagtgaggtgcgtggcttgttcatcacttattttttattagcacaaagagatcattacccagttaac

SEQ ID NO: 25304 - DNA, 458 bp, Triticum aestivum
  Clone ID: PAT_TA_25304
tgattcactcataccaagcattaattgatgtcgagggaggcttcacgcaagctcctcttggcggcgctcctcctggtgctgctgctggcggccacgggggagatgggaggcccggtggcggtggctgaggcgcggacgtgcgaggcgaagagccacaggttcaggggcccctgcgtgcgccaccgcaactgcgccaacgtctgcaagaccgagggcttccccggcggcaagtgccgcggcttccgccaccgctgcttctgcaccacccactgccgccagtaaccaacccactacctctacttcgtacgtccgcctagctgcagcctgcctgcgtgcatgctggcttgctcgcaccttctgcgtgtattgtagtactgtgtgtgtccatgaataaacctcggcctgtctgtcatggcatgctgagatgggtataagaaacgcaggttcccttttacttt

SEQ ID NO: 25305 - DNA, 616 bp, Triticum aestivum
  Clone ID: PAT_TA_25305
ctccccagcaccctgacttgcaagctgtagtgtaccgatccatggaggcttcacgcaggctcctctccgcggcgctcctcctcgtcctgctgctcgccgccacaggggagctgggaggcccggtgatggtggcggaggcgcggacgtgcgagtcgcggagccacaggttcagggggccctgcgtgcgcaggtccaactgcgccaacgtctgcaagaccgagggcttccccgacggcaagtgccgcgggttccgccgccgctgcttctgcaccacccactgccaccattaacaagcctctccttcgggtgatgccttctttggggtggcctttctgcgagcgtccgtgcgtgcgtgtccatgaataaacctcagcttgtctcggcaagctaggtgcgagtcccttctttgttttttgtatgattattgccagtgtttgtttcttgttgggttcgtcctcagagttgctgcgagatttatgggattatcccagtcaatccttctgtcatgtaagattttattttgggcaaatcatgagtgttgtatgcctgttccctcagtaactcactcgttgtgtatacaattggacaggcatgtcacatggtgcctgtagttgtg

SEQ ID NO: 25306 - DNA, 857 bp, Triticum aestivum
  unsure (1)..(857): unsure at all n locations
  Clone ID: PAT_TA_25306
gaggaccctgatacactcctcccaagcagtaatcgctgacattcgagctctagtcgatcgatccatggaggcttcacgcacggctcctctcggcggcgctcctcctcgtgctgctgctcgccgccgcaggggagctgggagggccggtgatggtggcggaggcgcggatgtgcgagtcgaggggccaccggttcagggggccctgcgtgcgcaggtccaactgcgccaacggctgcaagacccagggcttccccgacggcaagtgccgcggattccgacgcccctgcttctgcaccacccactgccaccattaacaagcctctcgcctgcgcgtgatgccttcttccgtctcggcctgcagggtggcctttctccgcggtgcgttgcgtgtgcgtgtccatgaataaatcttagcttgtctcggcaagcttggtgcgagtcccttgtttgttttttgtatgattattaccagtgtgcatgcgttgttgtttcttgttgggtttatgggattatcccggccggtcaatccttctgctcatgtagtaagattttattttgggcaaatcatgaatgttgtatgcttggtactctcaggcactcacccgctctgtatacaattggacatgcatgtgtgatggttttatggggattatcccagtcaatccttctctcatgtaaaattttaattttcggcaaatcgcgagtgnngtatgcgtnnnnnaaaacttcgnangggggggggccccggtanccccaaatttcgncccctattagnggaagtcgggantttacnaaatttnaacttgggcccgtcgntttttncaaaacgttcgggggaactnggggaaaaaacccct

SEQ ID NO: 25307 - DNA, 865 bp, Triticum aestivum
  Clone ID: PAT_TA_25307
taaaaatccttttgctctgtctatcctgaagcaagtggaacataagttacatggacgagatatagatggtaccaggtccttgaaaatttcggagcaagtagactatcttcttaagcaggcgacaagcatcgacaatttgtgtaatatgtacgagggttggacaccttggatatgagacaactttcatcaatgtatgctgtccagagtttcgggcagaagacattccatggcaaaagcaggatagcatgtcaagcaattgtatggttgctatgaatgacggcgagccaagttaaagagctctaccggtgtcatttataagacagcgcggctcgacttccctgcagcatgtggcatgaacggctacggatgcttccaagcagaggaggggcaccacttcggtactgttggcctctgcatctccaatgttaggttgccattcacatgcattctgggatccagacaatgacattgtggagtgctgaagcttagcatgatatgaacgaaaataccctaagcattcgcaatttgcatggacatgcggcgcgctcacccacggggattcgaaattggtaaagctgtcaaatgtacataatacgttccctgtacatctgatattttggaagctcctttccatgatccaactagcatattggaaagcgtaggcgctggatatgcaactgtgaaaatgccgttcgtattccacgactcctcgcggatcatcaggtgtaaatagaaatgttcaatgtcgatcgatgatcacagtatattgatcggagttaaatgcgagtgtagagctattcaacatgctagtaatgggaacgtatactcccagatgagatccttgcagtaacttatgtccactctt

SEQ ID NO: 25308 - DNA, 1208 bp, Triticum aestivum
  Clone ID: PAT_TA_25308
ggcgcggcgccgtgccggagacggagagcagggcgggccatctcccccgccggggaggcggccccccgggcgcctccgggcgccggacgtgtgcacccaccgcgtggccccgtggcgaagcgccattccgccaccgcccgcccgccggtggacgagcgccgcggtggaggagacacgccgtgcgaattagcgggaaaaacatgttcatccagaaggcatggaggacggcggcgttcgggctctacggcttcacccagttcaccaaatccggcttcgtggaacacgccaagaagttcagagaggaggatatgcagatccggttggatgggaaaaattgcctggtaactggagcaaattctggcctaggttatgctacagctcagggcttggcttctcatggcgccactgtttatatgctttgccgtaacaaagaaaggggagagactgctctgaatgaaataagatccaaaactggcaatatgaatgttcatctggagatatgtgacctttcatcaattaacgaagtcaagtcgtttgccacaaaattctcttcattggagaagccacttcatgtccttgttaacaatgctggcttactagagcacaagcgtacgactacaccggaagggttggagctcaattttgctgtgaatgtggcagcaacatacactttaacagagctagtgatgccactgttggaaaaagcagcacctgatgctcgtgtcattacagttgcatcaggagggatgttcactggacccctgaacacgaatttgcaaacagcgaaagcgatttatacgggacaaaacatatgctcgtaacaagagagtcaagttgctctcactgaatggtggctggagaaatacaggcaagggtgtcggttctactccatgcaccaaggatgggctgatacactggatcccaacaagtgctggtcgacagagaacttcaggaactcaggaaacctgagatcgaaaaaagaccgggctgatgaaccaggatggttgggtttgcaacccaacaagaattgacaaacggttattttcggactggaccgggctgaggcgcaaaaacatttgaagtttcctgggactgcagcatcccataagaagataggttcgattgttgacagcacccgcgccacctgtaacctcccggcaaacccataagtttctcagtgaagggatggaagtcctggacatgccaat

SEQ ID NO: 25309 - DNA, 681 bp, Triticum aestivum
  unsure (1)..(681): unsure at all n locations
  Clone ID: PAT_TA_25309
acgnncaacggantgtagcggatggntgcaagtnacgtgagctgncctgatctaancccgtgcattaagggcccatcgtccggtgggcgagagagtccttcatcggggaacaaaggacgcctgaaattcatcgggaaggaggcggtcatcacgtcacagtgtctgaatggctggtatcttgtgaaggcgcttgacagcggagagagtacgcggctgcagtaccggtcgctgaggaaagtgccggagctgcaactgcagacgcaagcgaggctgcagcccctggcatttctcggtggcagacaataggagatggcaatgacggatcatgcgtgtaccataaccaccgcccaaggtgtcggtcaggtaggacgaggaagatatgctggtagggctgctgtgtgcaagttgtgtaccaatggatcttaatttcctttccttgtgtgtatagctaggtagggcgctcccctctcttgttcaaaggcgagatcaatgtaaaagtcaagagtatgaaatgtagttccgtgcctgccttagggtattcgctatcaggccatgcggcggctgtagtagtaagcgacctatgtttgcgcgtcaaatctgttcatgtttgagcttgtagaggaagaatgtgtttacatgggttcttcaaggctggctccagattgtacaagaccattctgt

SEQ ID NO: 25310 - DNA, 492 bp, Triticum aestivum
  unsure (1)..(492): unsure at all n locations
  Clone ID: PAT_TA_25310
agcgcctcgcaccggttcagtgggcgtgcgagccctctgcccaccgtctcgcagccgggcgggtggagcatccacgtcgtgcaggagatcgagctgctcgggcccatcgccacactccctttcctggtgagaaaacgatttgggtcctgtgctcatgttttcttggttatcactataagtgatatgaagtttaaagacaggagttgataacaagtacaactatggagtagtttccaagtaggatgcaagtgatccgatcaggttaattgggctatagcacattcctgcaaaggaatttctcatctaagctcaccaactggttaagcataatactgtatgtatgtgtccgtgactgctaactggaacaattgcataaaacaataactgatcgccttttggttggggttctcacttacctagtaccaatttctgccggctgcaaaagctatnctaaccctgcctaagtaaccaggggccatgtgttttggaatc

SEQ ID NO: 25311 - DNA, 846 bp, Triticum aestivum
  unsure (1)..(846): unsure at all n locations
  Clone ID: PAT_TA_25311
gcctcctccaactgagccgcaggcgccgccgccctctgtcagtcccatcatcaaacctcccaccaacccctccccaacctctcccaccgtccctgctactcccaccgccccctcgccgccgtcgacgccaggttttggtcctccatctctgcctaccagcccaacaacaaccccaccaacaccaattggtcccaacatgccacaggacccctcattgcaggacagcagccgctcgccgagcagccatggtttgtctaatggcacaaaggcggggatcggcatcatcgtggcgattctcgtgcttagtttgatcgccgccgggtgctggtacaagaagaaacagaggagaatgaccggttaccatgccgggtttgtgatgccttcaccctcaccatctgcttctccacaagtgctactagggcattcagacaaaactaaagccaactacagcgccgggagccccgagttcaaagacacaatgtcaagagtacagcatgggcaactgtcgcttcttcacctacgaggaaatgcacaacatcacaaacggtttctccgatcaaaacctgctgggggaaggcggctttgggtctgtttacaagggttgcttgcccgaagggggagaggttgccattaagaaactgaaagatggcaagtgggcagggggagcgcgagttccaagccgaggtggagatcatcaaccgcgtgcatcaccgccacctggtttctctcgttgggtattgcatctcgggcgaccaacgcttgcttgtctacnattttgtgcccaatgacacgctgcactatcatctacatggacgtggagtgccggttctggaatgggcaaccaag

SEQ ID NO: 25312 - DNA, 528 bp, Triticum aestivum
  Clone ID: PAT_TA_25312
gactagttctagatcccgtgggcgtcggggtgacctgctccggcgaggttcctcgatcccgcccgccacaagcccgtccacgggcagccgtgctcgccgttggtggctacgtgcagcacgggcaccacggcggggcaccgcgcaccgttgtcgccggatctggcgactccaagcctgaccgccattggatctggttagtcatgaatcatctctcctaacctctctccatatcatgatttcggttttatttttcatgatttcaaaattccttgtttctctaccagatcatcggcctcctgcatcttcagtttcagatatttgattgtttgtgcagagggcatgtgttacacttttctgaaagagaaccaagagtgaatcaatttcagaaatcaagttacatctatgtacctgtgtgtgtagctgagttgtgcaagatatgtgaaatttatatttcaatctgtaacttgttatttgagtgaaatatgtattgaaatagttgtttcaatataaattgaaattctttgtgcc

SEQ ID NO: 25313 - DNA, 450 bp, Triticum aestivum
  unsure (1)..(450): unsure at all n locations
  Clone ID: PAT_TA_25313
atcccacgctccacctcgccgccgccgccgccgccgccgccatggccgatccgccgctctacccgtcgggatccgcccctcaccgcgacgaatccaccaccgacggctccggccgccggctctacaacccgtaccaggacctcaacatccccaccgcctacaagaacctctacgacctccccacctcccccgagttcctcttccaggaggaggccctcgtccagcgccgctcctggggcgagaacctcacctactgcaccggcgtcggctacctctccggcgcagtcgcgggcgcagccgtcggcctgcgcgaggccgcacacgccgccgagcgcggcgacaccgccaagatccgcgccaacccgcctcctcaactcgtgcggctccgccggacgcccgcgtcgggaaacaggctgggcgtcatcgggctcctctacgccgggcatggan

SEQ ID NO: 25314 - DNA, 325 bp, Triticum aestivum
  Clone ID: PAT_TA_25314
gatgcttcccggttgggcatgacgacaaacagaacgataatatggagggtatggcgacgaacatacttgtttttcacatgcgttaaacgcatagttgagaagccagagcaattttgctcaaatttgaagctacgcttaattttatgatgcatgtgccatatttattaaatttcgttcacgttcggccgctgcaaacaggccctaaacatattagccgcaatccttacaatgacaacataagcccacggctgcaaacaagcccacggtgttagtagtctctactcctaatggagcagttggtgaatagtctgcgcggtttattttc

SEQ ID NO: 25315 - DNA, 484 bp, Triticum aestivum
  Clone ID: PAT_TA_25315
cccaatcgcccggcaccttcgacccccatcgcctccagcccagaaaccctagccccatccccccaccccggccccgatggcgaggccggcgaggcgacgcgtcgtggaggaggaggaggaggaggaggaggaggaggagtcctccggcgaggagcagcaggaccagtccgacgccggcggctccggatccggcgaggaggaggggggaggcggcgaggcggaggaggaggtggacgaggacgagatcgaggccgtcaccaccggcgcgggcgccgacgacgaggaagaggaggaggacggcggcgaagaggacgaggaggaggagccggagtccgacgacgacgacgacgaggccgaagaccctgctggaattccagaggtagggaagcaggaacgagccaggctcaaacaacttcagaaactgaagaagcagaagatccaggagatattacagacccagaatgctgccattgatgctgacatg

SEQ ID NO: 25316 - DNA, 804 bp, Triticum aestivum
  unsure (1)..(804): unsure at all n locations
  Clone ID: PAT_TA_25316
atccagcagtaagctgcgcngaggagacgtcgccgttctaggcgccggggcggcggtgacggagccggacctggagcgcctcccctacctgcagtccgtggtgaaggagacgctccgcctccgcatggccatcccgctcctggtgccgcacatgaacctcagcgacgccaagctcgccggctacgacatccccgccgagtccaagatcctcgtcaacgcctggttcctcgccaacgaccccaagcggtgggtgcgcgccgacgagttcaggcccgagcgcttcctcgaggaggagaaggccgtcgaggcccacggcaacgacttccggttcgtgcccttcggcgtcggccgccggagctgcccagggatcatcctcgcgctgcccatcatcggcatcacgctcgggcgcctcgtgcagaacttccagctgctgccgccgccggggcaggacaagatcgacaccaccgagaagcccgggcagttcagcaaccagatcctcaagcacgccaccatcgtctgcaagccactcgaggcttaattgaattgaggtctcggtcatgggcgcgcgctgacgcggggagatggatccatacatgtgactgtgtgttttgccttctttctttttggtgttttgcagtagtataagtttaatttttctttggtgttggcctatttgtcttcatgtgaggcgtcgtgttgtaaatttccatatagttggcaatgtgatgtaatccaaatacgacatgattacaaattttgcaaactcggagaaggtcaaaaccattggtactctgtcctgttcac

SEQ ID NO: 25317 - DNA, 1873 bp, Triticum aestivum
  Clone ID: PAT_TA_25317
ccccgcgtccgcccacgcgtccgccccgcgtccgaaacagaacaaccaaccccagcaaccgttccagagcgccaacacacaacagagcggcagcagttcccgggccgttcccgccccggccggcgccatggacttcgtcttcgtggagaagctcctcgtgggcctcctcgcggccgtggtgggcgccatcgtcgtgtccaagatccggggccgcaagctgcggctgccgccgggccccttcccggtgcccatcttcggcaactggctgcaggtcggcgacgacctgaaccaccgcaacctggcggcgatggcgcgcaagttcggcgaggtcttcctcctccgcatgggccagcgcaacctggtggtggtctcctccccgccgctggcccgcgaggtgctccacacgcagggcgtggagttcgggtcccgcacccgcaacgtggtgttcgacatcttcaccggcgagggccaggacatggtgttcaccgtgtacggcgaccactggcgcaagatgcggcgcatcatgaccgtgcccttcttcaccaacaaggtggtgcagcagtaccggcccgggtgggaggccgaggcggccttcgtggtggacaacgtccgcgccgaccccagggccgccaccgatggcgtcgtgctccgccgccacctgcagctcatgatgtacaacaacatgtaccgcatcatgttcgaccggcggttcgagagcatggacgacccgctgttcctccgcctccgggcgctcaacggcgagcgcagccgcctcgcgcagagcttcgagtacaactacggcgacttcatccccgtcctgcgtcccttcctccgcggctacctccggctctgcaaggaggtcaaggacgcccgcctcaagctcttcaaggattacttcctggacgagaggaagaagctggtgagcaccaaggccacggacaacaacggtgggctcaagtgcgccattgatcacatcctggaggctgagcagaagggggagatcaacgaggacaacgtgctctacatcatcgagaacatcaacgtcgccgcgatcgagacgacgctgtggtcgatcgagtgggggctggcggagctggtgaaccacccggagatccagcagaagctgcgggacgagatggacgcggtgctgggcgtcgggcaccagatcacggaccggacacgcacaggctcccctacctgcaggcggtgatcaaggagacgctccggctgcgcatggccatcccgctgctggtgccccacatgaaccttcaagacgccaagcttgccggttacaacatccccgccgagagcaagatcctcgtcaacgcctggttcctcgccaacaaccccgagcagtggaagcggcccgacgagttccggccggagcgcttcctggaggaggagaagcacgtggaggccaacggcaacgacttcaggtacctgcccttcggcgtcggccgccggagctgccccggcatcatcctcgcgctccccatcctcggcatcaccatcggccgcctcgtccagaacttcgtgctcacgccgccgcccggccaggacaagcttgacacgactgagaagggtggccagttcagcctccacatcctcaagcactccaccatcgtcgccaagcccagggtgttctaagcagtcccgtaccggacgtacgtgctctggagtttggacttccagcattttggttcggtgttgtaggactttcatgattgttcgctcgtcctaagtatacttgattatagtatctgtcacagagtagacgcacgtttcgttaatgttatccgcaaggaacagaggagctgaagaaaggtcgaacggggaggaaaagactggacgatttccatcctgatgctgcgat

SEQ ID NO: 25318 - DNA, 2033 bp, Triticum aestivum
  Clone ID: PAT_TA_25318
ccccgcgagcacgtccaccccgccgcacgacggcagactcaagagcgccccccaccgcctcctcgggtgggcgaccacctcccggagcggcgcccgccacggcctcttcgccgccgcggtcgtcgccatcgccgtcgccaacgtgaccggcggccgcttccgcctcctgccgggcgccgtcggccgcccccaggcggcgaagctgtcgggtcgccggcgacgggcgccgccaccgcaagccggcgggccccgccccgcgccacggccaggtaggccggcgccgccgggggcgtcggccacccggcggccctcgcacggccccgcggccagcacggccgccccccccatcaccagggcgcgcctgccaggctctcccgtccccgagcctcgccctccgcagcccacccccgacagggcgaggacggggtgttcccggtccgcggcgttcgacatcccactcttcggcgtggcgaggctgaaaccttgcgcaccatctgacgggcctcgtagactcgatgcttgtgcgagtaatagggtggggccggtcctcgcggacctgatgcgcgagccggcggcggcgacggcgggcggtcgggcccgccgcaggccgcagcacgtgatccacgacgacaagtcccgccgcagcctcaaccgccgctcggatgcattggcgatttcgagcggccgcccgggcaggacaagcttgacacgactgagaagggcggccagttcagcctccacatcctcaagcactccaccatcgtggccaagcccagggtgttctagagcagcgccgtgccggacgtacgtgctctggagtttggacttccagcattttggtttggtgttgtagtactttcatgattgttcgctcgtcctaagtatacttgattatagtatctgtcacagagtagacacacgtttcgttaatgttatccgcaagaaacagaggagctgaagaaaggccaaacctgatgctgcgataaattaaagttaaattcttgaaatcttgatgattttttcataaaacgaaaaaactcacccatccggttgtaattttcgtcgaatcccgccggaaccgataactcgtcgcgcgacgccaaggcgcggctacgactcccccgccgacgtccaaagatcctcgtcaacgcctggttcctcgccaacgaccccaagcggtgggtgcgcgccgatgagttcaggccggagaggttcctcgaggaggagaaggccgtcgaggcccacggcaacgatttccggttcgtgcccttcggcgtcggccgccggagctgccccgggatcatcctcgcgctgcccatcatcggcatcacgctcggacgcctggtgcagaacttccagctgctgccgccgccggggcaggacaagatcgacaccaccgagaagcccgggcagtttagcaaccagatcctcaagcacgccaccattgtctgcaagccactcgaggcttaactgaattgaggtttcggtcatgggcgcccgctgacccggggagatggatctatgcatgtgactgtgtattttgccttctttctttttggtgttgttttttgcagtagtaagtttaatttttctttggtgttggcctatttgtcttcatgtgaggcgtcgtgttgtaaatttccatatagttggcaatgtgatgtaaaacaaggtccaaatagttggcaatgagatgtaatccaaatacgacatgattacaaaaaaaaaaaactaaaagaaggtcaaaaaaaaaaaaaaaaaaaaacccagaactacggccgcgtacacagagtgttttaagcagtcccgtaccggaggtacgtgctttggagtttggacttccagcattttggttcggtgttgtactttcatgattgttcgctcgtcctaagtatacttgattatagtatctgtcacagagtagacgcacgtttcgttaatgttatccgcaaggaacagaggagctgaagaaatgtcgaacggggaggaaaagactggacgatttccatcagatgtactcctgatgctgccat

SEQ ID NO: 25319 - DNA, 984 bp, Triticum aestivum
  Clone ID: PAT_TA_25319
ggcggtcgccgcctcgctcctccggggggcgtcctgctccttcccgtccgccgccctctccctccgcgcctcgctcgtgtgctagcatcggctctccaccggcgcccgccatgcgagcggctcagagtttgttcctgtagcctgcctgtctctctgcttgcactgcgatgcaagccggcgaagtgagatgagatgagacgaactagtagccgcttagtgagcttcagcaccggcggcccgatcgcctgccagggcctgtcggaagaaccctgctctccaacattctcctgtagatcctccttctctgcgttcagcgcagccagggctccagctccatcttgcggagccttgttattctcattcggtgacagccccgaacccatgaaggatgctgcgcctgtggtgttgatgccgagcttctcgttcttctgtgggctagggtccgacgagcctgagccattggtggcatcaggcgacatcaccacggagaagggagctcattgtgtcgaagacgccgcggtggtgtgcctcaacacctcctcctcggctctgaggaggatggcggaggcggccctgagaggggcggctgtgacgagggcgaacccgtcgtcacgcagcaggcggaaccacaccatcggcgccggcgacgagcgggggcaccagcacgacctggacatggcggtggccgagtcggtgatccggtgggcgtcgtgcacgcacctgtccaccaccctctccctccgcgcctcgctcgtgtgctagcatcggctctacaccggcgtcagagtttgttactgtagcccgtctctctgcttgcactgcgacgcaagccggcgaagtgagatgagacgagaagagattagagatgagtgtgtcactgccactggttgtagtagagtgtaatctggacatgatgatattgttatagacttatatagtagatcgccgagtgtttgttgctggtgccaagtggtatcgaaatct

SEQ ID NO: 25320 - DNA, 293 bp, Triticum aestivum
  unsure (1)..(293): unsure at all n locations
  Clone ID: PAT_TA_25320
gccgcacggccgggacgattgataagtcaaattagttgattcacctggatctcagcctcagttatttagagggagtaaatgtataggttaatggtagctactacttttttcggcttatttgttttttttttgcctttatttgtttgtacgagtaagaggatgcaccagcgtagctgtgaatggcttcacagttctcaagagacgaactagtagtgttaaccgttgatattttattattatatatgttgctttggtagcacaaaaataatccggcaanaacaaannaaaaaaga

SEQ ID NO: 25321 - DNA, 585 bp, Triticum aestivum
  unsure (1)..(585): unsure at all n locations
  Clone ID: PAT_TA_25321
tgacgcttcttcccntgatgtantgaagttgagaaccggagcggttgcttgacgagcgaattcctcgatggcgcgttgagaccncatcggtcntgtaccgccgatctcgaaccgttggcgctgtccaccagtcgtacgccgggcactcgatgcgctcgcacgacggcggcacggcggcgcccgcgccggcggcgagcagggcggccgcggcgagcaggaggagcatgccgctccgccgcgccatggttctcggtggggagtggagtgggggattgggtttgtggggctcgggtgcggccatccaggaggtgatcgaggaggcgatgctcacggacaaagggatggcggtgcggcagcgggcgaaggtgctcggcgaggccgttcgcgccgccgtggcagacggcggctcctcgagcaaaggcctcgacgacttcgttgcttacgtcacgaggtgatcagcgtatctgtgcgtgccatagacagatacgcattgggcggtttgatcattgcttcggatgtgtttgaaactttgaatcatgctttctacgaaagctggatttcagtatacaatgatttgtcgttttc

SEQ ID NO: 25322 - DNA, 1229 bp, Triticum aestivum
  Clone ID: PAT_TA_25322
cgtccgcccacgcgtccgcccacgcgtgcgcccacgcgtccgggaagaagagagagaaaaaaaaaatggcatcgtcggcccgcgccgccgcctccgccgcgagatcggccctccgccgggcgcccctcgccgcctcctcgtcctcttccgctgccgggatcctccgcaggtcggcggcggcgggcctggagacgcggatgcccctccacagcgcggcgtcggcggcgcgcctcggatcctgcatcacccgagatggcaacaatgctttctcatggaactccaggcgcatgttcagttcaaatgagaaacatctgcctgcaatatctgacccgaaaattgagactgcatttaaggatttgatggctgctagctggaacgagcttccaggttctcttgtggaggaagcaaagaaagcagtatctatggctactgatgataaggctggtcaagaagctttggaaaatgtatttcgtgcagctgaagcatgtgaagagtttagtggagttttagttaccctaagaatggctcttgatgatctttgtggtctaacgggcgagaatgtgggccccttgcctggttacttagaagaagctgtgaaatccgcctatagccgatacatgacatatctggaatcttttggtcctgaagagcactatctacggaaaaaggtggagagcgagttggggacaaaaatgattcacctgaaaatgagatgcagtggcatagggtctgagtggggaaagatcaccctgatcggcacctcaggtatctcagggtcctacgttgagatgagggcatgatggaactctctcgtatcagaaccgtggcgtaacaccggtggtctgacgggaagctgcgtatcaatatcagagccaggtgttccgttttcttttatctttcctctgtagctaccatgccaataaacaaggcgatcgtcaaaacatatgtgcactcacttaaagtagctatttgcgccccagattttcctgctgtaataagaacatgtctgttgaattgttttgctgctcaaaactatgatggatggtctttattgggcaaaaaaaaaaaaaaaaaaaaaaaaaaaaaaaaaaaaaaaaaaaataaaaaaaaaaaaaaaaaaaaaaaaaaaaaaaaataaagaaaaaaaaaaaatataaaattaaaaaaacaaaaaaacttaacaaaaaaaaataacaatcaaaaaaaaaaaggggcccctaaaaggaata

SEQ ID NO: 25323 - DNA, 1157 bp, Triticum aestivum
  Clone ID: PAT_TA_25323
gccggccgtcacatcgtcgcagggtacccccctttgcttgcgcctccacagcccccactttccaacttagggttctagggtttctccagcagcgccggcgcctccacccgcccacccaaccaccatgacggccgagaccgcgacgcaggcggagctgctccgcgccgttctggaagagcagaagctcgcggcgcagggagacgagcccgtagttgaggatgatgatgatgaggaagatgaggatgatgatgacgaggatgacaaagatgatgatgttgagggagttgatgcaagtggaagatctaagcagagtaggagtgagaagaagagcaggaaggcacatgctgaagcttggcatgaagactatcactggcgtgagccgtgtaactgtcaagaaagaagcaagaaatatcctgttttgtcatctccaagccatgatgtattcaagagccctgcctctgacacctatgtcattttcggtgaaggctaagattgaggatctgagctcacagctgcagtcccaggctgccgagcaattcaaggcgcctggcatcttagcagcgtcatctcaaaccctgaggctttctacagctgttcaggaggatgacgaggattgtgatgagactggagttgagccgaaggacattgagctggtgatgacccaggccgggtgtgcctaggcccaaggctgtgcaaggcgctcaaatctgctgacggtgacatagtcagtgctatcatggaactgacgaactagccgggcccagcctgtgatattctgtcagtttttcctaggtttacatgggaatacatgagttgtaacgtttggtggtcatgtgtgagcattgagactgactctgtattagcaaagacctgaggcaatgtcgaatgagcttctttttcttgcattacaacagaataaatagtgttttaacgtttggtggttaattgtgtgtacatccttatcagcctgctcatctaattaaccatatgaccttgaaatctatctgctgaattgcgtctatttctgtacaattgttgatttgttcataattaggaagtctggtttgttgctaattttgggacaacgaaattttaacatgaaaattaagattcaggaagttgataggaaccctgggtgcttaaccaaactttaaaaa

SEQ ID NO: 25324 - DNA, 1125 bp, Triticum aestivum
  unsure (1)..(1125): unsure at all n locations
  Clone ID: PAT_TA_25324
gcttcattgtagctgagaaagganataattttgagcctgcagatagtgaaaaggagagaatgcaagctataaatattcagaaggagaatggagaagaaagtccccttctgaaaaacacatttgcttacactgatgaagttaaagagaagttcaataggatcctcaagcattatgttggaacccgcaatttccacaacttcaccacaagaactaaggctgaggatcctgcagccaagaggtacatcatttccttcactgccaatagcgttgttagtctggatgggattgattttgtcagatgtgaggttgtcgggcagagtttcatgcttcatcagatccggaagatggttggccttgctgtagcagtgatgaggaactgtgcacctgagtcaatctatgacgttgccttccgcaaggatatcagacttaatgtgcctactgcacccgaggttggactgcaccttgatgaatgcatgtttacctcatataactcaaaatggatggatacacatgaggcagtttcaattgaaccctatgctgaggaggctgaagagttcaagatcaagtacatcttccctcatattgctgcaatggaacacaaggagggagctgtagcactctggttgcatgcgttgaacagcagaaactatccagatttccgctacatggagactgctggatctgaggcaaaggttggggctgaagttgagaatatggaagaagtgcaaatgccaagtaataatataagcgagtaactttttgtaaggaacatgcaagaccgatggatatttctgattgtcctgttcacctggagagttaaaacattgcttggaataaagactgaagagaaagggttgctgctcttgtcctatgaagtgccggcatcaaaatggtcggaagcatagttatctgcttcattgttatcttaagacaatatctgttacagcggagatcagctttcccagattagatattttaagattgatatgatctatgtaatactttgagacagttttgagagggaactatgccccctggaaaatacttcattgaatccagcatgcagttcaataggttctatatatattgtatggcttagacctgaaatatgttgttctggtcttt

SEQ ID NO: 25325 - DNA, 588 bp, Triticum aestivum
  Clone ID: PAT_TA_25325
gattcggcacgagctcgtgccgcttaacatggatccaccactcctcccaactcccaacaccgaaaagtgatccgcaaaatcaagagaactcggccatggcgagaccgctcttcctgctcgccctcctggccacggctctcgcagccacctcaaccctcggccgccgcggcgggctcctgggcgggtggagccccgtcccggacgtgaacgacgcgcacgtccaggagctcggcgggtgggcggtggcccagcaccccagcctagccaacgacgggctgctcttccgccgggtgacgcgcggcgagcagcaggtggtgtccgggatgaactaccgcctcttggtggtcgcggcggacggctccggcaagagcgtgatctatctcgcgcagatctacgagcactggagcggcacccgcaaactcacgtccttcaagccggctgccggcggctaactgatgcgccttgaatttcatctgttcgtcctttgtgcatgtacgtagtactccactacaagtaaataaatgagtcgtgtggtttgatcgtcaggcatgcagttcatcctgactaataatatttgctatcactagc

SEQ ID NO: 25326 - DNA, 492 bp, Triticum aestivum
  unsure (1)..(492): unsure at all n locations
  Clone ID: PAT_TA_25326
aaggacgccatcgcgagcctcaacgccaccgacctggagaagcaacgtaagctccaggagtggagcagcgccaccagctacgacaagtgcgtgtcccacgagcaagcgcgcgacatcgccgcgggcctgggggtcgggtccgtgttctgggactgggatctgccacggaccagggaagggttctaccgcttccagggctccgtcgcctccgccgtcgtccgcgggcgcgccttcgcgccgcacgccgacgtgctctggatggagacgtcgagcccaaacatcgccggagtgcacggccttcgccgagggcgtgagggcggctttcccggaggccgtgctggaccccaanctctcgccgtcgttcaactgggacgcgtcgggcatgacggacgccgacatggcggggttcatcccgcacgtcgccaagctcggggtaagtttggagttcatcaacnctgggccgggtttcantccngaacccgcctggtcacc

SEQ ID NO: 25327 - DNA, 923 bp, Triticum aestivum
  unsure (1)..(923): unsure at all n locations
  Clone ID: PAT_TA_25327
anagagcattgtgtttcttcctagnagaagagcaaggtcaagatatcggttttgtgcagtaccctcagaactttgacaatgtggtgcacaatgacagctatggcaatcccatcaacgttgtcaatgagttggataacccttgcttggatggatggggtggaatgtgttactatggcactggatgcttccatcgcagggagaccctctctggacaaatatatagtaaagattacaaggaagattgggctagaggagtggggatagcagaaaatgcagatgagctggaagaaacgtccaagtcacttgtgacatgcacgtatgagcataacaccccgtggggcattgagaaaggagttagatatgggtgcccactggaggatgtcattacaggattgcaaatccaatgccgcgggtggagatcggtgtactacaacccggctagaaagggcttcttaggcatggcccctacctcactaggccagatcctggttcagcacaagagatggtcagaagggttcctccaaatatccctctccaattacagtccctttttattaggccatggtaagatcaagctgggtcttcaaatgggttactcggtctgtggcttctgggccctgaacagcttccccaccttttactatgtcatcatcccttcactttgcttcctcagtggcgtctctgttttccctgaagataaccagcccttggggcattccatccatatacgccctgggacgcttcccccgcccccggagcctccctcgggtccgctcccgcgtggggtcgcggcaaccgcattggggggcctgcgcagacacgctgctctgcggcatcacacctcccgactcccgcggccccttcgacacatggggnggangctggtgtcncccaatccgnttccaacttacgtaaaggggnca

SEQ ID NO: 25328 - DNA, 1386 bp, Triticum aestivum
  unsure (1)..(1386): unsure at all n locations
  Clone ID: PAT_TA_25328
tctggccgccgctctcctgaagcccgacccggcagttgacgcccagctccaacaacaccggtgatcccctcctccggcgtcggcgaccttcctcggctatcgtccccgcgtcgccctccacatccaccttttcttctgttccgacgcagccatgaattacatcatcggcgccttcaagccgccctgcgacatcttcgtgaccttttccgatgagaggagccggaagcaggttgcagtcaagaaggataatgggaagacaaccatggtgccggcgttccagagcctggagaccatagccggagaggtatcaatagcgcctgttcctggtaaaaggattgagcacatgggtgttaagattgagctgcttggacagatagagttgtatttcgacagaggcaacttctatgacttcacttcactggtgcgtgagttagatgttcctggtgaaatatatgaaagaaagacatatccatttgagttctctactgttgaaatgccatatgagtcatacaatggaacaaatgtcagactgaggtacatcctgaaagtgacgattggtagaaactatgtcggtaatattgtggaatctcgggatttctgtgtaagaaactattctcctcttccttcaatcaataacagcatcaagatggaagttggaattgaagattgcctgcatattgagtttgagtacagcaaaagcaagtaccatctcaaggatgtcattgtaggaaagatctattttcttctagtcagaataaagataaaaaacatggagcttgaaattcgccgccgggaatcaacaggatcaggtcctaacacatatgttgagactgagacacttgctaaatttgagctgatggatggtgccccagtcagaggagaatctattccagtaaggctattcttgactccatacgagctaaccccgacttaccgcaacataaacaacaagttcagtgtcaagtactacctcaacctggtccttgtggacgaggaagaccggagatacttcaagcagcaagagataaacatgttccgccttgacgaaactccacagccttcatagacatctatcgctgggaacctggcctgaatcgtgtgttgcaagagttagcaatttggcatcctgttatgctgtatataactctccaggagagcatgcagtttagttccaatgtaccgtgcgctgtcacttgttacgcctttttcatagcaatctggttagatacaatcactgaaatgctggattgctgacttttggccattttcatttccgccctcttgtgagacatttttttttccttagacgcttgtgaagcatcttgagataaccaattgtatttgatatttgcttcatgttgtgtannananaannnannnnnnnnn

SEQ ID NO: 25329 - DNA, 505 bp, Triticum aestivum
  unsure (1)..(505): unsure at all n locations
  Clone ID: PAT_TA_25329
cccaaacctcccagtttccatagccgcccccgtgcccatgccccccgccaagccgaagcgccggacccttcagcgccgccgaacccgccgactgctctcaccaaggcggagatggatacttcagctccttcgccatttgtcaatggagagactctgaagatgtttcttgggcgacgagtgcgcacagtggttcaagtccaacacaatgaaggtggagttcttctcgggctgtccactgatgggcatcagttgactatcagaggtgcttctggtgcccctgaaccaccacactacatcgaggttattgggatcgctgacagcaacctgtccatccgtgctgaatcttgcactgattttggtgaaaactttgatggtgtggcattcaacggggctatgcaagccttgcgaatgacaaagtacaattacctgttcctggtggaattcaacatcaccccanaaggagngtggggggtcaatcaagccatgctcgtcaatcnatggatng

SEQ ID NO: 25330 - DNA, 634 bp, Triticum aestivum
  Clone ID: PAT_TA_25330
aattgcagcgaggtgcttttgtctttggctgggcaggattcagacaggaagcgaagggtaaggctgattcagacatccatggcgccatgggggtcaagaagccgcagccggctagtgccgcccgtcttccggagccctcccttggccgtgccgccggtcttcgtggtcccgcccttggccgcccgcatcaggatgttggcgccggcatatgagttcatgttcggaaagctcgcgcggggaggcctctttgatgacttgttccattcgttgggagattctcatgctcatctgaatgccactatgtcgacaaatgggggggaagctcactttcgatggcctagggatttgaacgacccccatacatttgtggacttacttgtgtcaactttgaaacctacaatgcggctgtcttcaagcgtttactatcccaagtatggtattggcgcctttgggacgttccctttgtatatggcaaacgccttttgctcagccccttttggcgtcatgggtttggcatgccgttcagattatggtgtcattggggccagatatgtcccagagaatctgccaattggggcccccttcgttgcatggttggctgctggtgaggtaccctatggtgcatggttggttg

SEQ ID NO: 25331 - DNA, 1291 bp, Triticum aestivum
  Clone ID: PAT_TA_25331
acggcgcccgcgcccgcgcctccgcctcctccgctcgtcgtcgccgtccggtctagctgcgagatggcggcggcggtggacctggaggacgcgttcggcgcggtcttcggcgaagccaagccggagggccaccccaccgcgcgccccatcctcttccgcgcccacgcccgctccgccgccaccctccgcgtcgtcgccaccgactgccactccctcgcctggggctgctccctctcggtctccgacctcgacgacctcagagacgatgttggaatcgggggctcctgggtcgacttcctggattacctcaagtcctccttgtcctccggcgaggtgaagctgctcttcgccggcgaccaactccgcaagtcaaccggttctgatggtgcaaagcttgtggctaccaaggcaaagggcctgcctctcatcaccatttctctccatagtgttactggcgctgtgacgagtgatgtcatagccgagttctcgctagggctctatggagcttataggactgcacgggagcttgtatccaaagaacaagaacaaatgtcacagctgatggggagtctgtcaactgaaagagaaaagaacgaaatcatgcaaaaacaactcgaatctctttctttcctagacaaaagaaaggcaacaaagccaaagctgttggctgatcaggttccaagtgtgtctgctgtgactctgggctctgatcaagttacagctcctgtgcagcagcaaatatcagtaccttcacctagtaaagcccctccagctaaagtcacgaagagggtagcccccacgtctcggagggcaagggtgcgaggagctctgctgcaagataatgaggatgaggatgacaactgacaaagagttagagatgctgatatcttggtttaagtttgctatatgtgaacttacaaagagtggcttgtggttagtcagttttctggccgttttgactcgtctcaaacttgtggaaatgaaattaattgcaattcatggcatgaaagtgcaggacagagtacatgctatgatgctaagttcatataaaatattttttttccatttttttaggatttatcgtgcctttgctactgaacatagttggatgatgcaaaggccaaatgctgctcctctgaagacgtactcgtaggggaatagaatccatgtattgggggggaactgagtggtcaagagagttcgactcctggcttgttctgttctgtgttaccatttggcttccggtctcgcgcgccgcctaaccgcatcgttcaaaaaaaaaaaaaaaaaa

SEQ ID NO: 25332 - DNA, 924 bp, Triticum aestivum
  unsure (1)..(924): unsure at all n locations
  Clone ID: PAT_TA_25332
gtgtgcggcgctcgagccggccgcggcaaccgcaactatgccgctcccgaatcagtacacccatcacctccgccacccccacctacccccaccgccggcgcgagccgcgagcacgggagcgcgagcggatcgatggccggcgcgggatcctcgtcgggcggcggcggggggagggagggcgactgggactacggcgggtgcggcaaccgcaactatgccttccgctccctgtacaaccgctgcaagcagctgcgcctcctcgtcgaccccaacaccccgcgtgactccaagtggctcccccgcgccggcgactggatctgcaacgatctcatctcctcttgttctgcgccggccagaccatgaacacttcaagcggaaggatgcatgatgggctggacgacaaggtggagatcctggacacacagaggggctaccaaaccggtgctgcagcaacaacgacttcgcagcccatacaggaggtggactgcatacagtgccttgttaaataccaccattctaccctgctttgcattcgcattttcatttgctgtctttttgccaccatatgacatctttaaaactgctaagagattcaaactaagaggaagtcgtgttcagtttcggttggcactatgatatcaagtttcatcatgtatacttggtgttggtttgatcaaataaacaggggatttatttacagtgttgtactgatgtgccagctcatacaacatgcattaagtatacagtatcttccaatttgaatcgaactagaagttgaattactattacgtctcacgtgtgcctcggctgtcatttactctatagaactattattaattggccctgatctgacgcaatgttttctggatgttaggatgatacggngtactactccattcttcatcgattctctgtcccctttta

SEQ ID NO: 25333 - DNA, 686 bp, Triticum aestivum
  Clone ID: PAT_TA_25333
actgcacaagcgaaagctcgcgggcatttgttcgcccccgcgctgtccagccatggagagaagcgtcgcccacatcctgctggtgctgtcgctcggggcggccctcgccgtcgccggccgccccgccggtacctccggcgacgtggccgccattcgcctcccgagcgacggccaaggtcttggtggtgatgcaacagcactaggggcggccatgaagaaggtcctcgaggagggcgaagaggccgtgggcatgctgcgaccacacccagtgcctgagggtgctcccgaggggcctgcctctgccacgacacggtggcgcagtgcgccagcgcgtgccagcactgcgacgaggtcagccatggccgctacgtttgcctggatttgtacgaaggttggcccggcccaaagtgcacgcacgaggtggacgtcgccgccgtcggcaactagctaccatagctagctaccatggcacgtacgcgtacgtttcggcgtgttgccctctctgttggcttgttgctccatgacccacagagtagtcccagtgcctatctatgtaccagttcaatttcaactcgcttatcatgtgtaataataaaaataagtgtgcgtgccgtgccgatcgatcaaaaaaaaaaaaaaaaaaaaaaaaaaaaaaaaaaaaaaaaaaaaactaaagggggggcccg

SEQ ID NO: 25334 - DNA, 1516 bp, Triticum aestivum
  unsure (1)..(1516): unsure at all n locations
  Clone ID: PAT_TA_25334
tnagagngnnnnnnnnttgaanccgtcagctctttgatccgccagctcgnnattaaccntngtanntgnancgaagcggnggcngctctagaactagtgcnttctacancntgcaggaattcggcactgagctcagagccaccttccaatcgaccaagccccctccatccggccaccggatcgggccggccgatctctcgagctccccggccgccccctcccgcggcggcgtgcaatgggggccgacggctaggacgccccatgcgcgctcggcatcctcatggatcaagtggacgcgccggtgaggaggacgttccagaatgtgcaccaaggccaccctagagaaacaatgttgcgctttctcaaggctagagaatggaacgtttccaaggctcataaaatgcttgtagattctttgaattggaggattgaaaatgaaattgatagtgtattggagagacctatactcccagtagatttatacagatcaatacgtgattcacaacttgttggactctcaggatacaccaaggagggtcttccagtttttggcattggtgttggtcagagcacatacgacaaagcttcggggcactactatgtgcaatctcatattcagattaacgaataccgtgatcgcataattttgcccatgttgacggaaaagtttggacgcccgatcaccacttgcgttaaagttctcgacatgactggttttaagttgtcagcactgagccaaatgaagatgctgagttcaatatcaactgttgatgatctgaactaccctgaaaagtcagagacatattacatagttaatgttccatatatattctctgcatgctggaaggttgtgaagcccctattgcaggagaggacaaaaaagaaggttaaagttttgagtggttgtgggagagatgaacttctaaagattatggactactcagctctcccccatttctgccgacgagagggatcaggctcatccaagcattcatcttccaacgccgacgattgcttctcccctgaccatcctttccacaaagagctctacgagctcaccaatcagcaatcgtcgcacaaggagctcctcaagatgggatcattgcatgtcagcatcccggagcctgacccaaacgacgcgaagatcgtggaggtgatccaggccgagttccacaagatgggggagcagaatgggtcgaccaacgggcacaaggtctgatgccgcgccaccaccgaagacggccatctgcatgcggagcaccttaaccaatgcaagccacctccgatgaaactgacgatttaacctgtccatgttggttgtatcccccccggccccctggggggataatagtagcgaaggctccgtgatgcatagggtgatgccggcttgggatcatagctggaagagatgaaccggacagtgtatattcattagcatagaacctgcatatgttaaactggcactataacaagttccatggatgatggatgtttattatgacagcttgtaagcttc

SEQ ID NO: 25335 - DNA, 1190 bp, Triticum aestivum
  Clone ID: PAT_TA_25335
aatcgttggcgtacatcctcgcggacagcggcttcgacgtctgggtcgccaacaacaggggcaccaggtggagcagccgccacgtctccctcgactcctcctcccggaggtactgggactggtcgtgggacgacctggtggtgaacgacatgccgagcatggttgactatatctgcagccacacggcgcagaagccgcacttcctcggccactccatggggacgctggtggcgctggcggccttcccggcgtccggaacggtggacaagctcaagtcggcggcgctgctgaccccggtcgcctatctgtcccacatgaccacccccctcggcatactgctagccaaggcattcgtcggagagctcatcaccatcctcggtgtggcggagttcaacccagtaacgccggcggtggcgagcctcttcaaggaactgtgccgccatcctggaaccaactgctacgacctcctcacagacttcacagggaagaactactgcctcaacagctcggccgtggacgtcttcctccagtacgagccgcagccgacgtccaccaagaccatggtgcacctcgcccagacgttccgcgacggcgtgctgtccaagtacgactacgtgtggccgggcgtgaacgtggagaagtacggccagccggacccgccggcgtacaacatgtccaacataccgccgggcttcccgctcttcctcagctacggcggccgggacgagctggccgaccccgtcgacgtcggccgcctcctcggcgacctccggggccacgaccccggcaggctcacggtgcagtacctggagcagttcgcgcacgccgacttcgtcatcggcacctgcgccaaggactacgtctacaaagacgtcgtctccttcttcaaccgcttcaactagcaacaagctctcgtctccaacaaacacgggagatttggaggatgaacagctacagttgctgcaagattacggaggggaaattacgcttacatatagtagctgtgaatatgtcaatgggatggaaatatcataattacaccagaggtgatcgctatggctacatggtccggctacatgcacacgtttatgcacatgctgatgattaccaggcgatccctgaactgaaagtatggccactcgtataactgtactgcggtgccaaagtttacaaaaaatatatacgtagat

SEQ ID NO: 25336 - DNA, 479 bp, Triticum aestivum
  unsure (1)..(479): unsure at all n locations
  Clone ID: PAT_TA_25336
gtaaagaaaggcatattagttccatgttggaccatagaacttctttataaacaaagtgcaaagctcttcttagctaaacaagttcttagaatattaactggaaaactctccttgcaccttttgatgatgcaaatcatttcaacatgtgctttgtacacgttgcgactatctgaccacaaatttactgtgctctgtgatagagctttattaatgcaagattgtacttgcatcatgctttagatgttcattcaagctgtacaaagttacaaacttctgctactgcctcttgttttgtggggaaggtatttcttcagtccttaaacaattaaacctaacccaagggtgttgcctttttttgttgttgaagctgaggtccggttgccttaataagtgccaatttctggtgtggcctcaactnaccttaactgcgnattaaggtgatctnattcaagttgcctcgcccccctgcattccctcaa

SEQ ID NO: 25337 - DNA, 626 bp, Triticum aestivum
  Clone ID: PAT_TA_25337
gactggactgcccacttgcatacaatggcgatagcatgatcagtttgtcgatgattacaaccaaattggtatcacaagttacatccatacataccaaatacttttacataagtagggccattatggcaaagtcttaaacataaacatagctcgaggacgaaatatcaagcaagtctgaatcaaaaacttcaaagatgtcttcgaaccctaaccaacatgtcttaaccctataggtagttaacaagggcaccttaacttgcatggacgttgtaaactccttctggtattggtctctcctccatgtctggtttggcagaatcttcaaagtcctcgggaccatcatcaaaattctacacaatggtttcctctcagagtgctgaaactttgtggattctgttgaaccgtgacctttgttttctagacaatcagggaactttatatgttccctgcaaggtgttcccattcttgggtctatctcatggtctgtgcagtaaatgtggagggtttgccttccgtttctttcgaccaggaaccaatacataatcctcagagtgctgaaactttgtggattctgttgaaccatgacctttgttttctacaagagcagggaactttatatgatccct

SEQ ID NO: 25338 - DNA, 888 bp, Triticum aestivum
  Clone ID: PAT_TA_25338
cgccgccgacgccccctcggctcttgtacgtaacccgcaatggcgaggccctcacgccaaaccctggccccgccgtccgcgacctcccgccgccgcctgtacggacactcgaagccgcctcctcccccggcctcggcgttccggagagccgcggcggcgctcctcctcgccgcggccgtggcgctgccctgcgccgtgctgtaccgagccgtcgtgtcgaatgcgcctccgctggtgcaggtcgtgtgggatcgctggccctcgagggagtggggcccgccacgagctccggttgtggtccccgagcccgaggaggaccgcgacctcgaccccatttccgccgacgatctggacagtgaatatctcaaacttgagcaagttctacaagcggcttctatggacaataagaccattatattgacgacgcttaatgctgcatggtcttctccaggctcagttatagatctttacattgatagcttccggcatggtgttagaactagttcactactgaaacaccttgtgataatagccttcgacaggaaagcatataggcgatgtactgagatccatacctactgttatgctcttgtaaccggtaatgtggacttttctcaagagaagaggtttctgactgctgggtatctggaaatgatgtggacaaggctggatttcttgcgcctagttcttgaaaaaggttacagcttcattttctcggatgcagatataatgtggtttcgcaatccatttccatacttttacccggatggagatcttcaggttgcatgtgatcactatgtaggcaatgcaactgacttgagaaacatagcctaatgggggggttcaactatgtgaagtcgaacaatcaaagcaaaagagttttacaag

SEQ ID NO: 25339 - DNA, 577 bp, Triticum aestivum
  unsure (1)..(577): unsure at all n locations
  Clone ID: PAT_TA_25339
nnnnnccgcgggaattcgatttcgagcnnncgcccgggcaggtggcaaaattcaagaagatgcaatgaagctattcgaatctgggcttcatgatttttggggttctcggaatgctggatggagtattacatctctttctgttacagcaagcaaaatatttgacataccaagtggaacaaactcaatcttgaaatatatcaaaggccgaagttccgatgcatcttcagccatccttgattcttcctctacacctgagtcaacaccatctgttgataacaagttatatatgactccagttcatgaggaacggtgtgaatcatcatctatgaaggaagactgtgacaatagtaattctgccaaacaatgtagctcaattgaaggaaaaggtcttccgaagaaattaccgaaagttcaggtgtgtcgtttctttcctcctcgggggccgcctctctgtcgccgcgtcggtcgctaatgtctgcccgggccacgcgcgaggcgccgttgcgttgaccgctccctctgtggccatcttgggcctcaccgtccttccgggtgcctcgcccgcctccacgccatg

SEQ ID NO: 25340 - DNA, 613 bp, Triticum aestivum
  Clone ID: PAT_TA_25340
actcatagcaaggctcaaacccaacattccacattcatgtctgtctatcgtcatcacgccctgtcacatttcattcattcctagatagcctgtaacgacaccgacgacacaaaaacgagggtgacgaaataaggcaggcctccgctgtccctgctgacgatgcgggcctcgtagaccggggcattgatcaccactatggccacgctggccacagcctgcagaaacagtggccccagcccttccgcgcctccgcgcaattcaactctgcccagcctgcccaccaagcacaccaggttgaacagcgcgatcgtggtgatgatcacaaacataccaaacatacgcccgaactccatcttccccttcttacccctctcgtacctctgcgactcatgcaactccaccaccagctccgacagctcgaatccggactccaacacacccaccattccgtcgatcgcgtcgatggccgccaggatggtcgtggtcatgagcctcataatttgtgcattttgtgcctcccaccactcctcagcagtgtcaccacattgcagcgactccattaggctccaggagtatgaagctgccacgacgtatatgaatggaatgcaccaag

SEQ ID NO: 25341 - DNA, 617 bp, Triticum aestivum
  Clone ID: PAT_TA_25341
ttttttttttttgttcttcttcttggacctatctcttgaacatttgaacaagaacattgtatttacattgtatttcaaggtaaatgacagttcgtctcatcacatgattgtccttatcaaagtagtgggtcaactaatctaattcccttagtaactatagtttatatgggctttccgactacaggcccagaaaataagtgtaagagcttatacaattacaatattttgtcgataggcttcaaccccgttggtaaattgtcatagttgccaggaccaaagtcaaactcgaggacacgctcctttccatcgacgtccatcccatgttgtttcaacaccttacaatcttgatcaagtgtttggcatctgggctctctgaaatcctcaacaccaattcccaatccatacgatctcggacccttccaatgaacattttcaactgtgacactacatgtgaagatgggtggaaacttatatgccaatgctgcagaagacttggaggggcctaacttcccctttacaatgtaaatcagtattgagctgccaacttgcagctacctgaaacgaggaattgccaacatcgtctgttggtttgtcttatcaaccttgtggcaactcaa

SEQ ID NO: 25342 - DNA, 951 bp, Triticum aestivum
  Clone ID: PAT_TA_25342
acccgagaccagcctgctggtgatggttgggggtacaaccaagaggagccatcaaaccacatccacaatcaagaccggtctgacagtggcttcagacacgacaatggccggtcctcaaccgcacacgaagaagaatggtccgaagaatggtccaaggagaagccagacggggacttccattcatatccagacgcaggagcagaacctcaggaggagacacagcagaagcagcagcacgtcgaggaagtggctcctacgcccgggcaggacggcgtgcaggctgcccagtgctcagccaacgacgtcgacggtgtggtccaagacgcatatgtgcagaagtacacgtttcctcccggttggggtgacgtctcgagcatccccgcgacaggctgggagtgaccgaccagatctcttttcttttcttttccgtcggggccattgctgttggtagaataagacggggatcggccttgcggagctaacttccgggggcatcctgaactcaccctcgtcggatgctaattctgaacgtctctagtgtttgttcgctgcgtcacgttgttttgttaggccgtcgtgaactggatgtttgttgactgggggatgggtggacgtgctaaataccacccctgtttgttgaatagaaatatgatatgaatgtagtcgtcttctcatctgctggctgttgttccttcagatgatgtgtttattcatcaggtgttagggccttaggggtgttctctcctggtatttgtagggtggttctgtcctgacactgacagggggtttcattcatctatcggtgactgggattcatgcgccaacatagatgtgtgggagaaagattgttttaaaacttgctaaactcgtgctttttcccccacctgaacaacaattttagttgtatcttcgctacctcggccgcgaccacgctaatcacttggggattcc

SEQ ID NO: 25343 - DNA, 583 bp, Triticum aestivum
  unsure (1)..(583): unsure at all n locations
  Clone ID: PAT_TA_25343
gcggccgcccgggcaggtcattgctcaagatcgcttatgacaaaaaggttcgagggcttgttcttctctggtcannttaatggaacaacaggatatgaacaagctgcagctcatggtatagtttcatgaatcaatgcatctagacattctgatggaaagccactaatcgttcttgagagggaaagcagttacattgggactctgattgatgatcttgttacaaaagatcttagggagccttatcgcatgttaacaagtcgttcagagcaccgtcctaccatttcgatccgataatgctgatagtcggttgacccctttcgggangagagattggtttaatagatgacagacgctgggagctttataagtcaaagcaagccccgcattaaagaagaaaaagaacgattgaagcatacaagagtatcggggggtgaattttctgccgaagttaccgcagtatcaaaccaacctgttaaggggtcatcgacacttgaagccatactgataaagccacatgttcctcggcagcctcctcgccaagcaccgcnnttgnaaatnancatntatccccacttgnagnaag

SEQ ID NO: 25344 - DNA, 498 bp, Triticum aestivum
  unsure (1)..(498): unsure at all n locations
  Clone ID: PAT_TA_25344
ccaagaacaacttcattttcgatcggtatagtagctgacagacctatgactcttcttgcaaattgacttgttgaacgcttccgtccgtaccgcctcgctagctccgccgcttgcaccgtcgtcgtcgcaaaggtcagatgtatctggtgaaggacatcggcggcgccatcggcctgatggcggcggccctggtgctcctgggcacctggccggtcgtcctcgccgtgctggagcgccgggggcggctgccgcagcacacgtacctggactactccatcaccaacttcctggccgccgtgctgatcgccctcacattcggccaagatnggcgccgacacgccgggagacgcccaacttcctcactcagctcccccggccccaaagactaatgggccgctatnaatgtttgccctggngggcggcnttgtgatnaacctcngnaacgtgggcaaccaataacggtgggcaataacctccggcttttcgtcaaccgaaagg

SEQ ID NO: 25345 - DNA, 876 bp, Triticum aestivum
  Clone ID: PAT_TA_25345
tggcgaacaatttgaacgcgaccttattaccaacctctacgccccaggaaatttgtgggatggctgttgtcgtttacaggaagtgaaagcacattgcgagtctgagcttcgcgaggtggtggcacgttcaatatctatggtgcaagatgtggaggcgagatctaaatccaggtacgataaactgagggcggagtttctcgaaaaatctgctagtatggtggcagaaagcgagaagatgcaagcagaatttcaagacaatatgagtgcagaaacagaggctctccgagctggcttggtgcagaaggtgtatgagatggtggcaacttggagagaagaaatggcgactaacctgatgagaatgaaggtgcagatgaagaagatggctgaagaagacaatgcgacggcaacagatgtgatagaattcatggagcggagtttccctcaactgtcactgatttccaccctgagtgcatttgctccggcacctgctcctgctcctgcgcctgtggattctgataacacaaggccaggctgcaatcaccctgatgagctgccactctccctgacactgcctggtcctggcggtgccgtgaagagaaggcggggttgagggacctgatacccgttccctgaatctgctgatgctgatggacagactcgtaactccgtgccttgttgtgctagctatgccatgttgcatgtcctatgtatataccctccctgctagctacggagtagtttgcaaatcatttgtcatcgtcgaccaatcgtaaggaactaattaacaatatgcagcaggcctactacttataatatctatctcacactatcaaacagtgctatatatatttgctgctcgacttcttttatcatttc

SEQ ID NO: 25346 - DNA, 614 bp, Triticum aestivum
  Clone ID: PAT_TA_25346
cctctcaaaagtctgctgttgactccgccgttctctcaacccacatggctctcgaagcgcgcctccgcctcccgctcgccgggccaactccggccaccgctttcctctcaggatctaaccccaaacccagtcacatatccttctccctcaaacccacctccacttctctctccgccgccaatgcgccgcccatcgtcgtcgtgggctccgccaacgcggacatctacgtcgaggtcgaccgtctcccgctcgtcggcgagacggttgccgcgagtgccggtcacagcctcgccggcgggaagggcgccaatcaagctgcctgcggggggcggctggcgctggggcccacctacctcgtggcgcgcgtgggggacgacgccaacgggcgcctcctcgagggggcactcgcggacgccggcggcgtccgcctcgaccgcgtcgctcgcgcccccggcgcgccctcggggcacgctgttgtcatgctcatgcccgacgggcagaactccatcatcatcgttgggggcgccaacatggggggctgggcaccggaggtcgacccggaggacctggacctgatccggcaagccggcgtgctactgctgcaacgggagata

SEQ ID NO: 25347 - DNA, 866 bp, Triticum aestivum
  unsure (1)..(866): unsure at all n locations
  Clone ID: PAT_TA_25347
ttcttgatgataaggcattcttcatagaggagctggaggagcacatgcagaaattgcatgagaatcgggcactggctgtttcagagagacgggctgccgactttgctgatgaatcgggcgtgatcgaagctgcggtgagtgcagcaatatctgttcttagcaaaggaccaagctcagctaacctgtctgctgcatcgcatgctgcacaagcagcagcaactgctgccagggaaagcgctaacctaccaccggagctggatgagtttggcagagatatcaatctccagaagcgtatggatcttaagcgaagggaagagaacaggaggcgaagaaaagctcggtccgaatccaaaagattgtcttctgcacggaagagtgctactgagcacattgaaggtgagctaagcactgatgagagtgacaccgacaccagtgcttatctgtccagccgtgatgagttgctcaagactgctgatgctgtattcagtgatgctgcagaggaatactcgagccttacaattgtcaaggacaagtttgaaggctggaaaacacaatatcctttggcctaccgagatgctcatgtgtcactaagtgtgccatctgtgtttaccccgtatgtgaagctggagcttctgaattgggatcctctccatgaaacaactagtttctttgacatgcagtggactaacgttcttgtgggttatggagtgcaagatgaagatagtgctgaccctactgatctagatctgaacctcattcaagttctagcagaaaaggtggcccttcctgtcctgcaccaccgtattaagcactgctgggacattctgagcactcaaagaacacagcatgctgtagatgcnnnnnnn

SEQ ID NO: 25348 - DNA, 825 bp, Triticum aestivum
  Clone ID: PAT_TA_25348
cactccgcaccgagaggtcacaagcaagagtaggagctcgatcaccgagtgttagctctcgtagatcgcaagtgtttcgtttccacggtgcagtttcagcaagtcggcaatggctacgattgctctggtagtagtggccatggtgctcagcctggcgcagctctccgccgggagcaggaggctgatggagctgtacgtacctccggagagcgaccggctcacgtaccaccagggcggcgtgctcagcggcgacatccccgtgtccatcctctggtacggcaagttcacgcccgcgcagaggtccatcgtctccgactttgtcgtctcgctaaactccgcacctgacggggccgccacgccctcggtcgggcagtggtggggcaccatcgagcagctctacctgtccaaggcggctgccgccaacggcgaggccgccgccacgcacgttctcctcgccgagcaggtgaccgacgagcagtgctccctcggcacgtcgctcaccctggcccagatcgaccagctcgccgcgagcatcggcgccaagaagggcggcatcgcgctggtgttcaccgacgaggacgtcgccgtggagggcttctgcagcagccggtgcggcaggcacgggtcgtccgccggcggcgactccacgcacatctgggtgggcaactccgtgaagcagtgccccgggcagtgcgcgtggccgttcgcgcagccgcagtacgggccgcagggcgcgccactggtggcgcccaacggcgacgtcgggatggacggcatggtgatggtcctcgccaccatggtggccggcaccgtgagcaacccgta

SEQ ID NO: 25349 - DNA, 494 bp, Triticum aestivum
  unsure (1)..(494): unsure at all n locations
  Clone ID: PAT_TA_25349
tgaaaatcctgctcgagccaatggccacatcttcaatgttgggaatccgaacaatgaagttaccgttagggagttggcccaaatgatgacagaggtctacgcaaatgtctcaggagaggcaccgctggatgagcccatgattgacgtgagctcgagtcagttctacggtgaaggatacgatgatagcgacaagaggatccccgacatgactataatcaacaangcagctaggttggaacccaaangacgcctctcaaggatctgctggagacaacactgacatatcangcacaagacatacaaagaaagctgtgaaaaggcaaatgttcgcaggcttcagcgtcgacttagataagccgtgcccccttggctcccgtcctagagcctaagccgcacactgttaagatatgttcctggaagcccccgtcgccccctaccgaccgcacnggtncttttttttttgagggcccctanaacngtccgttgtttntttt

SEQ ID NO: 25350 - DNA, 848 bp, Triticum aestivum
  Clone ID: PAT_TA_25350
gcgcaacgaggataagtggtggttgcccgagccatgcgtgccggaatccggcctctccgatgctctccaccgtgagctgcagcacaagagggaccaggctagccagatccacaagatggccatggagatcaacaacgccatcctctccgaaatgcaaatcccatcctcatacatagaaacccttcccaagaccgggaaagtcgggacgggcgacgtcatataccggtacatgtcctcgggggatcagttctcgccggaccacctcctcgacttcctcaacttgagctccgagcacgaggcgctcgagatcgccgaccgtgtcgaggccgcaatgtatgtgtggagaaggaaagctagcatgacccacgtggtgaccaaatgggagaatgtcaccgagctgaattgccgatggggacaagaaatttgatcctggcaaagcagggccagggagcctgctgctctgcctgaaacaaagatttccaggcctctcacagaccaccctcgacacgagcaagattcactacaataaggatattggacaggcaatacttgaaagctactcaagggtgctcgaaagtttggcctacagcattgtctcctggatagatgacgttctccttgcagacgaaaatgcaaagcaagggaatagcaccagaatacagaagcaagtattcagccaggtctctcctcaacgctgacgatcgatgatgatgaacaaatcatagaattaaacgagttgattcatttcctgcacgcacgcacaggattattttgtgattggcgtcatgactttacccagtggtgtgtttgacattgtttttgtgagatgcattcatgtcatgatgtgt

SEQ ID NO: 25351 - DNA, 651 bp, Triticum aestivum
  unsure (1)..(651): unsure at all n locations
  Clone ID: PAT_TA_25351
ctagnactagtccattccttgcttggtcagtcatcttcaacctccagatccgcgtttggccagcgagtcgcacaagggggggttgtgatccgatgggggcggtggtgaccgcggtgatcgcgatcgcggcggtggtgctgggctggatcaccatcgagatggcctgcaagccctgcctcgagaccggccgccgcgccatggaccgtgccctcgaccccaactacgaccccgacgactcccccgcagccaactccaccgcgccacccactagcgagccgctactcgccgacctctctgcctccgccgccgcgccagccaaggccatctgatgcgtttcttgctcagcgtcgtcagtgcaccagtgctaggcttcctttcatccttactccagccatgtttgtctatctatgagtttgcgtgtttggttcttgtggcttttgttattacagtatgtgacaagaacttgctttatgttataacatgttatgaaatgagatatggtggtgatctgtaaaaaaaaaaagataaaaaaaaaaaaaaaaggagcctaggatgccctgtatatgcgatcctgaattcctggctgagacttccagctttctatgcatnacnnaaaaaancaggggccgacaatcccaaanatcttacncc

SEQ ID NO: 25352 - DNA, 1088 bp, Triticum aestivum
  Clone ID: PAT_TA_25352
gcacgcgcccctgcttcctcatttgctcaagtttctttcagctcgttcggtttgtgtgtgagagagagacagagtagcctgccttgccatggggaagaagaagagcggcggcaacggcggcggggagaaggtggtggcggtggcggcgagggagttcgcgctgaaggtggcgatgcactgcaagtgccacgggtgcacggacaggctgcgcgccgcggtgcgggacctcacgctggcgcccggcgtcgaggcggtggaccagaccgcggccgaggccaccggcgaggtgcgcgtgctcgccacggccgaccccgagcggctccgcaaggccctccgcaaggccaccggcaagaaggtcgacctcgtcttcccgcccgccaaggagcgcaagaagggggacgccgacgccgccgcggtccaggcgctgctcgccgacctgcagctgcaccaccagtacgggggccaggccgcggcgcgttaccagtacgggggacagggcgccgcgtgggccgcgagccagcagcaccagcagcagctgctcggcctcggcggcgggtggaatggagccggtgctgggggctacggcgcggcgtacccgtggcagccctcctctgcggcctcctactacccggctgcgcccgccgctggtgctggttggggcgcgtacggcggctacgggtacgctcctcaggcgcaggccccgtcccagggccacggcggctactacggcgcgagctcgccggcgtggcacggccagggctactgatcggtcgaccgagccgaccgcgcggccggagacgggcgagtacgtcggatcatcataccggatcgccagacgacgatggcatatacatatgcgtactccttttgtactagcagtattatatctcagttcagttaattgttggtagcaatcggccggatgatcgggtagtggtagtagtagctgtgatcgatactgaatccagggagcagatatagtactgcttcctttgctctttgttcatgtatattttgcggttgagagattgttggagttccctatgctatgcgtatgaatgaaaatcgttggagtttctacaaaaaaa

SEQ ID NO: 25353 - DNA, 713 bp, Triticum aestivum
  Clone ID: PAT_TA_25353
ctcggtcgaacagtcgtccggcgacatcatgagagatcacagcatgagaatgtgcacactagtgctgtatcagtcgctgttcttcctcaagctgatgaggttgatgtccaactgcgtaatgaggacttgagaattgatacctacagatcaggtggctccggaggccagtctgtcaatacgactgatagtgctgttaggataactcatcttccaactggaacagcggttgcaatacaagatgagagatcacaacatcagaacaaggccaaggctctcaaagttctccgggcaagactatatgaattggaaaggcataggctccatgcagaccggtcgaagctccgatcagagcagattggaagtggtgacaggtccgagcgcatcagaacatacaacttcccacaaggacgtgtcaccgaccatcgtgtcggggtcacgcaccactccatagtggacgtcatggagggagagagcctggacgtcttcatcgaagcgctgctgctgcaagaagagatggacgcaattgcttcgtttgcttcatgagccctaatttttgtggatttcttcctggagtgacaaaccacatcataaacacacagaacactgaaccaacgaagagaggaaactttaggattcacacagtgtattgttcggctgttctgagttgacatgttctccgatcccttgttaactcgggttatgttcttacggtc

SEQ ID NO: 25354 - DNA, 1046 bp, Triticum aestivum
  unsure (1)..(1046): unsure at all n locations
  Clone ID: PAT_TA_25354
cccgcgcgtccgcccgcgagtccgcgggatccaacgcagcggagggaggggattctccccgcgaactcaataaaagaaacccaatctcgcgtgcctcgtggcgagagttgtttaccgctcctccatctcatcaaagggataaataaagaacaccattgcccaaaagccgcaggcgttaggtggtggtggtggtggtgcgtgccagtcaaagaagaggtctgggaaggaagaagaatcaacatccatccatccatccgcccaccaacctactcttcctcctcgtcctcctcctcctgccgtccctaatcccctcccattctcgccacgccgacgagaggggcgaaagggggagccttgcttgatttgattcccgtgcgatcctcggttgattgttcggggcaaagatgtgcccgctgagggtgatactcatcttcctctccgccaccatcgccggcttcttcctcctccggggcctcaacgccgagccggacctgttccaggacgacgacgccgccgccgtcgcggcgaacgacgaggacgacgaggggtcgccggggtctcccagggaccccgcgccgctccattccaaggttgcatctgccgcgaagacaggattctggacgatggtggacatggcaagcgggcggtacctttggaggacccttgttgcatcaccggcaaaatctgactccgagaaggcccggtgacgaaccttcatcacccgtttgatactcgagtaattggagcgcccgaatggggataatttgcactgtatctgttttggttgcatcttgtgtgtaatgcggcggcagttgtaacatgggggttatatgtttggactaaatgtgccaaattgtttacgtatgaaccttgtgtcgtatatgctgggagcctggtgtatggatttggaactgaaaaaaaaaaaaaaaaaagtctcctaattgtttccacttaaaagaaaaaaaaaaaaaaaaatacaagtatagccctttggtggtgtatgggatctagcaatttggtgtaaggaaganattctgaacttcttt

SEQ ID NO: 25355 - DNA, 482 bp, Triticum aestivum
  unsure (1)..(482): unsure at all n locations
  Clone ID: PAT_TA_25355
cggncgcgtgggtcggngggtaatacggaggaggtgaggagacaggttggggaaaccatttatgctcgagataaagttgacaaaatgtttgctgctttcacggggcaacccatcgatatagtgcaacagtggacagagagggatcgtttcatgtcgtcgtccgaggccatggacttcggactagtcgacgcattgctggaaacgggatgctaagcaaacggctgcaaattggagctctaagtcagatacattcatcatgtttcgttgccctttcagttgggaccgacctatgttcagtcactagggatgagaagaagggggtgtcatttgcctcttaggagtttggcttgggctgcgggtgattttgtgttggagatattattgattttctgattaatttaattcataagtaaatcatcatgacaatgttgacaatcctaatctcacattgtaagctaatgacgcgattgcgtgctaggcat

SEQ ID NO: 25356 - DNA, 859 bp, Triticum aestivum
  Clone ID: PAT_TA_25356
ctctgctccggtcaaccaagttcctcctccgcttcccaagccgccctcgtctccgcccccctccccctcgcagtgatggctgatgaggatgagtaccgatgcttcgttgggaacctgtcctggtccacaactgatgaaagcctcaaagatgcattctcaaaatacggcaaagttaccgaggcaaaggtggttatggacaagttttctggacgttcacgtggatttgcctttgtgacctttgatgagaagaaagccatggaagaagctatcgaggacatgaatggattggacttggaagggagggccatcactgttgataaagctcagcctcaaggggttggtagagatcgtaacggtgaccgtgattttgatcgtgaccgtgggtctcgtggtggccgtgactatggcggtggtcgtgcgccgcgtggtggtggtggtggtggggactgcttcaagtgcggcaaacctggacactttgctagagagtgcccggatggtgacggcgggagaggtgaccgatatggtggcagagatgataggtatggtggtggtagatctgaccgtggtggcgaccgttctgaccgtggcggcgaccgttctgaccgtgacggtgatcgatctgagcgtggcagtgaccgatattctagccgtagccgagatggtgggagtgggggtgaccgctacagttgtgaccgatcaggtccgtactgatagccaagatcttgagaagtgtgtttcatccaggtatgaaaaccctatctactatcatgaggtgtgtttccttgtatttgaaactctgtgatcatgtatttgaactatgatgttgtaccgtgagtaagcagatcctttattacagacc

SEQ ID NO: 25357 - DNA, 974 bp, Triticum aestivum
  Clone ID: PAT_TA_25357
gccccccgcgcctccgctgtacgacgcgccccctcctccgcccatctctgctccggtcaaccaaatcctccgcttcccaagccgccctcgtctccgtcaccgccccctccccctcgcagtgatggctgatgaggatgagtaccgatgcttcgttgggaacctgtcctggtccacaactgatgaaagcctcaaggatgcattctcaaaatacggcaaagttaccgaggcaaaggtggtcatggacaagttttctggacgttcacgtggatttgcctttgtgacctttgatgagaagaaagccatggaagaagctatcgaggacatgaatggattggacttggaagggagggccatcactgttgataaagctcagcctcaaggggctggtagagatcgtaacggtgaccgtgattttgatcgtgaccgtgggtctcgtggtggccgtgactatggcggtggtcgtgcggcgcgtggtagtggtggggactgcttcaagtgtggcaaacctggacactttgctagagagtgcccagatggtgatggcgggagaggtgaccgatatggtggcagagatgataggtatggtggtggtagatctgaccgtgaccgttctgaccgtggcggcgatcgttctgaccgtgaccgttctgaccgtggcggcgaccgttctgatcgtgacggtgatcgatctgagcgtggcagtgaccgatattctagccgtagccgagatggtggaagcgggggtgaccgttacagtcgtgaccgatcaggtccctactgatggcctggatcttgagaagtgtgtttcatccaggtatgaaaaccctatctagtatcatgaggtgtgtttccttgtgtctgaaactttgtgatcatgtatttgaactataatgatgtaccgtgagtaagcagatcctttattacagaccatattactgacctgcttattatttgcttcctggttaatgtgagtc

SEQ ID NO: 25358 - DNA, 712 bp, Triticum aestivum
  unsure (1)..(712): unsure at all n locations
  Clone ID: PAT_TA_25358
cttcacttcacttcaactcaaccgcccgttgcagcggcggcggcggcaaccatatcacctatccatgtcgagcccagtgcacgcccggaagccccccctcctgagcaccatgagcgacaagctgctccagcccctcggccgccgcgtccggctggccgcctcccctccctccgtgctcagccccttcaccgggcgcaggctcttctgcgccccctcccctgctgcccgccggcgccgccgccgccgccctctgcgccttcgccgcgccgaccctggtcacgtcgtcctccgccccgccggcgtcgtcccagccacgcgctggtcgccctaacgcggcgccggagcgcggcaccggaacagcggggcggcggcgagcggggtgtcgctggctggcgtgctacaccgcctcgcactgcaactcgccggggaccgcggccccggaccgggacgccgcccgcgggctggggcgccgcgcgccctgcaggtaccgcctctccgggctgggcctcgagagccccgggcgggcggcgctgaaccactctcgacggccctccaccacgggccccgcgggtctcgtcggcggccgccaccccgcgatcccgggagatcggcgtccaacccctctgccgccctggtttaatctcgcccagcgcccccccggttccaactgatcgcctgacagccccntntccnctggggaatacnaaaagcc

SEQ ID NO: 25359 - DNA, 2026 bp, Triticum aestivum
  Clone ID: PAT_TA_25359
gctccaatcaacaggacgccttcgttattgttggagcaatgtatgcttgcatatgttcagtttggaatttctgaatcaagtcgcgaacagccctgaaaactagcctcgccaccgcccgctgctccgctctactccgcctgctcataatctccctcgcgtcgccaccgtcgagcgctgcttcttgcgtgctgccgccgcggcgaggaggaggagaccgttcgaatgaaggagatgatggtggggtcggtggcgccggtaggcccggtcgggagcttgggagcggcgccgccgcgccagctgctggagcggatgaaggactacggccaggagggcgccttcgcgctctgggacgagctctcgcccgcctaccgccacctcctcgtccgggatttctcgtgtctggatctatgccggatgaaaccgtggagtcgacgtgccgcggacggacatgcagacgcgccgacgcccgccgagtccttggtggaatccagcgtgacaggggcagcagagggaggaagcaaggagggagaacggcactggaatagcaaggtgggatcgaatgcctcgcagtttgggacattggtggtgttttgagcgtagctctttgagctgtcttcattagggttttcaggcactgtgtagactgttggatcttttgtgagtaattggcccagattctgaatgcgtcttggcttttgccatttgtcacaagttggctgctcagtccagtgacagtccaagaaatacaataccaatccactggtacataatgaccagccccttcaccgatgatgtcacacgcaaattctttgaaagctgtaaatattttggcttagaggctgaccaggtgacctttttccaacaaggcacccttccatgtgtttctgacgatggcagatttattatggagacgccatacaaggtagccaaggcacctgatggaaatggaggagtttatgccgctctgaagtctaagaagttgcttgacgatatgtcttcacggggtgtaaagtatgtagattgctacggagttgataacgtattggttcgcgttgcagatccaaccttcctagggtactttatagaaaagggtgtatcttctgctgcgaaggttgttaggaaggcttatccacaagagaatgttggagtatttgttcaaagaggccgtggtggacctctttccgtggtcgagtatagtgaaatggatgcggctatgactactgaaattaatcaatcaacaggacgccttcgttattgttggagcaatgtatgcttgcatatgttcagtttggaatttctgaatcaagtcgcaaacagccttgaaaggacagcgtgtatcatcttgcacagaagaagataccttcgattcatgggtatacaatgggcctgaagcttgagcagttcatattcgatgcattcaattactccccgtccacgacgcttttcgaggtgctacgcgaagaggaatttgctccagtgaagaacgcgaatggctcagcctacgacacccccgatagcgccaaactgatgctgctccgactccacagcagatgggtagtcgctgctggcggcttcctgacccattctgtgcccttgtacatgacaggcgtcgaggtttctccgctcagctcctacgccggagaaaacctggaggcgatctgccgcggacggacattccacgcgcccagcgagatctcgttctaggcgcatcagttcacgacagtggcagcaaatggaggaagcagtattgcacagggattgcaaggtcgaacgaatgctcgcagttgacattggttgtattgagctgagctctttgagctattggcattagggttttcaggtactgggcagactgttgtatcttttgtgagtaaattggcccagattctgaatgcgtcttggcttttgccatttgtaactcttttcgctgttgctgcccctttagatgagcatcttcaactgtactaatttggtgccccatttatctgctgtcacgttccgacagtgtccgctctgaaccccaaaa

SEQ ID NO: 25360 - DNA, 776 bp, Triticum aestivum
  unsure (1)..(776): unsure at all n locations
  Clone ID: PAT_TA_25360
ccttcgtcggccctcacacggncagnacccggaaataccttcctctcatgttaacaagatgattctctttgatagttgatttaccataaactgaatggcttggtcgccaggggcgatcttcggagtcttcgccaccactgtccacatcataactttcactgtcaccagtatcttcagacagcccttccagaatctccttggtgattttttctgtgttggtcttcgacatcgctataagaaaccctaagttcttctcttcatcaagactcagcttcatctcagcagcagctttcttagcagcttcagacatcttcggaaacactaaaaaactgttttcaaagccgaagcttcaaagctaaaagcttagcaaatcgcagtgcacaagagctaaaaaaatgaatgagcgagagtggttggccagaaagcgtgcaaaatgagtttgcggtatggccgtatttatacgctcggtgtgttggaagctgaaagaccccacttgtcattgaatgttgctattctagcaaagggaaggtgttttttcggaccttcggcgtaaagccttcgtccatttcgcaatctaaatttattatttcgaacaaattaatattgcgaggggctactgttggggaccttcggcgtccgaaggtcctcaaaaacaggatttaacagcattcctgcagtacaatgtgtaaacaggtatcctcggactaaagtcggcattgcggtggaccggaataatacgaaggttgactcagagccgactagttnctagatcgcga

SEQ ID NO: 25361 - DNA, 799 bp, Triticum aestivum
  Clone ID: PAT_TA_25361
tggcaaccgcgagtaaaatggaggggcgcccccgcggcggcggcggcggcggcgggcggacggcgatggactactcgctggcggcgctgaagctgctggcctcgcagctggagggctccaccacggccccctcctccgagggctcctcccccgcggagatgctcttcggcatccgcttccagcgcgcctggatccagggcgtgatcctgcgcgtggactacagcgccggcgacaacgggaggctgttcgtggatgacggctcctgcgtcaccgagttcatgctccgatccgaggatgccaagggccagccctggcgcccagggatgtatgtgctgattattggggcatatattgcacccgactctacggaaaatctgccagcggtcaaggtgcacaagatagtggatctctcggcgcagccggaccgtgaagcgatgtggtacatggaagtcgccgaggcttacaacttcttctacgaggccgatgcctctggtgtcggctcaccgtcatgagcactcttaacaccttgccccctcctgatggttcgtgtcactgtagcactcgtagcactgctgccactctgtacccgtgctcgttaccttgttctaggccgcccgctggtaactcagagaggcccttttggtgctgcgaattgtttcagggttatctcggatgaacgttggagcacgtccaaattccaacagcgagaaaattgactggaatctcccaacatttcatgcgactgattcttgatgtctcttgcagtctcgtgttgggccgccgctagtggttttgttgc

SEQ ID NO: 25362 - DNA, 477 bp, Triticum aestivum
  unsure (1)..(477): unsure at all n locations
  Clone ID: PAT_TA_25362
gagagagagagagagcggcgaccgtgccggccacggcggggagctgggcgctctgaagcgctcgtcttcgtacaatgccgacaggagcagagagtccacgatgaacactgctagtactactactactactagtggtggttgtaagctggagcttgcggcggaggaggtggacggcgtgcgcgcccgctgcatccccgccggcaggaaacccancggcggcagcagtaagaagtctccgaccacccacgtccacgttagcagcaggcgcggttgaccagnccggaaaccaccgacgacggacggtccgactgaattcaccgantgaaaactcaagacatactactaactagcatcaaaatgtgggtcgaaagcgcgtgcactgcaggctgaacgaatgtctttgcagggcacgagctcttgcatcgacacccctttcattttttatctattacccattttctggagttacctnncgtt

SEQ ID NO: 25363 - DNA, 1756 bp, Triticum aestivum
  unsure (1)..(1756): unsure at all n locations
  Clone ID: PAT_TA_25363
cgcgccccttctccaggccatccgcgccgccgccgtgttcggctgcagcctcgcccacgacgaggcccccgccgcgtgccccgggagcgtcgtgggaatggaagattgggtccgcattactttcgcttgcgttccatcttcccttcaagatggtcttgaaaggatcaaatcattctgtcaaaggaacaagaagaagaattggataaatggttgttagttgtacacacctttagttgtacatctggctgaagctgtaactcgtttcgagttatcgttatccatatatttcaataaaacatcttgtaacggtctggttgcagcggtcccattcatgtgcctccgggcgatacggttctggctccgcggccgcgcaccggtgatcggaccgcggcccgtgcggcccctggcccacggggcacccgtccgttttccccgccttccgcacggccgtcgaggccgaggacgccgtcgcccgcccgctgcgcccgcgccgccgctggaacccaagcaatcgaggtcataatcccggtgctagcccaaactgccggcgccaacatactccgcccctgccctgcctgcccgcggcccgcggcatcttcctcaccgccggtggaacccaagcgattgaggtcataatcccagttctggcccaaaccgccggcgccaacattctgctcccaagcccaggctgtacaagcacccagccgcgaggctcattataaaccctggaggttcgacctgcagacctcaccccgtagcgggcatttggccaaggccgcggaggcggctaggaaccctcggcatattggatcattgctgataaggtgttacggaaagctggttctgggtcagcgccccatttaatccccatgggtgtcttcgggcacattgcccctgtcttgtccataggatctctgtccaagtcgtggatagtgcctggaatggcgacttggatgggtggcggtttacgaccccacgtaggttttaggagaaaaccaagatctctacatatattacgaattaccttaacgtctcaacggacccagcaaccttcgttcagggcagctcttcctgaaattcgttgagaacacaaaagaagatttctttaagaagataattggactactaaaggaatcatcacgagatatgttatagacgaaataaaggaaaacaaatacattacatggcctcaaaaaggagatttgttcaaggggttgataggtctgctataggaatcatcagagatatgcgtcagagaaataaaggagaataaatacattacttgccctcacaagccacaaggatcgatgtttgtaatggtgaaactgaacttacatcttttggaggagatccatgatgacattgatttttgctgcaagctcgcgaaagaagaatcggtgattttatgcccagggagtgttctgggaatggaaaattgggtccgcattacttttgcttgtgttccatcttctcttcaagatggcctcgaaaggatcaaatccttctgtcaaaggaacaagaagaagaattcaattaatggttgttagttgtacatctgactgaagctgtaaatcattttcagttatccccatctatatctttcaataaaatggaacttttagttctctatgaatagaagtcaacatctccttgaatatgttatggttgccatggcctggaccaaacaatagtgaatgctagtgaagttaaaaaaaaaaaaaaaaaaaaaaaaaaaaaaaaaaannaaaaaactcga

SEQ ID NO: 25364 - DNA, 751 bp, Triticum aestivum
  unsure (1)..(751): unsure at all n locations
  Clone ID: PAT_TA_25364
ggnattgggnagtctctgntcgttgttgacagggcaaatgttggtggtaagcttgaccagctggatacttttgatggtgatgctgatgctctttttcaagagaacacgaaagagctctactttcctccgcgccgcaatgggaaaggaaaaccaaatacgagccaacatcctgcaatcgatgaaacagaagaagagacgtcagaggcggagcaggtgaccaaggcggcatctcacaccaagaattcacggcccaacaagcgcaagaaagccttggaacatgcagaaccagaagaggaggcagagtgtggcagtcatggccgcgggcagtctacgagaaggggcagaggcagaggcaggggagccaagtcggcgactccggagccaatgcgcagaggcagaggccggcccaggaaggggagccctggcgctgctccttcggaagccggaagctctgcacgaggtggaaagaagagcgggaagcgagggaggcctcgcaagtgatcggccggatgaacctcaggctcgccaacgaatttttggtcagactaatggcaacgagagtggttgctagtctttggtgctgccatgccagcgtatcctgtaatatggttttgaactactacagtactaatctggtggagatgacaagggctagctatggacactgtaaggcaccggcgatgatgctatgaacgactgatgatctatggaggaatgaacgagtcatcctgcatgttttttctggaagaat

SEQ ID NO: 25365 - DNA, 947 bp, Triticum aestivum
  unsure (1)..(947): unsure at all n locations
  Clone ID: PAT_TA_25365
gncgcattgcactagctagnacttgggctcgcaacctcaacacccttccgcttaacctgcagcccttcggtcatcatcagcactcagcagtagcataggcaccaaggtagcgacccccgacacaatgcagtacggcgcggcggcggcggagcaggcgtggtcgtacatgccggtggtggcaccgtcgtcggccgtggagacggcggcggagcgcgtggagcggctggcgtcggagagcgcggtggtggtgttcagcgtgagcacctgctgcatgtgccacgccgtgaagcgcctcttctgcggcatgggcgtgcacccgacggtgcacgagctggaccacgacccgcggggccgcgagctggagcgcgccctcgcctgcctcctcggcgcctccggagcctcggcggcgggcgcgccggtcgtgcccgtcgtgttcatcggcggcaggctggtcggcgccatggaccgcgtcatggccgcgcacatcaacggcaccctcgtgccgctgctcaaggacgccggcgcgctctggctgtgatctcatcgccggccgctagctactagccattgccgccgttgcagctgttcgatcggggggctagctgatagtaaggcaggttacttattaattaatacacccaaagtagtgagttattaatcatagagtgcgtgcgcttgtgtgtttgtgtgtgtgttagtgggtgtgagagagagaggtcggtgattctttttactgatgctgcctccgtcttgtgtgtgggagctagctagttagatcgtgcttgcatgcccacgcgcgtatgtacgagtgtgtgtgcactgctactgctactgctagctaggtttggtcggtgctagaagagatcgatcggtttagtgttcttctcttccatgcatcttattaatcagtttggcttggggttccggcccctcgtctttgtgttttc

SEQ ID NO: 25366 - DNA, 568 bp, Triticum aestivum
  Clone ID: PAT_TA_25366
aggaattcggccggttcatccatccgatcccatctgcccgctcgcagctccaaggaaggaaggaagccttcagccatgtctggccgcggcaagggcgggaaggggctgggcaagggcggagccaagcgacaccggaaggtgctgcgggacaacatccagggcatcaccaagccggcgatccggcgcctggcgcggcggggcggcgtgaagcgcatctcggggctcatctacgaggagacccgcggcgtgctcaagatcttccttgagaacgtcatccgcgacgccgtcacctacaccgagcacgcccgccgcaagaccgtcaccgccatggacgtcgtctacgcgctcaagcgacagggacgcaccctctacggattcggaggctgattgacctgctccgtctggtctcttcccccgctgttccatctgtccgagtgcgtgtgttgttgttccgtcattgggtttggtctgtgtagttagtgcaaggcggtgtgtatggatgcaatggaaccagcgttggtattatcttaactgcatctctcgatatgttatagttttaaaaaaaaaa

SEQ ID NO: 25367 - DNA, 604 bp, Triticum aestivum
  unsure (1)..(604): unsure at all n locations
  Clone ID: PAT_TA_25367
gcaaaagtgtagtgtttgtgtaaccaagnagaagagctctcggcaaagctggtgctggtgtctttcttggtgtgtgcgtgtgtatgtgttgagttttctcatcatgtgtgtgttcttgagagaaactacaagtgagagttgtgtgaggaagaagaagaagcggcgctgcggaggaggcggcgccaataggctggacttggtgctcgacccgaggctcgccggcgagtcatgcacctgcagggacgagatgcgcagggtcctcgacgtcgcgctcctctgcgcctccagcctctcgatcgatcggccgtccatgaggtccgttgtgaaacagctgctcgaggtcagcaaccccgtcgtcgccgtggtcgactggtcgtggaggacaaggaacctcttcatgtgtgatccatgcatggccatgtctcagaaagcaatgctagtttggtagtggcttacggtttttttcgatgcaaaatagctctgaaatcttagagataaaaccaggtgtcttgttgtccatgccatgtccagcactcctccatgaggtctttttaaagatctcccatgtgcatcgggaaaaaaaaaaaaaaaaaaagggcggccg

SEQ ID NO: 25368 - DNA, 667 bp, Triticum aestivum
  unsure (1)..(667): unsure at all n locations
  Clone ID: PAT_TA_25368
ctccttcagaccaaccgaaacctaatcctctctgcttcggactttcgtccgcccttctgtcttccttgacgacgatttctaccgcttgctgccccgtccgttctgcctgcagaggacaacatgaacactgaaaatcaccaatatgttgctgatgctaatggatttgatagagttaccaagtctgaggtcaaataagaaaaatataatgccagtatcttatgccgggcaaacttcgctacatggactggaaaacttccatggatgctgtcgctgttccacgtgtcccatggcttacttggatatattcacagacttcaacgttatgattccaaactggcctggagatattccaaggcccttngagcatgggacaacaagcatcccatgaggctgattttactgctccaagtgtttcaactgaacccccttggatacgtgggaaaaaatttagaccggacagtgtttggcccggtaattacngtcctccaccgcgggggtcttccagaagagggctctgccccatgcacaagtcccggtttggctgaaaaagattatgggcagggatgcgcctccacatgaggtgatgctgcggcgccagcaatcgcgcgtgactacgcctgggaggcggccccgcccgcttggttnaatacaaaccctgtcanaaaaa

SEQ ID NO: 25369 - DNA, 587 bp, Triticum aestivum
  Clone ID: PAT_TA_25369
gcagcctcctcatcctcatcgtccgatgcaacatacaaaagaggtcgctgccgctgccgctgctgctactcggagcggtcctcctcgtggccgccatgctcccggagggggcggcggccaagtggacggcggtgaacccgaacggtggggtggtccagcaggtggggcggttcgcggtgatcgtgtacgacctggcgcaccgcgcgggcctgacgtacgtgggggtggcgcgcggcgagacggaggaggcggtgggcggcggcaccatctaccggctggttgtggcggcggcgacgcccgacgggagcagggctcagtacgagtgcctggtgtggggcgtgccggcgtccagtctcagcacctggaagctccgccggttcaggaagatcgcaatggcatagggtcaagtatcagccgtacgttctaacgtcggagagtatgtcttggttggttcatgcgtatgctttgcaagtttgtttctctcgtctttcttcggagtgccggtgtaagtggccgtgtaataaggtttctccctagcacaatgtgtttcacatatgtttatttaacgtgttatatgcctgaatcca

SEQ ID NO: 25370 - DNA, 524 bp, Triticum aestivum
  unsure (1)..(524): unsure at all n locations
  Clone ID: PAT_TA_25370
gcggagggcagccccaggcgccgccgcgggtcgccgtcggtctactccccgtcgccgtcgccctaccgctcgccctcgccgctgccgtccccgtcgacctaccggtcgctctcgcactcgccgtcgccctgccgctcgtggtcgcagaggccgcccagcgacgacgatgccgacgatctgagccgcagccgcgggtcggacgacctcgaccggcacggccggaggcctgcctggcggccgcacgcgaacaaggagctgggcgagcatgggcgcaccggcgagttcagcgtccggatcgacgactacgaccgcctcttcacctgcaaggcctgccgccgcatgctctcgccgccggtctaccagtgccccttcgcccacgtcacctgctcgaggtgccacgaggaagtcggcgacaaccgggtgcagctgctgcggcagcggcaatggctattgggcgcaaccgcgtcgtcgaggagttcctaggccgcatnccgcttctcctgccgcaacaaagttgcatgcct

SEQ ID NO: 25371 - DNA, 1080 bp, Triticum aestivum
  unsure (1)..(1080): unsure at all n locations
  Clone ID: PAT_TA_25371
ccacgcgtccgcggtaataagatctgtcaggaaattgaccttaataaggctagttggactgccttgtttgagccttttatttttttcgaggcatatacgaagtatctagtggttgacattgttgcggacaatgatgatgatcttcggctttggaagggatgggttgagtctcgactgaggcagctgaccttgaagatagagcgggatactaatggaatgctgcaatgccatccttacccatgtgactattcaaatcctacagtacagtgtgctcattgctccttctacatgggcttatcaaggaaagaagggatgaaaatacatggtcaaaactttgatattcgtggaacggtagatgagtttatgcatgaaatcggaatgtacacattgtggaagtctggaatggacctagcggtcactcatgttcgtaagaagcagatcccttattatgtatttgaacagggttacaagaaaccttgtccaccaatgcatgcaaaccagcaagagcagtctgatagacatgacactgaagatgacacactgacagcatctatgttgggccaactaaagagaaagcgtgattttgatgaagctggtcacagtgaatcatgtaaatctgttaaaaggtcttcagtatgcctaggctacgaggaaagtccacctgaatatggaagcattgtaagtaaagttgtatccggaaacacagtcaaattggtttccagtgccctctgtaatggagttcagaatggactgtcgcatggcaatgtaaatttggaatcagcaaattgctccagttcaccacatggatctgaggagtctgcagcatcaggcacaagctgtgcagctgtggaaacagttcacatggtttatgaaactgttggtcctgaaagctcaatggcatgtgttatcaatggtatggtccagactatggcagtgcacacacctttaaaatgtgtggctgagaaagatgaacccaagtttgagggaattggtagcttggcaaacagcaattctgccgagtttatggagcagacagaaatgctcactggnaaacgtccttggtgagaatatgcacttgtg

SEQ ID NO: 25372 - DNA, 862 bp, Triticum aestivum
  unsure (1)..(862): unsure at all n locations
  Clone ID: PAT_TA_25372
attggggagtttaccttccgctctgatgtccgggccgtaaaattggggaaagataacattgtgattgtcctcgagacaaagatatatgtttataactttacggatctgaagatgctccatcagatagagaccctgccaaatcctaaaggactctgctgcctctctcatcattccaatacttcagtgctggcctgtcctgggctcagtcagggacatgttcgggtagagcattttgggctaaaggtgacaaagatgattacggcccatgattcacacatttcttgcatggccttgaccatggatggtctcttgctggcaacggctaagtatgaagggcactctaatcagaatatttaacacaatgggatggcactcgcctgcaaggaggtgcgcanagggccttgataaaagcccgagatatacagcattgcactgtcaccaaaatgtgcaatggggttggcagtggccagccgacaaaagaacgggtcaatattttcaagtccaaaaatcaagggtggcgggtgaagattcaagttatgataancgaccttgaagctcacgntnggatcaccaaaaatcttctccttatggatcctntatacaaacaacctggatccatgcaagctatacttttttatgaanggatntgccaagncttactnaaggggcnttgttagttcnttcggagnncccttcntnganntttggctaaanacggaaggnggtggccggngggngtttangggcntttttccaaaaangggncnanaccnaanaancnnnggtttnaaacnntccctcctnggnntnccnttaaccgggcctcccccccnnnaaannnnnannaaaggggnttncnttt

SEQ ID NO: 25373 - DNA, 483 bp, Triticum aestivum
  Clone ID: PAT_TA_25373
cggacgcgtgggctggagtacaagagtcgataaaggatgggtggcaaacagctgcaaagaaccatcctaatagacccagcgttttgtttatccaccatgctaactcctcacctagaggctctccgccgtgccaagcaacagcggaaattgcaaatcagaccaaacctattgggagaaaattcaccgcctccatcatgggtggcatctttggttgtgcacggccaagatcctgatgcactgaatcagcctcatggaacacgtgcaaacctgttgcaaccattcactgatcgatgatgtgtgtgctgcacgaccgtcgggaggcgtggccacagggtggccaaatgtgcggtcttctcctgtgcggtgtggctgccggtagtgagtagattgagatgaagatgacgcagcttcttcgtgatgatcgttagcaagttacaagcaaatcctgttaacttttcaatgaagtttagagggttacacaca

SEQ ID NO: 25374 - DNA, 573 bp, Triticum aestivum
  Clone ID: PAT_TA_25374
cgcttcttcctcctccgaagcgaatcgaaccaagcgttgcggcgagtcgagcagagccgaaaccctagctcgcccgcttccccggcgccggagctggagccaggtcgggatgggcgccgaggaggacgccgccgcccgccgcgagcgcctcaaggccctccgcgccgccaaggagctcctctccgcgcccgacggcgcctcccccgaccccgcccccgcccccgcccccgccccgacgcggaccagcagaatggtgaacatgggatgacagaagaacaggtggaccaaccagaattgccaggtcctgtggatgcacccgaggatgcttccaaggagaacgttagccccactaaggaatctgatgaggctgaagacagtggggaggtaccactgaagttcagaaactaccttcctcatgatgagcggctccgaggtggcaaggtggccccgctgtctcttcccaaggtttgaagattttatcgctgctgatgctgccgagccaaagcagctggagaacccgtttgggaacatcgttccaaagaacccaaactgggacctgaaacgggacgtgca

SEQ ID NO: 25375 - DNA, 828 bp, Triticum aestivum
  Clone ID: PAT_TA_25375
caggccggggcgggccccgtcccgcgcccagtcgcgcaccgccgaggagcggcccaaaacccccgaagcccccgcccccgcccccgacgccggcgccggagacggggcgcgtggggcgccgggggggccgccgcccccccccgcgtgccccgctcctgtggatgcacccgaggatgcttccagggagaacgttagccccactaaggaatctgatgaggttgaagacaatggggaggtaccactgaagttcaggaactaccttcctcatgatgagcggctccgaggtggcaaggtggctccgctgtctcttcccaagtttgaagatccgatagctgctgatgctgctgaaccaaagcagctggaagaacccctttgggaaacatcgccccaaagaacccggaactgggaacctgaaacgagatgtgcagaaggaggattgacaagctggagaagcgcactcagaaagctctggcggagattgcattggagcagcaaaaggagaaagagacgctggaggagggaggcgatgcagctcaagagtgacatggtactggtgctggtccaaatgtttgtgtagaacagaggaagcagctagatgaggtcaaacagtgatgtgtttgtaatgcacggtgtgggctgaggactaatgtacggaaattgtagtcgtgtgctcgcaaggcccggtgtggatgatgcttttcagttcagtatccagaattttgtggttcgtgtcttcgccaggcgactacggcatcaactagattcatctcacgaagttggaggatatatttagccatggaccaaccgtgacacactccaccaagacca

SEQ ID NO: 25376 - DNA, 1033 bp, Triticum aestivum
  Clone ID: PAT_TA_25376
ctctcctccatgccgccgcagcggcgagcccctctgtcctcaactacgccctccaccgccgaccccctccgccgatgtggcgacccgccactgacatcgatgccgccggtgcgtcgagatcgacctcgactccgtccacacggatctggtgtgcgtggtcaacgtcgcctcgctccccacggcaccgccctaggactggtcgacggcgccggtgcgtcgaggtcgacgtcgccttgatccccagcacgagatcccgctacgaactccgggcctgttgtctcaagttcgccgtgccagcccacgccatcgcgctccttttctccgcgaccctccacgcggacgagcgtggtcgggctccccaccacgtctcctaccacaccgacggcgagcgcggtgcctgctccccactacgctaatacatcatggtgctcagatctgtcatggtggaaacgcgatgcagattttccctcccttccaccgaattactactgggctccaagtctttcttattgctgcctcttttgcttccctcccactccatccctcccctactccaagtattgttgaggactgcctctcgctgtggcacgcaaattgatgcaggcgctatcagtgaaaggattggggacctccgatcgcagttttacgccaagtaagcgactacaccttagcaaccacagcaacacccgctgatgagaggttcgatgggctacaacctgcccagtatttacgggccccacagcccgctgcaccacccgatccccgacaacctgccaaacgagggcgggaccaacatttactctgtgagggcggtgagggcactttccttgcttctgagaccttgcgtgatctacaagcttctgacggtttggatgatctacaagcttctgaaggcttggatcacctacaagctgctgaatgtttgcaacgacctacaattaagttggtcgacttacaacctcatgtacctttttggtgggacccgcgcccagtgccagtccgctcctccttttgtggcacaacctgtatatgt

SEQ ID NO: 25377 - DNA, 1156 bp, Triticum aestivum
  Clone ID: PAT_TA_25377
ccacgcgtccggaacaataacaatactatgtctatcttgctgctgcattatacagtggggatgttaagattgtcaataccactcaatttgcttgtacaaaagattgagggaagcccacacaagtatttgcagcagtgtacaattcattccttggagaccttggacagcaattactggtggcctcgactcaaagcttgctgtgtgggatttctccaaagggcgaacactattttctattgattatggatcacctgagttgcaaaatagcagttcttcgggtagtacagggcaatgtctcaaccctgctttcgttcactcggtagcagtttctgaagagggcattttaggagggttgtacaaagtttgtgccgttgcaaggggggacggtgctgttgatgtagttgatctagaatatgaattggcccctgcaaaatccaaaggcccttctcgggcaagggggtcgaccatgagctcaaaaacaactgatcttggggatgggagcaataatcaatgtcaaaggagaaggatccatcttgattactcaatgggtggccatactgcagctgtctcctgtgtggcattttcagcgtttggtgagaaggggaagttacttgtttcaggtggtaacgacgcatcactgcaagtatgggattggtccaaaggattttctcctgaaacaagcagcaatagtgaactggtgttggatattgatgtgaagaaaaaggtaaattggttgtgtactgctccaactgattcagataacctgattgtgtgtgacacatccaaggtggtcaaagtatataatttttcataaatggaaaaatgtgcggtgtcaccttatggacagttttttgggttataacccagcatgttggccctggctcatcagcgccaattgccctgacacctagtcctttgatatgaacccaagccagctgcatcttcttctgggaaatcagtacatgggactctagagccctgcagaaaccattttttgtaacgagacaaaagtcatgtggtactgaaatcttgtgctctgatgtgctgctaggatagacatgtatgtctttgttgtgttggcgttataaatgtatggtttcggtatagaacgattgggtttgtgtaggtagttcatcgaagatagacaaatgtgctt

SEQ ID NO: 25378 - DNA, 1247 bp, Triticum aestivum
  unsure (1)..(1247): unsure at all n locations
  Clone ID: PAT_TA_25378
gnngctctgcccggctcggattgtcccccctagagggtacttgaccgggccccccccgcggcggcggccgctctgctactgctggtccccccgggcggcaggcatggaaccaaggggctgtgctacagtggctcctggtttggccatggccgggttgaacgtctccctgatgatgcggctgagcacgtgtcgcgtcgggccctcggtctatacagtgcggcggctacaatgattccaatacaatttgggctgcaactgagttctcgcagactaagattcccctttcctgcctttcgcgccggcccttcccgcagcatctagtagagggagaagtgttataggtgtacttgaggcaaattttattgagccggcacatgacaagcaagattttgagaggactccactgttcattaggctggaaacaaaactgaaacaaattatcgttgattattggaaagaaaagtgtcatctaataggttaccagccaatcgatccgaaattgagatcccagtataaggctgctcttaaagattcgggcggccctagtgtgaagattcggcatgaagcttccactgctcagaagactggagggcacctctcaaatttgctcccacagacatatgatgatgaagcagcttttagactgacagctaacagggcaggttctgctttgcattcgtctggccaaggtagtatggactcagcaggcttggaagaggatctggtagatattggctcttcttggtgtacttgatcccagttgcaatgagaagttgagtgaagaaaatttggttctgttcacaaggcgtgaagatcttcggcaacgagatacacagttgaagcagacgattggcgagctggagcatgaactagaggaaacaagaaggaagtgctctcagctcgcagctgagctgcagttgcggaggagccagcaacaacattacatgtgaaggttatttttactacttctgacagggcctaaactatgggaaccaaactcctggaaatatgtggtttcatcaaagcacaaatactgaacagcgatacggatgggttgctcatacgcatacaaatgatcagcgcgatcggtatagttgccctcttcagggggaatcttcaggtgtgaagttcctctgtcccctttctcgtctcggtgcgggtctgccgccggccgccactgttagctatggtgtggtgtggggcagcatgcacagttcactgtaatatatacgggtgttacatttcac

SEQ ID NO: 25379 - DNA, 915 bp, Triticum aestivum
  unsure (1)..(915): unsure at all n locations
  Clone ID: PAT_TA_25379
gggcgaggnaaaagggcgaccggcggaaaattctccggctcgttcgtctccaccaggggccggcgagatgtcgtcggcgatgtcccgcgcgatccggggggccgtcgcggctggggtgtcgaggaggggcctggcgtccgtggaggcgatgggggcggcgaagggggcgccgcccgcggcggggcgctgggccgggcgcgggcgcggcggcccggggcccgtggaggacggggcgcgggtgcagtgggtgttcctgggatgccccggggtcggcaagggcacctacgccggccgcctctcgcggctgctcggcgtgccccacatcgccaccggcgacctcgtgcgcgacgagctcgcctcccagggccccctctccaagcagctttcggagattgtgaatcatgggaaactggtgtctgatgagatcatcataaatctgctgtcaaagcgccttgaggagggaggagagaagggtgaattaggcttcatacttgatggttttccaagaactataagacaagcggaaatactggagggagtcacagatattgattttggtgatcaatctcaaacttcaatgaaagagtctgcctgccaaaatgcattgggtagaaggaantgcaaccaagtgttggaaggaaactccaatgtggnctccaatggacatggagggtgagaatgggggggctccgaatgtgttatccccactactacctccctccacaagtgcgaaccaaanttatttaccaagacccgatgatactggaagaagtgggtaaaaggacngntgcctgtttaccaatgaattgtgtgaaccaatgggagattctacangacacgggggaaatcctggagtcaactnaccgggaagnatcccgaatcatggcaaagctgctcaagcnttaatatagaana

SEQ ID NO: 25380 - DNA, 676 bp, Triticum aestivum
  unsure (1)..(676): unsure at all n locations
  Clone ID: PAT_TA_25380
aggaattcggncgaggacctcccctcccccgaagccgaaggagcgcccccctcgatcccctccccagccccgctggcggcgagctcccacggcgccacggctgaccagtctcgatttcactgccccggccgctgattgatcggtcgaccgcggcggcgatgggaggagggtcatggcggcgccgttaggggcttcttggtcgactccctgttgcgatggcgtccaaggccgttgctgagatagtcgatgacaagcaatgcagtaaaagcgccgccgagtcctccgaggccgcgccttccaggaggcagtccgaggagctaattgggggagcaagcaaatcggggcctgcctcaccgagagcagttccgccaggtgatgtggccacgtccagtggagtgaaagaacaagataaggactgcagttctgttgatggctctgtgaaactggacgaagatgaagacgccgagaagagctcgctgcgtgggagcgtcaaggatagctcggtttctgccaagttcagcgacggagcaagcagcctgacaaaggcgagcggcagcaccaaggtcagcggccacgctgatttggtccagagcgggaagagcagcgtttacagggctagcgccggcagtgatgtcagtgatgatagcacctgtagcagtatatgcagcagcgctag

SEQ ID NO: 25381 - DNA, 504 bp, Triticum aestivum
  Clone ID: PAT_TA_25381
aaaaagggagattacatgagttcctcctctcgttcaactgaagcactgtggcaagcattcttcgctaatcctcttgactggtgggataccaggaaagataagaagaacccaaggtatccagacttcaagcacaagagcaccggcgaagcgctgtgggttgaggggaggaacaaccccaactgggtcgtttcccagctggcgatcttggactcgaggatgggttccctgcaggacaagcagaggaaaccagtctcctacatgtacgccgacgacttcatgacatctgacgccagcgactaggccctgctataggtgggaggaagcttctgatcccccaagcatccagctccagtatcctaaggtgcgttagttgcgccaagtcatctgcgcgtctcggttttcgttgtacataggtaggctccggaggctttattattagtccatctgttccacgtcgctggtagtgacaaatttgtgaacgagaagctctatcatccgcccatc

SEQ ID NO: 25382 - DNA, 1005 bp, Triticum aestivum
  unsure (1)..(1005): unsure at all n locations
  Clone ID: PAT_TA_25382
ctcgagcggccgcccgggcaggtactgattctacctctggttcaactgagaataagaagggagattacatgagttcctcctcccgttcagttgcgcgggggcgccttgccgtctggatgtcggccaccgatactacctgggtaactcttgcattttgggacgacttggctgttattgcctctacacatgtaaagcagaggggctgtgggtttgtttctggacggcttgtatcagatactgttgaggaggggccttataagcggcaggtttactacaaggttgtcgttcaacagttcaacttcattgagtccttccaacctgtgcggttatattcagagtcaagccaggatggtggaaagcatggagattatgttggtaatgattctacctctggttcaactgagaataaaaagggagattacatgagttcctcctctcgttcaactgaagcactgtggcaagcattcttcgctaatcctcttgactggtgggataacaggaaagataagaagaacccaaggtatccagacttcaagcacaagagcaccggcgaagcgctgtgggttgaggggaggaacaaccccaactgggtcgtctcccagctggcgatcttggactcgaggatgggttccctgcaggacaagcagaggaaaccagtctcctacatgtacgccgacgacttcatgacatctgacgccagccgctaggctctgccatggggggggcgtcgctgccccccccccttgcgccccgcgcctgcatcggctcatgtactagaatggcgcgttcagtgccgccggggcagcgggccctcgcggggctgtcctgtgctgaggtaggctccggnagctttattattagtccatgtgttctacgtcggtgggtaagtgacaaattgttgaacaatgactanngtacgaggaagctcngatngttcccgcacaatcaaggttgatngcgnttccangcanntaaggangtccccgntccantcanttgntncgt

SEQ ID NO: 25383 - DNA, 626 bp, Triticum aestivum
  unsure (1)..(626): unsure at all n locations
  Clone ID: PAT_TA_25383
ggagccanactctgccctgacagaaaacaagaatgttttctcatgggcaggggtgccacgtggacagcttggtcatggtgaaataatcgacaggaacacacccaagatgatcgatgccctgacccgggacgggactgcttgcaagcagctggagtcatcaaacgctgttccaatgacagctaaagtctgggtccctccttcgaagcgattcgccatcgtccctgaggagaatgtcagtaaaccaggcaatggaaccgacaagcacgcgcctgaaggcgatgccaagaggatgcgcgtctgagcatatgtccttcttccaccttccttggccacctatcagtaattcagtatacaaataagcttacttgcttggacaactttctccttcaccatctaatagtatacatggtgcccagttttagtgcattgtcttcatcctgaagtaatgatgtatttaatgatgtgctatagactctagcggtttcaaaaggtattgaccaaggtgggcagccgcttgttaaattttcaagttagagggaactcccggtactagtaatttgtcaagagcgtaataaaataatcagttttgttaattctcacatgactcagaattaaccaagtctaaa

SEQ ID NO: 25384 - DNA, 1220 bp, Triticum aestivum
  unsure (1)..(1220): unsure at all n locations
  Clone ID: PAT_TA_25384
aagcgcaacacaccaccgcccggatcttctcccctctcgctccccgtttcgcccgagctcagcgagcgccaggaccagccgccagagaccctttctcctcttcgtttccgcggcgcgccagatctcgcgccccttctccggcggccggcgcgggcagccaatctttagtttcttctccttcctttgctatatttttgtgccaatacctagttgacggtaggatgagtttgtcttccatagcaagacgactatgttgttcaagacagtcatccacaagtcgactttcagtagttttggctcgtctgcacagcaccgaggctgcaaaagacactggtgctaagaggtacaaatatcctgaagtctatgacccatatgggcctatgccaccagcatcagagaaagttgtgggtctagcggaccgcattgccgctcttcctcctgaggagatcaagcagatagctccagctctccttctcagactgaaccagccagcaccacaggcaatttctggccagggttttagtatgggttctcaaggtggtgcaggggctggcgccgcaaagtctgaagagaaaaaggctgagaagctagtattcgatgtcaagttggagaaatttgaggctgctgcaaagatcaagattatcaaggagatcagaacatttaccgatctggggctgaaggatgcgaaggagttggtggagaaggcccctgttattctgaagcagtcactcacgaaggaggaagcggaagcaatcatcgcaaagatcaaggcagctggtggtgttgctgtgatggagtgaaggatcaaattctgaacactgcaatccttatttctttcttctgattttgttagcatgatggagcattccaggtctgaggatctctatacttttggaggaaatggtttacttgtgacaggtaacgaaagcgagatgcgaactagatatttagttgctacgttggcgttctagaataagactttctttcagtatcgcatatctttcctgatggaacactgttgttggcgttctagaataagactttctttcagtatcacatatctctttcctgacggaacactgttgatactggaactgggtgaaagaaatgtcgacgccgttttttatgaatgtgatgctgatgcctcgtgtctggctcgcctcggtgtattgtgaatcattttggattttgctacagnatcaaatgccaaatttttagca

SEQ ID NO: 25385 - DNA, 915 bp, Triticum aestivum
  Clone ID: PAT_TA_25385
ccccgcgtccgctgggtcgactgcaccgcggcgggtgagcgtgtcggagccgacccggatcttctcttctcgcagggaggaagaggcggagggtggaagcttctagaaccagccggccgcggatgggagacgccgcctccgccgcgcagcctccgcccgcggcgtcgcccgccttctcctacctggccgtgttcggcaactgcccgctcatcgccgccgtgctggccttcgccatcgcccagtccatcaaggtcttcaccacatggtacaaggagaaccggtgggacgcgaagcagctggtggggtccggggggatgccgtcttcgcactcggccaccgtcaccgcgctcgcagtcgccatcggcctacaggaagggttcagctgctcgctcttcgccaccgctgccatcttcgcctctgtggtgatgtatgatgcttttggtgttaggctacatgcagggaggcaagcagaggtcttgaatcaaattgtatacgagctaccatcagagcatccacttgctgaaacaagaccgttgcgagagctcataggacacacgcctcctcaggtttttgctggcgcggtgcttggatttgcagtagccacatttacggggatgatggctgggcttggtaacagtggttgattctcttgaccggtggatgcacggtctccatagcttcagcattacttgcattgaagtgttagaatacatacaaattgggtttatggtttcagaaggccagcttgttctaggtaatgctttttgtataggtgtgtttactttgctgcaattcagcgtctcgagaaagagagaaattgtcccttcttttgtaactaactggtaaataaccattttgctatattctgatgttgttgatgtgaaatttggtagctataaagcataccatttaact

SEQ ID NO: 25386 - DNA, 1068 bp, Triticum aestivum
  unsure (1)..(1068): unsure at all n locations
  Clone ID: PAT_TA_25386
agcagaagcgaagcgcgcgcgggaggacacgaggagcggcgctgggaagcacagcaggcctcgacgccgcagggtcgagagtagcgggcagcggcggcgggaagcaggcctcgacggcggcgcaggggttgagagtaagcaacagcgatctgtcccacttggtgaaatgccttgttactacaacgttgatgacatcctcatggaggaggagcttatttcggttgttttccaagtaactgcaaatggtgttggaatgctagatcctggcgccgagagaaacagtgttgaaaagggtgccaaggtagaccttccattttggcttgctcatgggatgctgtctctggaacaagcggtgtcgataaacgtacctccttgcttcacccagaaaactcggaaggagatccaagctgatgcagccgtgtgttgatttgagggttcggtgcccttacttttatgagctaggatgcaagattgttcctctggtgggtgacaagagcatcggccagttcttgcgctacgcgttcaccagcaggtacaaggaggtactaagcaaggcacacagctcttcgacgatgacagtgcccaagttcgcaacacgacttacaaaagaggaggctcaagtgtttgaatctgctagggagtcgatatccgccttcaggaagtggcgcgtcgggggtgcgagactgcagaaggcgtccattcttggaaggaagaggaagacaaaggtgccggaggggccttcgacgccctgaacggtctaccgcgtagcagcggagtcggagtccctgggcaggcgaaaggcagttttgatctgcgatcagaacgtcggcgcacctgatatgtttctttgaatactcgtaccttcaatgtgtcagttggcctgaactcccatttctggtcttggatgttcgtgtcctgctttcgccatctcacctggtgcctctcctggtttagcacacgcgaaagaaatcaatccctgcaacttaagcagctagacgctgacttgtgaatnctnctgttgtgcttgcatgaaggagatccgttcccatcagttatgcaaaaaaaaaa

SEQ ID NO: 25387 - DNA, 586 bp, Triticum aestivum
  unsure (1)..(586): unsure at all n locations
  Clone ID: PAT_TA_25387
tcgagccactatagggcgaattgggtaccgggccccccctcgagttttttttttttttttttttagttgacatattgtataatattatgcgtccgtgcatatacatagccaccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactcttttttgacctcctccacctcgttgatcacctgtgtggcgtcggtgcacccgaacataggcagcttccacattgtccaagtaccggccatcataagtacccaaggagatgcgttgtgctcacgggaagatgaacccaaccttgctgaaccgaggcaaggnaaccacttggngggggtcagataa

SEQ ID NO: 25388 - DNA, 667 bp, Triticum aestivum
  unsure (1)..(667): unsure at all n locations
  Clone ID: PAT_TA_25388
gctcccctttgggccgaattgggacccggccccccccccacgacttactttggccccccttttttttgtgctcttttttttttttaagagcacaatatatgatcaatatatcaaaagtatacatggtacatggtacaacatactcgtttatcttctcaaagggagcgaaggaacaaccaaacatcgatactacactggccggccatgcagagttggctccacgtacgtagtcctctctctcacatggagatcagatcagagcatttattcatgtatatgcagtaaatcggtaacctcaaagtactcaagtatcgatcggtggagctataatctgcgatgctggcggcaagcaatcgatcactagaccttactgcagtccacatttgaagctgatcttgtaagggacgctgacgcggcacttgggcggggatctctgcggccttgccttctttgaccccaccggcacgcactcttgatgcacaggcacgccagctttccttgtcatgcgggggtcggggctgtgccccggcaatctccctgacgccgcctgcaccaagcccccaaacgggcctggcgccggggccggcccccttngccgccgcgcggggacaaaanggnaaggggncaagggggggnggttcaactnggcncnaggagattngcccng

SEQ ID NO: 25389 - DNA, 561 bp, Triticum aestivum
  unsure (1)..(561): unsure at all n locations
  Clone ID: PAT_TA_25389
cggncgcgtgggttccgagctgctagcgctacagtccccatcaacagttcaggcttacagtacagctagttgcagtaccacgcgagtacaccaccaagccaacgcccaacagagaggtagtcgtgccactgggtctgggaggatggcttcgatcgtgctgctgctgtcggagctgctcggcggcgcggggagcaccagcatgctggaggccagctgctacatgggcggccacagcctgcgggagttccggcccgcggcggcggccacgggcgaccgggcgccgccggagccgaagctgtccacgaaggccaaggatgaggagccgtcgtcgttggacctggaggatctctccaccgtgtccaggatatcggtggacgtgatgtggccctgagcctgccgccagctcccgctgactcgggaggtccattcgcctcgaggttgctctgtgtttttgttgccgacgacgaagaagagacgtcatgtgattcctcgttgcctcgagttctatgaaatggagatgtaaatatgcaaagccaccgctgaatgtactccttttgttcc

SEQ ID NO: 25390 - DNA, 644 bp, Triticum aestivum
  unsure (1)..(644): unsure at all n locations
  Clone ID: PAT_TA_25390
cgacagcgtgggtttccaggctgctagcgcaccgttccccagcaccagtccaggcttacagctagttgcagtactacacgagtacaccaccaagccaacgcccaacagagaggtagtggtgccattgggaggatggcttcgatcgtgctgctgctgtcggagctgctcggcggcgcggggagcaccagcatgctggaggccaactgctacatgggcggccacagcctgcgggaattccggcccgcggcggccacgggcgagcgggcgcccacggagccgaagctgcggggaacaacctcaacggcggcgaaggatgaggagccgtcgtcgttggacctggaggatctctccgccgtgtccaggatatcggtggacgtgatgtggccctgagccttccgctgactcaggaggtcgattcgcctcgaggttgttctgtgttttgctgccgaggacgaagaacatgtgtcatgtgattcctcgttgcctcgagttctatgaaatgaacatgtaaatatacaaagccagcgctgaatgttctccctgtgttccttttcatccatctgacctttcccataaataacccaaacaagttagcacaggattaacacaaaaaaaaacaacgaatcntgcataaaaaaaaaaaa

SEQ ID NO: 25391 - DNA, 890 bp, Triticum aestivum
  unsure (1)..(890): unsure at all n locations
  Clone ID: PAT_TA_25391
tcatcctctacaacgtcgtgttcaaggtgctgcgcaagcggcggcgctggagcgagacggaggcgctctgggacgtgatgctgcgggacggcgtgcagccggacaacaccaccttctcgaccgtcatcagctgcgcgcgcgcctgcggcccgcccggcaaggccgtggagtggttcgagaagatgccggagtcagggtgctcgccggacatgctcacctactcggtcgtgatcgacgcatacggccgagccggggacgccgagatggcactccgcttatacgaccgtgcccggtctgagagatgccagctcgaccctcgcgggggcgcctcggggaccgacccccactccaccagcggcaacttcgacggcgcgctcaacgtgtttgaggaaatgaaggccgtcggcgtcaagccaaacctggtcgtgtacaacaccgtgctggacgccatgggccgtgccatgcggccgtgggtagtgaagaccatccacagagagatggtcagccagaaggtgcagcccaacagggcaacctactgttgtctcctgcaggcgtacaccagggcacgctacggtgaggacgcgatgatcgtgtaccggaagatgaaggacgaggtgatggacatcgacgtggtgctgtacaacatgctcctgtcaatgtgcgccgacatcggctacgtccgacgagggcgagggatatnttcanaagacatgaagtcntccatgggacaacaantgnaagcctgataactgggncctaactcatcaatgggttgacaccnatattcctgnnactggcaattgttccctgggtgcaaaagggccatactgaaaggagaattggcaagngggnaagtttcaaagcccaaacaatcttcaacccncacggtt

SEQ ID NO: 25392 - DNA, 597 bp, Triticum aestivum
  unsure (1)..(597): unsure at all n locations
  Clone ID: PAT_TA_25392
gcgcgcgctttggggcgggcccccccccgggccccccctcgtgtttttttttttttttttttttttttttttttttttttttttttttttgggcaaagatgtttctcattattaattacccgaatacatagtcnacagattgtanaaatatattatgtgcatgtgcataaacatagccaccgattgcattcacatacgagcatgctttctcgacccatgttggtacatgaacgtggacatacacatattcttaggaacaaacaangaaagataaatggggaaggaaaacccaaagcaatgtcagagttgacaaaacgcgcaatggcactttatatgtggcccgtggtgagtgagctgtttaggccttgccgganctccccccagcccgggtggctttgaaggcgattaagccttgacccaccgcaccccggcggcatgtttggtncgaatcccgattttgcggncgtacgcgtcagggtacnccgtccttgncctccnccccctcgnttgatcacctgtnttncntccggtgcacccgaaaaaagggncgcttccaacantggtccnnttnccggggcatcntntnacccaaggggg

SEQ ID NO: 25393 - DNA, 1062 bp, Triticum aestivum
  Clone ID: PAT_TA_25393
tccctgcagcgcacgccggcgatgggcaaggggaagcagcgcgtccgcgcccgcggcgacggcgccggaggagagcctgccggggaaggcgaagctgccgtcgccggaggcggcggcgctgccggcgggggccacaccccctccaccgtcttcgtctccaacctgccgtacacctacaagtcctccgatctcgagacggtgttcagcgaggtcgggccggtgaggcgctgcttcatggtcgcgtcgaaagggtccgagacgagtaaaggatttgggtttgtacaatttgccactgttcaggatgctgagcgagctattcaacaaaagaatggttttgctgttgctggtaggaaaatcagagttaagctcgcaatacaacgtgctccgcggaagcgtgggctgcaaaagaaagagaggtgcatgttgacgactccaatgcaaaagatgaagaagatgataattctactcctgttcctgtaaaacataaggagcccttgcataaagctgatacaggaccaccacagttaccggccaaggataccaaagtagcaaaggaagttagcattaatgctactgataaagcaaaaagttctgaaaagcaaaggattgccaaaaccgttatatttggtggtcttcaagacttctctatggctagtgaagttttccgtctggcaggagagattggcacagtagtgtctgtaaattatccacttccaaaagaggaaatggagctccatgggcttgcacgcgatgggtgcacatcggatgcggcagcagtactcttttcaagtgtgaaatcagcttgggaggctgttgttctcttgcatcacaaggagatcaaaggagcaattgtttgggctcgtcaacttggtggggagggttcaaagatcaggaaatggagagtgatagtcaggaaccttccattcaaggttactataaaggagatcatggacatatttagctgtgaaggatttgtctgggatgtctccattccacaaaaatctgatgatgggaaatcaaaaggatttgcttttctgtctttcacacgcaaacaggatgcag

SEQ ID NO: 25394 - DNA, 607 bp, Triticum aestivum
  Clone ID: PAT_TA_25394
gttaccagttccttccgtctcctcccattcattaaggcgagagcccctcgctcgctcgtccaggaaaggaggacaaagggagcgcgggcggttcgttgagatctcggtctcgccatgccgaggacaaggaggctgcgcggcgggttccggctcggccggaagctgctgaccgcatggcggtgggcgctctgcggccggaaccggcgccggggcggcggtggctacctccgcctcgacacgccgtgcccgatggagggcagggaggccaagaagctggcaccggtgctgcggtggggcaagtcgctggcgcggctcctcagcctcggccgggcggaccgcgggcagcagacgctcgaggcggtgaagacccccaagggcaggtggcggtgtacgtcggcggcggcgggcccggggagccgctgcggtacgtggtgcccgtggtgtacttcaaccaccccatgttcggggagctgctgcgggaggccgaggaggcgttcggcttccagcaccccggcggcatcaccatcccctgcgccgccgccaagttcgagcgcgccgccgccgtggccgccgccggcaagaaggggttcgccaggtggtagcatcg

SEQ ID NO: 25395 - DNA, 866 bp, Triticum aestivum
  unsure (1)..(866): unsure at all n locations
  Clone ID: PAT_TA_25395
cggncactcctaaagcgaggcactctacttaccaaagctactctgcccgcccccaccaccttgtcgatcggcgagcgccatgggcaactgcctgaacaaggcgtctacgcagcagcagcgcgagatgcggcggcggcacggccacggcgagcgggtggcgccggaggagagggaggaggaggaggagcagctcaggagcatcggccaggtgctgctgcaggaggaagaggaggaggaggaggaggcgccggcgtccgcgtcgccggcggccgggatgaaggtgaaggtggtcctgacgagggcggagctggagtggctcatggcgcagctcaagagcggcgagcagcgcctcgaggacgtcctccgccagatgggcaacgcccgcgccgacgactacaagccgccgcgcgccgacgcctggcgcccgcgcctcgagtgcatcctcgagtgccccgaggccgccgacgccacctagctcctcaacgtacacacggcgcccgtccgtccgctctcgatcgatctcccctccccggtcaccgcgcgcgatcagagcttgatctcctccatgagctagtagctttcttgcttagatccgtccgtctctgtgcatggtccatggtgtgatccatggagaggcttcttgtttttctgtttctctccaaaggatccatgaagtggtgcttgagttaggatgaacaccaactgtactatgtagcctgttagagcagtagtagcttttgatttctcactggtgatgtactcgtatctgggttttgctccgtccgcttgctttggttttgccttccgggtgttgtttgtaaaaagatgtggccattcggtggcgcaatccaccctttttaaaaaaa

SEQ ID NO: 25396 - DNA, 643 bp, Triticum aestivum
  unsure (1)..(643): unsure at all n locations
  Clone ID: PAT_TA_25396
cgacccactatagggcgaattgggtaccgggccccccctcgagttttttttttttttttttatttaactgacgaaactgaagaaaaacagctactgtcgaaactgaacttttcgacacctaaaaccctgctcaacctgaagtttaagcagcaacatagtccacatgtacataattgttatgtacatataccaaccacaatcaggctaccgtacacagggcgtcgaaaacgaccaacgtctcttctcgtctttcaaggaacgtggaatcaattgtggtttgaaaggaccgacgcataaaccttcttcaaggatgaacacactttggagatgtctgattccgtgtgaccagctgatacgaacaggcggatcccaaccgggagcttgcacctggccaaaggtggccttttgggtgggaccacgaaaactggatcttccttcaaagcctgcccggcaatgggttcaagaagatccagggccgtggcccgagggacccggccctattttccgcgcgtgggggggacaatnaggggcaanacaatgggtaaaaaaccggaagcccccggggtcctggcaagncctttatgcnaaaaaaggnaaaatggncccttaanttgggcaaaaactgganggntcnccttccagg

SEQ ID NO: 25397 - DNA, 803 bp, Triticum aestivum
  Clone ID: PAT_TA_25397
ctatatcagtctgttccaattgggtatgataaggaaaaccatgtcaagaagtcattgggaagcctaagtgagatcaagacacttggaattactggcagtttcatgaagtatctatcaaaagggtgcatactcacgaagctcccagttgtgtttactcgccttgaggatatttatcttacgatatgcttttgggaccagaggcaagtcttgaccgcttattcattgtttcagaatgctcctaacttaaagaagcttgccgtgtggagtcaatctttgagcacatgggatcaggatcaggcgagcattccagagcttaccatgcaagtgcaattggatcatctcgtaacagccagtgtgaaaggtttcaggggtgtggactgtgaagttggtttcgtggagaagctactgaactgggcaccggctctggaagaagtgaagatagaatggcagtgcaaaacagagtgcagcatggttcttgccaagctattagctctgccgagggtgtctcccagggccaaggtcattgttacattttgataagcatgcatccctacagtctacagagcatcccccatcacttgccggtttaatttgcagccaactagaactgtttcatctttcttgatgccaagactagatgatggttatatatgtgtgcattgacgcaaatcatcaggcagggggagtacttaatgtgccagtattagcaagtgttatcctttgttgagccggggacacaagccgctgttgcccgtgctcaaccgtgtcagctcagcccgtcctgttgttctgcgtaaagtaaa

SEQ ID NO: 25398 - DNA, 571 bp, Triticum aestivum
  unsure (1)..(571): unsure at all n locations
  Clone ID: PAT_TA_25398
taatacacccactagtagggcgaattgggtaccgggccccccctttttttttttttttttttttttttttttttttttttttttttttgataaagcatcataagggcacttttcggccttttggtcttttccattccgtcaagtggcctcgcggctcttatctagcggagatatataacaaaacatcgtagcgtcattccatgctttctctttccaaaggtataataaataatccatcattacatccaccaacttttcgaacaaaatcttatagtcgaaacgtttagatggcaagaatcctgcttggcgaaagtgcgggcaagagcctcgaaggagtcgacgacgtccttgaaggtctgcttctgctcaagacgcgatctcaagagacctcggttgggcggtaaggggtcctccgtcccttgtttgcccaactgggattccccggggggtggagcgcgctcggaacgttcgggcccgtcaacgcccgtgggtctggccccgtggggctgccacgggggctgggttaacccacnggnagctgggttgaccngaggggcaaagaagcctccga

SEQ ID NO: 25399 - DNA, 809 bp, Triticum aestivum
  unsure (1)..(809): unsure at all n locations
  Clone ID: PAT_TA_25399
atacgagccactatagggcgaattgggtaccgggcccccccttttttttgaattgtgatcctatgctttattaatggcgcatcttaaatatatatggaacatacacaactatctcaacgaaggtaacacacccatgagagttgtgtaacaaatagtacaacaatacattcaaagatagttatttagctggttggatgaaactcaattctcacgccagatacttgagcacaccaggaaagtgaaccatgtagaaatagtcgtcccagtcgattttcttgggatcgaaatcaaagtagtattctccctccatcactattttgctccatggccttcctcaagcttctcaaggttcatgtcatcaaagcgccctttgaataaggtgtaaggcgcataagagctcgatcagatgcatggccaatctgtattttccactgagctcgttgtagcgccctgagaaaacaccnacataagccctaacgtttaccaagatgaagggtcccaaagagggagcttggtacctggatgaccatgtgcacgcggagccttgcaaccgtgctaaagaagcgcatcttgttcagccggatgggctcgccgttttcccctcgcggcgggttgtccacgaagtagcggtgggccgactcccggagagtcatgtaggaggccgggttgctcatggatgatgtcacatggtagatggtctgtgcttgttcccctgagtgcgctagcatggccaccatcatagtgtttaccaccatgtcccccggaatcacgtccattatggtattggggtctactagaaagaattcaag

SEQ ID NO: 25400 - DNA, 886 bp, Triticum aestivum
  Clone ID: PAT_TA_25400
acagtgcggcgattccaccgatccccttcgccggcggggggcgattaggtgtcggcttgctgatgggaacacggatctgtccacagagagaggctgtagatatagaagagatcatgaggctgaacatcctgtccaaagaggttacctttcgccattggcatgcatgttgatgcgccatgcatctcctttcatcatgatggtctgcaaccaggtcttcgccaccggagctgttcagtatcgcctactcttggtcagtttatataactacgtagcaatttactatcttgaggcaaattattgtgtattaaattttgatttcggtccaaaatttagtagttttgatcatagctaaactacaagtttaatactgacattacaaatttttatttcgttccaaaaatttagttcctccacgtcagtagtagattgtgttctgctctaaattgattgtaatagaccaattttgttgaagataataagctatttggagttataagtgtgttatatagatcatgaaatccatgcttaggttctttcatgtgcagattacatttgctggacatatagatagccaattactggttttaggactatgtaatagattcgtacattgcacccatgtcatttcactagctggtaagttgtgagaaaagaagctaaaaagctaatggtcatggtgttcagtgttatagactacaagtatgcatgctagaaaacaaattcagaactggcaaaaagcagaattgagttcttcccgaaaacaatggctatatataaatatgatagtgatttttttggtgactatttcggaaaagaaaacttagtgtaactaataatattctctagcgaaagagcacattaaatatacatggactcaagcaaggca

SEQ ID NO: 25401 - DNA, 1046 bp, Triticum aestivum
  unsure (1)..(1046): unsure at all n locations
  Clone ID: PAT_TA_25401
gcaagctggtcatagaatatgggacacatttcttgaagaattcaaaagccttgcaggtagagagaattaataggccaaagaaagagcaccttcaattgcttggtggaataggtctgagatgcgtagagaggcctgtttatggtagaaacattatatagcttctgaccataagacattctatgtgtgatgtttttgaaaagaagaacaacccttcatgctacatggatttttcatcgagtctagcagatcttgttctttcatctgtggaacgcttaaataaaatgcttggctttattgaatcatttacttttgcaattcctgctgcacgggctgctacttctatttgctggtgcaaaaaaaagaattcacctgttattcttggaccagcttacagcagcacaatgtatgaatgagttctcgcccattctctcccctataaggcctgcaattgttcgccgtcaagtgtacttcccggacaggcgcttgatccagtttgactgtgggaagttgcaggagcttgctgtcttgctgagacgtttgaagtcagaaggacacagagccttgatatttactcagatgaccaagatgcttgatactttggaggaattcattaatttgtatggctatacatatttgaggttagatggttctacccagccagaagagaggcagacactaatgcagaggttcaatacaaacccgaagttttttcttttcattttatccactcgcagtggcggtgtgggagtcaacctagtannggcagacactgttatattctatgacagtgactggaaccctgcaatggatcaacaagcccaagacagatgccacaggataggacaaacacgtgaagttaacatctataggctaattagtgagagcactatagaggagaatattctcaagaaagcaaatcagaagcgaacacttgatgatttagtgatacaacgcggttgttacaatacagagttcttcaagaagctannccctatggaatttttttctgggcacacagctcttaatgtcgaannacagccgnnnnn

SEQ ID NO: 25402 - DNA, 1163 bp, Triticum aestivum
  Clone ID: PAT_TA_25402
tcctgagctactcatggaagacagtagcgcatggctgtcgaggatcaaggggctccatttcccactccctgacgagagccagttgaaagccaggcaaattcagtcagatgagatgcttgctcttaagcttcaagagcagttcaaccaggaacagccccacgcgtccgcttcccagcaggttgatacgactctagcttggacactgcaagaggaagatgctgcgcgtgcaagaattgctgcaagagagggccaatctagttctagccagagggaccgctcaatggcacacttgtattcatacggctggcgctcgcaagttcaaggttctacttcatggccacctagtcacacatcagctccaataacaagcagacggtggttgccaagaaacagcggcccaggatcagagcaacaaaatatgattatctctcaactgaccaaagggtgttttggacaagaaaacatggatttagaaatgagaatggctgtgctggactcactccaagaagcacttgaaagctgtccagacacctatcctacagattcagatgatgatgactatgagaacctgatagcgcttgatgacaacaaccatcacagaggagcttctgacagtgaaattgacagcttgccactatctgttgctgagggagaaagctgccgggacgagccctgccctatatgcctggactgccctgctgatggtgcttccctccggcatctgccctgtgcacacaaattccataaagagtgcatcaacaggtggcttcggatgaggacctcgtgcccggtgtgcaaatctgctgtattttgacagggcgccgccataccaactgcagcacctgttggaatatatagcatgaaaaatagattaggagccatttcgacactcctggcgccgatgtgcgtaaacaactttgtagtgttgcgttacacaatgctggccggctctctctgagcagtgagcagagggtgtttgagtgatgcggagcctctctctctatctatctcttctgttgcctgcgagaaacagggcatcgcaaatattgtattcctttttgctgcaatttttgtgcaggggagatgtgtgatatagcctgatttccatgtcgtgtgggccctgtcctgtagtagtcaaggggatgaaaggtttattctgctgc

SEQ ID NO: 25403 - DNA, 755 bp, Triticum aestivum
  Clone ID: PAT_TA_25403
tcggcacgaggagatgacgctccttggttggatgcaccggaagctgcgaagtaataacgacgtgttcaaagagttcaacaccgccggaggtggggcctgcaactgcatcgctggactagcctcaccggacgatgagtactacggtgatgatgctttcgtcgccaacaatccttcaccgtcggtcaacgccgacgacctcttcaccttcggcggaagtggcctcctcaccattggcacgctaggcttcgccgccgttaatgttcctggagaacacgtgggcgatggagactatgacgtcgatgatgaagactgcgtcgacattgaccttgacaacatcgatggcaccatcggggaagttgacaatggcaatgttgatgatggtgccgccacacctaccttcaccttcccccagcttgagtccaccaccgcggagaaggtgatggtcagcgtcgaggcgatcgcggaaaaagatgacgtcgccaccacggaggacgaactcatgctggtgagcgctgagttggagaaggttctcgggggcagcaacgtgccgtcggcacgggtaagcttcgccatgggcatcgattgcccactgcagggcttcctacttggttccccagtgtgcagcgacactgaatcatggccagagaagccaaacgggtggtgggcgtcgtgcctcgcccggtgaactgttcatgcgtacacgcttcacggaagagaagggggccctagttgccgtccaggagagcgaggatggt

SEQ ID NO: 25404 - DNA, 1086 bp, Triticum aestivum
  Clone ID: PAT_TA_25404
gaaagaacagccgcggtcgtcgccgtcgtcgtcctccccttcctcctggtggtgcccgcgagctccaagcccttggccggtcgcgggtagggtggcgagtgagatggttcgatctccgtccggagcggcggccgtcgccgtgctcctcctgtgcctctccggcctctgccgcggcgccgagcggctcggggcgagggagtgcgaggagctggggttcaccggcctcgccctctgctccgactgcaacgcgctcgccgagttcgtcaaggaccgacgagttagtggatgactgtcgtaaatgttgcacggaggattcagatgattctatcagcaagcttgtatactccggggcaacttatcgaagtatgcatgagaaagctggtgttttatcctgaagttgttggcttctttgaagaggataaagataacttcccatacgtagaatctcggtatgcttatggctctccgccaaagctcataatgcttgacgacaagggatgcttaaggagactataaggattgacaactgaaagtgtaagcatattcggcaatttcacacagagaaggagaagccggcgaaatcagagacctgagtacacacggcaagttcctatccctgtagaaccatatatcgatatttgtatttccgtgcttatgcacacaaaaccccggtcatccttgatctctttccctaaagaaaggattacatgtgtatacttcaactattttaacaggacaacctgtcatgtacggagtgcatttgattagttgttgcagacaggcttgtggatctgttatatgtgcatttagttttggttgtttggagacaggctgctggatctgttatctacaaaaaaaaaaaaaaagtataaaaaactactaccgactccaaaaccatataataggactttctcgcgcgagtagtaagcaagacatagttgaactttggggcccgtgagcaatctgtattaccttgacggtgcctgagtttgtttctgaacgatttggctagttacgaagttgatggaactagacgattctcttggaacaagatgcaaaatgatctcgtgccgaattcggcacgag

SEQ ID NO: 25405 - DNA, 721 bp, Triticum aestivum
  unsure (1)..(721): unsure at all n locations
  Clone ID: PAT_TA_25405
aancaaaaatattacggcatatgaatgggctgatgctttagaagcctctattgctgctgttagcaaatatggtggtgccagagcaggatatcgcacaatgttgtggaatcctgtatgacatactctgcaaggctgcatatgcaagcttaaaacaaaacatccggtgactgcatttatcgcttctgctgaagcagcagcagctggtgctgaatccactaaacaaatgcaagcaaaggcaggacggtcatcgtacatttctcccgaccatctggtctcaattcctgacccaggagcaatggctgcagctgcatggtaccgagccgcagcgctttcggtgaagaacaagctgcatgcttcagaaagctagtagtagtgcatgctatgcatgcctccttcacagtccaaaatactatactgacggcgaaatcctcaggggcctttgtcaatccctctgatttgatttccgcttgtgctttgcatgggccgagaaatcgagttccgtattgttttgtgctgagagcagttcaaaggatttgtagacgtttacaaaggttgagtgaaactatgcttttgccttactggtgaagtgatgatgatctgtgtgtgtgcgcgcgccgtgtggtcaattgtgttgatactaacgattgttgtctatttttacctgaacggcctgaatcacatcagttctttcatcgcgtaatacaaaagtcccaaaaaaaaa

SEQ ID NO: 25406 - DNA, 705 bp, Triticum aestivum
  Clone ID: PAT_TA_25406
gcgtgcggcggcccgcgcggctcctccccggccctgcgccgccgctgcccgccccggcccttgctcgcctcccacccgcggcgcacttcggtacccaggttgcacggggcgcgccgctgctcgatcgcggtggtggtcgtgatctgccttgttcgtgatggcgttcgggtggtcgtgggggccactggggtggacggtgccgagcgagatcttcgcgctggagacgcggtcggcggggcagagcatcacggtggccgtcaacctcttcttcaccttcgtcatcgcgcaggcgttcctgtccatgctctgcgccttcaagttcggcatcttcctcttcttcgccgcctggatcacggtcatgaccgtgttcgtctacgtcttcctgccggagaccaagggcgtgcccatcgaggagatggtgctgctgtggaggaagcactggttctggaagaaggtgatgccggacatgccgctcgaggacggctggggagaagggggcggcgagcgtgctgacaacaagggtcactagtgactagtgagtgaagatcatttggaatgagttgttgtgcattgttggttggttagatcctgtaagacacagtttaacatgtaggcagaatgctttgtatatgcaccgatgcagcctatgtttatgttatgacttgtacgtactatagtgcgcttgttgtgagtctcatagagaac

SEQ ID NO: 25407 - DNA, 723 bp, Triticum aestivum
  Clone ID: PAT_TA_25407
tcgacccacgcgtccgcaaaaaaaaaaatctctctgctggctcccccccaaatccccagccccagccggacccgccgctgtcctgtcaacctcgccggcggcgcgatggattcgtcgttggggagccacgtcacggtcatccccgattgggtgggcgacttgggcgagtccgtcggccccgtcgactacggctgcgtgcgccggtgccgtcaccgccgcctcgccacctacctctggctccacggcttccgcgacgccctgcgagggctgctcaacgagacggacgcgtacatgagcgtcatccacctgtcgcggctggtgcggcagggcctgtgggacgacgccatcgcctacgtctcccgcttcctgcgcccgacctcgcacccgcagagcgacgaggcacaggtgctcctccacttcctcaagcaccacgccgccttcgccagcatggtcgccggcgtgcccgaccgcaacctcacctacttcaaccgcaagtacaacacacggtacctcaagcacgacgactccgtctcccacgacgccctccggatccgctccatcgtcctctccattctccactcggaacaagtcaggtcctccctggactgggagcgcgttcgttgcaaggcgtctcaaatcgtccaacacttggcttataaggctccagagttgaaaaacgtggccctattgccgggcggcccgatgatgccccacgatgtgctt

SEQ ID NO: 25408 - DNA, 1253 bp, Triticum aestivum
  unsure (1)..(1253): unsure at all n locations
  Clone ID: PAT_TA_25408
tcgtcccccgcgtccgtgcagcgcttctacacttctgccctggaggggggtggtaatgcatgaagacccttaagcccccgctgacaggaagatctttcattggcacaaaaggggtaccatggaaacaaaataaacatctgagcatttaaccctggaagcagtttgtagagccatccatccgaggggttccagctggagacatcagcaagaaggggaccagagtggattatcacttgctgaacggtactctggaaaccaactgtcgcagacggcatccatcctctcaagtaagctccctctccggcgcatacttgaatgatcaacgtcttgtcgggttatggatctattttcaaatttgacaagtattacactcagcaacctgcacttgacagtcgtcgtttcaccgcttgcttaccaacaagttctgttgcttggtttgtgggcattgccagaactgaccttcctatttggtcttgatctgcatcaggactcatgggactatgtgtggcaatgttggccaactggccaagccgtgcatcccgccctgctgcatgctgccgctcctccacgcgagccgtcggtgctgtgtgtctggctcacaatataagacatccggactctatccttggtggtcggtgcagcgctagccaactttgtcttgctgatctacggctaaataattatgttgaagcttgctgcctgctgtggtcatgcaactatttccagtcccaatgctgtgcggtggatgttcatgcacacaataaccaggcagtagcattttccaaagaaggcgtcatcagggctctatgttagtgaatcagaggacatattcatccaagaaagtttctgaacctggcgtgaaaacagtatagcatctaaaagaacccgaagaaaccacggcatgcaaagccgtgttttgctctcttgaatcaactacgcttcctgacatagagcggcagacacgtctgtgcgggtctccaggacccgagctaaggtagagtgggcatttgaagcacaagaaaagatccagacaggattgtaatgcatgaagacccttaagccctcgctgacgggaagatctttcattggcacaaaagggtaccatggaacagaataaacatgtgagcatttaacccttcaccgcaaagatgaaagcagtttgaagagccatcaggttcactggcatcaagagggttccagnncaaggattgancanttttacganctganaacgntcnggctgganaccgatg

SEQ ID NO: 25409 - DNA, 569 bp, Triticum aestivum
  unsure (1)..(569): unsure at all n locations
  Clone ID: PAT_TA_25409
taatacgacccactatagggcgaattgggtaccgggccccccctcgagttttttttttttttttgacgaaactgaacctttgtttatatgcaacactcgatgcagctgcgcgcgagtcgtcgccgagctgcctgcgccgagctgcctgcgcctgtgacgcagttgggccaaatgcgtcacacggacgcggtcgtacacacaacgtacatcggagtccattgtatactaattatttattatccgtagtaaagcatggctgcaaatgctagccgagctttgacgggacatagagacacgcacgcatagctggctcagtgctgtccgccgggaagcttctccttgatcttgtccattgacgcccttcttctcgccggtggcctcggtgccgttgcgtgcccggcgtactcgcccgccaccgccgtggtgctggctgccccggcgggtggcgtcctgtgtgggctccggccggggggangcttctcccttngatcttcctccttcatcccccgttcttccgtccctcccggcccaaggcccgtccgtcctccggagcgaagctggggagctgg

SEQ ID NO: 25410 - DNA, 1986 bp, Triticum aestivum
  Clone ID: PAT_TA_25410
ggcggaactcccctgcccgcgccgctcttctcctctgcacactctcctccgatcccgaatcaaaggagagaagcacgctcccccgccgcggaccgtgcccgcgcggaggcgcagatgcctccccctcccacggccgcccgagctcatgccccttgtgtccaagcagggccccacgatagaggggggtcaaagggatgctatccatgttggttccggtctttgcactgctacaaaagcaccgtcatcattgtgcgcccgattccctaatgtggggtcagtggggtgcgatccctctgggtgccggcctgggcacggctaccggagcgctaacatcgccctgcgcctggttccctctctcgctgcctcggggattggactcccctggttcgtctcctcaaccatcgatgactctgggcttgattggttagtttattgcaagatattagtgtctctcaggctgaaatccccacctaaaataacgttcattgggcttttactcggttgcagttggttgcacaaatctatctgctctccaccttattggttgcgagtacatagacaatgtagagtggctggggctcctcgcggtggctggtgcttgcgcaagtctatctgccctccaccttattgattgcgagaaaatcgatagtgtagagtggctggaatacccttggtagggatggaatcgttggaagagcttgtagtgaagaattgcaaaggaatcaatcatcatgacttcctaaagtttggttctggatggatgaagcagttttgagtttgagaggaaaagagaaagatttgattgtctgatgtggtctatgactccttgtacgatgctcacagcatggatgcatatgatttctgctgtgagagcttgaaggatttaaggttggcgcatattaaaacttggcccgaagtaggagttcgtgttctcctagggaagtgtaaagcattggagaagctttgccttgagtatgttcatgccctaaatgacaatgacatgattgcattgtctcggagctgcagcaaccttaaaagcatcttacttaggctcaacctgcagcgctactctagtgatgtcagctattgtgaaaccaggacgtcatttactgatgccagcctttacgctctagccctcaactgtcgtatgcttcagatggtagacctcagctctattggatgttcccctgactggccatcagtaataggattcacactctagccctcaactgtgctcagcttctcctgccagacctctgctttcgtgctcatcctcctgactggccatcagaaagataggattcacacaacagggttttctggtgctcattcagtcctgcccgattcgtgttctcgtgctaaatactgccaacttctttgatgacgaggggatgaaggccctgtcatcctcaccatacctggagatactcgagcttatattgtgtgaagcggtaactgatgctgggatgtgcttcattggacagaccccacgcttgagtaatctcaaacttcggttgtgtcatgaggtgactgatgttggagtgtctgaactgggacatgcacgtaagttagagtctttggttatcgagtgttgtagtatggtctctctgcgggcgccgcggggtgttgccaagtcggttcgctactccagctacgtcgctcaggccccttcgttggccatgggtatgggcgtcatccgacctagtggcccccggatggtcctgcttgtgcctgctgccgttgccattatgttgttcactgtgcgtcagtcgactggggtgcgctgcatcccacctggtgtttcttgaatggaccttctattcccttctacgcaccactcgtgtattactgtcaaccgtaattctggttgcttaatttctactctctgtagccgtttcgaaaccgacataagtaggccccaagattccctgtttgtgcggtggggggcactatatgacagtttggtgttccttatttgtattgttt

SEQ ID NO: 25411 - DNA, 548 bp, Triticum aestivum
  unsure (1)..(548): unsure at all n locations
  Clone ID: PAT_TA_25411
tacggcncactagtagggcgaattgggtaccgggcccccccttttttttttttttttttttttttttttttgatcaaacagtcaattgcatagttcgttctgccagccagatcacctaaagtgaacaactagaagctgaacacaaactgaacaacaatactggagtttatatttacaattctaatgttagattgaaaatattgaggtatttcttgcacgactataactgcatcgagaaaaataagcagtgttgatctttctctgtttctctccattgatggggattttttcttcttcccttttataaataatgcaaaagcttgcttcctcgtgcactgatagaatgaaagaaccgttttgtaaatgagactagacaacacccatgaccatgtcttcgtgtagatctgcagtcacctgctgcacgtccggccacttacccccacaagacgcaagtcacttattcgtggttgggtcagaaaggaccaagccaatgaagcaaggcaaggtgatacccacaagtctcccggggaacaggccgggtaggcctc

SEQ ID NO: 25412 - DNA, 1051 bp, Triticum aestivum
  Clone ID: PAT_TA_25412
ggtcccgacatccgggtcgcccacgcgtccgcccacgcgtccggcggcacgaggggagggagggtcgcgacgacgatcaatttttctcaccaaaagggtttgggcgtgtcaggattggatcgatggccacggcgacggcggcggcaggggaggtgctgcagcacatgggaccggtccctcgagtggaagagaccaataatgcggcggcggcggcggaggaactcgggggagacgacgaagagatcctgcgattcatggactcggcggacggctacctcctcctgatggattcgctctcctccgctcttcgccagggttggcttgatctggcaagtgctcgccactcgatgggtgcatcacgtgtttcaagtacgctgtttgatcattaaagagcaatctgcagccactaagctgcaagtagtttatcctgcagacttgcaaccatcagaatcaaacccacatttttctctatcaaagtggtgtcttgcaagaagaatcaaactccagtgatattgtctgtgcgcaggatagcgctacagcaaaactaaggtacagaggatcagctgctaccccagatagtagtaatggatcagatgcaactactgcaaagtcttctactggtgttgacgttaacagtcaggttcaaaaggcgagatcaaaagcattatcagtctttggagcattggtgtctccaaaactgcgaacggcccaagtttcctttgaaacagcacttgaactaattgtggagttagctaatgcaagatcagccatcctctctagtttctcccagataaagcatgaagcatgatttcctacctgagtttgaggttctgtatccttgcgcgccatctatcctatttgggttaccagcaattatacaatcagcaatggctgtggacactatatgaattgttgatgtacgtgtgggaatgtatatttttgtccatttgtttgttgtacttcgactttccttatcaaccatgggaacaaagacagtagtttttttttgtacgattgatattcatttaccaagttaaactctctgatgatc

SEQ ID NO: 25413 - DNA, 593 bp, Triticum aestivum
  unsure (1)..(593): unsure at all n locations
  Clone ID: PAT_TA_25413
cggccgttcacttctacaggtaaggaacgggttcgttactcatggcgccgccgcagccaaagtcgggcctcttcgttggcatcaacaagggtcatgtcgtcaccaagcgcgagctgcctccccgcccgtgccaccgcaaggggaaatcaacgaagagggtgtctatggtcaggggcctgatcagagaggttgctgggtttgctccttatgagaagcgtatcactgagcttctgaaggttggacaaggacaagcgtgccctgaagcttgctaaggagaaagcttgggactcacaagagggcaaagaaagaagagagaggacatggcgggcgtcctcacgaaggtgaggtcggatggacacgcaacactgacgcgttgcaagtgagtgaatttcgcgtccatggggcctgcaacagagtatgttccagtgcctgattttccatacatgtagaacctaatagacacgtccacgtattattgatcaggtatggctcctccccttctactccccccgttgcttccaccggttagggttccaacaatttatgggatcttgctcctattcaaatgcatccatggntttgtgaaaaaaaag

SEQ ID NO: 25414 - DNA, 537 bp, Triticum aestivum
  unsure (1)..(537): unsure at all n locations
  Clone ID: PAT_TA_25414
ggtcgtccgcccacggtctaatccgattcagacgcaccgcttcctcgggtccgaactaagccccaatcccgtcaccaccgccgctggtgctcggcgcgatggcgcagaaggacgccgccaatggcaacggcgccaccacgcgcccgccgcccactccctcccccatccgcttctccaagttcttccaaggccaacatgcggatcctggtcaaccggcgggagctggcttcatcggctcgcacctcgtccgacaaagctcaatgggagaacgaagaaagaaacgagggtcaattggtgctggacaactttttttcactngggtcaaaaaagnacaacctggaaagnaaagtggggatccgggcacccaaagattttggactcaatcccggtcaccgaatgttcacccgaaaccaantggctccgggggggggttgaccaaaattcttaacaaactttggctttgccctggcctcaaccaaatccttctaaaaggcaanaaaccctggtccaaggcccantcnaagaccgaatgttntt

SEQ ID NO: 25415 - DNA, 424 bp, Triticum aestivum
  Clone ID: PAT_TA_25415
ggcctgcgctccctccctcatcactctcccccctccccgccggcggctgacctttctctctgccgtcgcctacgagctaggaggagtaggctacgggtgagcgatagcccgcagctctgtcccgccattactcctccctcgtaacagaggaagcagagagcagaggaggcggagaagggccgggaaagagcacgccggcaggcagagaagtaattctgcggccgtaccttcacccgggcggcgcggggggcaccaccaccacgctcctaggctcctaagctagctaccgtagctacgagcgagccagccagccaagcaagagaagcccactcctgcatccatcgcccagcaagttccggcgcccccggcgcgccccccccccgtccgtccgtccgggcgggcaaatcttttcccctgctcctcc

SEQ ID NO: 25416 - DNA, 616 bp, Triticum aestivum
  Clone ID: PAT_TA_25416
cacagcacggcacggcagccgcgggagccaccgaccgacggagccacccttcgccgtaggtcgccgcaggagccgtcgcgctcttagccgcgggacgccgcccttcgccgcaggtcgccgcgggagacgccgccgcgacgccgcgggagccgccgacggagccgcccgccgcgcccttcgagccgcaggtcgccgttcctcttctgcttcccggcggccaaatgtgagcgtacaaccaagagcatgtggcagaggagcggaggcatgggacgcaacatggggcagaggagcaatggcgtgatggttgcgcagagggaatgttcgtgaggacgaaacggtacatattttaggggctaattgcggggattaattaagcatgcacttaacttggttgatggttgatggcttgatgctcaatattgggaggatttcaactttctcattgttgcggtctatggcgagagcaaagtacaaatgcgattatttaaatatatggactagctagaaagcataccaaaaatatgctttttgaaagtaccctttcctctgaacatgtatgtatcccagtgctccacattccactgaattctggacaaatatgctacttcctatcaaa

SEQ ID NO: 25417 - DNA, 717 bp, Triticum aestivum
  unsure (1)..(717): unsure at all n locations
  Clone ID: PAT_TA_25417
gcacacgtctacagtgcgggggtgatcctgctggaacggcccgcgcggaaggaggctgctcgtgcaccccttctacgccgccggctcgctccgccgcttcttgcagatctggatcaatgattcacgatcgcgggcgcgtttctgcaagctatccattggcatcgtcaaggggctgggaaaccttcacacctcaacgcagaagccgatcatccatggcaaccttgcaaccagcaacatcatgctcgacgccgattgaaacggatcctgaagaggctggaggagatatcaaggtgaccgaagcacgccgaagctcggattgctcgcgtacgccgcggtgcatggctacatataccccagcagggtagtattagtggtgataagtgtagtgcccgacgtttacagcctgggggtgatcctgctggaaatgctcgctcagaaggaggcggcgaacgacagcccgaatgcgcgtgacatccacttgcccgcctcgttcaaggatctggtcctcgagaggaatatcgctaacgcgttcggctccgctgaattatactatgtaacggcttagtagaaggtaccgctatgtaaggagccctccgagctcgcgacggcatgctacaacccttcgccgtccttgggaccggactcgagacgcatcctgaagaggctggaggagatatcgaggtgaccgaaacacgccgcacgcccgttnactcgcgt

SEQ ID NO: 25418 - DNA, 540 bp, Triticum aestivum
  Clone ID: PAT_TA_25418
gagagccctcgcccagggtgtgcacactgcaagcatcatcgatgggcgtgtcccgcactcgctgttgctcgagattctcacagatgagggcactggcacaatgatcaccggctaaggttttcttgtaaattttaaagcgccagcccaggcgcagagctaagtgcagcgtgatggatagaactgcggaaaccaagtggatggggaaaaggacttcgattgagcgccgctacgtcaaggtccaattatgctagccatgaggatgcgggagactgatatgggtttgattcttctcgtcagtttcgacccccatgttgtcatgggcatagcatagtgaactccactcatagctaaaaaggaacggtgcctgccttcttttcagtatctaattaccgcattcgtcggagctcttccgctgctgcatctcatttgttggacggggatatgctgagaaaacgaagggcaaatctgtgcccactgactaattatgttgcctgcttgcttttcttgtgtgatactgaataataccggtgtgcatcgttt

SEQ ID NO: 25419 - DNA, 920 bp, Triticum aestivum
  unsure (1)..(920): unsure at all n locations
  Clone ID: PAT_TA_25419
gnctagttctagatcgcgggcggccgctcgcgatctagaccccgagctgcagtcctccgtgatccgcgacctcgtcctcctctcctgcgtcggcctccgccccatcctcgtccacggcggcgggccagagatcaactcctggctgctccgcgtcggcgtcgagccgcagttccgcaacggcctccgcgtcaccgacgcgctcaccatggaggtcgtcgagatggtgctcgttggcaaggtcaacaagaatctcgtctccctcatcaacctcgccggaggcaccgccgtcggcctctgcggcaaggacgcgcgcctcatcaccgcgcgcccctcccccaacgccgcagcccttggcttcgttggcgaagtcgcgcgggtggacgccactgtcctccaccccatcatcgcctctggtcacatcccggtcattgccaccgttgctgccgacgagacagggcaggcctacaacatcaacgcggatacggcggcaggtgagattgccgctgcggtgggcgccgagaaattgctactgctcacagatgtgtctgggatactggcggaccgtaatgaccctggcagcctggtgaaggagattgacatcgctggggtgcggcagatggtatccggtgggcaggttgctggtggaatgatcccaaaggtggagtgctgcgtgagagccctcgcccagggtgtgcacactgcaagcatcatcgatgggcgtgtcccgcactcgctgttgctccgagattctcacagatgagggcactgggcacaatgatcaccggctaaggtgtaaaatgcctccttggtacttccttatcctttcctgttcatactgccaatctgccatgttatttatgccaatgtagcctcacctcaatgattgcaataaagagtaccttcctgacaaaaaaaaaaaa

SEQ ID NO: 25420 - DNA, 467 bp, Triticum aestivum
  unsure (1)..(467): unsure at all n locations
  Clone ID: PAT_TA_25420
gctcagacagtcagctaagagtggtggttaactgtgtatctgtggttactgtaggccggcacgcagccatggccggcgatgatgagcagcggccgctgcacatcctcttcttcccgtttcccgctcccggccacctcatcccggtcgctgacatggccgcgctcttcgcgactcgcggcgcgaagtgcacaatcctcaccacgccgngtcaacgctgccaccatcccgcccggccgtcgaccngtgccaacgaacgctcgccggtggaactccgggttccccgcccccgccggcgatccagatctccgttcgtgcccttccctgaacgttgggctcccgccggggcgtcgangaacgcccacgggcccttgccccggccccccccgccccgcggtccttctcccgtttcaccccgtccccggccccgtcgccccgttcccctttccnagtcaagttcntttgtncng

SEQ ID NO: 25421 - DNA, 711 bp, Triticum aestivum
  Clone ID: PAT_TA_25421
acagctgctgggcagctatccagcgggccactgagtttaccttactgcttactcttacatactaagatcgctaccagagcatggcgggaacttcgtcgtggtcgtcgtcttcatcctgcgcgtcgtcgtccgggtcgcccgaccacgatgtcgtctgcgtcaccgagccggactctgtgggtgccgcaggcgccgtcgccgacgccgagggaagcgtcaagttcctgtgcagctacggcggcaggatcctgccccgccgcaccgacggcacgctgcgctacgtcggcggcgacaaccgggtcctctccgtcgaccgtcccatccggttttacgtgttgcagcggaagctgagggaattgtgcggcggctgggaagcgcactgcggtgtcagctaccgacggaggacctggacgcgctcatctccgtcacctgcgacgacgacctcgccaagctgctcgaggagtacgacgaggctagcaaggaccgcctccagtcgctcaagatccgggcgttcctgttcccgactaggacgccggcgccgtccatactacagcgtaggagcccgccgtcgattgctcacctccactggcaaaacacttccccgccgccggccgcagccggcgtctcgctgacgtgcgcgccgcggtggtgggcagcgccccaggcctctcgccaggcgcagaactacgaccgacacagcctcggtgagga

SEQ ID NO: 25422 - DNA, 1037 bp, Triticum aestivum
  Clone ID: PAT_TA_25422
gaggagagcctctgcaacgcggtgggccgtggcagggacccgccggcgccgtggctgtacgtgcacctacagacagattacaagccggacgatcggcgcttcttctgcgacgacggacaggagacgctgcgtggcgtgcgatggctcgtgctccgctccgacaactacttcgtgccgggcctcttcttcctcccgcggtacgaggaagagctggtccggctgttcccgcgccgcgacactgtgttccaccacctcgggcggtacctgttccacccgagcaacacggtgtggggcatggcgacgcggtactacagctcgtacctcgccccggcggaggagcgggtgggcgtccaggtgcgcgagttcaagtatgcgcgcatctccgccgacgaacgctacaagcagatcatctcgtgcgcgagccgcgagagcctcctgcccgccgtcgagaacgctactctcccgagctctgcctctgaccaccaccaggagcaggagcaggagcagaagaaacgcaaggccgtgctcatcgtgtcgctcaacggggactactacgacaagctgagcagcctgtactacgagcacggcgcggcggctgtgactgtgagcgtgttccagccgacgcacctgggcacgcagcactcggagaagcggcagcacaaccagaaggcgttggctgagatagtgttgctcagcttttcggacgtggtcgtcacgtccgcccaatccacgttcggctacgtcagccaggggctggccgggctgaggccctgggtgctcatgctccccgtcgacgggaaggtccccgatccgccgtgtcgtctcgcctccaccatcgagccctgcttcatgaaggcgccgcactatgactgccggaccaggggagacagcgacaacggcaagctggtcccgtacatccggcagtgcgaggatgtgtcgtatggcgttcagttggtggagtaactcagctcagctggccttccctcaatttggcagcctcatcgtagcttcatcatggcctcttggtcttgagggca

SEQ ID NO: 25423 - DNA, 425 bp, Triticum aestivum
  Clone ID: PAT_TA_25423
gcgacgagccatctgggctttattatggaggtgccctactcctcctaaggtgcgtgtgttcgcgtggtgactcatcactgattcccttccaacatgggttaataagaagcgtcgtaatttggaggtatctgacgtgtgcccggtgtgtgcgtctgaacccgaggacacataccacgcgttctgcaggtccccacgagcagtaggtctctggcaggccatggcgagcgactggaggctcccggacgtccgcaagctggtgaatcctggaccggagtggctcctgcacatccttggggacagtacagagacggaacggcttcacctgcttatgactctgtggcgcagctggcatgtaaggaatgatatagttcaccataaacggcctcccaccgttgagtcatcgaagcgcttccttcatagctatg

SEQ ID NO: 25424 - DNA, 1302 bp, Triticum aestivum
  Clone ID: PAT_TA_25424
agcagatacacgagagaagggaaggaggcgatggcgaccatggccgggcgctactgctgcagctacagctcgccctctgcctctgcgccgccgccccatcggcagcgcgggcctccgctgcagccgcgaccgacgggaggacggggaaggggactccggcggccgagcctacgggcggtcgcgtcggcggcggcggagcccgtgaaggctgccaccgacgccgagttcttccagcccgccgactcgaggcccatcatgctcttcgacggcgtgtgcaacctctgcaacggcggcgtccggttcgtgcgggagcacgaccccggccggagcatcaggtacatccccctccagagcgactccgggaggaagctcctgcgccggtccggcagaagccccgacgacatctccagcgtcgtcctcgtcgagaaggacaggtcatacatcaagtctgacgccgtgctgaggataatggagtacctgaacctgccgttcccgcagctcgccgcgttcctcaaaattgcccccctgtttgtgagggacttcgcctacgacaacgtcgcgaacaaccggtatgtggtgttcggccggtcagagacagaatcatgcgagatactctgaattgctgccacagatagcacctcggtgctcctgcttatatattatagatagaagaatggccatacattgagaagttgtaggcatgacagatatgagatggcatgaaccaccatcatattacaaccaatccaattttagcactgctaccctcccgctcgtagcgctcacctagggtaagcatttctgcacttgctcctcggtctatgtccaagcactatgttcacgacggagagcgctgcggatcagaggccgcggaaccgtacttgtggcttcaccgtgcccgcgacgcgtccttgggcatttaggattttggcttttgttggggccgtgtggttggcccaagagaggtccacgttgtggagaaaaatcccgtggcacggcgcgcttttgctgcacaggatctggatggcctcttgctccgaggacgtcccccggatgttgatgaacctcgcgtccgttatggccacaccaccttcccgttctggacagtttccctgggggcaatagaactggtcgatgtcgataggataccgtacttcagtcatgttgaggtcccctgaaaaggaacgtgttcgctttgcctcgccctccctgccacgatttgatcctgacaccggtcatcgtactaaagagttgcagttggatagtgtaattctttccaccagcgctgtttttcaccgcacc

SEQ ID NO: 25425 - DNA, 1412 bp, Triticum aestivum
  unsure (1)..(1412): unsure at all n locations
  Clone ID: PAT_TA_25425
gcgcgcgtgccgccactaccatcgacggctagccccaccgcccctcgccgccccggccgtcgtcactgacctgcaaaggaagcggaggccgccgccgagaggcaaaacctacagcccgaaccctaacgagctccgtccatggcggactcccccgcgcaacccgcaccagctgcggccgccgctgccgccgggaacccccacaagcgcaagaacaaggggaagggcaaccccaacaagaagaacaagaagctgaagggccccgacgacaccacccgccgccgccgcaagccgagcgccaagttcctcaagctgctcgagaagcgcgcccgcgactacaactccgacgacgacgacgacgctgcccaagtccgaccacgaaggtcacagccacgaccgccgccgaagcaacgtgatgctgctcccgatgttggcgacgacctcaaagaggccccctcgtccgaggaggaggcctccagctccggcggggagtcagatggagaaaaggcggtcaccatgttccaggaaggctgcagggctttccaggccgccttcaccaagatcatggagaagaagctcgccgacaacccattgggtccaattctgtcggcggacaagaaattggtcgccgccaagttggccgaggaggcggacgagcacaagtccaagggagaggcccgcaaggagaagcgccttgctgcacagaagggtcataaaatacctgagaatgctattgacaacaaagaaaagatgcttatcaaggttgcaacccaaggagttgtcaggttgttcaatgaggtgagcaagcgacagactaggaaaggtttgaatccatcaagaagtaaagatgtcaaatctttggcaaaacactctgtaccatctaacgaaggacaacaaggccagggatcttccaagttctcaaagaatattggcaaaggtgaagatgagccagggtgggcccctctacgtgacacatacatgcttggttccaaattgaaggactgggataaagcgcaggattctgatgtggctaaaccgagtgaggtccctttggacaacttttctgatgatgaataggaaacaaaatctatttgcacggttggctgaggggctacattttgaaggggggaatggagggtggttgatgcttttggatgcatccaagagcgcaagattttggagaggggaagaatggcgtctctgatgtggttttcgtttactaggtttcattgcatgcatccaagagcgcaagatttctacatgcaaaccttgtagttttagtttctcttcatccttgtatcacaacaaaattcttgcagaattgttgtcacagcttaatgagtataattgttttgcccagaattctttnctagtgcattaagacaaacctgatatttttatgctgcaatgattgt

SEQ ID NO: 25426 - DNA, 1245 bp, Triticum aestivum
  Clone ID: PAT_TA_25426
cccacgcgtccgcccacgcgtccggaggaggaggaggaagagcaagaagatgcacggcggcgggtcgaagatgctgggggtggtgaacttcatcaccttcctggcgtcgatcccggtgctggggggcggcatctggctggcgtcccgggccaactccaccgactgcatccgctttctgcagtggcccatcatcatcatcggcctcgccgtcatggtcgtctccctcatgggcttcgccggcgcctgctaccgccagacctggctgctccgcatctacctcttcgccatgttcttcatcgacgtcgcgctgctcttcttcatcgacttcgccttcgccgacaccgaccgcggggagggccaggtggtcatgaaccgacgcttgctcgagtaccagctctacaactacaacggatggctacgaaaccgtatgggcgacccggagtgctgggacaccatgaacgcatgcctacagaacggacgcgcgtgcgcctccatgcggcgccccgcccgcgaccccaacaccggcatgctcgtcaccgagccccccgtcatgttctacggccgcaacctctccccgattcagtccggatgctgcaagccaccgacatcgtgcgccttcacctacaacaacgagacgtactggagcgcgaaccccggcgtccccaccgtggtgaccgaccccgactgcctcaaatggagcaacgaccagcagacgttgtgctttcagtgcgactcgtgcaaggccggcgtcctggccggcatcaagaagagctggcgcaaggtggccatcatcaacatcgttgtgctcatcatcctcatcatcgtctacgtcgctggctgcgccgcgttccgcaacgccaagagggacgacaacgacgagtcgtacggcatggccaggatgaccaagtcccggccgagcaggttccagttctagacctcaggcgaaaaaccgggaaaacctttgactgtacaaaaggccactcactgtgggtggtggtgttaagactttggcctgaactatatttcttgctgaactgtgtggatgatgatgatgatcaccctgtagtgggtggtgtggaagggaaggtgttcttggaccgaatgtttggtgtggtgtttgggttctgtggtgtttagggtaggtctattctgtatttggtggtacaagatgaggtctgcaaggaacaggaggggctgtctcattttaggattgtattattctgcacttagtgattttgatttgtt

SEQ ID NO: 25427 - DNA, 1458 bp, Triticum aestivum
  Clone ID: PAT_TA_25427
actgttccaccccctgcaccccccccccacgcagtcagtccgcccacgcgtccccccacgcggctctccgcccacgcgtccgcccacgcgtcaacgagccggtcgtcatgccggaaggcctctcccaccagccgacgcccacaccaaacggcagcaccagtagcagagccagagagagagaggacaagaagcaggggacctccgaggagcagagcggagccaaagaagctgggggtggtgaacttcatcaccttcctggcgtcgatcccggtgctggggggcggcatctggctggcgtcgcgggccaacaccaccgactgcatccgcttcctgcagtggcccatcatcatcatgggcctcgccgtgatggtcgtctccctcatgggcttcgccggcgcctgctaccgccacaccctgggtcctccgcatctacctcttcgccatgttgttcatcgtcgtcgcgctcctcttcataaccgtcttcgccttcgccgtcaccgaccgcggggagggccaggtggtcatgaaccgccgcttcctcgagtaccagctctccgactacaacggatggctccgcaaccgcgtcgccgacccggagtactgggccaccatcagcgcatgcctccgcgacggccgcgcatgcgcctccatgcggcgccccgcccgcgaccccaacaccggcatgctcgtcaccgagccccccgtcatgttctacggccgcaacctctccccgattcagtccggatgctgcaagccaccgacatcgtgcgccttcacctacaacaacgagacgtactggagcgcaaaccccggcgtccccaccgtggtgaccgaccccgactgcctcaaatggagcaacgaccagcagacgctatgcttccagtgcgactcgtgcaaggccggcgtcctggccggcatcaagaagagctggcgcaaggtggccatcatcaacatcgtcgtgctcatcatcctcatcatcgtctacgtcgccggctgcgccgcgttccgcaacgccaagagggacgacaacgacgagtcgtacggcatggccaggatgaccaagtcccggccgagcaggttccagttctaggcttgcgagcggcgaaaaccggtagctcgctctttgcgtgtacaaaaggccactcactgtgggtggtggtgttaagactttgccctgaactatatttcttactgaaccgtgtggatgatggtcgctgtagttgggtggtgtgaaagggaagatgttcatgggatcgaatgtttagtgtggtgcttagggtaggtctattctgtatttggtggtacaagatgaggtctgcaaggaacagaaggggctgtctcattttaggaatgtattattctgcacttggtgattttgatctgtcatcttccttagtactagttcatgctattattatgattgccatcaatctcaatatatcatgtttttgtttagac

SEQ ID NO: 25428 - DNA, 628 bp, Triticum aestivum
  unsure (1)..(628): unsure at all n locations
  Clone ID: PAT_TA_25428
tccgtggcgattgggccagatggcaccaaggtgaacgccgctgaggcgttcaagatagcaggcatccatggcggcttcttcgagctacaaccgaaggaaggtctcgccatggtgaatggcacagctgtgggctctgctctggcatccaccgtgctctttgaggcaaatattcttgctctcctggcggaggtcatttctgccgtgttctgcgaggtcatgaatggcaaaccggaattcaccgatcaccttacccacaagctgaagcaccatccaggacaaatagaggcagctgctatcatggagcacatcttggagggaagttcctacatgaagcttgcaaagaagcttggcgatctcgacccactgatgaaagccaaagcaagaccggtacgcgctccggacatccccgcaagtggcttggnccacaaatcgaagttatccgtgctgccaccaagtcanatnagcgtgagatnaattctgtcaacgacaacccactcattgatgtntcccgtngnaangggatacaacggggggnaacttncaaggggaaaacctnattgggggtntccaaggggcaatanccccctcccaatcccaacaaattggaaacccaangtccggccatttt

SEQ ID NO: 25429 - DNA, 858 bp, Triticum aestivum
  Clone ID: PAT_TA_25429
cgagcacacaccaccagctgcacctccgccggccgctgccccggctagccaagagtagcaacagccgtgtaatggcgcagcggctccagcggcctccgagcccgtccgggcccgggaccacctccacccctgcttgtggagaccaggcacatcagatgaataacggagccgtgaagggtgccgctccaaccgggtacgacagggcccagcaatctgatcaacagtggagtcggcatcgtccaacgatgcagcagtttcaaggtcagtgagcagcaacccggctggccggcgtgcccgcttccggcggcaacccagcgagctcccaagccggcggagtccatgcatgaggaggatgagctcgaccatctcatcagcagcgaactcgcggagagcgggctgttcatgggggagcagcagggtggcggcgcgtactcgtggaacatgtgatgggagggaccgtgaaatctctcaacctaaagtttctctctactccctgagtcgtgcttgatgtaaaatcgccgcaagttattcggagtttttcttcttttcttttgagctttcgtgctgcgctgactggaacagtttctgatgatcatgcactgattgaaccttcagttgtgtgagtgtgagggatctggctgggaaagttgttgagagtagtacactgcaacccagtgttatcaagtaaggaatgccatgctctgtgttgttgtcattgtgctgcattcttactgattttcttctggccctcggaagaaaatatactctcttctttccttattgggtttcagttcgaattgcctcttgtttaaactaaaaaaaaaaaaaaaaaaaaaaaaaaaaaaaaaaaaaaaaaaa

SEQ ID NO: 25430 - DNA, 1248 bp, Triticum aestivum
  Clone ID: PAT_TA_25430
ccgcgcggccccggcagaacgcagccatggggggagcactacccgcgcacggacggcggccgcccccgcgccgcggcggccgcggagctggcgggcgcgccgcgccggcggtaccgcggcgtgaggcagcggccgtggggcaagtgggccgcggagatccgcgacccgcacaaggccgcccgcgtctggctcggcaccttcgagaccgccgaggccgccgcgcgcgcctacgacgaggccgcgctccgcttccgcggcagccgcgccaagctcaacttccccgaggacgcgcgcctcccccccgcgaccgtcacccccaccgccgcgccggcgcgggcgccgaccgccgcgccgtcggcctcgacgcccgtcacgcacgccggctacacccaggcctccgtgcacctgcgctaccagatgctcctgcagggcaggggcgccgccgccggcaaccgatccaccccgctctcttcctcgttctcgggctgctccgtggccgctgccatgagcagctcgtatggcggcggtgtcatgagcagctcctatggcggcggcggcgggggcggacgcaccatgagcggttacctggggtcctactactagttcccgtcctcctccccctcggtggccacggtgccgtcctcctcctccgcgtcctccgctccgggccaccactactcgtcgccgcacgacccgcagcagcaccagcagcagcagggcgacgcggcggcggagtggagctgggagagcgcgctggcgccggaccctggcacgacgacggcggcctcctggtccgactcgagccagcagccgtaccacccgccgcacacccaatagcgcagcaatcgcgaagccaaccaagattctgcgccgtctctggaagaaagaataagatgcgtacggacggcgacggagacgggcgcggcagcagcagcagaggaagatcgagaatgatggcgtcactcgtggtcgggtcgggtcgggcgcatgtgttgattgaggacagccatgggctcgttttgttcgttcgttgattagtttgggcggtggtgcggggccgccccgtttttactactttctgttctggttattattactgcaaattaagaagaagaaaatggaagagcgggcgtgacgcttgcagttgcaggtggagattggatgcttttggggagggttaatcagagtcatttggcgaggtttaaccgcgtcatttgggaaaaataatgaatgttgcgtgctacctgg

SEQ ID NO: 25431 - DNA, 191 bp, Triticum aestivum
  Clone ID: PAT_TA_25431
ggaattcattcgctaaccctgaaggctgtatgattgtcgtagttctgtttattgcaaacctgcaatgaatgcttagttttatgtcttgcaaaattgtcatggatgcattcgttgatgtagctcttctgccgcaaattttgatgttgaatgcattattattttttatcaaatatagtgtaatcctacctgcc

SEQ ID NO: 25432 - DNA, 893 bp, Triticum aestivum
  unsure (1)..(893): unsure at all n locations
  Clone ID: PAT_TA_25432
ctggattggtgtgtctttgcgtgggcggggcaaccggagttgttgatagatatacaggcatggttaaaggctatagtggtgttttccggcttggagaagcaacatcaacctgggatgcagattcaccagttattcagagggaatcatgggaacacatccaaagatgaagatattagaaaggcagcagcatcattcatgggtgaaatatggcaagttcctccgatgttttctgccatcaaggttggtggtgaaaaaatgtatgacaaggcaaggaggggcgaatcgatagagctttcaccaagacgtatatcaatatacaagtttgatattgagcgcagtttagaagacaggcaaaatttgatatttcgagttacttgctcgaaaggaacatatattcggtccctctgtgcagacttggggaaagcgcttcgaagctgtgctcatttaactgcccttcggagggactcaattggtgactattcggtcaatgatgcttggaacttcgacgaactgcaagaacaaatcaccaagggatacctatgagaattggccatgccctttggaagattgcgatcgagagcagctatttctagacatgtggtggactgaggcactgagcactcatggtccgtggtgcaagccgctgatacagcagtatggtctacatgaatctgcaatctgacttcttaggtctccttggagtcaaggaattcatttgttaaccctgaacgatgtatgactgtcgcagttctgtcatttgcaaaactatagtgaatggatagccctatgttttgcaggatcctctccctgccgctcttctgccgcctcttctgccgccatttcttgtcgtattcattttttnggggnatnatgtaatgtgattttnggggggg

SEQ ID NO: 25433 - DNA, 910 bp, Triticum aestivum
  unsure (1)..(910): unsure at all n locations
  Clone ID: PAT_TA_25433
gtcagttccatccccatttgctgcattcgaaattccccatcccagatgcccagcactctcccccgagccaatctccacatatgaggaagaagaaggcggcggcggcgccggcgcctgtacccgcggctgccaagacgaaatcggcggcagcggtgcccgcggctgctaagaagaagcccctggcggccaagaagaaagcggcagcggccgtacccgcggccaagaagaaggcggcggcggcggccaagaagcgcgcatccggtggaacggccgggtgcaggccacggaaacgggcacgggatgacaacggcgacggcgatctcatcagcaaccttccgggacgccgtcctctngcaccatcatctccctcctccccaccaagggacggcgctcgcacgcaanggccaatcgccccgcccgtggcngccccctccggcgctccgcccctctcaacctcgacgccaagaacctcagcaccaatgatttcaagcagccgcgccgccgncaagggcgtcgaccgtcgacggaatccatcatctccaggatccttgccgaccatcctggccctgcccgtcgnttcgacatccgattaccctgcatntccccaacaaaaagagagtncgccaagaattgttgctcaaatcgcgagctgggttccaagtnttggagccttngnaacccttgnggagctccatatccntttcccaatctttgngaattagnnnggtnccgaanccccctggttttaannnngggctcccgntttaanattaaaatttttggncngggggccncttgtggggttacttggngaangncntcaaaatgggaaaaccgctccntncatttggaatttnccccattcctttaagnctttttaannttttgggttanccgttaaaaaattccn

SEQ ID NO: 25434 - DNA, 898 bp, Triticum aestivum
  unsure (1)..(898): unsure at all n locations
  Clone ID: PAT_TA_25434
cccccccgcgcccccagggcccgacgccgggcagacacgcgagagggtagaccgcggcggcgaggcctcctgctttgcgcctagggttttgattcgatcccccccgccgccgccgccgcctgccggatggccatggagagggagctcatggagaccttcgaggccgccaagaaggccgccgacgccgccgccgaggaggccgacggctcctcccccgaggccgagcgctgcctcgacgccctgcgccgcctccgcgagttccgcgtcaacaccgacgtcctcgtctccacgcaggttggcaaacgtcttcggtacctgacgaagcaccctaactcaggacatacaggcggtggctgcagacctttttgggtactggaagaaaggttgttattgaaagagaacaggaaaggaaaaacaggcacaccagcaaatggagaaatcaaacaactctgcacatcccatgaagggatgaaagcccatgagcgttgaaaggaagtcagcgaacgtgaatgttgaaaagtgctctacgtcgacgactgtgaactctgaagactatgcaactgtgaagactgaaaaggattctatgtcggcaagtgtgaagattgggaagactgtgaatagtgattcccgaggtcgtgtcaggggaggtgagcggttcatcgggaacatagcagccctcctctgtcccaagtggcccccccgggcccatatccccccccaggctgacatcctttgtagatgcaacgatgctgtcgagataatcaggagcttcttgtgacgccttctcaaggtttcaaggaactatgatgataccgagaggaatagagactctggacnggtaatgcttngaccatttnagtntggnnatgaatcgcctnttganagnagcgtcnccgnt

SEQ ID NO: 25435 - DNA, 416 bp, Triticum aestivum
  Clone ID: PAT_TA_25435
cccaaaaagaatactattaggaaactatagcacggtgtagtaataattgctaataaacaaattttgctccagttgacatgctaataaaccggaaatcatccatccacacacgatgtgcaatcccgcacgaccattgctgtgagcagctcagacgacggccttgagcttcttggcgatgccggcgaagtacttcccctggtgcgccgccaaggcgagctcggcgtcggtgggcgtcctactgccatcggcgccggcgaaggtgccagccccgtacgggctgccgcccttgacctcgtccacgtcgtgccgacctgcgccgtgcgtgttggcgtcgggctcgattatcttgccgtggggcgggcgctgtgtcccgggcgcgggggccgcggtctcctggccggcgccctgcgtgcccg

SEQ ID NO: 25436 - DNA, 830 bp, Triticum aestivum
  unsure (1)..(830): unsure at all n locations
  Clone ID: PAT_TA_25436
ctcccacccacttaaacatctcctacttaagcgagaccgaccagactagcaagaagaccacatcaaagagaagctgctgtagtagcgaaaatggcgaacccggcttctcctcgtccccccatccggtcggtgaacctcggaaactggctcgtcaccgagggctggattctgccctccctcttcgacggcctccccaacaaagatctccttggatggcacgcagctgcagttcaagtccgtgacgcagaaccgcgttcgtggctgccgagaaaatggcggcggggcggcgctggtcgccaaccgtccctcgggcctcaggctgggagaccttcaaagctctatcgggatcaaccagaacaccttcaacttcaagggtggttaacaaccagttcgtccccccgcggccggagtggacggggcctcggcccacgggcctccaatccttcaagcttggtccgcacgatnttgncaaaatgnataaggggntcaaagnnccanggggtcctttttacaggcaaaaaannggtttcgggaacgggccncttcccnaaggggcaacaaannggggnaanacacncctccggnttnngggggncatnnaaaggggnttcttcnttttnaaaaaaattnaaaaaactttngggnggcacaaatacntanagnnccggacaaanagnttttggncccaaatnggggggggaaattttnnnaacgggcnngnnnnnnnggaaacttantttggggnnnnaaaacnttaattaggggtanaaccntnggntctgcnngntaatnggggccanctccangggnnnggnaatnnatnnnccnnn

SEQ ID NO: 25437 - DNA, 635 bp, Triticum aestivum
  unsure (1)..(635): unsure at all n locations
  Clone ID: PAT_TA_25437
gcaacaacatccgagcatccgcaccagctcaaacacacatactgcactacattgcacgccaagctagcacccgcgcagagcacagcatggctgtctccgcgcgcagggtggccttcgccacggcagcctccttggccgtgtactggctcctcaaatcgttcctccacgcaccgcaccccgcgctgctgccggcagcggccgccctcgtcgccgtcgccgtcgccgcgggagcgggaggcggcgccggccccggcgcccctcccggccccgcggccgtgccggtgttcggcaactggctgcaggtgggcaacgacctcaaccaccgcttcctggcgcggctgtcggcgcggtacgggccccgtgttccgggctgcggctgggccgtgcgcaacctggtggggtggggtcggacccgncggcgtggccacgggggggctccccacccacggcgtggggttcggctcccgcccgcggaacgtcgtcttcgacatcttcacgnnnaacggcgccgacatggtcttcaccgagtacggcgaccactggcgccgcatgcgccgcgtcatgacgctgcccttcttcacagcgcgcgtggtgcagcagtaccgctccatgtggnnnnnngagatggacgacgt

SEQ ID NO: 25438 - DNA, 447 bp, Triticum aestivum
  unsure (1)..(447): unsure at all n locations
  Clone ID: PAT_TA_25438
ggtccgtgtggaacaacttaaatctaatctctcatccttcgacttatgccgtcactgacgacaccgcctttaataacggcacaagcgtaaagatttggaagcaagatcctgcggttgttgaggcaggcattagaaaggtatacttgccttccagagtcaagacaggccccaaagacaacatggtcgctattgtcggaatgccaaatcctgtccagcccgacgtgaacggagacttccttctggatccaaagagaaatgaactcgaattcgactcggttcataccttctcccgtcngttaagaatggtcgtaaatatgttctcaaagatactatgggaaaagaattcaaagtggcaatggggggatgggtgctatcaaagtgggattccgaagagcaaggcctcaatgcaaatgccgtattactcgcgcctcccgaaaaaagccntng

SEQ ID NO: 25439 - DNA, 516 bp, Triticum aestivum
  unsure (1)..(516): unsure at all n locations
  Clone ID: PAT_TA_25439
gggggtgcaaagtacaaagagctgcttctccccgaggagaccatcgccctcctgtctggatctgcgacgactggcaaagctatggaggagaatatctggcatcttccagttcgccatggatgtcttgtacacgttctccctgtcgataagggaaatggatctcaccgcaaggttgttctagtgggctctgaaggcacccttgaatctgttgaggagaccattaagcggctgcgagatctccaaactaatggagatcctcttatcgaagtgcagaaagcgccagtccctataatctcttcggtggcgaaagctgaaagcgactgaatcctcccgtgccaatgatgcgtgcagtgtggaccactcccttgggcgaccaagagcccctatacttgagtagagtccttcaaaaangccgtcanttnaatncgtcaaaggatttnganaccanaantgccgacgtnatnaatgngaaacnaattgacaccancaanctgggtatccnnggncaaatttgaa

SEQ ID NO: 25440 - DNA, 475 bp, Triticum aestivum
  Clone ID: PAT_TA_25440
ggattacccaaacgcaacgaacccaccgcggcggccaggcgcctccgtcctcaattcccagcgcaaccgagagaaacacggaagcggacgccggggcacgctcgcctgggaggccaccatggacatggacagcgtggagtgcctctccctcccggacgcctccatggacgtagacgacgtcgacagccaccaagcaccaagcaagcaccaccacagcatcccgatccatcccgtgcacctcgccgctaacgggggcgtcggaggacgcgcgttcgcgaagatgaatgccgggggcgcggccgcggccgggggaatgggtgctaacgcgggccgccgccgggcggggccaacggcgaacaacgtaaaacaattgctcgaatttccctgtctgcacaactccaatgttccccgcccaatccaacaatggccaaaaatgggcataactttttgttccaaaagcaaagcggtgggtgca

SEQ ID NO: 25441 - DNA, 439 bp, Triticum aestivum
  Clone ID: PAT_TA_25441
aaatatggtctcctttgcactcaagttaccttatattttagctgctattgctttagtcaaggcttcccatattaaaggggttgcacctgaaaaacaagctttatatcaatcttcaagtgatggcacgtggcaatgtttagatggctctaaagttatttcatactctgccattaatgacgactattgcgactgtccagatggttctgatgaaccaggtacgtctgcttgtcctaatggttacttttattgtgaaaacaagggccacattccaagcctatatcaagtcctctgctgtcaatgacggtgtttgcgatgaggcatgctgtgatggttcagacgaagaaagtgggtcaatgtcctaaccgttgtcaagagggtggggaagcttatcgaaagggaccaaagaaataaaagcaaagatcgactgaggctggattaa

SEQ ID NO: 25442 - DNA, 439 bp, Triticum aestivum
  Clone ID: PAT_TA_25442
gcaatggctaaactgacagctcttgccggtcttctgacccttgccagcgtgcacgcaaatgccgccgtgctcttggacgccctcgacaaggtgcctgtaggatggcaggctgcttcagccccggccccgtcgtccaagatcaccctccaagttgctctgacgcagcaagaacattgatcaattggaatcaaagctcgctgccgtctccacgcccaactccaagcaactacggaaagtacctggatgtcgatgagatcaaccaaatcttcgctcccaagcaacgccaccaacgctgctgttgagtcctggctcaaagtcgtacggcgtggactacaaggtgcaaggcaacaagcatctggttccaagacgggacgtctccacgggcaacaaagatgctcaacacaaacttccacaacttacaaccgactccgttggtgcc

SEQ ID NO: 25443 - DNA, 435 bp, Triticum aestivum
  unsure (1)..(435): unsure at all n locations
  Clone ID: PAT_TA_25443
gagatgatgtccttgaagcatctccgggcgcctaccgccgggcagcgccgcccctcgccgctgctgcgtctcgtccccgggctcctgcttctgctgctcatctcgcggccggcgcaggcgtcggcgtcgacggtggtcacccgcctgccgggattcgatgggccgctccccttccacctcgagaccgggtacgtgggcgtggaggaggagaccgggacggagctcttctactacttggtggagtcggagcggagccccggcgcggaccccgtgctcctctggctcanccgggcgggcctcgctgctccggcttcagcgccttccgccttccaagtccgtcctgtaaagttcgtgttggcgcccttacaacgggatttgccccaactgggaaaaaaacccttttcatgggaccaaaattggaaacattcaacttct

SEQ ID NO: 25444 - DNA, 445 bp, Triticum aestivum
  Clone ID: PAT_TA_25444
cggtccttggcaaacactgaccaccaaacctttctcgggcactaaaaaaagcagcgtgataacaagggttcttattttagaaaaatagagtttgttatttctcgcaacaattttgttttgttttgttttcctttccgttggtcctactgcaagaacggtccgcctctccctctctatctccgatccccctccggcgccggcgcgccgctcccagcatccaagcacggctttcttgtgaatcccccttctcccaagctctctcaagcgccgcccatggcttcctccaaggccgctgcaagccgcagtcacatctctcttaccgccgcccgtgggtgccgagagggccggttccccaagggcgcctcctcttccggcgcctcccgcgcccggctccaagcccctaagggtcaaacccgtccgaacaacaagggctctcgccggggcc

SEQ ID NO: 25445 - DNA, 431 bp, Triticum aestivum
  Clone ID: PAT_TA_25445
gctcacagtgaaggaatctgctatggatgttcctacaaacctggatgctagaaggaggatatctttctttgctaattctctttttatggacatgccaaaagctccaaaagtgcgcaatatgctgcccttctctgtcttgactccctattacaaagaagacgtccttttctcctcacaagcactagaggaagagaacgaggatggggtttctatccttttttacctgcaaaaaatctacccaagatgaatggaaaaactttcttgaaagggtggactgcaagaatgaagaggaactccgtgagactgaacaaacggaaagatgagcttcgcctttgggcatcatacaggggccaaactttgacgagaactgtaagagggatgatgtactaccgacaagctttggtgcttcaagtccttgtcttgatatgggc

SEQ ID NO: 25446 - DNA, 430 bp, Triticum aestivum
  Clone ID: PAT_TA_25446
gctactctcaaaatgaacaacaagcctgttattctcatcgctggtgcttgcggtaacgttggattgcccatcgttcgcaatctgctcgctatgccaaaccgaaacggctacatcattcgcttggctgcccacaatcgccaaaaagtcaaggagttcgagggcaagcaaggcgtcgagattgtcgattttgacttcgacaacaaggacctctgcacgaaagccttgaagggtgttgatcgcctttggattactgagcctaaccccactaagaccatgaagatgtacgaagcgaagctcgttgggtcgagcgattcctcgattatgtgcgcgaagtcggcacggtgaaattcattgtgttcggatccgttgcaggtgcggaattgggagagcactaccttcgccaaggagttccgcatgggccgagaagaag

SEQ ID NO: 25447 - DNA, 1005 bp, Triticum aestivum
  unsure (1)..(1005): unsure at all n locations
  Clone ID: PAT_TA_25447
aacttggggccaacaacctatgctctggcgcccgaacaaatatagatatcgatctgctggcttaatcagtgtgagcgagcagggcatctcacgcggccgcaggaccttcaaggagagaaaggcacaccgaccttgctatatatagcgtgtacacagtgattgaagcatgataccacggatagacttatcggatctgagaataattaccaaccatttttcggacacccataaaattggaagaggtggttatgggagaagtttacaaggcagtttacaagaaggaagagatagcagtgaagttgcttgattcagccaaagaaattgacgacaaacaatttatgaatgaactcagtaatcatatgaaggtccaacatccaaacattgtacgacttgttggttattgtaatgaagtgaccagcgaatatattgaagcaaaaggatggccctcctgtttttggtaaacacatatacaaagtgctctgcttcgaatatatgcacggtaccagcctagacaagcatctttatggaaattccctgggacatgactggcccacgcattaccaaattataaaagggacttgtgaaggcttatgttatcctcactgtgggtgcgagcggccaatcctccccctggatttaaggccggccaacatattacttgccaagcgcaagaatccaaaaattgcggatttcggattgtcaaggatctacacaacaagccgtacccatgtaaaagtcattggttcagtttcagggacaacgaactacatggcgcctgaagtaagaaaagagggcgtggtgtcagataaggctgatgtctttagtttaggtgttacaatcatagatgtaattggaggatctcgcggtttagaaacttatcacgaacatggcgccaagaaatntgttgaatatgtatgtacatattggagggagagggataatacagcagatttatatcaagtagagacatgcaccaaaattgcaatatgctgtgtgcatactgac

SEQ ID NO: 25448 - DNA, 450 bp, Triticum aestivum
  unsure (1)..(450): unsure at all n locations
  Clone ID: PAT_TA_25448
ggtcagagctagagtcagaccgagatatcaaaagagttatcacctcaagctatgatgggctgccatatcatctcaagtgttgcttcttgtacctgagtatcttccctgagaaccatgagattaggcttacacgcttattgcggcggtggatagcagaaggctatataacaaagccacgtgacatgagcgtcgaggaacttggacggaggtactacaatgaagctcatcagtagaagtatgatccagccttcagagaaggccagggctagcatggcggttgaacgttgccgttgttcatggcgtggtgctccaaataatattgtcccaagtcctaatttgagggagaaacaacctccttcatcaatgggataaagcactggcaaatgagggctccacaagggtaacatacgccaacttnggtaagtggaccaagattggaagaaaaatgag

SEQ ID NO: 25449 - DNA, 519 bp, Triticum aestivum
  unsure (1)..(519): unsure at all n locations
  Clone ID: PAT_TA_25449
gccactcttcagtctccattctatattctctttgaatcatcacatcgccgagctatagatgttcagcctacactaccccattctgggcgcactttttagtaaaattggtttgaacaactaactacatctgatttcatggatccaaccatcgaggggaccagatcagttgtgggcatgtctcagatgcagaaagcaaaaactcaaatgtggcggccctgaaaaaatcccatgccaagaggtgtcgcgcaagcaatgctgaatgcgtctttgtccaacccaaagctctcctagcgaagcctgctgctgcatcgcagtctgaatccgggaccaaaattgcactgcttggaacaacgcttgagtcccgtccaaagccagctgccagctgagattcgggagttgagaaatgcactattaacaaaacctaattataaagaatctcancgactgnnatanaaaatccanaatcctnggcaagngccggggaaacnccttaaacaaaaantgttaaggggtttcann

SEQ ID NO: 25450 - DNA, 439 bp, Triticum aestivum
  Clone ID: PAT_TA_25450
gatgtcgacaacagcagccgccacatcgcagacccttaagatgcccgccgcacgcgccctcgagaacgcaaagcaatcttcagaagccgtcctcagcgacgcatcctccgccatgtccaaagccgccgagaaccccaagaaagtcaccgctgactttctgcacacacccttcatgcgagcagcactcccctttataaacggcggcctcgcaggcatgacagcaacaactgtgatccaacccgtagacatggtaaaagtgcgcctacaactcgctggagaaggagtaaagacgggccccaagccaaccccagtcacagtcttcaaagacatcatcgcccaaggcaaagtcctggacctctacaccgggactcagcgcaggcatcctccgtcaagccgtctacacaaccgcgcgcctgggtttcttcgacacattcatgaa

SEQ ID NO: 25451 - DNA, 436 bp, Triticum aestivum
  unsure (1)..(436): unsure at all n locations
  Clone ID: PAT_TA_25451
gccggcgcataccgactcttgccaattgccagtccaagagctgcgtcgctcgtcgtcgagcctactggcaaccactcgcaacacctcccaccgcattcccaccatgctggccgacgcgctctgccgcttggcagctgatgttcccaaaacaagcccacacaggatgcagcaactcacaagcctcgtgcgtcgcacgctcctcgctcccaatgccgcccaccccgccgccgccctctcacgtgcttacgcgtctgccttctctgccactcgctcgtatgccaccacgacggcgcgaaaccaaacccacggccaaccgtgaagaagacggtcaagggccgaagctgccgcgaagccccgcgcccaaagaaggctgcatnccgccaaggaagccaagctgttaataagacgggccgtggcaaaaaagccggttgctaan

SEQ ID NO: 25452 - DNA, 446 bp, Triticum aestivum
  Clone ID: PAT_TA_25452
tgatcactcaacagacgacaaacttgcttttgaaacatcagaaactgttcaagttgttcctacttttgattctattggattaaaagaagatttacttcgtggtatttatgcctacaactttgaaaaaccttcagctattcaacaaagagccattgtacccatcattaagggtcgtgatgtcattgctcaagcccagtctggtactggtaaaactgccactttttctatttcaagctttacaaaccatcgataccaccattcgtgaaacacaagccttgattttatctcccacacgtgaattagctactcaaattcaaagcgtccgtcttagccttgggtgactacatgaacgttcaatgtcacgcctgtattggagggactaagtgttgggtgaaagatattcgcaaagttgggaaggggggtgttcacaaccgggtccggggcaa

SEQ ID NO: 25453 - DNA, 409 bp, Triticum aestivum
  unsure (1)..(409): unsure at all n locations
  Clone ID: PAT_TA_25453
gcgacagcgtcaacaacagctgcacccgacacacgacatacacacgaccagaaccaccacagtacacgaagacaatcatgcagatcttcgtcaagaccctcaccggcaagaccatcacccttgaggtggagtcctccgacaccatcgacaacgtgaagagcaagatccaggacaaggaggggtattcccccagaccagcnaacgcttgattcttcgccggcaagcaccttgaggatggtcccaccctgtccgactacaacatccagaanggattcgacccttcacctcgtcctccgccttcgtgggggtatgcagatcttccgcaagactccgacccgcgagaccctttcgcccctagtcgccccgtccgccgccattgacaacgtcaagtcgaagatcaagacaaagg

SEQ ID NO: 25454 - DNA, 434 bp, Triticum aestivum
  unsure (1)..(434): unsure at all n locations
  Clone ID: PAT_TA_25454
gcagcagcttcaaccctcgccgcccaggttcccccgagactccatttcgataccccaattactacctttgctctacgccaccatgagagaagtcatcagtctgaacgtcggccaggccggttgccagatcgcaaactcttgctgggagctctactgcctcgagcacggcatccaagcccgatggtttcctcaccgaggagcgcaaggccctgaacgacgaccacggcttcagcaccttcttctccgagacgggccagggcaagtatgtcccccgtaccatctacgccgatcttgaagcccaacgtcgtcgacgaggtccgcaccggcccttaccgctccctcttccaccccgagcagatgatcacaggcaaggagggatgcctcgaacaactacgcccggtggtcactaacaaccgtcggaaaggggcgcctcn

SEQ ID NO: 25455 - DNA, 521 bp, Triticum aestivum
  unsure (1)..(521): unsure at all n locations
  Clone ID: PAT_TA_25455
gcaccaattgttgctgcacaggtcccggagtcccatcacaacaccaaaccgccaacatgattgaggaagtcttgaagaagacctcggagatgttcccgctgcctaccgcgacggcttcgttgctgccttcggtagctcctatccccaccgttgctcccggacctgagcctacctacgaggttgccggcgatgctggaatgaagaccctctgggtcgtcttcgttctcatgctcatcgcctctgccggtttcaccgtcatgtcctggaaggtgcctttgaacaagcgcctctaccatgtcattaccaccatcatcaccctcaccgctgccctctcttacttcgccatggcctccggcgctggtgtctcgctcaagaaggaggtcgagcgtgagcagcacgaccatgttcccgacaactaaaacgtttgtccaacgncaagtctaatgggcccgtttacgttgaatgggacaacaacaatcctcccctggtcctccatttccggccnccttgctgggnaatgt

SEQ ID NO: 25456 - DNA, 526 bp, Triticum aestivum
  unsure (1)..(526): unsure at all n locations
  Clone ID: PAT_TA_25456
ggacaacccctcccctccccttctttcccacggccgcggtcggatccgcgctcgtcccttccacatcgcagccgccacctccttccttccagatcgtggccgccacctccctcccgcggagctccccgccgtccatggcctcccccaggccctcctctctcccttcccctccctcgcgccgccaccaccaccaccgcgaccgtggaggagtacgaggcgcctccgctcaggctcctccgaccatataagcgggctaagtgctcccccctctcgccttcgtcttcttccctcgctgtccgctgccatcgggatctgccgacggaatggaggcggtagacaacaccagttctatgcaggcggtgattcgatggatgcttcagaccatccttccgagcctcggcaaagctggacgggtggattcnccaagcaagggcctnccggcaagtggaagggctganggaacaaatttancaaatcnaccgggncctntctggcgtnaaacggaangggggccnaaaaaggtngg

SEQ ID NO: 25457 - DNA, 498 bp, Triticum aestivum
  unsure (1)..(498): unsure at all n locations
  Clone ID: PAT_TA_25457
cgacaacgcgcgactggtcttgttctccccaccgtaccatactcagagacgttgagacaagatgctcgatatcaacgacttcatcaaggagcgcggcggcgacccggaaaaaatccgcgagtcccagaagaagcgatgcgcccccgtagaaattgtggacgaaagtcattgccgactttgaagaccaccgccgcacgcaatatgacgcaacacagatgggctccaagatcaacgccgtacaaaagcaaatcggagccaagaagaaggccaaagagagcgccgatgacctgctggaggagaagaagcaagctcgaggagtccaagaagaagcaggaagccgaggccgctgcaaagctcctcaagctgcaggccaaggctaagacgggtgggaactatgtctacaagggcgttccggttagcgacaatgaggacaataacgncgttttgaaaacattggctcctgagacaccggaaagcttagtttaaacnagaccggat

SEQ ID NO: 25458 - DNA, 516 bp, Triticum aestivum
  unsure (1)..(516): unsure at all n locations
  Clone ID: PAT_TA_25458
gcactactccacttcatacacgctgtcggcgttggtgtgtaacttgacctcaccctccagctccggtcccgacagtaccatcatgctcacacgccgtgtttgtgccagtgtgcgcggcatcctctccccgccgtgtgccaccgccgtccgctctcaggccttcagtgctggcgctccaacacaaagcccggctagagctcctaccctcgctgacatcacacccgatagtgctgccagcttcaacgagaagcagaagagcttccgcgacggtctggtagctgctcagaagcgaaaggagcaggaagagaaagatgcccgcgcccgtgagcaagaaaacggcaagaagaagggcggtgcgctatcatctctcatctacggcacgcccgagggccgcgaactcgacaaggacattgagcgcagcttttctcaagtcttagctcgcggcaaatacgtccactccattgtattccacgangtactgcaagacaangtcnaagagtacaccgagttgggtgg

SEQ ID NO: 25459 - DNA, 546 bp, Triticum aestivum
  unsure (1)..(546): unsure at all n locations
  Clone ID: PAT_TA_25459
gacaaacaacaacactacaaatatgtctgaagacgttcaagctttagttattgacaacggttccggtatggtcaaagccggatttgccggagatgacgctcctcgtgccgtcttcccttccatcgtcggtcgtcctcgtcacaccggtgtcatggtcggtatgggccaaaaggactcttatgttggtgatgaagcccaatccaagcgtggtatcttgactttgaagtaccccatcgagcacggtatcgttaccaactgggacgatatggagaagatctggcatcacaccttctacaacgagctccgtgttgcccctgaggaacaccccgtcttgctcactgaagcccccttgaaccccaaggccaacagagaaaagatgactcaaattatgttcgagaccttcaacacccccgccatgtacgtcgccattcaagccgtcgtgtccctctacgcttctgggcgtaccactggtatcgtcttggactctggtgatggtgtcacccacactgtccccatctacgaanggtatgcccntcctcacgccaa

SEQ ID NO: 25460 - DNA, 649 bp, Triticum aestivum
  unsure (1)..(649): unsure at all n locations
  Clone ID: PAT_TA_25460
gctcctgcggtcaacgatacagcaatagcacctttctaattatatctttatctcatcgacagccttcaagatgacgattcccgatgaggtcgacatcatcgtgtgtggaggtggttcttgtggttgtgtggttgctggacgtctggccaatctcgaccacaacctccaggtcctcttgattgagggtggagagaacaacctgaacaacccatgggtcttccgtccgggtatctacccgaggaacatgaagttggacagcaagactgccactttctactactctcgtccctcggagtgggctcgatggccgccgagctgttgtgcccgtcgccaacatcctcggaggtgggatcttccattaacttcatgatgtacactccgtgcctccgcttccgactacgacgatttccaagccaaggggttgggacgaaccaagggactcaatcccctttgatgaaagaaagcancgagacctaccaaacggttcctgccaanaaaccgcgacaatcaacgnttttgagggaaccaacaaaggtccnngtccggtaactacacctacccgnttaangggggacttctccgtgcancggatnncaangggatcccgacancgncggtttcaagaacttncaangggaanggngccgng

SEQ ID NO: 25461 - DNA, 497 bp, Triticum aestivum
  unsure (1)..(497): unsure at all n locations
  Clone ID: PAT_TA_25461
gcatcttcacagctctcgctcccactcgcgtaagatggcaagcactcaggacgtgaacatggacggcagcctcaccggctacgcaccgttcggctcgagcacgacgacgctgtccgtgcacaacgaggaggagacggccatcactgtggccgtgggtggcaacgagcccagcggccggtacatcctggtgggcggggcgcgccgtcgagaaggacggcgtgcgcctgccgatcccggtgggcgtcctcaaagcctgggatcacgtaccgcgttggcgggtggatcaagcctgggagcagcacggggcaccaaccaaccccgtgcgcatccaccttgacgttggacgacaatggcaacgaagaccctgggtggagtgccgcgccctttgcccccaaagaagggcgccgtgggcccggagatctggggcgccctcccccgcgtcgagccccgacggccccaacgccgctgttttacatccaacggngcccccttgccgg

SEQ ID NO: 25462 - DNA, 529 bp, Triticum aestivum
  unsure (1)..(529): unsure at all n locations
  Clone ID: PAT_TA_25462
cgtcggtatagagatgagagcaccgatggggagatcgccgtcgtcgcccgtgctctccctggtgtgggctgctgctgccctgctgctgaatgccgctctcctggtgcagtcggtcccttacgactactcgtcaagctccgagtgcttggctgagccgctggaggctcactacggcggcggcgtgatcgtcaactcggacttcagcgccggcctccagggctggtcggccttcgggtacggcagcgtcaccgagggcgcgtccccgacggggaacaagtaccccgtcccggcgaaacccggacgncggccgttaccagagcgtcaagccagaaggggttcctgcagaacgacaacgcactacaaccctctcagacttggttgcaggttagcgaaccggagcgccgacctgtttgccccctcttgaaaacngccgnncaantttatcaaacccggggggggtnaaacccaatcccggttgttgnncaancccaaagggggggttaacnccnccctcccggccgggggaatt

SEQ ID NO: 25463 - DNA, 445 bp, Triticum aestivum
  unsure (1)..(445): unsure at all n locations
  Clone ID: PAT_TA_25463
gctttcccctcaacccccacctaaccgccggcggccgccatgatggccgccgagtccccggcgacggcgaaccaccccgccgaccaacacctcgagaccctcgccctcgattccccatctgccgcatcggccgctgcttctaccgacccactgctccaccctcctccctccccctcgcccccctccgctcgcgccgcggccgcgaacggcgacccgttcgtcgaagagaacggtgaggatgaatcccctccgatcctccccaccccccgactccccggtcgtttcccgcgagccgtcaacgttgtcctaccaagattaccgtcaccgaacccaagaagcacgattagggccgccaaccggagccggggggcgttatccctgggctccggggagctaatttntcctaacctcgtcaacaacccggggccgncgaanggnaancaat

SEQ ID NO: 25464 - DNA, 463 bp, Triticum aestivum
  unsure (1)..(463): unsure at all n locations
  Clone ID: PAT_TA_25464
gcagcagcaagtgtggtgtcgtgtcgccttgacaaatgccctgcttgccgtcccggctccaaaagcacggggaaatggcttcttctgcaccggcggccgagagagcgcacgccgtgtgcctgccggcggccgcgcaggggcacatcatcccgatgctggacgtggccaagatgctccacgcccgcggcttccacgtcaccttcgtcaacaccgagtacaaccacgcccgcctcgtccgctcccgcggccccgccgcggtggccggcgccccggggcttccgcttcgccaccatcccgggacggcctgccgccgtccgaacgaacgccgacgtcaacgcaaggacatcaacgttgcctgtggcaaagtccaaccaccgggagaacctggcctccggggccctttccgcccccctcnatccgccggaccttcaagggngagggngggncccgccccggngncant

SEQ ID NO: 25465 - DNA, 449 bp, Triticum aestivum
  Clone ID: PAT_TA_25465
gctgctcatggtctaccagacgctgttcgtgcgcgagcacaaccgcatgtgcggcgtgctgcgcggcaagtatcccgagtggaacgtggagcagctgttccagacggcgcgcatcgtcatgggcgccaagatgaacatgatcggcgcggcctacttcaaggcctacttcatcgacgtgccgtggcccgacgacccgacggcgatcatgcgcagctggacgggcaagaccgtgctcgagatcaacccgctcaccatgtcctacccgtggaagatgctgctcaaccccaagacgggcgacccctactcgctgcccaacgaagttcagcgtgggctaacgctggcacgacctcatcccgggcgtcgctccaagatttacgaacaaaggagaacaaccccgaacgaacgcttgggtcaaacctggccccgagaacgggccttcaaacggcgaa

SEQ ID NO: 25466 - DNA, 424 bp, Triticum aestivum
  unsure (1)..(424): unsure at all n locations
  Clone ID: PAT_TA_25466
gcctacaggtgcatagctctcccagaggccatggcgtcgccgctctccgccccttctttgatcatggaggaggaagggcggttcgaggcggaggtggccgaggtgggggcgtggtggaacacggagaggttccggctgaccaagcgcccctacaccgtccgcgacgtggtcctcctccgcggcacgctccgccagagctacgcctccggcgaaatggccaagaagctctggcgcacgctcaaggcccacccangccgccggcacggcctcgcgcacgttcggcgtcgctcgaccccggtgcaggtggaccatgaatggccanagcatctggacaccatctaacgtgtccgggggggcaggttccctcccaacgcacacctccaccaacgagcccgggggccggganctccgccggactnaccct

SEQ ID NO: 25467 - DNA, 448 bp, Triticum aestivum
  Clone ID: PAT_TA_25467
gaaccagtcaaccagagaggagagcgcgtcgcgtcgcgtcgcgcgcacgagcaggcgccggaaacatggccacggcggcgcacgcgagacggctgggggcctcgcgcgacgatccgtcggccgccccgacgtcggggaggtcccagttcgacctctcgtcgggggcggccaccgccgtggtgttcctctccatcatcctctgcttcatcctgctctgcacctactgccgctgcgctcggcagcgcgccatggcggccgcgcgcggcggccgcgccatgcgccacggcttcccgagcgccctcctccgcccggccgacggcgcggcgctccccgtggtgcgctatgccgaacgccggcgccccggcgccaaagaaggggcaagcaaccccgaggggggactggcccccgtctgcccccgaggccccccgcgggcgaacgaacgatgggt

SEQ ID NO: 25468 - DNA, 447 bp, Triticum aestivum
  unsure (1)..(447): unsure at all n locations
  Clone ID: PAT_TA_25468
gcatggattgatcccacacagagccgcagagcagcttcctgcccccttccgcagctcagatgccgacgacgccgacgggccgccgcccgcccccggccgccgtcctcctccattgctgctgcctcatcttgctctgctgctgctgcctcttcccggcctgccgcgccttcccgctctgcaccgacgccagggcgccgctgccgctcaacgggacgctcgccttctgcggcaacgcccccggcgccacctgctgcgacgccgccgccgacaaggccctgcgggaccaagctccgaagccgccaacgtctccgacgccgcaatgcgcccgcccgtcctcaagttcctcctctggcggcgaaatggcaatcccctattctggctgagctgttccaacgccggggccgaaagtcgcgtccttcccgtccctngttgcaaactcaanncttc

SEQ ID NO: 25469 - DNA, 442 bp, Triticum aestivum
  Clone ID: PAT_TA_25469
gctccatactacacctacaccttttcacaatcccaatttctgaattctacaatccaacacatacccataccccaacaaacaccaactacaatcgcaaacatggttcaagcttccgaggttctcaagggaaagactggtgtcatctacggtgacgatgtctacaacctcttcaagcacgcacaatccgagggatacgccatccccgcgatcaacgtgacttcctcctccaccgttgtcgcatccctcgaggctgcccgcgatgccaagtcccccatcatcctccagatgagccagggtggtgccgcatacttcgccggaaagggcgtcgacaacaaggaccaagaagcgcttccatccagggaagccatccgccggtgctcactacatcccgcgcaatttgcgcccgcatacgggtatccccgttggttctccaaaaccgacc

SEQ ID NO: 25470 - DNA, 457 bp, Triticum aestivum
  unsure (1)..(457): unsure at all n locations
  Clone ID: PAT_TA_25470
gcttttggcgagaacagacacgacactcctacccacatggagcgcaattctcattgaaccctccgagcttttgtctttgtttcgacaccctcgctgatctgcgcattccactgttttgtcactaaatcaggctccacgctgcgactgcagccgtacctttacggactggcctttttctagtttggtcattcaacaacgagatatatcatcatactcgatatgtccgtcgacacgaagttacctgaccactcaggtcaacaatatcatncgaccaagttgcatgggaatcntttgatgctattgggcgttgccgnaaccaatgaagagaagaagactccgcggaaaacaagaagctcctccgcaagccctgtcaagatacatttgaaacaagccatctaacgcatcgtcaactaaccggaaaaaagagggacatgaattgcagaaagccggaacaact

SEQ ID NO: 25471 - DNA, 439 bp, Triticum aestivum
  unsure (1)..(439): unsure at all n locations
  Clone ID: PAT_TA_25471
ggctggagacgccactcctggcagtcagcagccagccgagccgcggctgcgccccaggagcacgcacgcgagagaccatcgaccaccgccttcacgcgcccgctaaccgcagctctccccgccgcgagacccaggatcgagcgcccagatccggtcacgcagccaccaagctccccaaggcgcagccttccacctccacgccggcgacagcaggaggcgcatcgcgcgccccggcctccgcaagcgtctcccggncgccgctccaggcccaggccaagatccgccgccgagattcctccgcgccacaccctccgacaccgcgccgggcgccctgagaaagctgccgcccctcacctccaagaacgtggctcttcctctcccantgctccccgccgtgcgccgccaatccgggagaaatccaacggnggcggccggcttt

SEQ ID NO: 25472 - DNA, 461 bp, Triticum aestivum
  unsure (1)..(461): unsure at all n locations
  Clone ID: PAT_TA_25472
gaaatggcaggagaaatggcgatggagaagcgtcggcgtcgccacgcgccaccggcggtcgcctcctcctcttcgacccccgccgaggcctccggccacacgccgtcccctccgccggacctcctcccggacatcgcccgtcgcctcacctccctggaggacttcttttccctccgcgcctcctgccgcgactaccgcgccctcctcccggcgtcccgcccccacctcgcctcccaggccccgctcctcctcgtctccctctacccctcccttcgcccgagggcgctcttccaacccccgccctccgccgcctccaacggcttccggcctcccctggggggcaaccaacttgccccccctcccggcctcaacccttcctctaaggcccaaggggtttcttcgtnaancggccanacaacggnggggcgngcccaagtnccccccccaaaggctcctccctg

SEQ ID NO: 25473 - DNA, 441 bp, Triticum aestivum
  Clone ID: PAT_TA_25473
gcttcgctccaaaccagctgttcccttccagacttcgatacgcagagctcctagaagttgttacggtcctttgtggagacactatagtactcaaaccaacatgtctgacctcttcgttgagcttactgcgccgaatggtcgcaagtaccagcagccaaggggtctcttcatcaacaatgaattcgtcaagtccaagtcgggcgagaccattacttcgatcaacccgagtgatgagagcgagatcgtctctgtctatgccgctggacccgaagatgtggacgatgccgtagcagctgcgcggaaagcgttcaaagaacccggactggcgagacatggacaccaatgctcgaagctgaccttctcctacaaagtttgcacaagctgattgaaggagcacaagggaaacactagccaccatccgagacaatggggacaaacggg

SEQ ID NO: 25474 - DNA, 449 bp, Triticum aestivum
  unsure (1)..(449): unsure at all n locations
  Clone ID: PAT_TA_25474
gagcgagctgtcgatcacacggctacggcggcctacggcttagcctttccctccgactttacctaaagaattagagaggttgatgccattgttcgattctctcgccttcctttctccttctcccggcgccttttctgcccgtcttttccttgcccacattcctcgcctcgcctcgcctcgtggcggcgtggcctatctcctctgctccgcttgctactaagtactagcctgtaccgtcggcagcaaagggttattcaagttgctcattttctccgtgatccgtagccgcctcctctctctctctccgtcctccattgctcttggctgccgacatgcgccttcttcctgtcgccaaacaatccaagaaaagcttctggctcctctccccatatgctgccgccctcccggggggcgggggggcccgggagggaancccgaagcccaacaan

SEQ ID NO: 25475 - DNA, 428 bp, Triticum aestivum
  unsure (1)..(428): unsure at all n locations
  Clone ID: PAT_TA_25475
gcttagcttcctccagcgagagcttacccagccgccggtcgcgagggcaggtcactcaccaccagctagttttcagcgtgtcagctgctccggcgatcgccggagagggagagtcagtccccggaatccggtgagttcccgatcccggcccctggtgcgggaaagctctgaatcaagcaccgggaaacgttggatctggtgtgattcctcggagctcctggactgggacaggcacgctgcgagcttggcttcgcggtgaactggggggggccgccgcccccctcgctaccgggtaattgccaaatggganattggggggcggccgccggtgggcaaattgtgaaccgccgaagcttcancccggagcaagtccggcgccggctcaananccgaaggggcgggcgttagggaagcccccgttttctcgt

SEQ ID NO: 25476 - DNA, 463 bp, Triticum aestivum
  unsure (1)..(463): unsure at all n locations
  Clone ID: PAT_TA_25476
cgccaccaccaaggcacagaccacagaggtagctagctagtggagtggtggacgccccgccgcgcgcacgggcagcaagcatgggccctgcggcggtcatcgtgctgatcatcctctgcgccgccgccgccgccgaggcccgcgtcccggccggccacctcgcgaccaggcggcgcgacagtgttcccgcgggcgtgggcgcgtgcgcgctggccgtggcccccttcggctacccctgcgaagagcacacggtgacgacggtggacgggtacatcctgagcctgcaaaggataccgagggggcggcgccccaagcggcggcnggcgcggggcaaccggttgctttctgcaacaatggcgttctcacgggacgggatgaaatgggctgctgaagctcccccggaaggaaatcgtttggcgttanaatcctccccgggcagccgggccctcancttgtggggtng

SEQ ID NO: 25477 - DNA, 324 bp, Triticum aestivum
  unsure (1)..(324): unsure at all n locations
  Clone ID: PAT_TA_25477
gcctagttgtggtgtagccatccgaccctgttcgtgcccggacacacgcagagctagcggcacagcggcatcgccattgatggagagcaggcgctccgtgcttctcttgttgctgctgctgctggtggcgacgctcatggtggcggcggcggcggcgttcctggaggacgacgtggttctcggcgccgtggcgaggctgggcaagggcgccaacgccagcgggcggggcggccccagctgcgacgtcgacgtcgacatctccgccgtcgttggcgggtcgtcgcgcgggtggaaggaggagatcgcggggatggncgggggcct

SEQ ID NO: 25478 - DNA, 442 bp, Triticum aestivum
  unsure (1)..(442): unsure at all n locations
  Clone ID: PAT_TA_25478
gccaatcctcaccatgcagaagttctcgaggctcggccgcctgggccagagccttgcttcgcgcaggcaattggccaccgtcagcgatgctcctctctctcgcaaggtcgagatgaccaactgggagaagggccactacatcaactacaagaagatgagcgagaacctgggcatagtccgctcgcgcctcaaccgccccctcacctttgccgagaagatcctctactcccacttgggcgacccccacggccaaggagattgagcgtggctccangctacctcaagctccgtcccgaccgtgtagcctgccaaggatgccaccggctcaaatggccatccttcagttcaatgtccgctgggctggccctccggttgctactcccaccaccgtccaatgcggaacaatcttttcgagggtcaaaggttggngggggaacnaagg

SEQ ID NO: 25479 - DNA, 460 bp, Triticum aestivum
  Clone ID: PAT_TA_25479
gtcctatggttaacaagtttgatgtcggcgtctgccgcatcaaactgctgttttaaatgggcaaactcgctagtccggctagccaccggagcttccatcacctgcacatagaggcagtatggttattacctgggaatatgatcctctgttcgtcgtcgtttccgacgacaaccagagtctcaggggctactatctacacagggcacacctagcatgtgcaggactatcatacattattttacgtacctcaaagcctgtcagtagactcataaaagcttcatgcaatctgctttcggcggacgagattctctccatcaccgtattcatcagcacacggtgttcatctgagatggccgctcgccccaccaactccctcagaacatctgatcgcacaccaaatggtgtcggactcttttgtccgctctcttcggcagccggacactgggagcttcgggggtca

SEQ ID NO: 25480 - DNA, 448 bp, Triticum aestivum
  unsure (1)..(448): unsure at all n locations
  Clone ID: PAT_TA_25480
gctttggcaatcatgatacaagcgagtgttcaatcaagcctcacaggctatgctttctctcttcgtccctagcattgcctttagtatcatcggtgccattcttgtttttgccgttcgccttctgaggaacgacccaaagaagggcaactacaaaccactgccgggtccgaaaggtttgccatggatcggacctatccacaagtttccttctcaagcatgtctacaagaagtttgctgaatggcatgaacaatatggcccaatctaccaagttcactctcttcggagtgacccatatccgcattaacaagcgagaagatggcccaagatattcttgcaaagcgtggggcacactacccgaaccgtgcgcctacacccaatattccaagcgccaaagtccacgcgggatatctccccccttctgggcaacaatgaggnacnttacgaaan

SEQ ID NO: 25481 - DNA, 465 bp, Triticum aestivum
  unsure (1)..(465): unsure at all n locations
  Clone ID: PAT_TA_25481
cgacggacgacgacgcgatgagcgacgcgagctcggacctgttcgacctggagagctttgcagcgtcatcgtcgtacccgaccacgtaccgtggtcgcagtagccggcgcaactcgggggacgacgacttggcgtacgccgccgccgccgccgaggagccagcgctgagcgagtgcatgtacgcgccaagcgaggcgagcgtggtgtggagcgtggccacggctgagggcgtcgcctacgacgccggcagcgtggccaacttctcgagcgcggtaccacaaccgccgcgtccacatgccggtgcgggacgtgatcgatgcgcgccctcccccgtctggcgcctattactattaacctatacgaaaagtacaagtacggtacataattctcttgtttgttccaagttacgttcaaaggtgtccgtttggcaacgtacaacntgcgcccctggcgtgcatgactatn

SEQ ID NO: 25482 - DNA, 470 bp, Triticum aestivum
  unsure (1)..(470): unsure at all n locations
  Clone ID: PAT_TA_25482
ggcgttggcaacttgaactggcaccgtaaccagactgttactgcgcagcctgctttccaggagcctctctacgacccccaggagctttcaggcatcgtcggtaccaatctgcgccgtcaaatccccatccacgagatcattgcacgtatcgtcgatggatcttctttcgacgaattcaagccattgtacggctctacactggtcactgggttcgcaaagatatacggtcaccccgtgggtatcgtagccaacaacggcattctcttcagcgaagaactcgctcaaggggcgcgcactttgtacaagctatgcggcaaagcgacacatcccccctcaatcttcctccaaaaacatctcaaaggattcatgggtccggccaagaacgcccgaaaaaaggggcggcaattgcaaagaaacgggcgcaaagcgcgccgctaccggagccgttgaggctgcgttanacgttaccc

SEQ ID NO: 25483 - DNA, 463 bp, Triticum aestivum
  unsure (1)..(463): unsure at all n locations
  Clone ID: PAT_TA_25483
cgccaattgccatctttaagaagtcaaatcgaaatttgccatcatgggtttcatgctcaagcccccgccagacacagctggtaaggcatggcctgccattgtaatcggtctcttcgtcgcctttggtggtgttctcttcggatatgacacaggtaccatttctggcatcattgccatggactactggaagaaggaattctccaccgaaccagatctcagtatcacagcagctcaggactctctgatcgtctccattctctcagctggtaccttcttcggtgctttgacggctgcgccatttggtgatctacttggccgccgcctcggtttgatggtttctgccggtgtcgtcttcaaacctcgggtgtcattctgcagaacgggccgcaaacaagcgcaaccaattggttcaattgccggtccaattcttcccccggttatggggtgggtcgccactcanctc

SEQ ID NO: 25484 - DNA, 449 bp, Triticum aestivum
  Clone ID: PAT_TA_25484
gcttcactcttctctcgctattctcttcgaacgacacctggtgtgctatacaccagcgtctggtctagggtcaagcttgtggtttgatcgttctgtctgtcgattcatactcccaccgacacggtagcatcccccgatctacccgacatcatggcagctccatccaccggcgcgaagtttattcgcatgatcgtcaagaacgactccatcaaatccgaccctcacgagatctacggatggcgcgccttcgccatggcgggttccgcctgttttggtggcatgttgtttggtttcgatatcggaaccattgggaggtgtgcttgaatttgaagggagttccaggacaaatacaacatcaccaacctccgacaaagtccgcaaagccaaacctgaacgctaacaatcggcttccaacctccaaagccgggggggttccccggttgcttcat

SEQ ID NO: 25485 - DNA, 457 bp, Triticum aestivum
  Clone ID: PAT_TA_25485
gctggagtccacaaagtcgttgagcagaccgtgtgcgtcctgcttgagggagacattgagacttcctacaccaaagcagacaactctgtcgtggtcgcgaccgacacccaaaagcaaaccacctacatccttgcaaagcagaaccctatcgacccgccagagcaattcgccgccatcatcggcgaccacttcgttaagacctacccccacatccatgccgcccacgtaaagattgttcaagcaccgctggacgcgcatgaccattgacggaaaggaccacccacactccttcttccgcgacggcgaagagacgcgtgttgtccaatctgtcacgcgccagaacgagggcatttctatccgttctaaagatcgagaagctgctcctggctgaagagcacagggtctgcgctcctccgctgccgtcccgaccggcgatggaataaaaaaagggtggccc

SEQ ID NO: 25486 - DNA, 447 bp, Triticum aestivum
  Clone ID: PAT_TA_25486
gctccttttcatgctcatcaccaactcattgatcgtacttatctctggtgcgattcaggtttacgctgcaaccactacaaaaggcaactaccttgctcaagtctctcccacttttcccaaaatgaaagcagcaacaggtgttgtctcttcctacagttcaggtccatatgatactaagctcctctttatctactgcccaattgaagggataccccgagccttggtcatcccctgatacaactcatcctgaaattcaggctgcttacaaaaaagatcaactggtccaaagttcctaaagcaccaagtaagaaagcaaaattccaatggtgaatgggtatctaatactgacggtcccagtgatccttactggctggtggtccgatactccgtgttgttaagccaaagggttcttatttgcctcccgatattcatgaatgtccaaagaaa

SEQ ID NO: 25487 - DNA, 446 bp, Triticum aestivum
  Clone ID: PAT_TA_25487
ggtccagtcttccttccgccatctccggcaccttcaacatttccatcccctgcggcgtagactctgcacacacaatgccatcctgcaccatgcgtctttaagaaggcccgacgacgatacaccctccagcgccccggcctcgacaacccagtgtttcgtgcttatgcacagcccatatccttgaactgcgagtttgggcttgcattggctttggcttctgtagcaccataatccgagctggagtagcatccactcgctactcgccatggttccttttcgacgcttatcgcagaggggccgtcgcagcttcgacaaccgcgactcctacgaatggcaagaccagccgagacaaacgcatcatgacgggcaccttccccatacaccctctctcctctatgcaaggcgccctttgaggaagtcgatgctccacgccactggggaaaacg

SEQ ID NO: 25488 - DNA, 650 bp, Triticum aestivum
  unsure (1)..(650): unsure at all n locations
  Clone ID: PAT_TA_25488
ggaactttttttttttttttttttttttttttttttttttttttttttttttttcgtgcggccgcccgggcaggtactaccattcatctcgagtggcttaaggccgtgattccaagactcgcaatgaagacgtaaacctgatccggcctactggcctccattatgacaaacatgacatggccgctccaagagtccggatcgtatatcacctaggatatggcccagtaatcgtaacctcattccaagatacgtcatcttccggtactaaatcaggtcggccatgcatgtagcggcgttgcccatctcgntggagaaccctggagatggtngattccgtcccaaagaagaatgcaggctgtgccggtggctgaagctccatggtgtcccttgttaacatgaaaatgacggttgatatttgaggcctgtcatcagggtccggttggacacacagcagcccgatgtggacgcaccgtagcgcatggcttcgagggtatccattgagtgattcgtccatcatttgtgatattgttccttttgtccagtaattccacacatcactaatgagattcacggtatccccataatccgaactgcagttccttctcctggttataatttccaggactagtacctcggccgcgaccacgcta

SEQ ID NO: 25489 - DNA, 1113 bp, Triticum aestivum
  Clone ID: PAT_TA_25489
gccggccggtctgggggagccacggctatagctcaagcacagaaaaactgtcacaaaaccccacctatgcacatggaggcttgtgcgggcgacaagcacggagaaacagaaacatctggtgcacggcgcatgcgtcggcggctgggcctggttcaaggtggccacgcggctcagggaggccggccaccgcgtcagcacgcctgacctcgcggcgtcgggcgtcgaccccaggccgctgcgcgaggtgccgacgttctgcgactacaccaagccgctgctggacctcctgcgagtccctcccgcccggcgagaaggtggtgctcgtcggccacagcctcggcggcgtgaacatcgccctcgcctgcgagctgttccccgagaaggtcgccgctgcggtgttcctctccgccttcatgccggaccacaggtcgccgccggcgtacgtgctcgaaaagttcgtggaggggggaacgcttgactggatggacacagagtttaagcctcaagatcccgagggcaagctgcctactgccatgcagttcgggccgctggtcacccgagcaaagttcttccagctgtgctcgccggaggatctgatgctgggaagatctctgatgagggtcggttcgatgttcgtggacgacctgagactgcagccaccatacaccgaggctcgctacgggtcggtgcgcagggtgttcatcgtcctcaaggacgacaacgccatcgtagaggggttccaacggtggatggtgcagaactaccccgtcgacgaggtcaaggaaatcgacggcgcggaccacatggcgttgttctcgacgccggccgaggtagcgcactgcctcgccgacatcgctgtcaagtatgctgcctgacgcaccttgcttggtggtctatctctttacctttgatgatacggtctcgttgccggcattaatttgtgatttgtcagtgctgtctgtgtcctttccgacctttgttagtactcctattgatctatctaccgctcttgtcacctcatggttggaccgggtgtttcgtccctttcattatgtttccgaggcaacttttgttgttgtcgattgataggttttgagatgtttccgagacttt

SEQ ID NO: 25490 - DNA, 820 bp, Triticum aestivum
  Clone ID: PAT_TA_25490
ccccgcgcgcgtctccaccggtcacggcgaacggcgagctcccctccgaccaccgccgcgtgtctgggtaagcatggcgcgggcgctctcctcccgggcggcggcgaccctgtcccggcggctgggggcccggcccgcggcggccgtggcccgccgcgccaaccacacgcggcgcccgggcgcggggggcgcgatggtgctggagctggacgcggcgggggcgtcgccggcggccacggagggcgcgggcgcgctcaagcggcgcctcgaggaggccatcgacggcgccatggcccgcatgtccgagcccgagtgggcgcccttccggcccggcacctcctactacgcgccgccgcggcccgcgggggccgccctcggcctgctcgagctcgtcacccgcggcggcgggatcggggtgctcccgcccccgctctccgacgacgaggcccgcgccgtcgcctcctcctcccgcggatacccctgctccgcctacttcgtcgacggacgcttcccggatgaggaggtggagggattggtagaggatgcagatctagctgaagaggactgaactggaaccgctagtttcattgcactgggtgaagtgggggatcaagaaagacctgtctgttttatgtttttattattacctatctatgggtttctgctactgtacatatgtagaacacatgaattcatgccctttcatgaggaaataagaacttaactgaattcgtgtaaccttttcttgtcatgtgcaacactcatcaatattgagatcagtagtactgcgtttaccaactcttgtgctaaaaaaaaaaaa

SEQ ID NO: 25491 - DNA, 452 bp, Triticum aestivum
  unsure (1)..(452): unsure at all n locations
  Clone ID: PAT_TA_25491
gacaattcgaaaggcaactacctatgttttgactagaccgggaagggagttattatttactgttgtctcacaggatgagaagtacacagccaaggtctgtatagatgttattgttcaaaggcttggtgatgcgacagctgctggaatttacacattacttttcagcagcttcgagaagaaaatatccattgtcaacctctatgcattgccgctctgctttggctggcttctcattgcatttcatttgggaacggctccagacaaatcttgccaggcttcaggcagcgtcctggacccgtccctaagttccctcccaaacctgtgcctgcctccgaaaccttaggtatcgtggggcttcccgtcggctgccttcccaggtggctccgttcggcggtctgtgcctggctggtacttttcggcgggttcggctcccgacggcccttancttttnc

SEQ ID NO: 25492 - DNA, 887 bp, Triticum aestivum
  Clone ID: PAT_TA_25492
tcagagcagtcatcttttgattccttggatgatacagtagattcagagtctctatcagaaaaaagttcgtgaaaatgatgatgataaaatggcatctgaagaatcaattgctgagcctatcgagattaaagcaatgaactctgactgttaccggaagattgttttagagagtctaatggcccggaagctataagtgcaagtggttgcactttgacagagccagtatccacttgtcacgttgaaaacttcagctgtggctgggacgggttgcaagagttgctgcagttaattgatacgaaactgaatggacagcaaacggttgtgcagagaagctatggaccttttgatagaaaatggagacctagttctatggatgacgagaaggctgcagaacagtaggactgacgagattgaagtagtacacttggctgtccgtatcacaggaagaagtcaatatagctacacaggtactacagtgtaccttcgatagaagaccgctgtcttatcgttcatggtccaacgagcaacatatcctgtaagattttgcctatgaatccagtctactgtctgttacacagcagacagcagagtagaaaggtgaggaacgttgaagatggagaagttatggtcctgtaacatcactgcctgctgcttgccaatactagtagcgcatcatattccctgttctcctttgattcaaaggatttttataggaattttttctattatctttgttgtttgattcaaagggctgagatttttttttccttagaatccttttgtactgcatttcataggaactttaaggccctttgattcataggattgcaaaagcccaggaataggaaaaacataataagattgaaatggcatgtcccttggattcc

SEQ ID NO: 25493 - DNA, 459 bp, Triticum aestivum
  unsure (1)..(459): unsure at all n locations
  Clone ID: PAT_TA_25493
gagcatccgcagctattgattaacgtgactccttgccgcaaaaattcaactttcaattttattcttattctcaccgatcaaccgagggataaacttcaatcattatggcctctttgactaattcgcaagccagttgtcctgccagttccccgactggatcttggcaacatgcccttcgcgaacgagggcgatccagcagtggtattggcgaaggctgagaaagatagagaagctgggagctgctgctcaaatacatcaacttccctgtttgatatcccccganggagggtgagagaagcaagctgggtccaactaatcaagcaagcagngttttggaattanccgcaagctgggggctaatcctcaaaatgggtgggaccaacaacgtatgccaagtcctaacggtgccccaaagattgactcctaaagaatccccgagcaaaagccgtgtgggattnn

SEQ ID NO: 25494 - DNA, 960 bp, Triticum aestivum
  unsure (1)..(960): unsure at all n locations
  Clone ID: PAT_TA_25494
acaaagccgccgggtctcacccaccagcgccgcacgtgggtggtggtgccgcgaggagggttctcgaggcgtggaagctcggggtggtcaagtacggcgacgccctcaggctccaggagaggctcgtcgccgaccggagagccggcagggtcccggacctcgtgctctcgctgcagcatccgcctacctacaccctcggcaagcggcgcaccgaccacaacctgctcgtgccggagtcaagcctcgcgggcatcggcgccgagctctaccgcacggagcggggcggtgacgtcaccttccacgggccgcgccaggccgtgctctaccccatcctctcgctgcgggacattgggctaggcgcgcggaggtatgtcgaggggctcgagtccgccatgatcgaggtggcctctctgtacggcgtcaaggcgcggccggggggcgcctgcgagaccggcgtgtgggtcggggacaggaagattgggaccatcggggtcaggatctcgtcagggtttacctgccatggcctggccttcaacatcgaccctgatttggggtacttcaagcacatcgtgccctgcggcattgctgacaaggaggtcacgtcgctgcggcgggaggcggcagtggaactccctcctgacgaggtgatccatgagcagctcgtgcagagcttggcgacaaccttccgtttcagtgatgttaaagtcaaggatgattcagagtgtgcagacatgattagctcagctgcaactgggcaacactgatatgtattttgctctttgtacttttgtatactgggattttgcctcaacaccttgttataaacttttgggtttcaaaattttcctctgaaaaaaaaaaaaaaaaaaaaaaaaaaaaaaaaaaaaaaaaaaaaaaaaaaaaaaaaaanaaaaaaaaaaaaaaaaaaaaaaaaaaaaaaaaaaaaggggcgggccgttt

SEQ ID NO: 25495 - DNA, 471 bp, Triticum aestivum
  unsure (1)..(471): unsure at all n locations
  Clone ID: PAT_TA_25495
ggttacttttctcttttctattttcgtctcttttctaatccacccatagattggctggtccagtcgtccatatacaagaaaataaaaacagtaataaaattcaacaacacaacaatccttcttttctgaatatacaagagatatctgtgctctctttgaagaaatacgtttgttgatcaaatcgtgtttcttaatttttacactgcacttttggcctgagttttccctggtggatattcagagaaacacataattcccattcctgtgtctccgaccatataaccaattttctcgtcgaaaccaaagtcattccaagcaagagcaaaatgttcgccgcacgttcagccaagccaaagttgtctctcagcatttctggctgcgacaaacaccgccccgtccaagctcctgtccttggcgatcaacccggccccaagccaagggacaactggttccccgttanctctcaancca

SEQ ID NO: 25496 - DNA, 436 bp, Triticum aestivum
  unsure (1)..(436): unsure at all n locations
  Clone ID: PAT_TA_25496
gagcgattatcatattttaattgacggtggagtggactttctaccttgtccagcccaaacaacccggcaaaccactctgtctatatccaccaaaccccagaaaccgagaaaccaacaacatgcctggccctgaaagtaactgtccagtgtcggtgcccataatctcagagccgacggcctcgacagacggcacaaaaccgacatcatgcccaatgaaggcatggccacgcgccattcaccatattgaccggaaggacctgtatacaaatcttgaagaccggatacattacctgcacactttcctcgatttcagttccaatgacatcgaagccctcatcaagcggatccagatatatcaaagcattaatacccgccgtggtcaatatcgtatatcgcaagcttctccaatatgacatcacangaangagcgttccaa

SEQ ID NO: 25497 - DNA, 3673 bp, Triticum aestivum
  Clone ID: PAT_TA_25497
cttgtctcagccaccgccagggagcaggggatcgctcctggtcactcttccgggtgaagcagaccaggacagctctggggaggcactgttgtgcttccggacgctccagcgtttgacagctgctcctcttgagcatgggatgcgtccacccatttcaccaaagccagagtggggagctcttctcgatgagatggctgtggtgggaactgaagcatatcggtcaattgtcttccaagaaccacgcttcgtcgagtatttccgccttgcaacaccggagacagagtatggcaggatgaacataggaagcaggccatccaagagagagctaagtggtggcattgaatcactccgtgcaatcccatggatgtttgcatggacgccgacttggttgcacttcccggtctggctgggctttgttggcgccttcaagcatattctcattaagtacatcaggaacttaatacatgctccaagagatgtacaacgagttgtggttcttgaggatcaccatcgatcttgttgagatggtgttcgccaagggtaatcctggcattgctgccctgtataacaggctcctagtttcagaggggctgcagccactgggtgagaagctgagggccaactatgaggagacccagaagctgcttcttcaggttgctggacacaaggatcttcttgaaggtgatccctacctgaagcagcggctccgcctccgtgacgcgtacatcaccaccatgaatgtctgccaagcatacacattgaagaggatccgtgacccagactaccatgttgcgctgcgcccccatctgtccaaggaggtgatggacacgagcaagccggctgctgagctcgtgacgctgaatccggcgagtgagtacgcgccggggctggaggataccctcatcttgaccatgaagggcattgctgccggtctgcagaacaccggttagggcaaggggagatgccggattatcttctttttgtaccttgatgagatatttttccttctatcgagggctgtgggccttgcttgtatctcagcggatgttgctgcatctgcccctctacccagtgaggaataatgtcatttcgcaagtagtgtaacatttataaataaaggcaaacaatgataatttctaatctgtttgtcagtcgtacttggaacacttaacaatgtactggattgggtgtttatgcagtgaactgtttccagtgcgctgaatattagaattaattctaaaaaaaaaaaaaaaaaactcgagactagacctgcccgggcggccgctcgaagtcactggtgaattcccggctcccctcgccatctggctctcagccacccggctcctccggtggctctctccgcgtccctgggcagggggtcgtttcggggctgggctgtggggcgccgccctggtgcgccggggcccgcccgcgttgcgcagcgcccactcttgggcgccggcccgcccatgacagaggaagttgctgatgttatgggcgcgttccaggttattgctgagctgcccggtgacaattttggagcatatgtcatctcaatggcaacatctccttcagatgttcttgctgtggagctcctccaacgtgagtgccatatcaagacaccacttagagttgtccccctgtttgagaagttggccgtcctcccgcccgccccgccggcgctgccctggctcctctctttcgggtcgctctgtgcgtggggtgaccgtgttattgctgatggaacccttcttgatttcttgcgccaagtctctacctttggactttccctcgtgaagcttgacatcaggcaagagtctgacaggcacactgatgctctggatgcaatcacctcatacctgggaataggatcttatcgtgagtggtctgaggaacgccgtcaagaatggctgttgtctgaactcaatgggaagcgcccattatttggcgcagaccttcccatgacagaggaagttgctgatgttatgggcgcgttccaggttattgctgagctgcccggtgacaattttggagcatatgtcatctcaatggcaacatctccttcagatgttcttgctgtggagctcctccaacgtgagtgccatatcaagacaccacttagagttgtccccctgtttgagaagttggccgatctcgaggctgccccagcagcactggccagactcttctcaatagattggtacagagagaggatcaatggcaagcaggaggtcatgattgggtattcagactcaggcaaggatgcaggccgtctctcagcagcttggcagatgtacaaggctcaggaggacctcgtcaaggtcgctaagcaatttggagtgaaattgacgatgttccatggacgaggtgggactgttggaaggggtggtggccccactcatcttgctatcttgtctcagccaccggacacgatcaatggatcactccgggtcactgttcagggtgaagttatcgagcagagctttggggaagaacacttgtgcttcaggacgctccagcgtttcacagctgctactcttgagcatgggatgcgtccacccatttcaccaaagccagagtggcgagctcttcttgatgagatggctgtggtggcaactgaagaatatcggtcaattgtcttccaagaaccacgcttcgtcgagtatttccgccttgcaacaccggagacagagtatggcaggatgaatatagggagcaggccatccaagagaaagccaagtggtggcattgaatcactccgtgcaatcccatggatcttcgcatggacgcagacacggttccacctcccggtctggctgggctttggtggtgccttcaagcatatcctcaagaaggacatcaggaacttccacatgctccaggagatgtacaacgagtggccattcttcagggtcaccatcgatcttgttgagatggtgttcgccaagggtaatcctggcattgctgccttgtatgacaggctcctagtttcagaggggctacagccactgggtgagaagctgagggccaactatgaggagacccagaagctgcttcttcaggttgctgggcacaaggatcttcttgaaggtgatccctacctgaagcagcggctccgcctccgtgacgcgtacatcaccaccatgaacgtctgccaggcatacacattgaagaggatccgtgacccagactaccatgttgcgctgcgcccccatctgtccaaggaggtgatggacacgagcaagccggctgctgagctcgtgacgctgaacccggcgagtgagtacgcgccggggctggaggataccctcatcttgaccatgaagggcattgctgccggtctccagaacaccggttagggcaaggggagattgccggattatcttctttttgtaccttgatgagatattttccttttatcgagtgctgtgggccttgtatctcagcggatgttgctgcatctgcccctatatccagtgaggaataatggcatttcgcaagtagtataatatttataaataaaggcaaacaatgataatttctaaaaaaaaaaaaaaaaacaaaagcctcactcactcgcgcgttccctcgtcctccgccgcggccccgctttggataaatatgtggtggggaaagaaaaaaaaaaaaataaaaaaaaaaaaaaaaaaaaaaa

SEQ ID NO: 25498 - DNA, 3136 bp, Triticum aestivum
  Clone ID: PAT_TA_25498
cggccgcggcgcagccgcccgcctctatcctgtcctgagacgcacaccagccagcggagcagagcactgacttcaccgccgcagcggctcacccgaggaggcaccgccggcggctcgcgggcagcgccggcgccacccggtccgacggcgaccaagcccaggctcggccgccccgagggcccctgtcgcggccccgcagccgtcccctccgccggcgccgcccccgtgaccggcccccgcgccgtcggcaggcgggccgtgtcagctcaggccaggtggccctgtcggagcaaggcgataacggaccaaggcagatggagctctcggaggtgctatactagacaccgagttcccaagaacgcaaaagcatacgaggctgcaactctcagttcgtgcaaagcaaaagctgatgatgctccaaggaagaacgtgtacttttcaacacactattatgcgtcagagaagcacctgcatccagaggagacggacgtgaacatagtgcttccagaatggcaagatgagaggtccctactcgaagaaacgcccgatgaaaagcagacagagaagacaactgaaaagccagtggaccagataattgaaaggtcaattgaacagccagatgaaaagataaccgagacgccgagtgaagagccagctgaaaggatatctgaaaaaccagttgaagagccagctgaaaaggatgttgaggaacttgatgaaaagccagacgaaagcttctctgtttcgccaactgaggtgaagcaggatgaaactgcctcacttgttgatagaagcgttccagacccagaggaagatcatgtggagtctgcgtccgttgtcattcagtctggcatcagaacatacagcgcaaggcaagagctatcgaaccataaggatcttgtgaaactgcaagctgtgatacgcgggcatatagttaggcggcaggctgcagaatctttacaatgcttgcttgctattgttaaaactcaagggcttgtccgtactcatcaagcacaacaatcttcaggaaggtttcaggatactttggtccgttcttcaagtgagaaattgcttcacaatggatttgctctcaagctcatggacaacatgtcaacttccaaatccatgaacataagatgtgatgcttctgaaactgatgctacctggaaatggatggagaggtggacaactctgattctgccaaccactgaaggccacttgcttgagaatgcagaaaatagtgggttggtggttgaaaagatggaagaggatgctcaccatgaagaaaaggttgttcctttggactcagacatttctttccccaagttagtgcctgatgatgtggaggagacactaaggccttctgaatctagtgcctttgtggaagagacaccaaggtcatttgatttgagtggattggaggctcctgaatgtgtcccagaggaaacctctatgttggaaaccaaaggtgatcctgcaccagagttgatcgaaaaggtcgatgacgatgctgaacagttgaccgattcaaagacagagaatgttgtggagcagtctttggacttctctggccggcaatctacccaaactggtccatcaagggaacccagtcctgttcctgaaaaatctgaacaccccagtgaggatactatggatgcatataatcttgagcagtcaccggagatggaagctagaagcgcagcaagaaaggcctgcaatccagcatttgctgctgcacagatgaaattcgaagagctgacttcggcagtcagtaggtccaacagttcatcttttctggatgcgccaagcaaatcgaaggtgcatactccccgttcactgggcggtacctcacccaagcaaaatattgaaacagtcgcaccaggaagcacagttggccatgatgctaaaatcatacctgctgcttcagaatgtgggactgagatttcaatttcatctacacttgactcaccagatagatcagaagctgatggtggtgagattgtaatggagatgggagctcttggaggtcggaactacgccagtgagaatgccgagaaagatacccatgttttacattctgaagtgaaggacacatccgaagaagtcgtccagccagagaaagaggaagaactgaatggtgatgttgctaaccctcccattgccacagatcctgtccttgagcaagcacatgttgaatcaggaaagccagatttgcatgaccaaatagaggagtctataggctcatatgccaagtcacctgagggaactcccatgagccgaaccacttttgcggaatctcaatgcacaccatcaagcgagatctctgtcaataccaacaagagcaagagcaagagcaaaaaatcaaagtctcatgcaagcagaaggtcgctgactagtccaagcagcaattcagtcggacgaagcagcacagataatctgtcaaaggattataagcatgcgaagagagagagctcaggcaaggttgccaagtctgacaacgctgatcaagaacctcgcatgagcaacagcactccattgccaagttacatgcagttcacagaatctgcaagagcaaaggcggctgctctatccccaaagttaagcccagatgtgcaagacaacaacccgaggaagaggcattctttgcccataacaaacggcaaaaatgaaacatctcctcgcatgcaacggtcatcttcccaagcccagcaaaatgtgaagagcagcgttgctgttcctcacaatccatctgataagaggtggaatatatgatggatggcagcacatcgacgaggtgccatcaaatatctagaagcactcatcccgcgcccttgttttctcgtcgcaggccctctaattcgtcagttgtttcttaatatttttttcttggaatgctgatggagaagagcagcagcttcatcatatatgtacatttgttggttgatcttattggttgtgttatttgactgatagtgctatttcttttgtgtgtaatacatatcctacttgacttgtattggaacgagcaacagcagtgtggatttgaaaaatgatgatctgttatatttgttgccggttgccactgatgtcgaatgaagttcatgttggtttggtcaaaaaaaaaaaaaaaaaaaaa

SEQ ID NO: 25499 - DNA, 811 bp, Triticum aestivum
  unsure (1)..(811): unsure at all n locations
  Clone ID: PAT_TA_25499
ggaaagcgtcatttatttgtgaacatagaagttcgagtctgcaacaatgaccaacacaacttgcaacatagtacaagtttgtttaacgaaaaaatacagtataaacacgcccggtttcgtaaaatttaaacacacaacagcacagccctctcaagcacaagcacaaccatgcaaaaaaaaggaaaagaaagaagcgcaagcacaacctcgttgtaggacgaacaagcagaacacaccataagcttcacacgatcaaacgtccgtcttgacatagaggtccaactttaaagacgggcggtgctcgacgtgggcgcccgagcttgctcatcaggctgtaccccctcngccagccggaacctgcccgtgccaccgaccacggcccgctccgccgccgccttcccgtccgggccgaagtcgacgcggccgcccagcaccagcgtgctgcccttatagcccccgttagtgaacaccacggtgaggagcgtggagaacaccccggagtcctgcaggtcggcctgcatgctgatcccctgggcgcggccaacgagctgcgacgccgcgttggacccttgacggagctcgtcgtcgaagacgctgagggtgccgtacgtggagttgcccccgagcggggaggccgtgacatggaccgcagtggcgttggcgccagagaatgtctcgtggatgtagaggcggaggtgcgtcatgccgtcgtccccggcgccggcagccagcgtcccggtggtggcagcgagaatggcggcgagaagatagaatatggttgccgtcatggtgatagctaatgatgcgagac

SEQ ID NO: 25500 - DNA, 643 bp, Triticum aestivum
  Clone ID: PAT_TA_25500
tgcttggcgacatcgtgcctcccggataagagatccacacgatctataatgaattatctccctactggctatatctgaactctgaagtcatgacatgtctcagatcagggaaggcggataaccaagcagctacccatagctagggtttccagctgattgatcgatgctctcctgcagaatcccttgagaccgagctggatcttgagcctattacagacgggtattgatcaaagacgatgcatggagtacaaccctttctcctgatgacaggatttgctattgattttgcactgcgcctcattattggacaggcccgtgcaattttcgatttcatggcaaaattttatgcctctctaattaacttcagccaatccgttttgtatacttgacccttggcatgtagcaatttgatagtagtagtagtatgtggtcttctcgccgaatagtattggattaacctaaacttttagattttgcacgctagctagcaactggacagggtcgatttgttgtcgatctatatagtatatgttttgcccaactcataagcagtgcagtaacggggtgatcatacagctagctcattcggaccacgctaatttattactcccaccaacttcgatctgattttttactgggtctc

SEQ ID NO: 25501 - DNA, 664 bp, Triticum aestivum
  Clone ID: PAT_TA_25501
cggcaaggccccctccgcgccttcgtcccgccgcggggtcgccggagccggcgggaagggcggcggtggcggcggtggcggcggcgaggcggcgcgccgcagcccctggatgaaggaggcggccatcgaggaggaggggctcctcatggaggccgacgacgacgccgacggccgcgccggcggcttctccgcgctccccaggaaggtgcgctacgggctgggcttcgtcgccgccttcctcgtgctcttcaccttcttcgccctcatcctctggggcgccagccgcaaccagaagcccgtcgtctccgtcaacagcgtgacgttccacaacttcgtgatccaggcggggacggacgcgtcgctggtgccgacggagatgtccacgatcaacgccacggtgaggctcacgttccgcaacacggggagcttcttcggcgtgcacgtcacggcgcagcccgtcacgctctactactcccatctttctttcttcttcctctcgttgcttgctgcatatgttatgttatgtaatgtgatgtaatgcgtggattactagtaccatttggacgggagaaagcggcgtgtccgttgtgaatggagtacagatgaattttgtcgcctgcatcgggatgaaatgaatgaatgatcacgcgttcttgccgcattt

SEQ ID NO: 25502 - DNA, 1101 bp, Triticum aestivum
  Clone ID: PAT_TA_25502
tcggcacgagggtcgacccgcttcacgacccgccgccgccgcccgccttcttcgccgcaggtggccaccacgccgtacacgctctccgccgtcaacacccaactcccagcctcctcttccaccttcttcggcgcagacacagggcttaggcttggttgggaggattgggggggagcagagcagaacgcgacagcggcggcgatggcaacggcgaggacggcccccgcgtccccgctggcctccgcgttctcgccggaggagacgaggagagccgtgtcccgcgtggcccaggccatcgccgaccgccgcgccgacctcgcgcgcgtccagggcttcttcgccgacaacgccgccctcgtcaacctcgtccagcgcctccccgacgagctctcccaccaaatcatggtcccctttggtggcgccgcctttttccctgggagcttgatccacaccaatgagctcctggtgcttctgggggatgggtactacgctgataggtctgcgaagcagacgaccgagatactgcacaggagggggatggagttggaggctcaaatggaggccatcaaggcaaccatctccgacctcgaggctgaggccaagttcttcgagtccaccgctgcggaggcttcggagggtcttgttgaaataagggaagaatatgatgaagaagacacagaaataatttcatcaaaaacagaggcttcaagttcttctgggggcatatcagatgaggaacatgctcggatgatggctaggtttgatgagcttgaaatgttagaaaaggaagctggaagtacttccgaagatgaaggtgatgatgacgacgacgatggtgacgatgaagatgctggaacaagtgaggatggtgaggaaaatggggaaacattaagttatggcaatgagcatgacaatgttagttttggtgcctcagtttctggaagtggtggtaatggccagagtcaaggaaatgcccagctgaagagtgcactaaagaagctaggagagaaggaaacactacaaggttcttctcttgcgccatcaggcagtacctccataacaaactctgaagttcaggcttcgcttagaaaagctgtttct

SEQ ID NO: 25503 - DNA, 451 bp, Triticum aestivum
  unsure (1)..(451): unsure at all n locations
  Clone ID: PAT_TA_25503
ggtatgtctgtccttgtcccccctcgccgtcgcgctcgtccgacctctcctcccccgtcgagcccccctcgccccgccgccgtcccagctggcccgcgcgcgcccacccccgtcatcttcgcgtcggctggctatgacgcccgctttccttatcagaaccagacaaagcactgctggcaaaactatgtagactaccacaagtgtatttctcgccaagggtgaaagacttccgtccatgcaaacagttcttcctcgcttaccgatctctctgccccaagtcctggaccgaccgatgggacgaccaagcgtgaggccggcaacttccctgctcgtcttgagtaaagagataaacaatcttgtcttgcatttaagatgcccaagtacgattcttctgtnctccactcaattcgataggncccgggggaattatgttccgtgtcgggggtcaagt

SEQ ID NO: 25504 - DNA, 795 bp, Triticum aestivum
  Clone ID: PAT_TA_25504
attcggcacgaggattgctcgcaccaagccagcagagagagagagcaaagcaagaaccgcacggcacggcacgacactctgccagtggagtgactgacatccatcgatcggcggcatgtcgacggcgtcggagcagccgccgccgccgcaccgggggctgtggagcctcggcgggacggtggagctcgtggcggcgttcacagcggtgtgcctcgcgctgtacggggcggtgctgtacctcaactatctgtacgtgcggtggagcgggcgggacggcgtgcgccggacggggcccggccccgaggccgggccggcgacggggaagagggacggcggaggagggctcgatgaggcggcgctggcggccatgccggtgttcaggttcaaggcggagccgcgcgggggcggcggaggcggcggcgaggagtgcgcggtgtgcctgggcgctatgcaggacggcgacgcggtgcgcgccctgcccgggtgcagccacgcgttccacgccgggtgcgtcgacgtctggctgggcgcgcacgccacctgccccgtctgccgcgctcgccctgctccggcagcgaaggacggctccaagacggcagagaccgccggacgggggccggacctggagagcacggtatagcatgcttgaggtacttatcttatggggtttgagtacagaatgtttgtgttagcttactccgattgggagtctgggaccgacaattttgtctcatggcttgtaaattgtaatcctacttgactttggtgatgataaataaagaagtctccaggatc

SEQ ID NO: 25505 - DNA, 599 bp, Triticum aestivum
  unsure (1)..(599): unsure at all n locations
  Clone ID: PAT_TA_25505
gaacgtccatctcactctccatctatctgactttagttattctttctccttaaacaactatcaccgcaatcatggttaccaaggttggcatcaacggtttcggccgtattggtcgtattgtcttccgcaatatcatcgagcacgaggacgccgaggttgtcgctgctcaacgaccctttcattgaaaccaagtatgctgcctacatgctcaagtatgacacccagcacggtcagttcaagggtaccatcgaggttgacggtaccgacctcgttgtcaacggcaagcgcgtcaagttctaccaaggagcgtgaccccgccaacatcaagtggtccgagactgggtggccgcttacattgtccgagtccaaccggtgtcttcaaccaccgtcgaagaaggcctctgctcaacttgaagggtggggccaagaagggttgtcatctctgctccttccgcagatgctcctatgtacgtcatgggtgtcaaccacaaggactacaagaagcgagaacaccatcatctccaacgcttcttgcaccaacaactgcttggctcctattgccaangtcgtcaacgacaactggggtctcgttgagggtc

SEQ ID NO: 25506 - DNA, 703 bp, Triticum aestivum
  unsure (1)..(703): unsure at all n locations
  Clone ID: PAT_TA_25506
atcaataagcgcggtgatggatgcccatctaagatattttaagcagggattcgagctactgagccaaatggaaccgttcattcaccaggttctaacatatgcgcagcaatcaaaagaaatggctatgaatgagcaagataaacttgcaaagagaattcaagagttcagaactcaagaagaaatagcaaacttgagaatggctagtaatgtaaacacatctacgagtggtgaatggcatacatgttgttggtcttcaatcctataaaaagattgaagccttaatgcagtcaactgccaatggccaggttgaaataattaaaacaaggttatctctttaagcgttctgaaaatctacgaggagaatggaagaggaggtattttgttcttgacagccatgggactctgtactactacgggaacaagggaaataaacaattgcaaggagtggcatcacagcaaactgctgaaccgactgggtgtatttagtcgcttcagattcttaaatccaaaaagcttcatcctcaagggggatgattcnccttcaantcgtacaattaatcccagaacntcaacaanttanatggntgctgaanaaaatgatttaagattttgctcagagtaatcacncccatgaggnataacttttangnggganagaggtgacaaaagggngggtcganaaatanaagggttttgaancctg

SEQ ID NO: 25507 - DNA, 424 bp, Triticum aestivum
  Clone ID: PAT_TA_25507
gcgagtatcaatatcgtcctacaaacaaacttagcaaccaagcttctttacaagaaattttatttcaaacccacccgcaaaccaatcaaaatgtctccttgctcctgcaactgctgcaaaggcgactgcaactcctgctcctgcggaagctgcagccactaaatggcagcgctcacttttcctcgacaatcgcctgattgcggaacgcttctcttttgtcaaacaacgatctcggtgatatctggacggaattgatggttggatatggatgcgggaagaatcggagtgggtagtcttttgtttgttcatttgtgaattgctgggggctgcgctgggggtttgtcttgaggggttctatcgttcgtcaatcaaatgttcaacggaacaagatctaagtcaaataaaagcccgagttccttaaggg

SEQ ID NO: 25508 - DNA, 448 bp, Triticum aestivum
  Clone ID: PAT_TA_25508
actctctaatccccctctgtgtgtgtgttcttttggcttgcaggtcaaaccctattggggatgtgatttccctgctccagattgaagtggttggcgttgggcgccgccgtgatgctggatggtgcaggtcagagctccagtgcgtgtccgtggagcagatccaccatgggtgcaggggaatggaaatgctactgagaagaagaagagagcttggtctggctatttggaagcagagtgaagagtgtgctacggtgaaaccttagccaggttactcctcctctctttctagtacctagctagttatggctgcccatccctgctgtacagtgtagtcatttgtggagtctctctattggctaggagttgcagcccatgcctagaccaactgttggtcaattgactactgatatctataatgcatgtgatggtggtggtcaatgtgtatccc

SEQ ID NO: 25509 - DNA, 929 bp, Triticum aestivum
  Clone ID: PAT_TA_25509
aataccatgccacgcagggctaaaagtctcaagtaggcttctcacatgttcgccaaattattacatctcctaacaccggagttccaactagaagtaccagatagatgatgataagatagttcctggattacatagctaggtcatagttacttattcatcccaacccccatatgtggcatccagatcgtacatagcactagatggatccacgtctaggtcccctgtgtagttgtagccatcaccattgctctcctcacttggtgcagtaggattctcatacaagctttgctctttcttcttttgccttctctgctgtttcttctagtgctgctcctacttccagatcccagtctagttggctaacttcttgttctagccttcctcctttgatctactatgatttctcaggtcaccatctctacttattgttcttggatctttgttggttgcagatagaaagactaagacagtgggaggaagacaagttgcaggtttggctatttggggaagaatggagatgtgtgaagtcttggcaatggcttgctctgctctctctccttttaatatcagaaaaccatcttccttggctggtatggcttcccatccccttctccattgttctcacaggtgctagcttgtaattggctgaaggttgaagcccatacatagactataatgttgaacaattgactattaatctattgtgcacgtgagagtggtggttagtgtgtctcaaatgtgtcatgttgtcctagttgactcaaagatattttgtgttggtctaagtttggtctggcattgttgtataggttaacatagtttggtcttcctatattttttttcaaagatttgtagtacacctgtacaactgtactgtttgaggtgtatggatataaatatatatatttgagtggttatgcttgttgaag

SEQ ID NO: 25510 - DNA, 1094 bp, Triticum aestivum
  Clone ID: PAT_TA_25510
agagatatgcaacatggaaatagctagagatggtctcttatattacaatatcatgccacgtggggctaaaagtctcaagtaggcttctcacatgttcgctagttccaacaacggtactagatatatagtgatgaaatagttcctggattacatagctagctcacaagtccttccgccgctgccggttttacctgctgctccgtctctacatgcccttcccctccctcgctctcccatgagtctcagccctgattttcttcaggattcagccccaatctctctcatcccctctcagttctgacttgcaggtgtggctctcctggggctgtcataccgctgctccaaatcgaggcagccgacaggtacttcttcatcccagcccccatatgtggcatccagatcgtacatagcactagatggatccacatctaggtcccctgtgtagttgtagccatcaccattgctctcctcacttggtccagtaggattctcatacaagctttgctctgagttatcgtattcagacccgaactcaatttgcttctgtcgcgtctccttctcctggtcgtcctcgcttcctttcttcttttgcctcctctgctgttcctactagtgttgctcctacttccagaccccagtccagtaggctaagttcttgctttagcctgtctccttagatctacaatgtgggtggaatacaagttgtcggtttttttttttggggtattgttggttgtaggtagagatatgcagacggttgggcagacatttcttttgttcttgatcagcggaccagcttccttggctggtatggttgacctttgccgttgtcgatgtttatacatgtgttagtgcctaatgccccgaaggcaaaagcccctccagtgtctcgcaggttgggcatttcactcggaatccattctgcacgtgaccgtcggggggggtgtgtctcgaacgtgcctggttctcctagttgactcaaagatattttgtgttggtctaagtttggtctggcattgttgtataggttaacatagtttggtcttcctatattttttttcaaagatttgtagtacacctgtacaactgtactg

SEQ ID NO: 25511 - DNA, 397 bp, Triticum aestivum
  unsure (1)..(397): unsure at all n locations
  Clone ID: PAT_TA_25511
gctgaatactgccacaatcagagatatcttctaccccaatatcaacaaacttcatctttcaaaatgggctccgaccatacctgcagctgtggcgcttcctgccaatgcccctctggtgcctgccagtgccctaaataaatgtcttcctagatccatctaggacgtgccatcgttaatctacattcctctcgtcattcgataatgcgaccaagagctcacgttctatgggttatgagaaatatgggacttttttgactttctttaaggaggacttccttttgttaagcattgcctcgtcgcagtctccagctgtcaactagacgactagcgatagggttgtttctgatttaatatgaattcttccctaacccggccaaaactngggnaacctcctttc

SEQ ID NO: 25512 - DNA, 586 bp, Triticum aestivum
  Clone ID: PAT_TA_25512
agcgagctatcaggactatgcattctacgtcttcgtgtcgatcatcttcaggataatcagcttgatgtgtccataatttttaataacctagaggtggattctttcgagaaaataaagatcttcgagattgcttgcagctccagctcgcatgttacttttggagagaaaacaatgaaaaaacttgagcagctgaaggtggactgctgcagtgggtcgtcactcttaggcctgaagcatttacctgaactcaagcaaattttgctcacgggttctagcggcgaagaactgaagatctccacacagaacttgcaaactacgcaaagcagaagtgtgaagctggacgaactacgctccttgtcctcgtagcttaaggtggtcaatagtttcgttttcttgttgcattatagtggtgtattaatatgttagtgaagaaaatcggtgtataaagtacatcgaaactgctattctagacgcacagcaatgatccggaatagcctctacaagcaatcttttagttagcacttagcactactgcatcgagaaatctttttacatgttttcagagactaaatagtagcacacatat

SEQ ID NO: 25513 - DNA, 1532 bp, Triticum aestivum
  unsure (1)..(1532): unsure at all n locations
  Clone ID: PAT_TA_25513
cccacctcccacaccgcatagacaccggcgacggcgacgcgatggcggcgtcggccctggcggcgtcggcggcggcgagccagtccatgaagaaccgcgagatcctcgacgccgtgggcaccaccgcggcggcgctctcgctcgccggctcctccttcatcgtgctctgctacctcctcttccgcgagctccgcaagttctcgttcaagctcgtctacttcctcgccgtcgcggatatgctttgcagcttattcactataatgggggggccagcaaatgcattctattgctttgcgcatgactacagtgcacatttcttctgtgtggcttcttttttatggacaaccactatagcattcactcttcatcgcacagttgtcaagcacaaaaccgatgttgaggagtttggattcattttccacttgtatgtatggggaacttcactagttacaactgtattacgttcaatagggggtgattatggaaggccagggacctggtgttggatccagcagggaagcacgggaaagattttacacttgattaccttttaccttccactttggggtgccattctctacaatgggtttacgtactatcaagtaaaccgcatgctgaacaatgcgacacggatggctgttggcatgagtgatcgatcaagtcaatctgacgtgagggcggacaagaaggcatttaaccggtggggttattaccctctgattttaatcggttcatgggctttcgcgacaatcaatcgcctgcatgactttgctaatcctggtcacaagatattttggctgtccatccttgatattggatttgctggacttatgggcctttttaattcgattgcttatggtctcaactcttcagtgcgcagagcaattgcagaaagaattgacatgtatctacccgagagaatcaaaaggagcctccctactttgtcaagattgagaagtcagcaagaaaatgagctgacctctcttattggtgagagtaataacactattacanggaacaacaatgcgagtaacacctaaggggttccctagctggctgagtttgttcatatccctcccgcgccccgtcttcagggcggtgggttagtgtggaccttctacttcacccccggggcgggcccttggctcttacccggcccatttggcataccggggggtccccggtacataagaggttgttttaggagatagccaacagtgggtagatacttaggtaagttggtgtggttgccgttattcttgccccaccctcatgttgtacttcttgagaactcgtctcatcggtttggcgaaactgactacggactgattgctcttgtatactagcactgttccatacagttcttaacccctttggggtatggtttccccttgttttctgcccaaaaagtacccttctgattggccataaaaaaaaaaaaaaaaaaaagtagcaaaatgaatagagagatttttaaaaaaaaaaaagattactaccccgttcttgcaacttaaaaacttttctattgggcc

SEQ ID NO: 25514 - DNA, 736 bp, Triticum aestivum
  Clone ID: PAT_TA_25514
ctttgatcgatggaatcctcttctccgaacaccaacatcagttggccaggaaaccacccatttcacaccatatggccgtaggccgccctcaccggaaggttgaagcaaatatttgtctgcactcaccacttatttgacagatgcagctagtgcgaagcgctcaagcaattgtttctgccttggtgccaaattggcccttggactacattctcatggctgagttatgagctctgtggatctgatgatcaggtcagaaagctcgtggaaaagctgcaggctcggtcaaaaccgagaggcttgaagctctgttgcggcttacattttattttcagatctggctcggtcatcatctgtcacagctgttgtaaaattactacagtgtaggtgaaggggtagagagcatttttgtctaatcttgggcatgtagggtcggtatctagtttggtgctctctcattgattattcatttggagaagcggcgatccttctcattgctaaattaacgttctgtataatcttttgacactttggtgcattgtattaaccgatgtgcacgcgtgtatatactgagaatctatgcccatgggcaatggcactaggttaggtagaagtagaagatggaaatgggaataggtgtagaacaatgttgctagatctgtcattaaagtgattgtatctgcttttcttccctcatttctgtcccataaattcgtcccgcgcaaaaagttacaagccc

SEQ ID NO: 25515 - DNA, 1009 bp, Triticum aestivum
  unsure (1)..(1009): unsure at all n locations
  Clone ID: PAT_TA_25515
accacacgcaccggccctcgtaattgcctcgatctccaatcataggccggctcgaggtgccgcgctattcaacggacctctccctttgtttactactcccgctcaaatcattcgcagttttctctcctcccctctgtttcgaagaatcagaccgagcctagcttcctagttgttgtgtggttgggcggtgctggtgcgttaatggcggttgacctcctcttcctcctcgcgcctttaaattgcgcgggaagaagcgccagtggtgagagcctcagataaccagtttgctgccccctccgttactgcctacctttgctccgattgagtctcgcctgggctctctgttccgcgttctgtttctgtctttgctcctgtcccttcttcttccctgacgcggcaatggcatcggagaagctcgtcgccaggaaaggcaggctcaggcagcgctacgacaacgagtaccgcctcgtcgccgggtgcgtcccgtaccgcgtggacaaagatgggcagctcgaggttctcatggtctccacagccaacagggacgatctcgtcttccccagggcccgctcggaggtcgaccaggtcgccgctgtgccggcgtcccgcctgccgctggtccagccccgagccaggcgctccgcccctagaaacccgctgggcttgtggggtgttcaggagcaagagcaggacagagcctgggccaagagcagcgacagcccgcggggcgcctgcaagggccacgtcttcgcgctggaggtcaccgaggagctcaagcaatggccggagcaggaaacccacggaaggcggtgggctctccccagcggacgccgtacgggctctggccggtacgactgggattgcgccgaggncgcttgacggcaattgctggaccctttggttcgacggcatcgtcgccgatccctgtagcggcggcggtggccgtgagcactgcggcgccggagctgaacgagcacgctggcatgtgcataagcatgatgctgatgaa

SEQ ID NO: 25516 - DNA, 757 bp, Triticum aestivum
  unsure (1)..(757): unsure at all n locations
  Clone ID: PAT_TA_25516
ggcaaaatcttggcgtggggagtacgaagaatcggagcttgcttggcatcgtcatggaggatccatccagcccgatctgggcggcaactcccagtgccagagacatggaggaaccatccaaccaccatgcccgatggatccgcagcagcaagtccgcatccccgcagagatctcgtgaatccgaggtacggtgggcgtggatggcgcgtcccgcggggctgcctgtcccgcgtccgactgtgtggtgggcctgcagcgccgccgcgcccagcccggcgccctcagctcgctgcccgccaggccgtccaggctggtacgacctaaccacgaccggtcccaaggactgtagcagccgctcgagagtcattttccaaaaatgtagcatccaaatttaatatataaaccttgctggagggttctcccatttaacaaccaccgcattactctggagtggacactttgcaaaatttgatgtgattgtccttctacggatccggtccgcgacgggctcccgtcgcccccgcccaatgcaccttccagccacgtcagctcactctccgtgcccccgctgccctgccgctggcggcggccgtgctgattgtgctggcaatttctgctagaataacatatggagtgattctcgtagtcccacctgccctatcactggtctgatctgcccatatcttgaacccagcaataacctcctgaaaccaagagcactccaaatctcctgtgcacctcgnnngcgaccacgcta

SEQ ID NO: 25517 - DNA, 1212 bp, Triticum aestivum
  Clone ID: PAT_TA_25517
ccacccccgccacccagcccgtcctcctccggtccggcctgtcgcctctccacatcgtcgacgagaaccgccgctcgccgctcgcagcccgccgctcgccgccgttaagttcaggctcctactttgatgcgccttggttgcgtgcgtatccactgacagtttcctcctaaggggatctgtttatcgcgatcacctgccgagttaagatcgagaggtaggaggagcttttgggggagtggggatggcttccggcgggaacccgcagttccggtacacccagcctccatcgaaggtgatacacgtgaggaacctgccgtgggagtgcaccgacgaggagctgaccgagctggggagcctcttcggcaaggtcgtcaacaccaagtgcaacgtcggcgccaacaggaaccaggcgttcatcgaattcgctgaccaaaatcaggcaattgctatgatatcatactatgcatcatcagcggagccagcacaggtaagaggcaagaatgtgtaccttcagtactccaatagacaggagattgtcaacagcaagaataccggggatgctgcaggcaatgttttgctagtgacaatggagggtgttctgccagatgctgtgagcatagatgttctacacttggtattttctgcttttggatatgttcacaagattgctacctttgaaaaggcatctggttatcaggcgttgatacaattttctgatgctgagaccgcgtcatctgcaaaagctgctctggatggcagatgcattcctagctacttgcttccagaacttgatgggtcctgcactttaagaatcaattattcagcacactctgttctaaatgtcaagtttcagagtcataggagtagggattatacaaacccataccttccccttgcaccttctgctattgatggatctggagtggcccaggatgggaagaaggaggagccagagagcaatgttctgcttgcgtcagttgagaatatgcagtatattgttacaattgatgctcttcacgaggtcttctctgcttttgggtttgtacaaaagattgctatttttgagaagaactctggcttccatgcactaatccagtatccagatattcaaactgcagttaaagcaagagaagcattagaaggacacagcatctatgaaggtggatattgcaagcttcacctcgcgttttcacgccatactgatcttaatgt

SEQ ID NO: 25518 - DNA, 490 bp, Triticum aestivum
  Clone ID: PAT_TA_25518
gccgcggctggcgaggggcaggtgccgcgcgtccacggcgcggccggccgcgtcggtgtcgctgctcgagcgcatccgtgacgtcgtgctccgcctcatcatgctcaccgcggtgtccaaggcctcggtgcagcgcagcagcagcagcaggacctcctcgccacgcgccggtgctgccggggccgtgacgtgccgccgggacgactccataaggaacgaggccgtcgaggagtgcatcgagttcctcaagcgctcgtcggccgagggcgaggcggtcaagctgtccagcgtcaccgccgaggcggttgccgctgccgttgcctcggagaacgatccggagccgaagcgcctgtccagctccagcgtcgtcgccgtggatgccgtggttgccggcgtcaaggacaccacacgttcggcctcgccgtccatcgtctgatgtagcgatcgaacaaatcaatctaggacacgaggatgaattggctcgttttgt

SEQ ID NO: 25519 - DNA, 702 bp, Triticum aestivum
  Clone ID: PAT_TA_25519
cggcgctcgtatccgtggccgccgccgccgccgccgtcgcgctgctgctggtgctcgccgccgagccgtcccgagcggagcggttcgtcgtcggcgacgcggcgcggtggacgtgggggtacaactacacggactgggtcatcaggaaggggcccttcttccagaacgacacccttgtgttcatgtacgacccgccgaacgcgacggtgcacgcgcacagcgtgtacctgatgcgcaccgccgcggactaccagtcgtgcaacctcaaggcggccaagctggtggccagcgtcacgcagggcgccggctccggcttcgagttcgtgctccggaagcgcaagcagcactacttcgtgtgcggcgagcgcggcggcatccactgcaccatgggccagatgaagttcgtcgtcaagcccaagagctctgcctgccgcgacgactgactgacacgccgccggacgccgatgtcggtgcgcgtacgtgtggcctcgatctcgtcctgtctttgttcgatctctgcatgccgccttctcagtcagatcattcctcctgtccaattgttgcgccctgcttgtaagttattattactatcagtcggtgtggatttactcagtgtgttgacgtatgattcgtgctgtctgatacaccagtgtttatggatgaaaaggttggttcaataaattagtgagtctttgttttctg

SEQ ID NO: 25520 - DNA, 898 bp, Triticum aestivum
  Clone ID: PAT_TA_25520
gccggccccgcgtccgccctcctccttaatctcgccttcattcctcctacccccccacatcgatcactccatcgtcatctctgtgcccgcatcgaaaagaggtagcaggatggccggcgccggtgccgcagcagcgatcagctcggagcagatgagcgagttccgggaggccttcgccttcttcgacaaggacggcgacggctgcatcacggcggaggagctgtccacggtcatccgctccctgggccagtccccgacgcccgaggagctgcgcgacatggtgcgcgacgtggacgccgacggcaacggcaccatcgagttcgccgagttcctggcgctcatgtcccgcaaggccgacgccgacgcggacgccgccgaccccgaggaggagctccgggaagccttcagggtgttcgacaaggaccacgacggccacatctccaaggccgagctgcgccacgtcatgatcagcctcggcgagaagctcaccgacgaggaggtcgacgggatgatccaggaggccgacctcgacggcgacggcctcgtcaacttcgacgagttcgtcaggatgatgatgctctccgacgccgaccagcagcagcagcagcagcattgagagtttgtccgagactaggaaatatagtccgtccgtccgtcgtccatttcttcggtggacggacggacacctctctaatccgcccggggattaagttagctaagctagccatgcatgtgtggatgaatggatcttgaattcttgattgattatttacaactgttattggaaaagctagagattaaataactaactaaagaaaagaaaaaactaactgaacgtggtgattctgttccgtcggcgccagcggtgcatataattaaataattttcaccagtgact

SEQ ID NO: 25521 - DNA, 938 bp, Triticum aestivum
  Clone ID: PAT_TA_25521
gaggaattcggcacgaggattttatgggatgcttgccccgtcgacccctcccccgcctctggcgcgcctgcccttgcggccctcatcagcgggagcgcgctcctcctggccgttgctggcgtctgccgcgccgccgtagcgccccctggcttggcggctcccaggccccgcgtccagaggccttcttccgccggaggcttgaggcgcctgcaggcctcccggggttgcgtggccgacggacacccgtggcggcggcgccctggcgccgctgcagtgggcccctggctcctgggccgaccgtgggcttgtggtggtcttggccccctctctgcggcgccggtggtggtgatgcggaatcttactgaggaggacgaattcctgatcatcggctgcgacgggatctgggatgtattccgcagccaaaatgcggtagactttgcacgcaggaggcttcaagagcacaatgaccctgtcgcctgctgtaaagagttggtcgatgaggccatcaagaggaagagcggcgacaacctttccgtagttgtcgtctgcttcaactccatagcgcctcctgtcttaacagctcccaggcctcgcgtgcagagaagtatatccgcagaaggcttgagggagctgcagggcttcctcgatagcttggcggactgatatgtgtggcttgggaaccctggcaacgctgtagtgatcccatttttccatagcctagcttggaatttaggtttagtatgtgccccatctcataacctgagattgttgttgttgagtaatgcatcactgtaacatattatgcggctaatttcatctgcacctggaggtacttgtttacttttttggaccctgctctagacttcacaagtttgaaaggttaacagagatttcggcggatttttcagtgatttttttggtgaaacctgtgttttgtg

SEQ ID NO: 25522 - DNA, 539 bp, Triticum aestivum
  Clone ID: PAT_TA_25522
gcgacgaccacgtcatcctcgtggccgaggaccccgccgcggctccggagcggcggatcctctccacggggtgcctcttcgtggagcgcaagttcctccgcggcggcggcaaggtggggcacgtggaggacgtggtggtcgacgccgccgcgcgcggccgggggctcgggctccgcgtcgtgcgccgcctcgtggagacggcgaaggacgccggctgctacaaggtcatcctggactgcaccccggagctgcgcgcctactacgccaaatgcggcttcgtggagaagggggttcgcgtggccgcggccgtcggacttctgatccatccatggggtaatgcgcaacagagactgcatttctttgtcccgtcgcatctacagtatccctttgtctgtggcaatctgttatcatatcattattctgaacttgtctgtgttagtgactgagaatgctatttatggaatcccaactttctcatgtggctgtatggctttggcctgtttctgctgcgttcataaaagaaaattccgtgctaaaaa

SEQ ID NO: 25523 - DNA, 411 bp, Triticum aestivum
  Clone ID: PAT_TA_25523
tagcgtggtcgcggccgaggtacctcgccgccgagcttctcgagctggccggaacgccgccaaggacaacaagaagtcccgcatcatcccgcgccacctgctgctcgccatccggaacgaccaggagctcggcaagctgctcgccggcgtcaccatcgcgcacggcggcgtgctgcccaacatcaaccccgtgctgctccccaagaagacggcggagaaggagcccaagtcgcccaagaaggccgccaagtcccccaagaaggcttagtcgattactgtctagtgattcctgatagtagtagtgttctgtttggataatgatgtcgatgtagtaatgttctgttcagctgagaaaaaagagtcagatatctctctgacttagtaaattcattctctgttaaaaaaaaaaaa

SEQ ID NO: 25524 - DNA, 778 bp, Triticum aestivum
  Clone ID: PAT_TA_25524
aatcacgaccacacgcaccggatcttgaccgatcaaaccattcagtgctcgcgctcactcacgcatcatagccaaattaagcgggaaggaaggaagggagggaggaagccatgtctgccgcggagggagccgtcgtcttcagcgaggagaaggaggcgctggtgctcaagtcatgggccatcatgaagaaggattccgccaacctcgggctccgcttcttcctcaagatctttgagatcgcgccgtccgcgaggcagatgttcccgttcctgcgcgactccgacgtgccgctggaaaccaaccccaagctcaagacccacgccgtgtccgtcttcgtcatgacgtgtgaggcggcagcccagctgcggaaagccgggaagatcaccgtgagggagaccaccctgaagaggctgggcgggacgcacttgaaatacggcgtggcagatggccactttgaggtgacgcggttcgctctgctcgagacgatcaaggaggcgcttccggcggacatgtgggggcccgagatgaggaacgcgtggggcgaggcctacgaccaactggtcgcggccatcaagcaagagatgaagccctctgaatagctcatccattgtactcatatgccacaccacttccgtctattatccctccaacttttgttgcctggccggttcactcatgtcaccatattgtgtttgtattgtgtgtttatgtgtactgacgcctatgtaaaatgagcattcaataaatgaacaaattgtggatgagattcaccccgttc

SEQ ID NO: 25525 - DNA, 814 bp, Triticum aestivum
  Clone ID: PAT_TA_25525
cggccgctccagccggatcgggacatgacgaaccacacgcactggatcttgaccactcacggatcatagccaagttaagcgggaaggagggaagggaggaagccatgtccgccgcggagggagccgtcgtgttcagcgaggagaaggaggcgctggtgctcaagtcatgggccatcatgaagaaggattccgccaacctcgggctccgcttcttcctcaagatctttgagatcgcgccgtcggcgaggcagatgttcccgttcctgcgcgactccgacgtgccgctggagaccaaccccaagctcaagacccacgccgtgtccgtcttcgtcatgacgtgcgaggcggctgcgcagctgcggaaagccgggaagatcacggtgagggagaccaccctgaagaggctgggcggcacgcacttgaaatacggcgtggcagatggccactttgaggtgacgcggttcgctctgctcgagacgatcaaggaggcgcttccggcggacatgtgggggccggagatgaggaacgcgtggggcgaggcctacgaccaactggtcgcggccatcaaacaagagatgaagccctccgagtagctcatccactgtgttgtgtttgtattgtgtgtttatgtgtactgacgcctattgtaaaatgagcattcaattaacggacaattgaccgattaactcatgtcaccatattgtgtttgtattgtgtgtttacgtgtactaacgcatattgtaaaagggcattcaataaaggaacaaattgtgcatgaaaaaaaaaaaaaaaaaaaaaaaaaaaaaggccccta

SEQ ID NO: 25526 - DNA, 635 bp, Triticum aestivum
  unsure (1)..(635): unsure at all n locations
  Clone ID: PAT_TA_25526
tagcgtggtcgcggccgcggtacccttcttgcacaaactctttaattttcaatgggcagtcactcaggttttctatgggctcccaggtatcctcttctgggccatatcctttccattgaaccttaaaatggattccatttttcctcccggtgccaccatagcagatctcaagtagcttttcaaccacaaactcatcctttccaagaggctcatcagcttcctcttcctcaacaggttctgccgcatcagaatcattgctatggacatatttgtcacatagaattgcccattccttaagaagtgcaagaaaatcctcagctttttcatttcgaacctctgttttgggatggttatatttaaggctcttgcatgcaaagctgttcaggtcaacagcccattttgtttcaagtttcaggccagcaagcgctgaacccaagcacagccctgttgacattccaccacaaccagaatacaggtcaaggagggatgccgtttttactggggccccattctctgaatcagcatcagtagaaataccagaattctctgtggtgtctgatgggatgttagcaaatgtagaataagcaacagtgtatgacatgtcatagtataagtcagtgcgagccaccngtttg

SEQ ID NO: 25527 - DNA, 406 bp, Triticum aestivum
  Clone ID: PAT_TA_25527
tcggccggccccccgcccaggtacaaggagaatgtaaactcggtgccaaatgtaggtgcaacccttgcttgtaaggttgcaaatcagacgaagatgggccctagcaactctagcaagggggaagtttctgtggatgcaagcctctctacatggctagtttcttcagacaactcaacagttgataaggcgcaaagtaaatccccccgttcagtttcctctgtatgcagacaagaaaggcctgtcctgggtgctttgactgttgatgaccttaagcaatcgtcagctacatcatctccacgaaggtctccaagccataaccgtgaagaggtgccgatcttgggttccggcccgggcggccgctcgagcacaaagcagggtaatgagtacctcggccgcgaccacgcta

SEQ ID NO: 25528 - DNA, 1122 bp, Triticum aestivum
  unsure (1)..(1122): unsure at all n locations
  Clone ID: PAT_TA_25528
gcggccgcccgggcaggtctactactccaccccagccaaacttctctctcgccttcgaagaagcagcagccgccgccgtagcatccatggcacccaaggctgctgagaagaagcctgtggagaagacccccgcgggcaagaagcccaaggcggagaagaaggtgccggcgtccaaggagggcggcgacaagaaggggaagaagaaggccaagaagagcgtcgagacgtacaacaagaagggtcaacaccattactcgcatccaaatgtccatgaatgggctcaattgctttgcacataagcttcccagttgttaatgtgcctgtcttgtcaaaagcaatagactgacaagaagaaagggcatctaagacatgcccacctttcaataaaattcccttacttgcaagagaactgattgcagtggcatatgctaatggagctactgccaatgcacacggagatgcagccaccataagtcctaatccacggtaaattgaacccctacaaactgagttaccgaaaaagggccaattaaagaggaatggtcccagtagtgcaacagccaaagacagagccacgacaactttgctataatgctccccaaactcatctaaccatctttgcaactttggcttgtttagctggccctcttcagtcagctggacaattctgttgagtgttgaatcctcccatgatttggtcacctttacaatcatcattccttccaaattcctggctccacctggtatagcatcccccactgttctctcaacaggtttagtttccccagtgaggtgttctatggtgattgtggatgatccttggtaaacttctccatcaacaggcacagcctcaccagctctgaccaaaatatgagaacccacttcaaggtcatgcacaggaacttttgcataatttagatttgaaaagtgtgccgattcgtctccacttgtttctagcaatagtgcaaattctggatgattttccttaagttccctcacatcatacattgacttgcttgtaaagtacctcggccgaggcgtactcgagggcggcggcgaggtagacgggggcgccggagccgacgcgctgggcgtagcggcctncttgaggtagcgcccgat

SEQ ID NO: 25529 - DNA, 720 bp, Triticum aestivum
  Clone ID: PAT_TA_25529
gcacgagggtcttttcacttgcttttcttctggatcctcttcgaaaacgtcatgtcgctgcatagatccaaggccacattgattggcttgttagaggcaggcagggcgaatgaatgggtcgtcacggagaagctcggcagcgccatgaagatgaaatctgctaacaaagcatcagccaggaagtcattcatgaggatgtgggagaggctaaacgttccggagctcggcgtgggagccttcctcttctcatgtgggtggtacgatgtcgcgttcgggaaggacaatttcttcatataccttttcttccagtcgatggctttcttcgtcgtcggggttggctacgtcggcacaatcgtccctcagtcataactgaaagaacgtcgggatcatctcgctcagcagttcacagttccctgagaaatcagcaaaagttagttggccgtgcatagccagttcaaaagtaaagatcacgcagtcgtctctgggtttctctctgttttccttcctccttggagactgatagtattgcagcattcccttgaatgtgctattgtaaaagaaagcgaggtgcagtgtaaggtcactgcatatgtatttgtggtgttctctttttgcttgtagcgagtacgtccccgtggttatggggagcaggatgtctgcttccaagtcgaatgtaatactaatagtataagaaaggaaaaaggttcaggaaaaaaaaaa

SEQ ID NO: 25530 - DNA, 976 bp, Triticum aestivum
  unsure (1)..(976): unsure at all n locations
  Clone ID: PAT_TA_25530
cggcacgaggcggccaaatcacccccttcctcgtgttacatcccgacgaattattttcctgaacctaattattcgcggcgctcggtcccacttcgccgcagaagaagaccgccgccgccgccgccgccgccgccgccgtcacaggaattccctgccatggagggcgttggcgcgcggttagggcgctcgtcggcccgttacggccccgcgatgacgttcaccgggcccgttaggaagtggcggaaggaatgggtcaccatctccgccgccacggccacggccacctccgccgcggcctcctccaccgggactggatctcgtggaaataacctcatcctgttcaagtggaccccgctgaacggcgccaacgaaggagatgaggagcagacggcaccggcgaagacggccacgagaaggcggcggtacgtgccggtttctgtagttcaagatcaaaggcaagaatctgccaaatctgatgatgagaacaaggctaatgatggagaaccttcatctacggaaactgagcagtctattgggaaaactaatatggatgatatacttatggatgagtcccaggcatcagacgaggttcgagattctggaaatttcgttggtggaaccgatataaatctgaacttaggtccaaaagaccccgaccgtgaagatgaaggtgatacaggtgagcaacacgaggttcgaacagaacacagattgaagaggaaatctgttacccctgacctcgagatgagaatgtaacaggcagcttcatttattccttggtttctttattattacagtttcctttttgggccatttatgtaattttcttgacatactgtatacgtggagagacaagtcaacagaatcacaactacatagtgaaacgcctgcgttgtgttgccaaataacgttaatgaaacttttctttcgtttcgcaaatgtaaactgtacnagtaccttttatttgtttcgcttg

SEQ ID NO: 25531 - DNA, 534 bp, Triticum aestivum
  unsure (1)..(534): unsure at all n locations
  Clone ID: PAT_TA_25531
gcggccgcccgggcaggtacgatgcctgaatcaagtcatttaaggactctgaagggcttgcatgcctccgccaacttccgcgccccaggacggcaatttttccatttttatcattgtttctggtaggcgaaggaagaactggtcctcgggtttcgcattgttaaaaagcctgccaattgaaatacaagtatgcaaaataagcggggatcaacatataataattgatttggtgatccttataactgacaagcacaactagtggctctttattggaacacagttagtggattctgtcttactacaaatctgattttaatacaggacctaaccgaacatttaccatttatcaggtgaaactttggatcagcagatcacagcctttcaattggatctactcaatcgaaccggcctattaggtcaaagtggcgccactgcccactgcgtcgtctctgaggatgcacagtcgctcgtcgggcctgaccgccgtgctaccttctacgcggtacctcggccgcgaccacgctaatcnnnnnn

SEQ ID NO: 25532 - DNA, 1262 bp, Triticum aestivum
  Clone ID: PAT_TA_25532
ttatgcttgatgcagcggagggtcacagattcacagttttaggcatttggtactttcggcatcgagaaaaaaaattgttcctctgagcgtgtgccttcaaatgcaaagttctgactatgatttcgcgtgcaaccatagcgccgttggccgctctgcctaccgagtgccaccccgccgcctcctcccaccccccacctgggacctcaccgcccgctccccgcccgacacacccacaacgcttgaggctgagcagacgccattggcccgtgggcacggaaacagagtccaggatggtgatggtgccaaggaggactctcaaacgtcgaccgattgcatcgttgctgccgtaccaatggagtggcgctgctccaaccactctgagatggagattagatcttcagaagaaactccaatgcatcgaagattaaaagaaaatcatgaagactcacatgcatattgttcaccagactcatcaatggcatcatacgactcataacaccaccgacttgaccacaaatcagccgctggttgcatgccgtagcactatcagttccttgtggtgatcgtggttacttgaagctgacgaggatggatgatggttggttttggtggagagacaggcctgagagtatcaaagcctgagaaattaaaattccatgggaagaatgaagacagctagcaaggttgggttctccgaggaatgcccatccgagctggctatggggacgatgactcaagggatggacacggcgatcatgcttaaccagttgggcaatccgaagtggagttgtaacttggtcgtggagagacaggcagagatgattttagggcgtcgcctggtttgccggggcggcgcccagccggaccttctggggatgacgctatgatttggggagcagcagtgcggcgaggctggtttcccgcattcgggcgtgaggttgatggaggagactagactgatgcgtggctgttgacgctcccatccggcaacaccgaccaagcggacgcgtcccagatcaatggctatccggcaacaccgaccaacggcggatgcgtccccgatcaatgccagaaaaatcccatcgtcgatcgtaagtgctccgggcttcgcgcagctcctgctgtactccgtcggtcccatgtcccatgaacatggagtgtcgcatgtagtttgttgctttccaaaagaagaagatgcttgatgccttgttttgttgacgccatttattaatgacttgcagcaccagtacgctgcttcagtt

SEQ ID NO: 25533 - DNA, 597 bp, Triticum aestivum
  Clone ID: PAT_TA_25533
acactgctagtagctagcacagcacattgacttgggatttggggatcacatcacacaagaaaatattactccatgggaggccaaaagggtcctgctgcgatcatggtgggtgtgctcctcatactggggctggccactgcggcgatgagctcctcggagaaggtggccaccggcgagaagacgtcgtggccggaggtggtggggctatgcgcggaggaggccaagaagatcatcctcaaggacaagcccgatgccaacatcgtcgttctccccgccggctcgatggtcaccatggactacgatcccctgcgcgtccgcatcttcgtcgataccgtcgccgaggccccccacaccggctagctaagcttggtacctacacggttacacagaagtgactattaatgtcaagggacatggaagaataatttcatataccccccatatccatgcatggatgtcacgggcatatgtgtgctagctccttaatttgcattgtcactttagttttgcgcctcctctcacacaaggctggcccctggggtgtccgaccggctccatacaaggacttcttctttgttgtgctttacggaaaaaaaa

SEQ ID NO: 25534 - DNA, 618 bp, Triticum aestivum
  Clone ID: PAT_TA_25534
ccccgcgtccgccccgcgtccgccccgcgtccgctcctaccagtggagcttccagaaatttcctctctgattgttagtcgaggcatagagaaattagcatgggatgctgcaggagagcgtctggcagtgtcattcaaagatggtaatgaaacatatcagggacttgttgctgtctatgatgtgagaagatctccacttgtttcagtttcgctggttggattcatcagaggacctggagagggcgtgaaggcgctcgcgttcgccttccacaacaaattcaagcaaggaccgctgctttctgtgtgctggagcagcggctggtgttgcacatacccactgatactccgctcccattaactatctgctggacactcgtggcgttttgctccccgagacctatttctgatttcggcaatatatgtgtactctttagagatgacgggcttctgatacctccctactacatagcactttcttggtttgtttgtgctcctttttctttttgcattgggagtgtcttgtatatcggctgtctttattactagtattggtagtgacggtggcggtgcttagagcatctacaaccgaatcccttaaaccctctccaaactttcactc

SEQ ID NO: 25535 - DNA, 1475 bp, Triticum aestivum
  Clone ID: PAT_TA_25535
atgacaaatggcattgcacgttagcagtacacgttgcattcacattttcggctacaacattacaaagcatgtttctcacggataactctatcttcccgctgctgctgctgcagctgtttgtcctctgctcaaactggaatttacagtcaactctcaaaactgtaacttcgaaaaactacggcgttcaattttaatcatctctaatacagctgcctatttcgtacgcaagacaagaggttacaagagctgtggggcgtccagaagtggctggacgggcagtgcttgctttaatccacgggcctgctttgggctcaggcttcggaagtgcgcgatctgggccgcgctaggtttgacgactccctgcatttttccttcaagcgctggcaatctcgccggtcggccgtccggcccctgccctccctccgatggttatcctcatggagcaaactgggacccagaaggtcgtgttgcattgttatccttttctaactcaaccacactaggttcagttcacttctcatcaaagccaccatctttagatgcccatctcctaccagtggagcttccagaaatttcctctctgattgttagtcgaggcatagagaaattagcatgggatgctgcaggagagcgtctggcattgtcattcaaagatggtgatgaaacatatcagggacttgttgctgtctatgacgtgagaagatctccgcttgtgtcagtttcgctggttggattcatcagaggacctggagagggcgtgaaggcgctcgcgttcgccttccacaacaaattcaagcaaggaccgctgctttctgtgtgctggagcagcggctggtgttgcacatacccactgatactccgctcccattaactatctgctggacactcgtggcgttttgctccccgagacctatttctgatttcggcaatatatatgtactcctgagagatgacgggcttctgatcagttcaacacaaaccgacacggagcatatcctcctcatacagctttcggctggacctgttcgaagtcaaacacctcgaacatcaagcgccgcacatcaggcttgccgtagacgcagtacgagagcccgtgtatcgcttgctggacagcagtcgtggaaggatttctcagccggcggttgtgttcgaatctgtcctgtacagtctccccgtatataatgtagtggtgaaggtgcttgtcccgcaggtaccgcccgcaatacttgttcatcaacaacctcctatgcttctctgacaaccacctgccaggtgcgtcgagatgcttcatgagcagcctctctgccaatactagatcctggatcttctgaccaacatattccagacgctcaaaacaaaatcttggatgctcaaacttgtattttgagggatgcatgaagcacagctggaggccaagtccaagttctatattccttgcttctgtaatttctggaattttatcattcgctggcaag

SEQ ID NO: 25536 - DNA, 1536 bp, Triticum aestivum
  unsure (1)..(1536): unsure at all n locations
  Clone ID: PAT_TA_25536
tcggcacgaggacgccgacacccagcagccgccgccggcgcctccgcccgacgccgacgaggacttatagccaccgattctcttcgtgttcttcctcgtggacgctccgttgctgatttgttctcgctagaagcaaatgcaaagacatataggcttgtttggaactgcacattgataacaagctggcgcttgggcttgggatgaagaggaagcagctcaagaagaagaaggacagagttttagatgccgccgtggagagcgagggcgctgccggacatgctatcgcggaagatataggaagcaagaagattgtattggtgaagcaaaagaagaaaattaagcatgccaaagtaacaagctgttgtaccaaggctcataatttggtgactctcaatgaggatgagggaacacctaaactcaagaagaagaagagcaagaagcagctaaaggaaagcaaaagtcctgttgaggtacagagtccattggacagtaatgatgctggaacacttaagctgaagaagaagaaaaggaaggtgaaggaagggaagagctctgttgagcccaatgatgcagatgatatcctgcatgaaaatctcgatgaagaaactctaaacgctgatgtcaaccaacttccagcagagagtgaagttatggatattggggaaccagaaaaggcaaagaaacgaaagaaaaataagacagctgatgtcaaacaagttgcagaagagagtgaagttatggacattggggaaccagaaaaggcaaagaaacgaaagaaaaataagacaaagaaagtaaagcaatctggggaagtcaacaggactgatatgcaggtatcagttagagaggacaatttggaggagcatgaagttgataccgcagatgttgatgagattgcatcagtcgatgaagactgttccagaggaataaaaaaatggatcttggagtacagacagaaacggccaggcttgaaagtcttgcagcaaaatatagatgtgtttataactgcacatgaggaacaacaagagcgggagaagaaggaaagagaggcagcagctgcagaagatgggtggacagttgtgatgcatcataaaggtaggaagaagactacagatgttgaaactggaacagcggttggctctgtatctctggctgcaatgcaagagaaaatggctcagaagaaacccaaggaagttggccggaacttctacagacatcagaaacgagaagctcaaatgagtgagctggcgatgctgcagagcaagttcgagcaggacaagaagaggatacagcagctgcgggctcaaaggagattcaagccttacggattttgaagggggctcctccatggagaggcagtgttcgttccacatcactcgagaccagccgtcgctggagtgctggcttggttgctatgttgaacgtgcactgtattccttttttttgacagaaaatgtcgcatcgttggacaaatgtacctcgcccccgaccgcgctcggtgccagttgtgtacaangttnaacatttcagcaagtg

SEQ ID NO: 25537 - DNA, 1265 bp, Triticum aestivum
  Clone ID: PAT_TA_25537
ccctccagctgccgagttacttgacaagtgccactggctactagtgcaagtatggctcgggtctctgccaatgcagttgcacttgttgcactcgtctccgttcttctcacgtatggctgctgcgcccagtcgccgctcaactacaccggctccttggccaaatcctccaaggctagctggtcatggctccctgccaaggccacatggtacggcgcgcctaccggcgccggtcccgatgacaacggtggtgcttgcggctacaagcacactaaccagtacccgttcatgtccatgacttcctgcggcaacgagcccctgttcaaggacggcatgggctgcggcgcctgctaccagatacgatgcgtcaataacaaggcctgctccggcaagccggagacggtcatgatcaccgacatgaactactaccctgtggccaagtaccatttcgacctcagcggcacggcgttcggcgccatggcgaagcccggccagaacgacaagctccgccacgccggcattatcgacatccagttccaaagggtgccatgcaatcatccgggcttgaacgtgaacttccacgtcgagcggggctccaaccccaactacctcgccgtgctggtggagttcgcgaaccgggagggcaccgtggtgcagatggacctcatggagtcaaggaacggccgcccgacggggtactggacggcgatgcgccactcgtggggcgccatctggcggatggactccaggcgccggctgcagggccccttctctctccgcatccgcagcgaatccggcaagacgctggtggccaaacaagtcatcccggccaactggaagcccgacacaaactaccgttccaacgtccagttccgttgattgctccgagcttccgatcgaccgacgaagacgttgattgatttggtacagtgtgaatgcaaagtatattgttgaattttacttacaaggtatatgtttacgtcatcgtgcgtgtagctcgaagatatgtgtgggaatggaaggaggctttagcatgggcagcatggcccgaaagcctaacatccaggccgggcttctgtctagtggagtagtatatccacgtgctacccagcccactatcaccagattcacagcttgaaatctgatatattgtaattaatcaggtttatccatatgcattatgggataccaattgtgtattcagtctgtctcatgctaaaattgtgtattcagtcaaaaaaaaagaaaaaaaactcgagctcgtgccg

SEQ ID NO: 25538 - DNA, 1232 bp, Triticum aestivum
  Clone ID: PAT_TA_25538
ccacgcgcccggcacactcccagcggggcgacgagggtgagtcggagcgggagcgcgagagagggcgaagccctaaccctcgatccctgaccggaagccgatggccgcgctgccccccgtcgtctccctcctgctggtcctcgtcgtcgccgcccccgcggcgctcgcgccggtggcctccgcggtgcccttcatcgtcctgcacgggatcggggaccagtgcgggaacgacgggatcgcctccttcaccgatgagctcgcggagtggtcgggatccaagggatactgcatggaaattgggagaggatcgtgggattcttggttaatgccacttcaagatcaggcaaatgtggtttgcaagaaggtaaaggaaatggaagaacttcgtgaaggttacagcataattggcctttctcaggggaacttaattgggcgggcagtaattgagtactgtgacggtggaccaccggtaaagaatttcatctcaattgggggtcctcacgctggtactgcttcagtgccactttgtggttctggttttctttgcgttcttgttgatgcgctgattcaactggagatatattcaaactatgtgcaggcacatcttgcccctagcggttacctaaagattcccactgatatgacagcttatttgcagggttgcaaatttcttccgaagcttaataatgagataccaagtgaaagaaacattacatataaagaaagatttagcagcttggagaacttggtattgatcatgtttgaggacgacgcagtcttgatacctcgggaaacagcatggtttggttattatcctgatggtgcctttaatccagtgctgtctcctcaagagacaaagctatatactgaagactggatcggcttgaggactttggatgaggctgggcgtgttaagtttgtgtcggtgcccggaggtcacctccgcatatcaaggagcgacatgaagaagtacatagtgccttatttgacaccgtcatgtggatcatccaagcagagtattcgtcgaatcttgtcatactgaggataggtaaaccacgctggcggctgtaatcgcacttgttctgggtctttgtaagcccaacccatgtctctatgcattagtaccttataaatacattggcgaaacagactggaaccataacgttgttgtgctcggggtaaatagactggcgagtttgcagcaaaaaaaaaaaaaaaaaaaaaaaaaaaaa

SEQ ID NO: 25539 - DNA, 636 bp, Triticum aestivum
  unsure (1)..(636): unsure at all n locations
  Clone ID: PAT_TA_25539
gcggaccaatactcctgattccccaatctcccccacagagtaccgccggcggcgccatgtccaccaccactaaaggtacagccggctacgaccgccgccgggagcttcaggcgttcgacgacaccaacgccggcgtcaagggcctcgtcgacgccggcatcaccaccatcccgctcatcttccgccaccctcccgactccctcgccagttcctccaccgcgaccatcccggtcatcgacctctcgggccgccgatccgaagtggtcaagcaaggtgcgggcggcgacagagacggtgggcttcttccaggtggtcaaccacggcgtgccggccgacctcctcgctgagatgctcgcgtccgtgcggcggttccacgagtcgccggccgagggcaaagaccccgcactacacccgttgacctcgccaagaaggtccgggttcaactccaactttcgacctgttccaagtcgccggcggcccactggcgcggcgccctcccccccccggccctcccgcgccccccggggccccacccgcgcccccccgccgggcctnccctccccccccagtacggcgacgcggtgcggcggctcgccgtgcgggtgctgnnnnnnntnnncgnnnnnnnnnggncnn

SEQ ID NO: 25540 - DNA, 592 bp, Triticum aestivum
  unsure (1)..(592): unsure at all n locations
  Clone ID: PAT_TA_25540
ctcgcctcccgatcccaaccgccaggcgctcgatctggtgccgcgccggccatccgggcgcggcgtcgatggatctggcggcgggtgcggcgtattgctccggtggcgacggtgtcctgctgatgctaagagaccagggcatgagggagataggaagaaatgaggataaggggcacaaggtgagggaggcggtcgccgccggcggcggctctggtgaccggccggagggcagggagaggagctcctgttgaggctgcggggcttggtggatgccggttcctccggatcgaccccctactcaagatctgcacgccccctgatgattggaggtgtgcttttcacatgttccgttgagttgcttaatgacataaaaaaatgaaatctggagttatgcaattgcagcaacaaggacggatggccatcttcacaggttaatgnccccttaattgtnagtttgcattcaagtcaatgntgcangtaataatgacataantttgttaagcctgccagccntgtttccagattttttttttttcatgattgactgcttctacacaaaaggagtttgtcgaaantnnnnnnatcccactgt

SEQ ID NO: 25541 - DNA, 607 bp, Triticum aestivum
  unsure (1)..(607): unsure at all n locations
  Clone ID: PAT_TA_25541
gcacgaggttatattctcagcccattactcccttctccttccgttccggcgccgccccctccctccggcccccgtccgacctctccgccaccgcccaccctctcccctcactgctcgcgcaccgaccgccgacgccttctcctgtaccggacgcctcgccctgcagccgcgccggttgaaggtcttcttcaagctccctgcaaccgcgccgataaggaggatggcgttaccccgacctatcctgcctctgcccggttgaaggccttcttcaagctcgccgtccggccaccctctgcttcgttcaaggtcgcctccaactcccctcctccgcccccagctcgctgctgagctgtgcaaaggggaaaagaacgttaccgcttaatggcttggggtcaagcttgctgggaagacccgcaatagggttccttgtctcgtgctcaacagctggcttgctcaaagggttacttcttgcgacaattccaaactaatcccgtgtgcggtcatcttccagccgatggcatgtttcgtaggagctttagctcagcggtgcctgcttcagagcaaatgaacctcattaagcaactccgagaaagaacgtgtgctccnn

SEQ ID NO: 25542 - DNA, 758 bp, Triticum aestivum
  Clone ID: PAT_TA_25542
cgacccacgcgtccgatttggtttaactcatattgcaagtatgcatctatatatgttcccaaacgagtgaaccccttccaatgtcaagattacgcatgtctttcacattgccgcttcccattgcccattggtatctgcctcggatggcttcaccattgccaaagctattgtagtcgtgcacaacatacttcactcaactcttcgtagctttttggaattttaatgaaaaccgatgtcactatttgagcattgagagcaatgttttaaatagcgggctatggaccgggtcgacgggcctgtaaatcagttatagcggagctatagcgggctaaagcggactatttgtgaaggcgaccatttagcggcaccttgctgaaaaggctatagcgggctatagcggagctatagccggctatttaaaactatgattagagagtgatgttattttcttcctatgttgtacaagccagaaacgtttggtgaaaggaaacaccatcatggtcttttatagagctacaaatgaatctttaccaatgtttttctgtaggcaattgtttgctctgcttgaaactgtaagacgtgtatgttggtctgcagttcatttgggactgcggatttgtcacctactattaggtacatatattgtgttactacacattgcctctatatgtgttcacttgaaaagataagactattttaccaaccaatactttcagctcccatttgaagggaattttaaaaaaaaaaaaaaaaaaaaa

SEQ ID NO: 25543 - DNA, 631 bp, Triticum aestivum
  unsure (1)..(631): unsure at all n locations
  Clone ID: PAT_TA_25543
tggatcccccgggctgcaggcaacaatccatccatccggatatccatctattccttcttcctcctcttaaaagccaagaagcagagatccaacagtcaacagagaagaagaagatgttcgccgatgcgggctttagcttctccgcctactcttctgcgttgtcgggctactcctactcctactcctccgtcttctcccatccccacccaagactactcctccttcttctctccctcatcctctgctgcactggccacaaccggccgctgccaacccctggcctctccggcaaccaaacaaacaatcaaagtcaactggttggttgccggcaacccaaangaacttccccgccggcaacaatgttacaacaacctgggggaaaattgggggaagccaatncccttgataagcaaaagttaggacttgggaacnaaaaagggggaacttgttaaaggggcncggcccgcccatccaanggagcgnnttgtnaacctccgaaccccgtttgcggncggcaattccanttatnttcgggaagggnnaaangccatngaagaaaccaatcaanggcnccgggnattaaccctggaggaaggngtttttnaantttgaaaaaagggcccaaaggggg

SEQ ID NO: 25544 - DNA, 591 bp, Triticum aestivum
  Clone ID: PAT_TA_25544
cgggcctgcagggaattcggtctgaggctctctctcgttctctgaactctctctcgttcctctgtttcccatcctctttccccttcaatctactagaaaactgtgagatctcttccaagggcctcacacgccgcctagcaattggtctgaaccctagccctgggcgacctcctcgctgagccctaggcctaagctacggtgtcgcctccacttctccgcaatacgcccttttctttttcttcgccgttggaggcgccgcggctgagggagatgtgtggtggacggcggcggagcgggccggcagaagcgcggtggaaggcggggtggtggtgttaaggctaggcggcaaacacacatgatggggctgcacagacatgtgcgaggtctgtgctgagtgagagatctagagtgagatgattgagagattcagggagaaattgttgatattcagtcggattaggtagatagagagtctatttgtgctttcagctgctctttgtgttctctgattgaggatgagctgttgttatttgtaatgatctagagggcttcaaatgatgttgctatctgtgtttgctcttaaaaaaaaaa

SEQ ID NO: 25545 - DNA, 698 bp, Triticum aestivum
  unsure (1)..(698): unsure at all n locations
  Clone ID: PAT_TA_25545
ctccaaacaatccatcggtactccgaatttcacacactcaactccctggcccaactacgacagcccattcatcattatttatataagccggtcatccccattccctgcgcgtaacctaacatctactcgagtggagcggaagcagaggcggcggcacgatgccgatgccgatgcgagggctcagctccgtcctggcgcggagggcccgctcactgaccggcgatccggcgaccattcctagatccgccggtggtcggatcaccttaagcggccgcctggactcggcagctgcgagcacgaaggcctgtgatggtggtgaaatcgcccgatcctggatccccaagacatctacgagcaagtccctcgtcacatcagccctctctggatctacctgcaagtctatcgtcacatcagccctctctggatatacgtgcaaggtccctccgtcacatcaacaagtggcatgttactggtaggaaaacctgggctcccctccgattaacaaagggtgtctcatcaaagccaatgttcctccaatttgggttgaaggcctgttcaatccaatnacgttgcaancggtgttctccaacaaaaggntctccaaaaaacaagggggggtggtcctcctnaaaaaaggggctctncccaagcccctcccaaagggggtttaaaagtcgggtggattgttntccntttgg

SEQ ID NO: 25546 - DNA, 800 bp, Triticum aestivum
  unsure (1)..(800): unsure at all n locations
  Clone ID: PAT_TA_25546
ggnnnnnttnannccnttttnnttctnttagctcgaaattaaccctcactaaagggaacaaaagctggagctccaccgcggtggcggccgctctagaactagtggatcccccgggctgcaggaattcggcaccagaacccccgccgccgccgccctccccgctctctctcccatcttgttcacctcctcgcacgtcacgtccctctcctcctcctccccctccttcgtccaccacaagggagaaaccccaagccagaagggagaaacaacgccggcgaccacagacagccatacaagattgattcgcacgcgcgccgcgaggagcaggagcggccgatgatgaacgacggccgggtccacccggcggccaccagctccgacttctccggcgagtacgcctactcctcctccgacccctcctccagcccgctctacagcttccacttcgagaagcccgtcccgccgccgccccagcaccaaaacaagccgcagcctggcacgtacgtcgtgcaggtgcccaaggacaaggtcttccgcgtaccgccgccggagaacgcgcgcctcttccagcactacacccgccgcgccaagcgccgcgccggctgctcctgcctccgcgcctgcctctacctcgccgtcgcgctactctccctcgccgtcctcctcgccggcggcgtcggggccgtgtacccctgcgttcaagcccaggcagcccggcgtacaccggcgtgtccctcggcgcgtcgggccccctccccgtggggccggcctacgcgctcggagcgctctcgtcggggttt

SEQ ID NO: 25547 - DNA, 862 bp, Triticum aestivum
  unsure (1)..(862): unsure at all n locations
  Clone ID: PAT_TA_25547
ccatggtgatttgaatttggagcttcattgtgatattactcctcggacatgtgaaaacttcctaacacattgtgaaaatggttactacaatggtcttatcttccatcgtagcatcaaaaactttatgattcaaggaggtgatccaactggcacaggaagtggaggggagtccatatggggtcaacctttcaaggatgaattgaattcaaagctgctacattcaggaagaggtgttgtcagcatggcgaattctgggccccataccaatgggtcgcagtttttcatcctatacaagtctgcagcacatttaaatttcaaacatacagtgtttggcatggtggttggtggtctgcacaatctttcagcaatggaaaaggttcctgttgatgatgacgaccgcccattggaggaaataaagttactgaaagttaatgtatttgtgaatccttacacggaaccagacgaggaagaagaaaaggcaaaggaggaggagaagaacaaggatgaagatcatgataaggtggggtcatggtatagcaacccagggactggtgtttctgcttcagcgagcgctggtggtggagttggcaagtatctcaaggctcggacggctggctctgctgatgccactggaaatgccgctgcagcagatgattcaagcaagaagagaaaagcgagtgctcctagcgtagaattcaaagatttctctggatggtagatccctgtatacgtgaatttcccctttcttctcagaagaaacaaccagttgaaactttgtaacatttgagcatgtgcgcccatgttatggtagtgtattaactgcccnnnnnnnnnnnnnnnnnnnnnnnnnnnnnnnnnnnnn

SEQ ID NO: 25548 - DNA, 614 bp, Triticum aestivum
  unsure (1)..(614): unsure at all n locations
  Clone ID: PAT_TA_25548
gattcagcagaagatagtgaagnagaagatgaagcttccaacgtatttgtctagtgaggttcactctctgctgaaagggttactgcacaaagaagctggcaggcgacttggaagtggaccgggcggcagtgatgaaataaagaaccacaagtggttcaaggcagtgaactggaagaaactagaggctcgacagatcaagccaagcttctgcccaaatgttgctgggcagacctgcattgcaaactttgacgagtgctggacgagtatgcccgtgctggattcccccgtggccagccctgtcgctgcagatagcaacttcgtggggttcagttacgtgcggccggagccattccttcaaaagccgagtcctctaggctgaagactactttataattgtggtatctaagaaatctggtatcttacctttgctcaagacagtaagatgaacctgctgttgtgcttgttttagacttcactagttgattgcccgtgcgttgccatggaacacaagaacacacgtaaagcaaattgattgctttgtgagctcaaaaatcaagcgcaacacatgtgcaattcacatccatatcatggaaagcattgatgtcgatgttgtc

SEQ ID NO: 25549 - DNA, 2052 bp, Triticum aestivum
  Clone ID: PAT_TA_25549
gccacacgtgggtgcactcgccgccgcttccagccgtccccctcaccctccgcaaagcccatagacaagttgatctcatgtattcaggaagaacagtggcatccagagtttcctgttcatcgggaaacaacggaagcttcccaccctgcctttgcccgggattcctgggatttcctgttgtctccgtgaacttccacttgttcaaggccattgttcgcagccctgcatcttctgttgtcttgggttatttgtggaaggagcctcccttagacagagctgccccataaggtgttcattctatatttctgagaattgggtagtgggaagccgtgcagccaccgctagctttcatcaagattctcaaactgttgaatcttggttcctgaagatggtttcctctgggaaacacttcagttacaacaacccatacacaacgccccaagctctttacagggatgatacttctgccaaaagggctgtcagatgctatcgttcctgaaaatggtgagtttgattttaacgatgtttttggtgctacggcggtccagacccccacagaagtaagcattctcaattcaggcagccctgcacctttggctgagtcgaatgaggaggtcaacaatgaccctgtgctctttaccaagctatctcattctcttgtctatcccccctgcacttgtttgccaattgttgctacttacgtaagcttactctaaatgagactgagagctcattagaactgctagagtgtctttcctaaagaaaagaaaagtggccaggggagtcttagtgatgaagagtctcaatgatacaacaaaggagaatgaggctgttggactcgacgactttgaactcttgaagcttgttggccaaggggcatttggcaaagtctatcaggtgagaaggaaatgtacttcagatatatatgcaatgaaagtcatgaggaaagacaagattttggagaagaaccatgctgagtacatgaaagcagagagagatatactgacaaaagttgatcatccttttgtggtgcagctgaggtactcctttcagactaagtaccgactttatctggtcttggactttgtaaatggggggcatctcttctttcagctttaccaacaaggcttgtttagggaggagcttgcgcgcatctatactgctgaaattgtatctgctgtagcccaccttcatgccaatgggattatgcatagagatctgaagcctgagaacatcttattggacgctcatggccatgccatgctaactgattttggcctggcaaaggagtttgatgagaacactaggtcaaattcaatgtgcggcactgtggagtatatggccccagaaattgttcagggcagaggtcatgataaagctgcagactggtggagtgtggggatccttcttttcgaaatgcttacgggcaagcccccattttttggtggaaacagggacaagattcagcagaatatagtgaaggagaagatgaagcttccgacgtatttgtctagtgaggttcactctctgctgaaagggttactgcacaaagaagctggcaggcgacttggaagtggaccgggcggcagtgacgaaataaagaaccacaagtggttcaaggcagtgaactggaagaaactagaggctcgacagatcaagccaagcttctgcccaaatgttgctgggcagacctgcattgcaaactttgacgagtgctggacgagtatgcccgtgctggactcccccgtggccagccctgttgctgcagatagcaacttcgtggggttcagttacgtgcggccggagccattccttcaaaagccgagtcctctaggctgaagactactttataattgtggtatctaagaaatccagtatcttatctttgctcaagacagtaagatgaacctgctgttgtgcttgttttagacttcatttgtctatcacccaagagggggcttgggacttggcaatgactttgtggcaattcgtttgtttcttttactctttagtgtcatctaataccaaaaaaaaacacaagaacacacgtta

SEQ ID NO: 25550 - DNA, 1036 bp, Triticum aestivum
  Clone ID: PAT_TA_25550
tccgcagtcagctcaacgcaaacacaccaggcggcccagcctgtgacagcccgccaagcgccccaggccgtcattgacaggcgccggcgcggggcctgggcgtccccggaacgacagggccgctgcgtgggccggagggccaggcggccgagtggttcgccatcgcggaggccgacgccttccgccctcgccgcagtaaacgtctgcgcggcgccgggcggcaccccgccgcccttcctcgacctctccagccaacttctacacggggcttgatgaggacgaggaggagtgggtccgggagatattctcggggtccaagaaggagtacgcggtcgagaaggagtgggagctcttggtgctgcggatgggcgacacgccgctcttcttccagaggaggggacagcccttccttgataaggacgacagctggccatctctcacttacccaccgggatgcggcgctgagagactacaccacaggcaacacccactggacaacaccgaaagcgaaaactcagttcaaaacacccaaataattatttttttcggccgcaatgcatacttcattgtcaacgctaatgagatgacaagtcaaaccaagcacgttacctacctccttgacatgcgtcgtgaaatcaaaaccgaaaaacaaagtgtacctccccggtagcatgcaacgatcaacccagccagactaaccgcacaaacttaaccgattgaataaagatttcagctccattgtgcataataggattcccctgttcaatgggatcaagcttatttatgcattatgcattatagggaacgacacgcctgatgttctatgggcagcaacacttgagcagagagcatctcaaaattgataaattgcttacttgaaatggttgtacttcctcttctctctgggtttgtgtttgagggcacaagttcctatgctgtataggtgctgaactgctcgtgctattctatccaatgctcttatcagttaagcatggcatttcaacccagcataataaaatttctggaacgacagact

SEQ ID NO: 25551 - DNA, 1608 bp, Triticum aestivum
  Clone ID: PAT_TA_25551
ccgggtaccagctgagcagcgggtgcagcgaggcgcccatcgccaaggccctccgcgacggcgtcagggtcatcgagctcgacctctggcccaacgccgccaaggacgacgtcgaggtcctccacggcaggacatggacgtcgccggtggacctaatgaaatgcctggagaccgtcaaggagcacgccttcgtctcctccccataccccgttatcctcaccctcgaagatcacctcactccgcatcttcaagccaaagtagcaaagatgatcaaggagacatttggggacttgctccacctctcggagtccgaggcaatgcccgtattcccttcccccgaggacctcaggggcaagatcatcatatcaaccaaaccgccaaaagagtaccttgaaaccaagagtagcaaggaggaggcccaaaatggtagcgcggaggagagtgtgtggggggacgagattcccgacaacaaggctcaggtggctactgctcgccaggtttcagagaaggacacagagcggtatgtggaagaggatgaagagatggagaagaaggtacaacagggggttaacggggagtataaaagtctcatctcaatcagcctcacccggagaaagcacgacatggatcaggatctcaaggttgatcccgagaaagtgtctcggatgagcttgggggaggcggcatacgagaaggccaccattactcatggatctgaaattataaagtttacacagaggaacttgctacggattttcccaaagacaacgcgcattacttcgtccaattacaatccgctgatgggctggagatatggagctcagatggttgcagcaaacatgcagggccatggaaggaaactatggctgactcaagggatgttccgggcaaatggcggttgtggttatgtgaaaaagcctgattttcttatgaacacggataaaatgtttgaccctagatccaaactaccagtgaagacaaggctcaaggtgactgtctacatgggagacggatggcgattcgacttccgtaagacgcatttcgacaagtgctcgccaccagacttctacgcaagggtgggtatagcaggagtggttgcagacacaatgatgaaggagaccaaggtgatcatggacaactggataccgacgtgggaccacgagttcgagttcccgctgtccgtgccggagctcgccctgctgcgcgtcgaggtgcacgagtcagacaaccaccagaaggacgacttcgccggccagacctgcctgccggtgtgggagctccggtctgggatacgctccgtcaggctctacgcccgcgatggcgaggcgctgcgctcggtaaagctgcttatgcgcttcgagttttcatagaggatcgagctcgcgggcgtttccctgttgatcctggcgatgttggtggtgtgtgtaaaaagtttggaaatttttgttcgttggtgcctctgtcattgtgcgcgtgcttgtgctgtatatgatgtgattagaactcaatgtgcgactattgtttgtcattgggtgtttgttgagtgagccaatgaaagatcaaagattgttccgctagtaaaaaaaaaaaaaaaaaaaaaaaaaaaaa

SEQ ID NO: 25552 - DNA, 1414 bp, Triticum aestivum
  Clone ID: PAT_TA_25552
ccacgcggcccgtgccgaggtctccccgcggccgctgcatcgagaccggctcccgctggcacttccagtcggtcttcgcctccctctgccccccgccctctggctttggcccctcgtcctggcgcgcggctctcacttctgggtccacaaatcgatgaagctgaggctcgtgctgcgtccttaggtgttggatcagaacttgctacctcactgttttctgccggcgctgctgaattaccttgtacagtcaagcttagagtatggcggcatgatatcaaggatccacgtgttgcattggcaaccgaggcgtggcgctggaccctacaacacaccgttgcttgcggtgcaagcgggggccttatttcctttagcgaggaatttatggttgcgtgtcaggggtatgcgttggaacgctcagtgagcatccgcgtcatgagcttatatgtgtaccttcactcggaacttttgtctgcaagctccatttttgtttagcagagcctcatggactaaattacaagatatcatcaggggcctccgactaaatctttcgagcggcagatgattctccacgagtttgttcaagtgcaatgtactgatctattgctggtttccagagaatgctgtgggccgactctaatcgtgcatcgttttgcaacttttaactcaggtctgtgcacaggcggtgtgatgatgtaaatttggcatggtcatcgttgctgtcaagttcccacgaccctgtaattataaaactgtacatgtaatctccaatcagcttaaaacaaccgctgttgtattttagaaagctcgcaatcctaatcctcaagtttcttttacgtgggaaatgtttgtactatttctgtcctgaccaatgccagtgatttgcattaacgcttcattgaggaaaatatgcttgaggtccagaggtatgcgttggaaggctgaatgatcatgtgcgtcatgagcttatatgtgtcccttccctggaacttttgtctacaagctccgtttttgtttaggagagcctcatggactaaatcacaagatatcatgaggggcctccgactaaatctttcgagcggcagatgattctccacgagtttgttcaagtgcaatgtctgtgcacaggcggtgtgaagatgtaaatttggcatggtcatggtcatcgttgctgtcaagttcacacgaccctgtaattataaaactgtacatgtaatctccaatcagcttaaaacaaccgctgttgtattttagaaagctcgcaatcctaatcctcaagtttcttttacgtgggaaatgtttgtactatttctgtcctgaccaatgccagtgacttgcattaacaaatctttgtattgtgtcaacgttatttggttcccttttccgcttacaaaaaaaaaaaaattacaaacaaaga

SEQ ID NO: 25553 - DNA, 1132 bp, Triticum aestivum
  unsure (1)..(1132): unsure at all n locations
  Clone ID: PAT_TA_25553
gtcacggaagttccaccccactccactcagcactcaatctctcagccgcgtacccttggacagaattctgttagagacagatgcaccactgcaagtaccccgcatcgcggatgtttctctagttacagtccctgtcgccacagcctccggcgtcggtgggttgttccagggcgattcgacctctcaggcggctaccccttcaaaagaatccttgaatcatccagctaacatccacattgttttgaagtatgtggcatcgctgcttgaaatgccggaagcagaactcgccgaggcgagctacaggaacgccaccaaactgttctcctaccctggatccaaagttcaccccaaagctgaaactgcgtgaatggggtggtgcgggtggccatccaatacgaaccatgctcatcggaatcctggtgcgttctgcctctggatgttgcctgtataccgcatgtatattgttgtactagtatatatagtcggcctatgacaaggtagcaattagagaagaaataataaagcggctcatggctgcccgtcccatgtttccaaattcccctcgcaatattactctactccctccactcaccattagaagatgtcaatatgaactacatagactgaaatgagtaaacaaacacactaaaacaacccttgagtagaattctacgtaagacagaactaccagatgtactaccaaagttggacaatgtttctctagtcacagtccctgtggacacttcagatgcagatgctgaaaagtctcacagcgattcgacctctcaggcggccatgccttcaaaagaatccttgaaccatccagctaacatccacattgttttgaagtatgtggcatccctgcttgaaatgccggaagcagaactcgccgaggcgagctacaggaacgccaccaaactgttctcctaccctggatccaaagttcatcccgaagctgaaactgcgtgaatggggtggtgcagatggccacccaatacgaaccatgctatcggaatcctggtgcgttctgcctctggatgttccctgtataccgcatgtatattgttgtactatgtatatataatcggcccaagacaaggtagcaatcagaganaaataagaaagcggctca

SEQ ID NO: 25554 - DNA, 501 bp, Triticum aestivum
  Clone ID: PAT_TA_25554
gcaagccagtgctagaaacgaccaaatcacatagaggtacatagagctggtggaagcactactacttgcaggcgtttgtccaatttcgtttccaacatgagcacgccaggcgacggtcccaagacggagtggccggagctggtcgggcgcacgatcaaggaggcgaaggagaagatcaaggcggaccggccggacctcaaagtcagaattgtcccggtaggaagtactattgtgacagcagacttcgatttgaatcgcgttcgcgtctgggtcgatacggtggcagaggttcccaagattggctaagctagcttaattagcctatactggaataaaggcccatgcaagtctccacttcgttcagttaatctgccgaataaataagcatgggtgcagtctggaaaaaaaatgtatggatgtgctgtgtaatgttgttttgtttgtgagttgtaaacatcagtaatattgtcgagccactgtttaaaaacctacagtactatg

SEQ ID NO: 25555 - DNA, 698 bp, Triticum aestivum
  unsure (1)..(698): unsure at all n locations
  Clone ID: PAT_TA_25555
cgcgtcccgattgcggcgcggccgcctgccggtgtcgcctcgtgtagaaagcaagccagtgctagaaacgaccaaatcacatagaggtacatagagctggtggcgtttgtccaatttcgtttccaacatgagcaagcaaggcgacggtcccaagactgagtggccggagctggtcgggcgcacgatcaaggaggcgaaggagaagatcaaggcggaccggccggacctcaaagtcagaattgtcccggtaggaagtattgtgacagcagacttggatttgaaccgcgttcgcgtttgggtcgacacggtggcagaggttcccaagattggctaatatagcttataattagcctatcactgaaataaaggcccatggaagtctccacttcgttcagttaattggccgaataaataagcatgggtacagtttgaaaaaaatgtatagatgtgctatgtaatgttgttttgtttttgtttttgattttggatgcatgtttaatattgtcgagccactggttttctttaaaaaagatagggaatctccttggagaccacatctaacacgaaaaaaacnccngggggggcccgtacaattcccctaaaggatcctnttaccccnccacggcgtcttttaactcngacnggaaacctgggttccaantatccctnaaaaanccctttccantgggtanacaaag

SEQ ID NO: 25556 - DNA, 624 bp, Triticum aestivum
  unsure (1)..(624): unsure at all n locations
  Clone ID: PAT_TA_25556
gcacgaggcccatcgccgccaccaaccctaggatcccagccgcgccgcgccgccatggccgactccggcgactcctccccccactccgccgccgacgacgcgcaccaccaccacctccccgaccccaccaccaacgcctccccggagaccatcgcttcgcaggcggcggcggccccggcggtgtcggcgccgcccccggtaccggcggtgccggccaaggtgcggctgatggtgagctacgggggccgcatccagccgcggccgcacgacaaccagctctcctacgtcaacggcgacaccaagatcctctccatcgaccgcccgctccgctaccccgacttctacgcccgcctcgccggcctcgccgccgcccgcgccgacctctgcgtcaagtaccagctccccggcgaggacctcgacgcgctcgtctccgtcaccaacgacgaggacctcgaccacctcgtcatcgagtacgaccgcctccacctcttccgcgcccccgccgcgccgggnatctggcgggtcctcccggggcgnnggtccacgcccaggctccgcgtcttcctcttccccgtcgccccgcccccgcgcccggcatccccgcccaagcagcagcaccagcnn

SEQ ID NO: 25557 - DNA, 651 bp, Triticum aestivum
  unsure (1)..(651): unsure at all n locations
  Clone ID: PAT_TA_25557
gccgcccactctcctctcttccccgcctcccttccatgaaaaccctagccgccactatccgccgagctctcttgccgccggcggccaagccccttcgccatctccttagcccagccggtcgccgcctccgtcgttctctaggtaggcagccgcttcttcttcactgagccccgtctgcatcgtgcttggcgcgagcgtctaggatttctaaccactagcgcctgacaccaccggatgggggcggccagtgctccaccccttgacgccgccaaatccccgtagcggaagacatcgacgaggacgccgacaaggcagcgccgcctgtcgaccgtgtgtgcctcctgccaccaccaccaagatctgggagaaagagtaggaggcagagagggagatggggtggtaagaagagagggtgaggaaggaggaaaaggagatcctcgcggcactcatggtggtcgcccagatcccagcgggggtggcatgccggctccttcctgccccctacaatnncccggnttngtttcaaaagaattncttcacngggtgggcctccaaaccaaanncagccnccnaaanagnaagggcctcccctngggcccccccttttccccggaagggncctttncccccaacggggggnaaccnaagggg

SEQ ID NO: 25558 - DNA, 549 bp, Triticum aestivum
  unsure (1)..(549): unsure at all n locations
  Clone ID: PAT_TA_25558
ggaatcattttcttcaaacttgcaccagtaaatatttgtagctcttcacgttgtctaatcaacatgttagttttgantgctttggtgaaacctaagcagtaaactcatggccacactctctcaaatggtgaaaccacttcttatgtaaccaccactctggttatcgaggttccaaatggttttgcctgcggccgcccgggctggtacttcttatgtcaaggtaatagattgtgacctccattttggttcgggttaggctttaatatttgtgaagtcaattataggtgtccattacattggtaagatagaagccaattantgaagtctttccatttagataatgtaagatgtagtcctttcctgttttgtggtacaaagataaattgctttatccttttggtcgccccttgccgttggttgaaaatagatagtgtccatgatggagttgaagttactgtgataattggttcatcaatttagctaatccttactattcagtaaaaaaagctggtccttttgattcctggtacctcggccgcgaccacgcta

SEQ ID NO: 25559 - DNA, 1539 bp, Triticum aestivum
  unsure (1)..(1539): unsure at all n locations
  Clone ID: PAT_TA_25559
cgtggcaagggagatggtggcttatgcgcgcagtctcggatgccccgatgtcgagttcacccccgaggacgccggcaggtcaaatcgagagttcctgtatcatatcctagaggaaggactaatctcaacatcccagacactgttgggtacactctccctcatgaattcgggaaattaattgctgatataaaagcaaacactcctggaattgaaaatgcaattatatctactcattgccaaaatgatcttggtcttgcaagtgccaacacattagcgggtgcttatgcaggagcacgacaattagaggtgactatcaatggtatcggtgaaagagccggaaatgcttccttggaggaggttgtcatggcaatcaaatgtcgacgagaacttttaggtggattatatactggaattaattcgcaacatattaccatgacaagcaaaatggtacaagagcacagtggacttcatgtacagccgcataaagctattgttggtgccaatgcctttgctcatgaaagtggaattcatcaggatgggatgcttaaatttaaaggaacttatgagataatatcgcctgatgatattggtttaacacgtgcaaatgagtttggtattgttcttgggaagctcagtggaaggcatgccgtcagaaccaaactagtggagcttggatatgaaatcaatgacaaagaatttgaggatttctttaaacgctacaaagaggttgcagagaaaaagaagcgtgtaactgatgaagacatagaagctttattgtctgatgagatatttcagcctaaggttatttggtcccttggtgatgtacaggcaacatgtggaacgcttggtttatctacagcaactgtcaaattgataactatagacggagaggaaaagataggatgttctgttggaactggcccagttgatgcagcatacaaggctgttgaccaaataatacagattccaactgtccttagagaatatagcatgacttcggtcacagaaggtattgatgcaattgcaaccactcgagtagttatcactggagatgtcagcgccgataaacctgctttgactagtaactccaatcgatccttcagtgggagcggcgcagccatggatgttgtcgtatccagtgtccgagcttacctcagtgccctgaataagatgtccagttatgttggtgctgtaaaagccagcagcgaagcacctgaaaccataagtgttcagaccacagaatgagcgtttacattacatttcttttcggttatttcatccccggagcaatgtgaaaaccctggcaaagtgtttacaatctggtattacatgttagtaaagagctgtttggtggtgtaaggggatgggttttccagcttgtgtgcatctgaaggatatttggttctcactagtgaattgcaacttttggttgaataatgaagcaattttacaacacaatatgtagtgcatgattttctactatttaacaacgttactcccaaaatcaataaaaaaaaaaaaaaaaaaaaaaaannnnng

SEQ ID NO: 25560 - DNA, 610 bp, Triticum aestivum
  unsure (1)..(610): unsure at all n locations
  Clone ID: PAT_TA_25560
agcagtagcagcagcgcctctcttcccccccccctcccccctccccggcccctggtggggggggtgggtggtctggctccgccatacttaattgcatgcgcctgctttgatctctccgtccgtcctcccgcgacccgcatccatccgtcgatctcacttttctctcccgtcctcccaagctcttgcttccaatcaactcctcttgctggtgcggtgctcactgtactctctccctcttcctcttcctgggcgaggacccgaagagaggggtgggcggttcttgtccgcgtacggcccggacagccttttcttgtcccgcccctccttgctcgtcgccgcccctcgcgggctccccccgccgggccgggcttccgctgaatcctccggtcccgggccggcgtacttgcgtacgtgtggggttggcatggactcgggggaccccaagaagccctccccgggcctccccccgggggccgcgccctccccccccgggccggcaggctgcggcaacgcgctggcccggtggcgcccccccccgtgnnnnnngnnncnggtccnngnggcggcggtggcatcngtgnnnnnnnnnnnacnnnnnnnngnnncttac

SEQ ID NO: 25561 - DNA, 431 bp, Triticum aestivum
  unsure (1)..(431): unsure at all n locations
  Clone ID: PAT_TA_25561
gcctcctccaccccgccgcttttctcccccgtccgtccgcccgtcttccgtccggtgagagagagaggggagataaacacagtttgtgaggagtgagaagcattaagtggcaggagaggcagccatcaccaccccgtacgtgttgggcgtaattatctcttcccccgagcggcgatttctggcctccgtccctcgccctcgctccgcgcctataatattcgggtaggggggtcgttcccgtccacgcttcacngcaggttgttccttctcggggcgggaaatggcgggggagcgcaacagcgcccgcgccgccccctggctgccgggcctgccccgcgccgacgtcctcctctccgacgagaaggcggcggccgccgcggcggcggcgtcggcggccaggagcgacagcgannnnnnggnnnnnncnnnnn

SEQ ID NO: 25562 - DNA, 147 bp, Triticum aestivum
  Clone ID: PAT_TA_25562
cagtcctcgacgtcggagacgaggtcgacgccgacctgcttcttggctactaggcgccactcttccatgttgggcacgaactcttgcgccgtcgtgatcccctgctggaggaagattctgtcgatgtcagtatcccgccgacttccc

SEQ ID NO: 25563 - DNA, 626 bp, Triticum aestivum
  unsure (1)..(626): unsure at all n locations
  Clone ID: PAT_TA_25563
gcacgagggtactcttcccttattcactaaagtggcattggttaaaaccaatgaggctgaagctcatgctcttatgaaaatgcttttaaaccatggagcagatgtgaacatattggaccagggttttcttgaagaaccagcattgatcatcgccgccaaaaacgaatggaatctggtcatcgaccttttatttcatagaacaaaacagatagctggcatagaggactggaccattgcaaatttactcatccatgtccagacagaagagtttttgcatcaagaccgtttgaggaaagcaaataaaatccagcagctgcgccccagaataattgttgaactggaagctagaaatgttgttgtcgcgatctatctttgcaaggctttaaaatctgatatggatgaatgggactggagcaacatcagcagtctatgcgacctctgtgtacattttggaatgacgtcatctgaatatgaagtaacagtggaatctatttctacgtacacaagtgcttatttcttatataagcaatatgataaggctcttttagctgtaaaggcttgtcttgccctttaaccagacaaccaggaattgatcagactccacacaaagntgaaaacgttatctn

SEQ ID NO: 25564 - DNA, 611 bp, Triticum aestivum
  unsure (1)..(611): unsure at all n locations
  Clone ID: PAT_TA_25564
gcacgagggagactagtctcgacgcgagctagtggcggcggcgtgtgctcacgacaatggaggcggcggcgctgaggaggcctagccaggaaggagatcctggcgagcggagcctaagttgttgcgagatgggacgggtcagatctgggttttgatttgggcccgaggggttggtctgttgcgtggctgtcccctggagcgggtgacggctgtcacggtggctctggtccttgcccgaggtggttggaggctgctgctcctcgcctgggttgctggtggagtttgggccgtgttctctcagctgtgtgaggtgttggcgatccatggcggtgcggcttcgacaacaaggtgctacggtggcggcggtgcgaggcttcatggacgtgccgcctcaaatctcggaggtgtggagatgtgtggccatacagatgaaaatccagtccgatttttgtcanncctgcggcgatggcacctgtgggtgccattcccctccttggnnncgtcgtcgagttatgtcgccatctccctcgctcgcttggtgtgggtaggtgtctccgggcgaaagcctnnnnnnnntgctggatnnncacgatggcgacnnnnncgacgtc

SEQ ID NO: 25565 - DNA, 721 bp, Triticum aestivum
  unsure (1)..(721): unsure at all n locations
  Clone ID: PAT_TA_25565
cctaccttcgccgcgtccgcgtccgcatcactcttccgcgccctggcgccgccgcgtccgccacttctcctcgccttgtcgtccccgtccctctctcatagccgagctccagccctccaccatcccctcctccttgaccgcctctcccctcgtctgaaggagcacggggctggcagctgcgcctgagccgccacaaggccgtcaggtagagaagatttggtgccactggccgttcccaccgctgtccgagtccgacgtctcggcgcggcctgcctcgccggcgcctcacgcagtcggctcgccggcgggctgctgctggcgggctccgggccggtccaatctgcagcaaatccttgggagatatgacggtgtactttggaatgctcgacggcttgctggctgcagaagagcttcctgaggaataccggaaccggtgccaggatatactctgtgacgactgcggaagaaaagggctttctcggttccactggctgtatcacaaatgcgccgcctgcggctcgtacaacaccagagttatcaagaccgaggcaccagactgttccacgtcgaattaacagggagtcgttttctgttttcttcttctgctcgattcttttggaaattcgcctatgtaatatatctcggtacagaggaacattgcatatgtatagctgtgatgcttaataaagtcagttcggannnnnnnnnnnnnnnnnnnnnn

SEQ ID NO: 25566 - DNA, 643 bp, Triticum aestivum
  unsure (1)..(643): unsure at all n locations
  Clone ID: PAT_TA_25566
aaactggaatcgaggtagttgccacgggctaggcactgggtctggactctgtagttgaaggccggccaaaaaccctcttttccccctgttcatctccatcctccccagtccccagttctcacttctcagggaagaggaagacaccacccaaggtccaaggacgacgtgcgcgggccggagaagtacaatggcgccgctcgccggagccgccgtcgcctcctgcatgatcctgctcctcctgctcgtcccctgcgccccagggccaggggcaaccacccgaggcgccggaggaggcttgggccgagaggcaaccacccgaggcgtcggaggacgctttgacgctgctcttgtccgagggcgggtgcggcgccttcgccggcctcgtcgccgcgatggccggcgtgggtgacgcgttccgcgagcagatcggcagtgacctggggctcaccatcctctgccctgacgacgaggctgtgtggccgttcatcccgaggttccatagcctcaccgtcgacgagcaggtcgcggttctcctgtaccacggcctgacgatggcttactccgnnnagctgctcagccaggtccactgggagtgggnnnngttgacgtttgatggggagcagncactcaccatccgtcannn

SEQ ID NO: 25567 - DNA, 1082 bp, Triticum aestivum
  unsure (1)..(1082): unsure at all n locations
  Clone ID: PAT_TA_25567
gcacgaggcagcaataaacagggagcaacacagtctgatttcactgttgataagcacaaggatgtagcggagtgtgtccgccatgagtggggtgcacctgaggatgatcttgctatggacaggacagcttaccaaggtaccagagattggggtatagttaacaaggagaaggttaagctgcctgcggatgatcgtgctatggacacggcagcttatcaaggtaccggagattggggtatagttaacaaggacaaggttaagctgcctgaggatgatcgtgctatggacacggcagcttatcaaggtaccggagattggggtatagttagcaaggagaagtatacgttgcctgctagaagatatccacagaagcccagaaaacttaactgcccctcttacatgtcaaaagggacctgcacatacgggccctcatgccacttcaatcacccaccgcagcttaaatctaggtcagatgaatcatggcgtccctctgaacgaagaaaccatggcgctgcagaaattctggaactgaaccgccttggccttcccattcgtgaaggagcaagaaactgtgactactatatgcgaactggtgcttgcagatatggcaaaaactgccattttaaccatccagaccatgtcattgatgctcagttcaatccaccaacagggtgggaggataatgctttgcagcaaatggagaaatcttctgaccgtacattagatgagacatcacacatgaagaaatcttccgatgatgcgaccttagataacagatcacacatgangaaatcttccgatgatgcgaccttcgatgacagatcacacttgaagaaaccttntgatggtgcaaccttanatgacagatcacacttgaagaaaccttttgatggtgcgatcgtanatgacacatcntactcaaagaagtcttctgaccatgacaactcatgtnnnttttggtgtcctgcaccaagnnttttagaatgnttttcctcccaaaangttctngctngnccggaaggaaaggcnaaaaaanttangnttggtcatnanacanttccgangttgntttnancnnaagt

SEQ ID NO: 25568 - DNA, 1218 bp, Triticum aestivum
  Clone ID: PAT_TA_25568
gtctcctcctcctcccaccaccccatcccgttgctgtaactccgataagcgcgcgccgccgccgacggccccagaagccacctccgagctgccatccgcgggaagagcgggtggcttgaccgattctgcgaggacgaaggggaggacgaacgtacgagggcctggcctacacgtgaccaccgcggcgaaaccaaagaatggcgtaccgggcggacgacgactacgactacctcttcaaggtggtgctcatcggcgactcgggcgtcgggaaatccaacctcctcacccggttcacgcgcaacgagttcagcctggagtcaaagtccacaatcggggtcgagtgcgccaccaggagcattaccggtcgacgataaggtcgtcaaggcgcagatctgggataccgctggccaagagagatatcgtgcaattacaagcgcatattacagaggagctgtcggtgcgcttgttgtgtatgatgtgacacgccatgtgaccttcgagaatgtggagaggtggctgaaggagctcaaggaccataccgatgctaacattgtgatcatgctagtcggcaacaaggccgacctgcgccacttgcgggctgtctctgtggaggatgccaaggcatttgcggagagggaatacacctttttcatggaaacctctgccctggagtccatgaatgtagaggacgctttcactgaggtgttaacccagatctaccgagtggtcagcaagaaagctcttgacatcggcgacgaccctgccgctccaccacgagggcagaccatcaacgtagggtccaaagacgatgtctctgccgtaaagaaggctggatgctgctcatcctaatccgtagactttgaaaagtataccgggcccttgtttatcattgatggatgggtagctgcgtcttgggcgtgcttttggaggcccatacttaacccagggggttggaaacgatataaaacactaacagtaatagaactagcagccgttttttggtggcagtcatggtatcctaattgttgcagtcttggttcatatcggacgccaaggatcccttccacaatcgattatgtatgtaccctattaagtatgtgtaactgaagctttcatccttttctcctttcttttgagagaaactgttgttatcttgtttgtatgattcttcacattttgctaatcagtgacataatgtaaatcttatggaggaatact

SEQ ID NO: 25569 - DNA, 677 bp, Triticum aestivum
  Clone ID: PAT_TA_25569
cacaaacataacagtcttacagtacgtagcagcagcctagcacgacgatggtgtccggcagcatcagcgaggagatcgccgtggccgtcccggcggagcgcatgtggaaggtggccttcgccgagaccaagtcggcgctcctgcccaaggcctgcgccggctacgtggacgccgtcgaggtcgacggcgacggcgggcccggcagcgttaccaccatgaagcttaacccatcgctgggtgagaacaagacgctcaagagccgcgtggtggcgttggacgccgcggcgcgcgtggtgaggacggaggtgctgcagggcggcacggtgagcgcgcagctcaggacgcacttcgccgagatcagggtggaggccgccggcgagggcgcctgcgtcgccaaggtcaaggtcgactacgagcgcctcgacggcgcgccgctcgcgcccgaggacgaggccaggctcgcgcaggggtacgtccgcctcgtcaggatggtggaggcatacctcgtcgcgcaccccgacgagttcgcctgagcccccacctttcctacgtacgtgtatgatcatgccatatggccgtgagtgttttggtttggaataacgggaggaaaggtcctctgtttggttgctcaattcgcttcgaatcgagtatagacgactgtttgattgttgtaaaaa

SEQ ID NO: 25570 - DNA, 655 bp, Triticum aestivum
  unsure (1)..(655): unsure at all n locations
  Clone ID: PAT_TA_25570
tcatcnnnncntggcaattnnnatccgcccgacgccccgttgccgttgccagccgccgcctccccccgcgcgccccccccagccggggctgtccggattggagttccacctacccgcgcctgccccccccggccacgagcggcagcgtcccggccggcgtcggggtccccgtcccggccgcggtgggggtccgcgccggctgcgctcctggtacgccgcccgcatcgtccccgtcgcggtgctgagccggctggtggtgcttcccgccctcgccgccttgttcctgcgctcccttcgtggtcgccccctcccgccgccgcccgctcttcgtcaccggcagggtcattgtctcgccctgctgggctgccctggcgggggttggcgcggctcccttttgggctactgcgactcggccgcacttctgctgcgctttggatgctggtcgctggtctggcaactcagttggttctatactcccgacttgcggtgctgcttgggtcagatgttgatggcaacatcgagaatgtggccactattagataattagaatgtcatatttaaggtcaacatttcaaccattgtagttgattgcaaggttgacaattgggctactactagattgtctcacatcttgtaatctttggaatgtattctt

SEQ ID NO: 25571 - DNA, 513 bp, Triticum aestivum
  unsure (1)..(513): unsure at all n locations
  Clone ID: PAT_TA_25571
gcacgaggcctcgtgccgaatctcgaactcgcgactaccagatgttgtctcttcctcttcctcgccacgccgaagcccccaaccccaagtctcccgaccacctccgcctgcctcctccgcccgcgcggccgtctcctgctcgggtccagcagatgcagagctgccacgaagtatcagtcggctgagtccccggatgcttcgagcctgcgcctcgcctccgtggccgctccctccccgcccgcctctgtccgacccccagacggcggcggcctcctcctcctcctctccgtcgctgcttccgcggttgcaatatctgccagcttcatattcttttcggcgatgccctccatgttggactgtaagagggcagcagagtctcttgaaaagtcatttgacctcacaagagagaagcttcctgaaagtatggcttcagtgagactagttgcaaaagagatcggtgccttgagtgttgatctcagtgacctaagtcaagaattgacgnnnnnnnnnnnn

SEQ ID NO: 25572 - DNA, 654 bp, Triticum aestivum
  Clone ID: PAT_TA_25572
agaaaaccttattcacacgcgcacgcaccaaaatcaccttcaatctcatcaccgcggaaggggatggccgccgccgaggagggagccgtgatagcgtgccacaccaagcaagagttcgacacccggcaagctggtgatcattgacttcactgcttcctggtgcggtccttgtcgtgtcatagccccagtctttgctgagtacgccaagaagttccctggcgccatcttcctgaaggtggacgttgacgagctgaaggatgtcgctgaagcatacaacgttgaggcaatgccaaccttcctgtttatcaaggacggtgcgaaggtggacactgttgttggtggcaggaaggatgatatccataccaagatagtggccctcatgggttctgcatctgcctaataagtgaagagtgataccccggttacatcaataagagccagcacctggtgtaagtagttatcgctgcggtatgctttggcttagtcgtgacagaactttgtgttgattcagtttagagttcagaacttcagacatatgcactagttgttctgaattacagtacctaatgtttgctacagttgctttgttgtgaagtttgtttaactatcctgcctgaaatgtgatggaaagccaatatgccgctggccttattt

SEQ ID NO: 25573 - DNA, 739 bp, Triticum aestivum
  Clone ID: PAT_TA_25573
gccggccccaaagacaacagaatcccacccccaagacaacagaaaaccttcttcacgcgcgcacgcaccaaaatcaccttcgatctcatcaccggggaagggggatggccgccgaggagggagccgtgatagcgtgccacaccaagcaagagttcgacacccacatggctaatggcaaggagaccggcaagctggtgatcattgacttcactgcttcctggtgcggtccttgtcgtgtcatagccccagtctttgctgagtacgccaagaagttccctggcgccattttcctgaaggtggacgttgacgagctgaaggacgtcgctgaagcatacaacgttgaggcaatgccgaccttcctgtttatcaaggatggtgcgaaggtggacactgttgtcggtggcaggaaggatgatatccataccaagatagtggccctcatgggttctgcatctgcctaagaagggaagagtgatgcccctcttgtgtcaataagagccagcacctggtgtaagtagttatcgctgcagtatgctttggcttagtcgtgactgaactttgtgatgattcggtttagagttcagaacttcagacatttgcaccggttgttctgaattacagtacctaatgttttgctacagttgcttcgttgtgaagtttggataactatcctgtctgaatgttaatgcaaagccaatatgccgctgaaaaaaaaaaaaaaaaaagggcggggccccta

SEQ ID NO: 25574 - DNA, 623 bp, Triticum aestivum
  unsure (1)..(623): unsure at all n locations
  Clone ID: PAT_TA_25574
gcacgaggctccgccccgcggggagctgcagccgccgccgatgtgagcaagcgccgcgcctccccttgcatctccgatggtcaccggcgcagccccgtcgagcactcctcgtccgaagaagaggcgacgacgggttgatggcgagccccttctggcgcagcgctggcgaggccgagggtcgccggagcccacgagccagcgcggtggccgggacggcggtcgacggcggagacggcgcgtccgaagagtcggccaaagcgcctctccacgcggctgctcgagcccgcggtggttaccagtggtggcggggcggtggcgtcggcgccctccatcccgaccccgaggcggacgaccccggaggcaccggtcggcacggagacaaaggcgagcgcctcctcctcgttcaccaccgagcacatcggcactggggcatagccaggcgggcctcggctcgagccagcaaccatggcgtcaggtgtcggcgtcgatggcgggatccaagcggctggcggaggagggggtggaggcggagaaccanggggtggtgcaggcgcggctgcattcctgtgcaccatggaggcgctcgggcctgccannnnncannggntcgaaccccatgggcn

SEQ ID NO: 25575 - DNA, 711 bp, Triticum aestivum
  Clone ID: PAT_TA_25575
ttcctcgatccccccaagtgaaattctcgatccccaaacaccagaaccctcgccaagtgaaattctcgatctccaaacaccagagcctcacagcagccagatccccagccaccccaagttccgatggcccgcacaaagcagacggcgcgcaagtccaccggcggcaaggcgccgaggaagcagctcgccaccaaggctgctcgcaagtcggcgccggcgaccggcggcgtgaagaagccacaccgcttcaggccgggaaccgtcgcgctccgggagatccgcaagtaccagaagagcacggagctgctcatccgcaagctccccttccagcgcctcgtccgtgagatcgcgcaggacttcaagaccgacctccgcttccagagctccgccgtctccgcgctccaggaggccgccgaggcgtacctcgtcggcctcttcgaggacaccaacctgtgcgccatccacgccaagcgcgtcaccatcatgcccaaggacatccagctcgcacgccgcatccgcggggagcgcgcctagatttggggtcgccggtaatactggtagtagctgttcttgtcttgtgatctggatgggcgtcggcctgtcgggtgcttctgtttgttggtgttgatatgacgtgtcttctgatcctaatgtatcgtgatgctcgaatgaaatgccaatggaaagttcagttaccaaaaaaaaaaaaaa

SEQ ID NO: 25576 - DNA, 607 bp, Triticum aestivum
  unsure (1)..(607): unsure at all n locations
  Clone ID: PAT_TA_25576
ccgtccggtgaacagttccaaacagggnaagcagggnaagaagctgtcacatagcatcatcagcgagaagcttgctgcttgtgtcaatatagtacctggcattgaatccgtgtactggtgggagggaaaggtacaatctgatgctgaagaattactcatcatcaagaccagggaatcacttctggatgccttgactgcacatgtcaaagccaatcatgaatatgatgttcctgaagttattgctctgcccataactggtggtaacaccaagtatttggaatggatcaagaacagcacccgggacaagtgatctcttttttttttttggagctcgacataatgcgatgatcgaagtgcccatggctccttagctcttccagtggcttgcacacaactacacaagggagtttcctctcttgacctggacatctcagttacgttgctgtaccgaatccatatctaccatcttcaggtaaacaagtgatttggtgtcccgtgtgggtaatccaaatgcatgcattgctctgagtattgacaggttggctagtgtaacgtgtaagtccaaaccagatcgtatccaaacatgcatattgttggtttttgatcg

SEQ ID NO: 25577 - DNA, 794 bp, Triticum aestivum
  Clone ID: PAT_TA_25577
gcacgaggaaatttcatttatatcattaaacagaataagcagtgtcacccaggccctcttgggagactagtatcttcttacacgatgctctcctctcctccgccatctccgagcgaggtctcccggcggcgggtattgtctcccggccggtcgtgctcaaggaagacagccgtgtgcctcttcctgggacgctgctctgtgtgcctcttccagggacactgctccgtgtgccccttcccgggaagctgctccttgtggtgcctctgccctgtacgacgctctccggctgctgcttcgacccaagttccgacaccatgtagctcgtcaagattttgggcagctggagccatgctccatggacgaggaggatgaccgggaccccaagcccaagccaacgagcacgacgagtatcgtcgagccatgcaaatgcacggcagcgagagattgatgatgtcgacgtcgttacccccaaaagttgcaaggtgtcgaagtgctgagaggtggaagcattattgtgtaaaaaggcaagatgaggcggacttgtgtttttctttgttggctggtagctgtggacgtgtactaaatgaaatggctggtgatagttgttcttgtacacaacataaaatggctctggtttcttggtttcatggctttgttggatggtagctgtggaagtgagctcaagtgttgaatattgatgtctgtcatcttgttcatgttgttcccagtcactacttaaagcaataaactcctgagggattgaaacttgccactgcaaaaaaaaaaaaaaaaaa

SEQ ID NO: 25578 - DNA, 696 bp, Triticum aestivum
  unsure (1)..(696): unsure at all n locations
  Clone ID: PAT_TA_25578
catttcaatgttccatcctgcagatgtgtaggcccaagtatttagnagtttgtcgatgccagaaacgaaccggtgaatgttgagctttctgttgatgagancaagggttgcacattcaatagccgttccagggttgctgtttttaaggacactgaaaaagatcgtagtgatcctgactacgatcgtaattacaaaaggtatgttaggccccccgtgcctgactatggtgtgagcccaggcgccttcaattttgccgtgcctcagtttgtgcagtatggtgttggttatatgcagtctcctagcatgccgagaaaccaaccttctgtgtactttggtcaacctgatttatcgatgggatcttctggaactgctgtttacccacagtggcctaccccagcaatgatgtacccccattgctatgacaatcttggccatgtgatttctcaggttccggtgtaccagtccttcaaccatggttaggagatgctatacttcatgggatgttggaacaaaattatttaaaacctgctatgtcgtgttgtcttgttaagtgcgtctattttggagtcagtttttcccatcatcgaacttctggatagtgtcagctaggtgtataagaattcttattattgttattgtgcactaatctacaagcaggggcgcttgtcttttgctcgtttacttctgtatttggtt

SEQ ID NO: 25579 - DNA, 1575 bp, Triticum aestivum
  Clone ID: PAT_TA_25579
gaaaaatccggagccgtggtcgcgtcgggaacccgctcctcgcttctcctctccctcggggctccgcttcgccttctccgcagcgcagccacttcgggatcgggaagcgggaggggaagggagaggcaggcgagtcgccgtacccggccgcagctcccctctctccgcccccgcctacccctgccacccacccctacccccgccgcgcacgatgagctccgcccccgccccgccgccgccgccgccgccgtcctcgccccccgccgacgaggggcggccgagggaggcgacggaggtggacgaccgggtggcctcccacgtcgacccgttcctcgtggaggcgctcgacaacccccgccaccgcctcatgattttgcggatggaattggatatacagaaatttatgcagaatcatcacctgcatgaatttgaattccagcattttccaacttcttacctccgctgtgctgctcatcgtgttgcacaacattatggtttagagactacagtagcagatagcttagttgatggttctaatagcaggatagttgcgagaaaaacacctgaaagcaagtatccagctattgctttatcagaagttcccgttaaacaagcaagaaatgatattgaggcagcagaaaagcttaagtttgtcatttgtcaaaggcccaaagcttcccaaaatggtgcatatggtgctggaaccaacaatggtgcggctaaaactgttgaagagaggatagatgattacaataaggcacgggcacgcattttcaatggttccatccctgcagatgtcgtaggcccaagtgattttggagctttgtcggttgccagaaacgaaccggtgaatgttgagccttctgttgatgagaacaagggctgcacgttcaatagccgttccagggttgctgtttttaaggacactgaaaaagatcgtagtgatcctgactacgatcgtaactacaaaaggtatgttaggccccccgtgcctgactatggcgtgagcccaggcgccttcaattttgccgtgcctcagtttgtgcagtatggtgttggttatatgcagtctcctagcatgccgaggaaccaaccttctgtgtactttggtcaacctgatttatcgatgggatcttctggaactgctgtttacccacagtggcctaccccagcaattatgtacccccattgctatgacaatcttcgccatgttatttctcaggttccggtgtaccagtccttctaccatcattgggagatgctactacttgggatgttggaacaaaattatttactaccccctgtgatgtcttgtgttcctgtgtaccgcgtctttcaactatggttttggagttgccaaacttcagtgtgatgtttggaacaaagtattagtataaacatgctaatgtcgtgttgtcttgtttaagtgcgtctagttttggagtcagtttttcccatcatcgaacttctggatagtgtcagctaggtgtataagaattcttattattgttattgtgcactaatctacaagcaggggcgcttgtcttttgctcgtttaaaaaaaaaaaaaaaaaa

SEQ ID NO: 25580 - DNA, 1271 bp, Triticum aestivum
  unsure (1)..(1271): unsure at all n locations
  Clone ID: PAT_TA_25580
ctcctctgctccgggctcctccggcgctctcgtgccggccgcgcccccggccccgctcctctcgccccccctttccatcacgtctccgcttcgtttcgattccccttgtccgtcgctcctcggcgcctctgcctccggtgctggcttgcagtggttccggcccgctccccccggctccgttggggccccaggaccgaccgatccggcccgtcggggcttcatccgtgcgggccgcggatgcgtttgggagtcggtttcactgtgcccatttctgtttccatctgtgggtcctgtgtgcctggtattcctattcgcatccgcgtgcggtggcctgagcctggctttctcgtgcggggctctgagtactggggccggaggatgggccaggctcagtgtcccgtgcgagttccgattgctgcctcggttccctcacctgcgttcgtccgcgagatctctctgcgttcacatcattgggacatgccccgccggtcctccgggttcccttcccgctctcgattattctggctatgatcccgcatggtgtggtggttccccgaccgccccgcttgattccgctgaatgtttcattggtactcatgggttttctgattgattggttggttgcggttctccggttgttgttctgatgatatggtcagatcttctgagtgatgaagcttagggtctcctaccaacctggaacctgcgatctgcgtttggataataaatactaaatccctcccaattttagtttcttggttcgcacactagtcaacggcatgcaattctgatctgaattctttgcttctccagaaattataaattggattacacgccatagcggaagcaacatctgcgtttggatgattattaccccctctattttattccttcatccatacagttcttagtctgttctgaattagatttgttcatggttgtccagaaattgggattatacggcttaccgggagcgacttgttattcttcctcacctgtgtttggatgatctgttcattttcttttctccacagttcaattagtctccacacaattctgatttggatttgttgctcctactccagaaaattggaattatacggcatagcgggtggccctgggcggttccttttctgtggctcatcaaatataattaaaacacaccaagacaagttttctcctgccttagtttgtcaattgtcagctcttgcagacatcgccttgggaagggataaaaatggatccgatgcttctacctgacntcccangac

SEQ ID NO: 25581 - DNA, 1065 bp, Triticum aestivum
  Clone ID: PAT_TA_25581
tcgcggccgcgtcgacggaaactcccatccaaccagaagcggcaaaaccaacagggaagggcacaaaacctgaaaatgtccgtgatgataaagtggacaacctctacaacgatggccaccagtactttgctgacattgtggaaatgggagcaactgatcctgatgcaatggagtatgttttgtctgtgatgaaagaagctaaagagaaggtacgcaagtttgaggaatcccgaaaagagaaaaggcctggagaaagtccagtttctgctagtaagaaaggcgccaaatcttcgaagccatctgctgaagatgtgggaaacagcacatctgcacccacaatgatggtggcagccgcttcagcaactctggcggcatctacaccaatgccagtgccgtcatgtacacaaatgtcagtgcccccaacaatgatggctatggctaccacgtcggcagctgtccccccaggaatgtttttagtaccgatgcacccacatatggtttttccacccttcacccctggattaccagcagcagtaccacctgtagcgccacctccagccccaacagccaatgcggtgggcgttgtttccaaccccacgaagaagagaaagaaaagaaaggggaatagttgagcttggggtcaagatgagctgcacttgggattgcctgctgtacattatctcgcccttggcttggaaccactaatcttagttagcgcagctttggactgcctactgtatacatgatcagccttctgtcggatgtaatcttatatgtagcgcggcttctgaatgttagtctgcttctgatcttgtggatcacgatttggtggaggctggtacaacccttgcagactcttatgttgctggagatttcgccaaattatgtgatcacgccgtatttatggccaaccaccgatgcctgttagtttctcgttagggaacacaccagtatgctcatcgtacataaactcatcatctgttatgctgtgggtactgaagtatggatcgcctgttttgaacccccattattctactccatccgttcctaaacaaaaaaaaaaaa

SEQ ID NO: 25582 - DNA, 1068 bp, Triticum aestivum
  Clone ID: PAT_TA_25582
cccgcccaatcacaatatatgatttttctgttactaggacttggtgataattagttgattgttgtgatctagtacttgcctttgaatgcctgaagatatttttcgttttgaatttttgcattcatgtactaggaatctaactaaaacataccttgcatgtgattactatttatggatgtattttttccgaaaaggaggggaaacccctggcctctgcatcggttgatgcaagcagccatctattgttgcatagtttcagcatgcatacaagtcatacaagagtacaaaagactagcacaaccagttggtaataagattacacgtttcccttatgcctcactaatcctattaccagaccgctatccaatggacatcaagatattgtgttcgtgtcatctgcgcagtggtttgctataacaattccaaatgctatacggaatatggcgatgcacctagtcgtctgtaaattcaagctatattgcaagccaacagtgggtcggaactgtatcgcagaactgtgacatttgccaaccttgttcaaaatagtagaaactggcgggatttctaattattcagtgacacatgttgactggtctgaggggaaatggcatccgtgttcctatgtagcagctgagcttacctacgaaacgattagaaacataacgtatttcaatgagattgtgcacattgcaagtgatgagactagaactgtgacatcgaccccatgtatattgaacggaagaaagagaccgtgcttcctttttgcaagaaaattttacccagatgctgtcaacaatctactgaagctatttcccagttacacatctgcttgaattctacacgattctttgccactggcctaggattcccctaggattttttcttttatgtaaattttgcaattgatacctagcttcttaacagagatccagggccagagacatgtcgttgctacaacaatagcgacgccctgtcattctgggaccctaggtagggctgatgtgatatctatttagtatatggacactgccctcattgtaatccattgtgccttgtgcagtttctgtt

SEQ ID NO: 25583 - DNA, 790 bp, Triticum aestivum
  Clone ID: PAT_TA_25583
gcacgaggcagtttgagataagtagaggtaagagtgttcagtgttgtctagttccaactttatgagtaccaaccgacaggcagctatgtatgaagttaagtaccgtgcaaattatctaatttctccctggagttcctttcccccatttatggttaacctcaccccaatcaagccaagcggcagtcttggctatcttcccagccatagttaccctgttatgatctagggatcatagatcataacataagagttcaaaatgtccacttgtcactatttttagcatgtacgataagtgctaattcaacttaaatacagtttggaatcttaagctgcctcatgatgggaagttcacaatcttagagaaaaccttcagaaaaaagaaacccataaatacacttttcgctagacatgacataggaactgacaactatcctaactcatacttttaatgggagcattcatctcatggaccagtagtgcgacgccttgctcatctatatgtgttgaaaagaaatggacatgatccatatagacttgttttttttaaagcattcatatagatttgttgagtgatgtacgatatataagtcaaaaaattataagcttcttaatcatattgccgcctataagcttttcccactaatccttgttgactgcaatagctgtggagtcaagatggtgtcttctcagttctaactagaagaaataaacagggtgaacttccttctaattaaatgtttattttctgcttattctggaaccctaactagtcttggcttactttaaagtt

SEQ ID NO: 25584 - DNA, 1415 bp, Triticum aestivum
  Clone ID: PAT_TA_25584
catctcctctttttccgatcctccttttctcattcaaatcaatcatgcattcttatgctcctgttctcatgatggtgctcgcagttagtacaagggccatggggcactaccactctgccgctaccgctctgggagcaggccctctggggcacgccgtttccggaagtgctagctgattttgttcagaaaaggaatggatcagtcaccgctcgtggagcactactctggacagcctattagcagcgtgtagcaccctcttctgcactatctgcaacgcgcgcacggtggcggagaccggcatcttcttccgcgaggccttcagctaggatccgggcagcaccatgaccctgtatttcccagcggaggcggagacagccatcctcccgcacgacatcgccggcaaggtccccttcgagaacctaagcgacgtcctctccacgttccacatctcaccaggctccgctgaggctgcgcaagtggaggacaccctgcgcaagtgtcagcagccgccaatcgccggtgagataaaagcctgcaccatgtcgctagagagcactgtaaaggccgccatggagatgctcggcaccaccatccagcagggtggtggtggtggtgacgtgtgggcggccacgtcgacgctcccccgcggtggcctgctaccacaccgggagtacattgtccaggaggtcaccaagctagagggcactggctacgtggcctgccacaaggtgccgttcccatacgccgtcttccattgtcacatcgcacatacggggtatataggttacaaggtcaccctccacggccgcggcgacaacgagggccctgtggtttccttgctggcgttctgccatttcgacacctcccactggaatccggcacacccggcgttccagatactgaagacccaccctggtgccagtacgtcggtgtgccacttcatgtcgtatggcaatctcgcgttcatcaagaaggcacgcacagcctagcttgctactgcatccttcgttgcgcgctacatacgccagtgtcgtgctctggacatcaacgtggcgctcttttttcatatatgcaccgtaaatgtgtaaatgtgggcattcatccgttctagctaggacggcgtcttctatatatagaataagaataagaatggcaccatatatagttctagctttggcatcagacgaaaatataagggtgtagcaatggtacggtgtgtgtccaggtttgtttggatggatgttatatgtaagcacctatctctactgggggtgagcggggactccgatcctacatattcctgtccactgctggtacaggtcatggttactactgtatgaacgttgggtggcccgtccgctgcggcccggctaccgtccggcatgcggtattttcgtgttaggtgtaaaaaaaaa

SEQ ID NO: 25585 - DNA, 783 bp, Triticum aestivum
  unsure (1)..(783): unsure at all n locations
  Clone ID: PAT_TA_25585
gcacgagggtgacgctctgtttatttcagcaagaatgctatctgggtacgttaccaaagcaggactgtataccgagacatgtacaaggagtaccgtgtcgccacccccgtcaaggggatgtacagagatggcttcccgccactgtgccagatccccctgcatccagatcatcaagactgccactgtccacttcagcatctgcaagcgtgataacactaagcagtttcacaagtcagacatcacgttccgctggtctaccagaaggtcaggcaaccaaccagattcctgcagggtcccagcagaggagagcaagttccatccatcccaagccctggagcaggcgacgtgaacattagagacggttcaacgacgtccgcatctgcaggcatgtcggccgacaagaacatgaactacgccgtcctgacatcagcatctgcagtcgtgtgatgtttggcatcggctacaactctgacgatagatgcaaacgacggtgacaagttactaccaaactttggcccaagagtggcaagacaccaaggangagaagtaccaccgattgaaagcaagatttggaagcactatgtaaaatggcaagacgagcctgacatgctacttgtgtgatctgtatgttggccaagtgcttgctactccctctgatccaaaaaaagtgtcgtggcttcaaccaagatactttttttggattggagggggtaattgatatgcctggtttgtaactgggttggctattgaactattgctggcgagtgcttgtgctttgtttgt

SEQ ID NO: 25586 - DNA, 740 bp, Triticum aestivum
  unsure (1)..(740): unsure at all n locations
  Clone ID: PAT_TA_25586
ccaccaggagggatcctgaccgccctctacatcttccacggccacgacatctctcgtgggctcctcgcggcgacgttcctcctcgtcgtgttcaactgccttagcagcttccagatatactccatgccagtgttcgacagcttcgaggccttctacacaggtcgcaccaaccggccctgctcagtctgggtccggtccggattcaggatcttctacgggttcatctcgctcttcatcggcatcgctctgccgttcctctccagcctcgccggccttctgggcggcctaacgctgccggtgacgtttgcctacccgtgcttatgtggatctgcatcaagaagcctgagaggttcagctacagctggtcgtgaactggggctcgcctgctcggaccgcttcacttgcctctctgtggtggtgttggacatattatctggataaggatgaagctcaagttcttcaagcccaactagcatgcttactgttttcagcttgcaaatttatgatatataggtatatgcttcttatattgcatgcctgggcaagaccaatggcattaagtggtgttgatcttatattagtaggctttgtcttggtaaaatgtaagtatcccctgttgggtaagaaaaacatgagccgatcaaagcctcctagtggcaacctgatgaaggtcgaatgtaacttgaacaatttatataacgactatgtctnnngtacttttttttctcaaaaaaaaaaaa

SEQ ID NO: 25587 - DNA, 597 bp, Triticum aestivum
  unsure (1)..(597): unsure at all n locations
  Clone ID: PAT_TA_25587
gcacgagggtcacgttctctcccctccccttcctcctgacacagccacccgcctctcctccggctctgacccaacgccgccgccgatctcctcttccgcatcacctctccggcggcctcctcttcccatccacgccgcgccggcgacctccctatcctctcctctgtctgcctggtcgggccgagaccctagcccgatgccatggcgaccatggcagcaggaggagcccggtcatggcggcctcctctccctgcagcgctgccgcacctcaccttctcttctcttctctcctcttctctcccagtnnnngagaggaggggagggaagggaaggccttctccggcgagcttccagggaggtgaggagcgcccagatccagatccacggcgcatcgtcccgtcgtcgacctgagccgcgaccatccatccagggccgacagaagccaggacggagatgccagaaaccctagcctagcctagccatggaggtacgacgcctcaacctccgggcgacagacgacggctgcagnccatctccggtgacggatctccgaccccgnccatggctgctgctgctgnnnnngcacgtcgcctgccn

SEQ ID NO: 25588 - DNA, 2111 bp, Triticum aestivum
  unsure (1)..(2111): unsure at all n locations
  Clone ID: PAT_TA_25588
gaaaacaatggagggacagcgcgtccgccatgtgtaaccgatgcgatgctttgtttgattgcaatgcaaaggtgcgtgtgaaaggaggcagagtgggtagcggcggcggcgccctgcgtgtgtaaagatttgggggctttgcgtgattctctcccaggtttcttcttgattcaggtaggcaggcaggcagttttccagaggctgtttcttgcgattttgggaggagaacatttgatccgagtgttggtcccaggtcaaagtgggagccagagattttgtctcttgatgctttagaggcgttgtttctccagttctgatggaagccaagggcgcgggcgagcgggatgctctgattgacctggagagtgggaacagcgttgttatcagcgagcatggccatggaatggatgctaattttgcggtgagcccacccagaacaccgccaaatggcgggctgaatcgcgtcatgcacaccaaggatgacgggaatcagcacatggattgttcctcgcccgccatggaaaccgcttccaagaatggagatgacaggaagtccgaaggggaggagaagctgggccttctggacagttctggaggtgagaaggcaaagaagaagcggtccagctccaagaagcccccgcggccaccgaggccgccgacgcatttgccgttggatgcttctgaccagaagctcctcaacgagctgaatgagcttgctttgttgaagcgggcaaggattgtgcgggcccgttcgggacggccctgcactcaaactcagcaggtggaggggggcgatagaggcaacgggccgccggcgatgtcgtcgtcgtggaactcggtggggctggaggtgctctaccaggtcatcgggtggatcgccttcgtcgcctggtccttcagcttctacccgcaggtcgtcctcaactacaggcgcaagagtgtcgtcggtctgaacttcgattttctggtgctgaatttcacaaagcattcttcctacctcatatacaatgctgctctattcttcagccccttcatccagcaacagtatcatgacaagtttggtgataaagagatgattcctgttgctgcaaatgatgttgctttctctctacatgcagtggccttgacatcttttaccctttaccaagtttttatttatgagcgtggaaaccagaaagtctccaaagtgtgcatatcaatctctgctgttgtctggtcagctgctattgtttgcctcattgtagcttggccaaaaagtaactggctatggcttattgatgtattcaattcaatacaggttgcgatgacaacagtcaagtacatccctcaggctgtgatgaacttcaggcggaagagtacagttggttggagtattggcaatattttacttgatcttacagggggggtgctgaactttggtcagatgggtgtgcaatctattgatcagcacactttagtgaatttctatggaaatatcggcaagactcttctttcattggaaactgttttcttcgatgttctcttcataattcaacactatgtgttgtaccctgtcaaacgggatgagaatggtaaggccatcatttctgagagggtagctcctctgatcaggccctcagataagcctgaagaagatagtgtatgatatatgtacagtacacgcagtgctgtctcaatttctatctgttttaacaaagataaaccacgattatttttcatgtattgtgaattaactgctgtacatatttcttcacggattactgtaaaaatttaaatattgcagaccttcagttttgtccttgacatttatactttgtgtaaagatttacaaaaaacaatttataattgatttggctagtgtttatttaaacggaaattactgtaaaaactttaaatactgcagacctgaccacgctgtccactgactgttttcctttgtgtaaagattcacaaaaacatttataattgatttggctaaaaaaacgcgggggcaaacagggttcctcaaatagcaatttttgtcccatgatcatcaccattatcttctgcctcgtcatactccnggcaagggttttgctccaggcaagcatctgggagtaagcttccagggt

SEQ ID NO: 25589 - DNA, 1416 bp, Triticum aestivum
  Clone ID: PAT_TA_25589
accgggcacgagcctccacgcccggccccaatccgcggtcgtgcgatgcgtccacgccacggcactcggtaggtgaagaacgctgcctccctcccggtccctcacccaccaactctccggcccctcagccagggcacccctccgcctccctccgtgcgcactataagtagcgtcacgcccgcgccgagttaaccagcgcccgagaaccagcggcggcccctcgcgctcgcctggacggaagcccaccgcaaccggtgccatctccacggccggcgcacgcaacaacaagggcaaacgcctccagggatgtgggtgacctcgatgccccacgtgtgggacgaggcaggcgaggagccgcaagggcggcggcgacatgatgtcccccgcgccggcggccgccatcctggggtcgctgggcggctggctgtcccgcgccgccgaccccccggcgcccaggctctgcggctcgccgggccccccgccgggtaccccggctcccgcgaccctgcccggcggcccccaccagtcctccgcagcgagcgccgctcccacagcgcgggcccggctccggtgcggaagtacagcggtcttcgggtgcattgtcgtattctgaggtggtcaggtcatcgctgagtagcgacggcgtcataggtgaatatggtggtgtaacatcaagcgttttttcgtggtggaaatcgcgcacccaggatgtgcgcgcaaaatatgtaattgaaccttggaaccgagaaagtagtggaactacgaccaaaattccacctcatcggcccctccctcgggggccgccccgcctgggccgccctctagtacatccctgaaaggattgctggagctgcaatgatggctccggtggtgaactactggtggccgggcttccctgcggatctcgccgcggaggtgtacaacaagcaggaggtgggcgaccagtgggcgctgcgcgtgtcacattacgcccctggcatcctccactggtggatggaccagagctggctgcccacctccaccgtcgtggccggcaccaccccgctccccaacaagcgtgacgccgagatccgcgccaagctcaaggccgacggcacgttccagcagaagatggaactggcaacacagcaaggcatccatgagtcgtactaccgcgacatgatggtgatgttcggcaagtgggagttcgacccgatgagcctgccgaagccggcttgccctgtccacatctggcagggcgacgaggacgatctggtgcccgtggtgctgcagaggcacatcgccagccggctcagctgggtgaactaccatgagctccccgcaaccgggcatttcctgtcgccggtccccgggctaggtgacaccgttcttcagacccttttcggcaatgctaagcaatgatcagcaacagcaata

SEQ ID NO: 25590 - DNA, 682 bp, Triticum aestivum
  unsure (1)..(682): unsure at all n locations
  Clone ID: PAT_TA_25590
ccaagcgtccgccaagcgtccgcccaagcgtccggcaccaccccgctccccaacaagcgtgacgccgagatccgcgccaagctcaaggccgacggcacgttccagcagaagatggaactggcaacacagcaaggcatccatgagtcgtactaccgcgacatgatggtgatgttcggcaagtgggagttcgacccgatgagcctgccgaagccggcttgccctgtccacatctggcagggcgacgaggacggcctggtgcccgtggtgctgcagaggcacatcgccagccggctcagctgggtgaactaccatgagctccccgcaaccgggcatttcctgtcgccggtccccgggctaggtgacaccgttcttcagacccttttcggcaatgctaagcaatgatcagcaacagcaatagcagctctgaacatactacgttgctgaagtatagcgttcttccggtgcattgttttattctaaggtggtcaggtaatcgctgctgattagcgacgatgttataggtgaaatggtggtgtacatcaagtgttttttgtggtggaaatcgcgcggccaggatgtgcgcgcaaaatatgtaattgaaccttggaagttagaaacgagaaagtagtggaactactataccatngatgatcttaccttttactccgtacttattttttgg

SEQ ID NO: 25591 - DNA, 800 bp, Triticum aestivum
  Clone ID: PAT_TA_25591
tactaattgaaacattcccatcttctacaggtacagggctgggttccgttggaagtcatctgcaagtgtgccacctctcatgatggattcttctcatggtggggattcggtctgaaggtggaagcattgctccagagtcactcaaagtctctaaatttggcaacaaatatatttgaggaaagaatacgaacaccatttttgtcgttgcacacctggactctcatggatatctgggaatgagcacttcctattcaaaattcacttgcagaatcaactcattgaaggtccatatgttgaacttctgtttaagaatctgctaatgacggtgtgtagaactgcggcttccttgcaaggactgctcgctgtcactcttttggcaatcttgctgaagattggttcgccagtgtgccgttattttatttgtggagctgtaaggcttgggactgaggcaggagcattcccccaaggaaaatcaagttttattgggaggtcatatgttgtggatgtcaccatatcgtgtattttccttcgttgaggttatatttcatttcaggttttagaattttatccaaaaggcagtgttgtttttatggattttgttaagctttgtcttacgacccttcatggcagtgttccctgtcaaatcctgtaggaaatatggctgactatggatgcgcccatgtgattgatgttcattcattttgcagcactactaggtttgccacaccccccacctgtgagatggttttgcctgtaaagatgtacctataatgaactataaatgagattgattgtgattc

SEQ ID NO: 25592 - DNA, 522 bp, Triticum aestivum
  Clone ID: PAT_TA_25592
ccgcccacgcgtccgacagcaatcgccactgcactagttctgccgtcttgcgtttctctgtgcgatctcgaccgcggcgtcgaccatgagctacccgccaccgggcaccgcgtacccgccgccggggcaggaggcctacccgcctccagtctacggcgctccgccgcctgtcgccgccagctaccagcagcagcaggccccgccgccggaaccggaggacagcggcgacggcttctggaaaggatgttgtgctgcgatttgctgctgctgtctgctcgacacgtgctgctgatcacaagagttcgtaccgccaacaccaggatatcctacgatgatcgatctacatctactaggagctgctcatatacagtttgtttctatcgtacgtagtatttgtgctgttcggatcgagatttgtatgacggtgttcggtgtagatcactgcatcgaattgtactattacctccgttcggaaataagtggcgctgttttagtttataaattgtactcctattactagtt

SEQ ID NO: 25593 - DNA, 529 bp, Triticum aestivum
  unsure (1)..(529): unsure at all n locations
  Clone ID: PAT_TA_25593
gcacgagccccacgcaccctctctcccgcggcgcccgtttcaccgtagagagaatccctcctcgccgccgcggcatttccgcgagcaccttccgcgcgccgccatgggctcgctcccggtgctctccccggcggaatgcgcgccgccgccgacggaggggacgcgggcgacggtggcggcgtcggacctggccgcgctcttcgacgcgcagcgccgccacctcgaccacttcttcgaccggctcgacatgccgcaggcggcggcgctcgcgcaggcgctgctcgacgcgcccggggccgtcttcttcaccggcgtcggcaagtccggcatcgtggcccgcaagctggcgcagacgctcgcctccctcggcttcgcacgcgccgggttcctctcccccgtcgacgcgctccacggcgacatcggctccgtcttccccgggggacgtcctcgtgctgctctccaagtccggcgcctccgacgagctgctcgcgctcgccccctgcgcgcgcgccannngcgcgcagctcat

SEQ ID NO: 25594 - DNA, 768 bp, Triticum aestivum
  Clone ID: PAT_TA_25594
gcacgaggcaccaccatgcggcgccaccgcctcctcctgccgctcctcatgctcgccggggcggcggcggtcgtcgccgcgcgcccaccgttcgcttgcgcgcccggtggcccggcgacgtcgatggcattctgccggcggtcgctgccgctgcgggcacgcgcgcgggacctcgtggcgcggctgacccgggccgagaaggtgcgcctcctggtgaacaacgccgccggcgtgccgcggctgggaatcgccggttacgagtggtggtcggaggcgctcccccgcgggtcgaacaccgggcctggggtgcggttcggcggcgcgttcccgggcgccaccgcgttcccgcaggtcatcggcaccgccgcgtcgttcaacgcctcgctctgggagctcatcggccgggtacgtacatgcgtgctcgctctcgtgccggcgccggcattgccgatgccattctgccggctctcgtgcctgagcgctctctgatgttcctgtttggtatgcgagcatgtgaactcttgcttgtccgtgcccctctcgctgcgcaccgcgcctgtctcgggcagagcagttccttccttttcttctgacggcgctgacgtttcgcggcaccaatctcaaagcagaatcctaccgcaccgagtcacgtggcaagctgcacgcatgttgattaccttgccgagagattaagtaacacagaatggacgcacaataaataggctgattggttagataaagaatactcttcctcgcaaaaaaaaaaaa

SEQ ID NO: 25595 - DNA, 466 bp, Triticum aestivum
  Clone ID: PAT_TA_25595
cccacgcgttccgccacgcgtccgggccgggacaagctatgccggctcggacatcgtggtggatgcggggacaatgccaccgttgccttttgctgacaattacagtatggttgcaagccatttccgtcctgagagcatcgaagaacaaatgatgtattccatggctgtttctttagcagaagctcatggtagaacgcacacgcaagggttggcatggttgtaacgcgatgattgtgacgtttcctgccttctctcccgcactatcgttgttctgctccccttctgctcttttttgccaccccgtgttcggccgttttgtttctcctttttgcatgtgttgcatcatggtttgatatagttcccgctatagctctccattattgcttatatgttgtaaaatggaacatgaggaagaaatagaaaagagaatgggtcagtgtcttaatgcctaagcaaaaaaaaaaaa

SEQ ID NO: 25596 - DNA, 1272 bp, Triticum aestivum
  unsure (1)..(1272): unsure at all n locations
  Clone ID: PAT_TA_25596
ccttacatagctacctactactcaagtatccatccttattgagtacagtgttgatccatggactcggaaggagttgtagcagcaaaggtggcagatgagactactaaaccggcaatccaagaagacggcgccgagagcaaggccgggatgactgatctgctgatgctgaccgacaagtcgcagctgcaggcgctggcgatgctgctgcggaacaacgaggagctcatgatgagccaggcgatcaagtcggagacggagcgcattgagtacctcaagacggtgagcgactgctacacgcggacgatgaagctcctcgacgattccatggcggccaagaccacgtacgagcgttcgggcggaacgaggagcctcgtcgcccgggacatggacgactacgtcgtctacggcctcaacgcgtgcttgcagaacctccgcaactgctgcgtccgcctggaccccatcgacaagctgcgggcgcactacgacgccctcgccgacgccctcgccgacccggccgccaacgtcgaggccctcgccgcggaggcgtccgactacaaccccgccggatgccccgaccgccgcaccccccgcggcgcccccccgcccggcgcaccccgcgcctttccccggcccgcacacccgtcggcatcgactcgccgagctggtgcggaggcaccagctccggctcgggtacggcagcaagggcgaggagttcgaggacctggacgacacccagaagctggaggggcaccacagctccctcgtcagtcccggggcngggcgggggctaccggtgcggatgttctcgtcgggccgctctgccggtggccctaagattgcagccacgacntgngcggaggcagtgagcgtcttcatcatggcngcgggcaacctggcgtgggacgtgttcaccacggagcacgaggtggaggccatcctcaagggcagcctcaacctcctggcggggctaggcngctttgccgtgnangccgtctccgcgcggctgtcaccaaggcggtcgcaaacttcngcnccggcgtcnttgcttgctctctcgcccgnttctcctgggcgccataaccggctgatttcgtcggcntcagcggctcctaattaactancancggtcccctngaangtcctacataacaactaagttcanacgccttctgccaatgaatggcctgctagcgtactaatatatttacanccatnacacaangttanatcacgntgancctgaataaaaagaatataaattataaatanttt

SEQ ID NO: 25597 - DNA, 2499 bp, Triticum aestivum
  Clone ID: PAT_TA_25597
ccgcgctcgcgggtcgtcgccgccgcgcctgcgggggccgccgcctccgcgtccgcggccgccccggcccggctctcgccccgcccgtgcctcgcctcgccccccccctctgccgccgccccctccttgcccgccgccgagctgccccccgccggcgtcgcccgccgaccctgccgctccgccgccgccagcctcctcctcggctgcggcggcggcggtcgtcctgccgcggcgcgcccgcgcccgccgccgctcccgccgccgccgcgcctctcccgccggcgagccggccgcccccaccccccccgtcgcttccgcccgctcggccgccgcctgcccaggggggcgagctagtcgggctgcagggggttcgccatgtcgagcccgcggcggccggagatgtcaccggcggcgaggaacagcgacaatggatacgtcgagaccgaccccactggtcgctacggccggttcgacgagctcctgggcaagggggcgatgaagtcggtgtacagggggttcgacgaggtgcgcggcgtggaggtggcgtggaaccaggccaacctcgccgccaccgcgggagccccgacgccggcggcgacgaggggcggccgcggaggcagcagggccgcatgacgaggaaccggtcgatggtggacgtgcggagccagctgctgcaccggacgctggtggaggagctcaacaagcgcatgttcttcaacaccgtcggcgcggtcgagaacatcggcttccgcggcatccccggctacggcggcgggccgtcgtcctcgtcggcgacggtgtcgtcctcgcgcgggggccggagaagtggcaaggacaagcaccagttcttcatgttctgagcagattactttgctcagatcgttggtatgtactgtagacaacgtgttcgtcaacggccaccagggcaccgtcaagatcggcgacctcggcctcgccgccgtgctccgcggcgcccaggccgcgcacagcgtcatcggcacgcccgagttcatggcgcccgagatgtacgacgaggactacgacgagctcgtcgacgtctactccttcggcatgtgcatgctcgagatgctcaccgtcgagtacccctacgccgagtgctccaaccccgcgcagatctacaagaaggtcacctccggcaagctgcctgacgccttctaccgggtcgatgacgccgacgcgcgcaggttcatcggcaggtgccttgtccccgcctcccatcgcccctccgcccaggagctcctgctcgaccgtttcctctccacgcaggacaccaccatgacactgtcacctccgccattgctgcctgccttgcccacctccggtgaccggaaggataacccggaggaggctgagccggtggcagcaaggactgacatgaccatcaccggcaagctcaacaccgacgacgacaccatcttcctcaaagtgcagatcgtcgacgaagcaggccattcgaggaacatctacttcccgttcgacatcgccggcgacacagcgacggaggtggcgagggagatggtgaaggagctggacatcaccgaccgggacccctcagagatcgccgccatgatcgagcaggagatcacgaggctggtaccggactgggtcggcggtggctgtgatgatcagcaggagtactatacgtacgccgataatgacgacaatgaggagcagcctcctttctactacctctcctcttccccgacctcttcaaacgggtctcattgtggcacagggccgacaacatcaggtggcggctacgctggctggttccaagattacgctgtgagcagcgacgacgacgagacgagctccacgcgctccgcgctgcactactcctccgaagaggcccagcccgaagagaagcctggcgtctccaagacgggccaggtgaaggccaccagattcggcccaggagacagcggcacagcaggacacgacgtgtcgtcgtcgcgcgccggccggccgcggcaccaccgcgggagccccgacgccggcggcgacgaggggcgcccgcggaggcagcagggccgcatgacgaggaaccggtcgatggtggacgtgcggagccagctgctgcaccggacgctggtggaggagctcaacaagcgcatgttcttcaacaccgtcggcgcggtcgagaacatcggcttccgccgcatccccggctacggcggcgggccctcgtcctcgtcggcgacggtgacgtcctcgcgcgggggcgaccagcgcggccggagaagtggcaaggacaagcaccagttcttcatgttctgagcagattactttgctcgatcgttggtatgtactgtacgcagtagcatatgcaggtgtgtggtgattaattcttgcgtcgatcgtgtgtacatatatacccatgcggatgcaacgacacagctgcttacgcgagagtacgtatacataacacaacacggaactaaaaaaaaaaaaaaaaaaaaaaaaaaaaaaaaaaaaaaa

SEQ ID NO: 25598 - DNA, 704 bp, Triticum aestivum
  Clone ID: PAT_TA_25598
gtcaccggcgtcacccgctttcttttcttcggccccgcgctctcctcccgcggctgcgccgtcgccgccttcgccgtctcctggctgacgttcctcgtcgcggaggcctgcctcgtcggaggatccgcgaagaacgcgtaccacaccaagtacctcggctactacacgaagcacgacctggtgagctgcgccgcgctccgcaagggggtgtttgcagcagccgccgccatgatgctcatcaacctggcggcctccctggtgtactactggagctactcgaaggcggcggacgacgggtacatcaagcaccagaacgaggccggcgtgggcatgaccgactacggcctcgacaggggcggcggccccgggctctgagtgagtgaggctttgtgttgctttgcttgttgtgaactgggctggggggttgctgtagcttgtgtgtgcctgaagctttatgcttccaggatgtgatggtccgagcgatgcggaaacggtactgtaactgcatcatatgtttatggtgtcgatcgccttgggtgatatcatcttcggggtgtactctagaaacaatggtgcttgagctgtcatggtaaaagtaaaacattgcggtgtaatgctgcatttcacatgctggtttagttatgttactttcttgttcgtgtacgccgtggtgctagtgaggtggctcctatgttggctaagat

SEQ ID NO: 25599 - DNA, 875 bp, Triticum aestivum
  Clone ID: PAT_TA_25599
ctccccactcccaccagtgtcggtctccccacaccgagctcagtgagcaagacccagcagccgccgccggagccggagctggtcgagactcgacgccgatggccgggttcgccacctcgcggccggcctccctcgcgctctgcggcttcctcatcttcctcaacgtcttcgccttcctcctcgccgtcggcgccgagcagcgacgcagcaccggcaaggtggtgccggacgagtacgacgagcgctcctactgcctctacgacaccgacgcctccaccgtctacggcgtctgcgccttcttcgtgctcctcctcgcgcagctgctggtcaccggcgtcacccgctgcctctgcttcggcccggcgctctcctcccgcggatgcgccgtcgccgccttcgccgtctcctgggctgacgttcctcgtcgcggaggcctgcctcgtcggatggatccgcgaagaacgcgtactacgagcgagtaccttggggtctactcactgcatgatatgtttagcagggcggtggcctttgggggggtgtccagggacaatgttgcatgaacggtcatgggaaaagtaaaatactgcggtgtaatactaaatttctcatacgcctctgacgccggtttcatcttgtactacgtggaggctggcgtgctcatgacggactatgtattttggcgagatagagtgagttcgctctttgttggtcatacttgatgtgttggcatgttaaaaaaaaaaaactgcgtggttgctgtgactcagccgtgcctcctgctttgtgcttgcacctgcatctgatgatccgagtgacgcagaaacggtattgtaactgcatcatatgtttatggtatggatcgccttgggtaaaaa

SEQ ID NO: 25600 - DNA, 659 bp, Triticum aestivum
  Clone ID: PAT_TA_25600
tttttttttttttttttttttttttttttttttggcatgagcaatgagacaaggacttttgttctcatgatactgttacagaatttgtgagaaggcctcttatttaacttacaaggccaaaatataatgccggctacatctgaaattctttaccgatacacctgactacaacaatacatattttcctccgctgtctccaccaccctactatgtacaagggggagtgtttttttcccagagctaccccaaagactatgcacctcacagcaggtagaagtagaactgtacatcgccggcggaatagttgcttcttgtgttcacccggtgaaggggttcgcgacaatccgcaagtcattgtgctgcctgttgaatagatatcatggcctgcctgcattgcttcgctactcatggaagtcctcataagacgactctgacgaatcgctctggtacggtgttgtttcacgcgggctagacgggagagaatcttgcattgctggtcctatgatcttttgccctctcgggcggaactttcttcggaggagcttcttagcttttgtaattgtgagctgtctggcaaaaggatactcgccatcactctcactcccctcgtcatggtattcattatccccatcgcctcgcattgcccgccggacgcgtgg

SEQ ID NO: 25601 - DNA, 576 bp, Triticum aestivum
  unsure (1)..(576): unsure at all n locations
  Clone ID: PAT_TA_25601
gcacgagcccgaggagaacacaagccaacgggcacacgcacagatacggcggacggtgaagcataaggtcagcacacctggccagggaggccttgctagcttttgctctccacctagcttcttctgcccgcttggctcttctccctggtcctggaacgcgcgcggctggatcggaaggatggcggcagctcgggaggcgtcgagggcagcttcccccgtcgctgcggccgccggagttctcctggtcctcgccgtcctcctcacagagcatgtgattgtggcgaatgccctgtccatcggcgtcaactacgggcagatcgccaacaacctccctgcgccggggcgggtgtcgacgctgctccggtcgatcaagatcagcaaggtgaagctctacgacgccgacccgcacgtcctgcgcgcgttcctcggcacgggcgtcgagttcgtgatcggcatcggcaacgagcacgtcccggcaatggtcagtcctccacgntggcgcnnnngtggctccnagcagcacgtggtgccnnacctccacgccggggcgcgcatcacctgcattaccgtgggcaa

SEQ ID NO: 25602 - DNA, 602 bp, Triticum aestivum
  unsure (1)..(602): unsure at all n locations
  Clone ID: PAT_TA_25602
gcacgaggcacaccactagcaccatgcagctcacgaatccgggacgccgcaacatgccgttcctcgtcggcgtcgccgtccttgtccttgcagcagcagctgcgcgggccgacggcgccctctgcgacaagtcggacaaggcggctctcctggccgtcaaggccgccctgggcaaccacccggacctctccggctggaactccaccgcgccctgctgcgcctggccgggcatctcctgcgacgccgccaccggccgggtcaccgagctcacggtcttcgcgctcaacatctccgcgccggtccccgccgccatcgccaacctcaccgccctgcagaccgtcaacctggcctacaaccgcctctacggccgcatcccggacttcctgggcccgcgcgccctcccgggcctcgccttcctccgcctcgacggcaaccgcctcgacgggcccatcccgccgacggnnnnngtgtacgacctctccgtcgccggcaaccgcctggccgnnncgctcccggccgccttcgcgggcgcggagttcggcagcgtggacgtcgccgacaaccagctcacgggcgacgcgtnnnngctnnncggcgccggg

SEQ ID NO: 25603 - DNA, 374 bp, Triticum aestivum
  Clone ID: PAT_TA_25603
ggcaacgtttggcgcgtgggttgatgcagtatgcaagatgaagggggtagaggagggtgacaagcttgtgaggagcttccaggataggaactttgccattgatgagaagtccatcagggaacatttggacaagaaagggccattctcaccgattgtttgggaggtgatctttgggaagaaaaaaacaagccgccccttttgatctaactagtatgtgctcatcctctcaatagttgaacctccttccgtggttaaatcaaaatggctagcatgctgtttttacatgatgtccacccaccagtgattttgtatttctctgtgtttacatgcaatccaccaacatttagttgctgcttgctaccaaaaaaaaaaaa

SEQ ID NO: 25604 - DNA, 554 bp, Triticum aestivum
  unsure (1)..(554): unsure at all n locations
  Clone ID: PAT_TA_25604
ttttttttttttnaatcgagaatagagtttgatatataatcattatcaatatatgataattattttttattacaataataataattattattattcccttcttatttccacacgcgcgttgcaacagtaggagctgaagcagttgcattggtagtcactgcgatgatattaagtaattaatgagataccgcatacgcaagggccattccatcgggcatgacggcggtgtggaacatgagcttgctcatgtcaggcaccttccttggggagccgatgatgaggttaatgaggaggccgctgacgccgacgaagatcagcccggcgatggcgcccacgacgaagccggcgagagagcaagcaaagacgccggcgccgacgtttgcgaccgccttggtgacagccgcgccgacgacggcctccacggcgaagccccctagccccgccaggaggttgaggctgcccttgaggatggcctccacctcgtgctccgtggtgaacacgtcccacgccaggttgcccgccgccatgatgaagacgctcaccgcctccgccca

SEQ ID NO: 25605 - DNA, 807 bp, Triticum aestivum
  unsure (1)..(807): unsure at all n locations
  Clone ID: PAT_TA_25605
ggagagagagagagaactagtctgctgcttcgcttcctcgcccggtcgtcctgctcctactggttgcttgcttgctttgggatccgcgttgcagaaaagaaaatacgcagagctattttatcttcttcgctctgcgcccgtgggagatcgggctgcgaatgatcagcgagcggtggacgaagagacgaggaatctgagactgagaatttgaccggcatcgatcgagctcgtgtcgtgagaagaggaggccggagacgacggggggccatggagaagcgaagcaggtgaagcgggcggttcgggcnggtgccccctaactggccgcgccaatgatctaccaaggacccccagcccggccccttcttccgcaccaactgccgcgcgcccttccccggccaacgccccggcccccacggccgacaccccccggctcgcccgcgcggcccgagaccctcgcctccccctccggctccccccgctccgccgacccggctccgcccaagggcggcttcctcccaccgggcccgccgggccccccgggggcgcgtcccccccgtccccggcccgccccgacaagcgcgggttcccccggtccaaggagcggcgattctgggncggcacgacnaaacggatcaggttcggcgaaacnggtcgccgctncaacaagccgcgtgaagcgaagctccgggccggcgttcccggangacaaagcnggccgggcgaagcgcttgacctcaacncgcccaaaggacggaggggggngaatttcaacgtgcccccggacnaaaggtccggcctcctcctaac

SEQ ID NO: 25606 - DNA, 875 bp, Triticum aestivum
  unsure (1)..(875): unsure at all n locations
  Clone ID: PAT_TA_25606
ggggcgacgccggcatgcgggagctttgggccaccggctggctgcatgaccgcatacgtgtcgtcgtctcaagcttcttcgtcaaggttctccagctgccatggcgctgggggatgaagtacttctgggacaccttgctggacgccgaccttgagagcgacgcgttgggctggcagtacatctccgggtctctgcctgatggccgtgagctcgaccgcattgacaacccgcagtttgaaggctacaagttcgacccatacggggagtacgtccggcgatggctgccggagctggcgaggctaccaacggaatggatacaccacccctgggatgcacccgagtctgtgctgcaggctgcaggaattgagctaggttccaattaccctctccccattgttgagctagatgaagccaaatccagattgcaggacgccctgtcagagatgtgggagcttgaggcagcctctcgtgctgagatagagaatggaatggaggaaggcctgggagactcctcagacgagccgcccattgccttcccccaagagctgcagcatatggaagtggacctggaccgtgccactatccacacaccagcgatggctggccggagacgagcagatcagatggtgcctagcatcacctcttcctttttcagagctgaaacagaaacagaactttccgcagcttttgaaagccaagtgactaggccggaggtgccatcacaggtgcatntccagcctcagactcggacggaaatcagggatgaagttgccagctacggcactgctgccagatacaacggcgtccagcagcagcagcagcagtataccctacaccatcaccgtgtgcaggtgcgcatagcaccatccacttca

SEQ ID NO: 25607 - DNA, 522 bp, Triticum aestivum
  Clone ID: PAT_TA_25607
acaggcttcagatccaagacaccatccatagaaaccaacatagagctagctagaatggcctccgtcaaggtggccatcgccgccatgctggtgctggtcatgctgtcttcttcccctttgcaggcggcggcacagatgcagtgcagcaggtgcacccaagactgcaactcttcgtgcgatggctccagcagcggcgtgagatgcagcaggacctgcgccaccccgaccttgcagtgcgccaactgccagagatgcatgaactcttgcttaagctactgccaatccacatgcattaattaactgccgaactagtatccctaccgaagtactcgtaaaattcaataattggttgcaagatgcgcttgtatatgtatgtattatcttcgtgtgtggcagttgcatgtgtgtctgcttgtccatgtatgctatctgttggtgatatgcacgatattgcttagttcacatatgagttgtgacgccgtcgcccattgagtatatatacacatgtagtttcaatgttat

SEQ ID NO: 25608 - DNA, 532 bp, Triticum aestivum
  Clone ID: PAT_TA_25608
ccgctccgagccggccgggccgggattcacactctgctgtctaaaccaacatatagctagctagaatggctagcaccctcaaggcggctgccatcaccgccgtgctggtgctggtcatgttgtcttcttccccgtggaaggcagctgcgcagatgcagtgcagcaggtgcaccgaagactgcaactcttcgtgtgatggctccagtagcagcgtgagatgcagcaggacctgcgccactccgacgttgcagtgcgccaactgccagagatgcatgaactcttgcttaagctactgccagtccacctgcgttaattaacagctgaaccgatattcttatcgaattgctcttggagcttcgtttaataagcaaaggttgcaagccgcagttatatctatacatttatcttcgtatgtgtaagtgttgcttgtgtcttcttgagtgcctgttcatgtatgttctgtgtgtgtagtatgtaagatattgcataatgctaaaaggggatgttaactgaaactgtgaatattgtactt

SEQ ID NO: 25609 - DNA, 632 bp, Triticum aestivum
  Clone ID: PAT_TA_25609
gccggccggccgggccggaacaggcttcagatccaagacaccatccatcaaagccaacatatagctaactacaatggcctccgtcaaggtggttgctatcgctgccatgctggtgctggtcgtgctgtcttcttccccgttgcaggcggcggcacagatgcagtgcagcgggtgcacccaagactgcaactcttcgtgtgacggctccagcagcagcgtgagatgcagcaggacctgcgccaccccgaccttcgagtgcgccaactgccagagatgcatgaactcttgcttaagctactgccaatccacctgcgttaattaactgccgaaccagtatccctaccgaagtactcaattcaataaccggttgaaagatgcccttatatatgtattatcttcgagtgtgaaagttgcatgtgtgtctgcttgtccatgtatgttatctgtgtgtaatatgtatgatattgcttattacatcccatgtaaatactcacgctgtcaccgattgagtatatatatacacatgtaatttcattgtcacaacttacctttgacatttcaagggcatggttaactaatgctttgaagtttaaaaaaaaaaaaaacaaaaaaaaaaaaaaaaaaggccccta

SEQ ID NO: 25610 - DNA, 1326 bp, Triticum aestivum
  Clone ID: PAT_TA_25610
ttattcagagttgcttgtgtcttcttgagtgcctgttcatgtatgttctgtgtgtgtagtatgtaagatattgcataatgctaaaaggggatgttaactgaaaaaaaaaagaagaaaaaaaatgaaaaagaaaaaaaaaaaaaaaacccttgcgccacaaccacgaccggaggaggaggagagcggcggcgaagatggtgtcgctgaagctgcagaagcgcctggcctcgagcgtcctcaagtgtggcaagggcaaggtctggctcgaccccaatgaggtcaacgagatctccatggccaactcccggcagaacatccggaagctggtaaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctgaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgatcagtttgaggccaagcgcgccaagagcaaggcaagcagggagaggaagcatgccaggagggaggagagattggctcatggccccagagatcatgcaccagcaccagcggctgcagctccagctccagctctccggcagcagcggcaccaaagaagccaaggccaagaagtgaaggtctgacatgaagctttagctttctggtattatgaagggttagcctgattttggagcatctgaagttcataactgttttctgtgcaatatctgtgtgccgcgtctgagataccttaaatatcatatcgtgtttggtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggcccgtttttaagggtcccaattttccttcccgggccttgcaacgtataattttttttttggggcccccaaatttaaatccctgggccgggttttaaaaccgtggggttgggaaaacccttgggttcccccatttaaatgccttggaaaaaaacccccttttccccggttgggttataaccaaaaggcccccccccatccccctttccaaa

SEQ ID NO: 25611 - DNA, 1235 bp, Triticum aestivum
  Clone ID: PAT_TA_25611
atatggtaagcgtaggggtaccagggaggctaggctccccaccaagatcctgtggatgcggaggatgcgcgtcctgaggcgcctgcggcgctcaggcgggggcggggcccacgcctaccagacggcaggtaagggaggaggaggaggagcggcggcgaagatggtgtcgctgaagctgcagaagcgcctggcctcgagcgtcctcaagtgcggcaagggcaaggtctggctcgaccccaatgaggtcaacgagatctccatggccaactcccggcagaacatccggaagctggtaaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctgaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgatcagtttgaggccaagcgcgccaagagcaaggcaagcagggagaggaagcatgccaggagggaggagagattggctcagggccccagagatcatgcaccagcaccagcggctgcagctccagctccagccagcagcggcaccaaagaaggccaaggccaagaagtgaaggtctgacatgaagctttagctttctggtattatgaagggttagcctgattttggagcatctgaagttcagaactgttttctgtgcaatatctgtgtccgcgtctgagataccttaaatatcatatcgtgtttgttctgttggatgcagagtttctttaaacatttgggttcacgggaacctagttttacatattctgtgcgtgcaaatttatgtaacctactgtgtttgtgatggtaatagtgcctgggtgccttcagtcatcagaacaggtgatggatacttgggcgcacgaaaggtagattttcatctcagaaagaagtttgtcatcacgtgtgtgcgcttttgtagctagcagatgcccgatattgggcgatgaatgactttggtagcctttgtagactatgatagggacatgctagtgctcttgaagttttc

SEQ ID NO: 25612 - DNA, 1736 bp, Triticum aestivum
  Clone ID: PAT_TA_25612
gtgcggctgctcgaggccggccgggtacgccggccgcggcttgcgccacgaccagacggcaggtaagggaggaggaggaggagagcggcggcgaagatggtgtcgctgaagctgcagaagcgcctggcctcgagcgtcctcaagtgtggcaagggcaaggtctggctcgaccccaatgaggtcaacgagatctccatggccaactcccggcagaacatccggaagctggtgaaggatggtttcatcatggcaaggaggacgcggagagaggcgacgaagagcgtggcgcggaagctgctgtcgcgcctggtcgcgaacgtcctcgcctgcgccgaggtcaagggcgggctcggcccggactaggccaacgagatcatcctggacaacctcgggcaggacatctgcaagcagatgatccacaggttcatcatcaggaagcctcagaagagccactccaaggccatgcagcaggacgggcacatgaggccaagcagaagggccgtcactctggatatggtaagcgtaggggtaggaggcagggtagcagggaggctacgctccccaccaagatcgatgcggtgcgcgtgctgaggcgcctgtctcgacaagctcgcgtcgaaggcaagcgtagcggcaaggacaatgtacacgttatgtaacatcacgtagggctaaggtaacatgttcaaaataaaaaggagattacgcaggaggtcaaggatccagaactcaaaaggaccgagaaggcaagcagagcacgacaaaatgagactcaagcatggagagcaagcgcgccgagagagaaggcaaagcagggcggggaagagagccgagcaaggggagagaggaatcgccgcgggcccagcgagagcatctagcaagcaccagcggcggcagcaccacccaaggccacggcagagggaccaaaagtcttgagcttcacgtggtgactttcctagagttggcctaagcagtgtgaccctaattgtggacaaccagatgttcaagaactggtatattttgaatattcctggttgtctcagtgtgtggagattcttaacattcttttatgagtgtttgttagttgttgctattgagagtttgtgaaatctcttgtgaatgttcttgttgtacctttctgcgcaagtaccgtgaggccaaggaagatcgacaagcacatgtaccatgacatgtacctgaaggtcaagggtaacatgttcaagaacaagagggtcctcatggagagtatccacaagtccaaggctgagaaggcaagagagaagaccctctctgaccagtttgaggccaagcgcgccaagagcaaggcaagcagggagaggaagattgccaggagggaggagagattggctcagggcccgagagatcatgcaccagcaccagcggctgcagctcccgctcaggcagcagctgcacctaagaaggccaagaagtgaaggtctgataagaagctttatctttctggtaatatcaagggttagcctaattttggaacatcagaagttcagaactgttttctgtgcaatatcttgtttgtgtcagcgtgtcagataccttaaatatcatatcgtgtttgttctgttggatgtttcaatcagagatgcttatgcagagtttgttaaaccatttgggttaatgtattatattatgcttttgaacctagtttaacaaacaaaaaaaaaaaaaaaaaaaaaaaaaaaaaaaactcagaagaaggg

SEQ ID NO: 25613 - DNA, 775 bp, Triticum aestivum
  unsure (1)..(775): unsure at all n locations
  Clone ID: PAT_TA_25613
tttcgttcaagaaggttgtccaaccgtaattgcagtttcctgctttcttgcattaggcagaatagatgcgactaggtaccactagcatcagtcccttgaaataattttttgtagagttctatgcagcctattgaagtaactgctatgacgataactccctaattgtgaatgtggtaactaatatttatagaaaggtagtagaagagtgataatattataatagtttaatgcaagtaaagtttgcctactgttgttcctgaaacaagattgctaatctttagccgggttttaccgtgtttatgtttcttcctattgataaatagtatgtccacccacttttcattagccctgctttctcatttaaataatagcatataagagccattaattttctaaacttccatcctttattacatgcatgttatgccactttgcgggccttgattagcaaaacttggaagtagaaaccttgtgcttgcttgtgaccagtaaggttgtgaggggttgtaatccaatgaactgtgtgtgtgctttcttcaggatccgattgagaacgtttaggtccagatgacaagaaataaaatatgcaaatccaatattttttaaggatttttgtttgttaattcaatggtccacttctaaactgtttgattttcaatggtggtggtgttgttgttgttcaagtagtggggnnngttcatgatgcacatggggaataacatgatnnntgtgaatatgtgggaactgtcatgannnnnnnnannncccttctttc

SEQ ID NO: 25614 - DNA, 637 bp, Triticum aestivum
  unsure (1)..(637): unsure at all n locations
  Clone ID: PAT_TA_25614
ctgaagtgtatcgccaaagaggcagagttgatgtgcgagcatatgtgcatgtgtacttgggtgtgttagcaggcaggagcccaccgccgtgcccgccggcggcatcgcccatggccgagaagaccgaggacaccgaggacccaaccccctcaagtacgatggcgttgtaccgtcctttctgctgcgacttatgttgacaagttttgagatcgatctcaatctacatatgaccgtgatcgggaggcgaacccggttgcgcttagagacagttgaataatggagatcctccagccaccgagctcctcaaggacacctaaggtgagaaatccacgttttttcatactgcttgacgtttaggccgagcagcctggtgaacttcgaccccatccaacctcatttcggccaccacgtggctcccctccccacctcaccccgtccaacgcagtgccttcgtgctaagagttcaagggactgtcccctctcacctaagacaaggtacagtttttgatctgtcttacacatttcttctgctcatgtactaatgtaaaggtttcacannntatgttatgtgagcatgcgctnnntatgaaaagttttgttttagttgattgacattgnnnnttaaaaaccttaaann

SEQ ID NO: 25615 - DNA, 635 bp, Triticum aestivum
  unsure (1)..(635): unsure at all n locations
  Clone ID: PAT_TA_25615
gcacgaggctcgtgccttcacttccgctgccccccttccctccccacccccccctccgtgcccgctcgatcgatccatggagtggacgcccgaccagcaggctctcgggggcctcggcctcgccggcgtctgccgggagacctgccgtgtggtccgccgcgccatgccccccgacttcgtcaacctgggtcccccgctgctctccgcgctcttgctcgccacctccgccgccatcccgcgccctccgctcccgcgtcctctccgacctccacgaccacgacggccccggcctcctccgcctcgtcacggaccggctcgccttcttcctcttcgcggccgtctccaccggccttgtcctcctgctcgtgctcctctgcaccaccgccgcctacgtcttctgcgtcgcctccctctactccaccgggggcgacctccgcgccgccgatcgcgccctcagggggttccccacggtcccgctcgcgcggctcctctgcacgttcctcctcgccgcggtccccatcttcctcgtgctctgcgcctccctcttcgtcgcccccttgttccatccccaggagctgctcggcgctccggacaagntcatgctgccgctgcagctgctgggatgggccgcgtgc

SEQ ID NO: 25616 - DNA, 650 bp, Triticum aestivum
  unsure (1)..(650): unsure at all n locations
  Clone ID: PAT_TA_25616
gcacgagggtggtttgtgccatggttgggcaccatcttaaatataaaatgataacattgcaaacatttttattttgaagggccaacaagaaaggatttcttccggcagcatagcaaagaacccattgggtggatgcaacacccggatgcctttttgactaaatcattttaattaactaattacagtggcggagctaggtgggcggcccgagggcaaatacatcaattcttgagcagtccaaaaactataatttgttgaattaagcacccccaagagttctttattcacacattttttcaaggttgggggtttaatggcagaagatcaagcactccgtcctctgccaggtcgccgccgctgctcgggacgtagacgcgcacatgggtccgtcagtcgctggcaaacgaggtcgagtccgtgcggagcactggtctcctcgctgtcgtcgtcgtcctccctgctgccagcgacgccctcctgtctcctctgcaccagtctactccttcatattatttacaaaagaaaatggtttggggtgaagaagttgaaggcttgaagccaaatgttcctaatccaggaagatgacccgcacaactcccctgaaacaagnccagcactatgtgccaagnnngaagntnccaaatatgttt

SEQ ID NO: 25617 - DNA, 616 bp, Triticum aestivum
  unsure (1)..(616): unsure at all n locations
  Clone ID: PAT_TA_25617
cctcgcggctcgcacctcgctcccgcccccgcccctccgggtggccgcgctccccgccggcggccccctggcgcggcggccgccgcggccccggcccgcccgtcgcccgccccctgcctccccgccggccccacccggcctgccccccccgcggggccgcggtgctcgccgcgggcccccacgcgcgcgctgcggcgggctcctggggcgcctcccgcggccccgcgcggcgctctccgcgcggcgtgctgccgcgtcgggcccgcggtggcgctcgcccgcgccgcgaggctgcgcgcgggcgccccgcggggctcgtcgggcgccgccagggcgcctctgcggcgcgcccgaggggccgccgagcgcccccggggccgttgaagctcgtcaggggttgcaatggagcgccgtcggtgattgcaatggagcgccacccggagctgcaatggagcgtcgtcggtgcttcacgccgcgttgtgctgccatggaagctgctgtgttggagcttttttggcgcggtcatcgttgccatttttctgagcagtagttagatggctcccagtgctgcgagcagtggtcgctggcggctccnnnnnnngttgttgtgannnnn

SEQ ID NO: 25618 - DNA, 564 bp, Triticum aestivum
  unsure (1)..(564): unsure at all n locations
  Clone ID: PAT_TA_25618
cggcacacgcggcgcgacctagagacagacagaggaaggaaggaggcggcgagggtttcggcgggcgagatggagaacggcgaggagaccttcgcgtccccgacggcggccgcggcggacttcggcttcggcttcggcccggcgctcaccaacggcgaggggggacacgccaaggcctacgacccggaggagatggacgcgctccgcgcggccaagcgcgacctggaggagcagctggccgccgtgcgccacgagaacgccttcctctccgcggaggccgcccgcctcgacgcgctcgtggccggggcccgcgaggacatcgccgccgccgaccgcgccgccgccaaggccgagggcgaggccgccgggctccgcgccgaggtcaagcgcctccagggcctcctcgactgcaccgaccgcggcgccgacggcccggggggcgccggcggggacccggccaccgcgcaccaggagaagctcgccctcgannaggagatcaaggccctcannncttccgccgccgccgctgccgcggacgnnnnnnnnnntgctgccgctccctcg

SEQ ID NO: 25619 - DNA, 603 bp, Triticum aestivum
  Clone ID: PAT_TA_25619
ccacgcgccccattggctcccccccccccctcctccccccgcgcacgcgcgccccgcagcctctctcgttcgccacgcagctttgtacagttcgtacgtgagttgcttggtttcgtctcgtctgcggcgggcggcggcggccgggttgaactcaaccggagggttcgcgcggttgagcgagttgttggaatggatgtggcggatagtggtggcggtgtccgcgggcgcgagcggagatggaaggggaaggccgcgagctcggcggcggagaagcagcagcagcagcagctggcgccggttttagaagacgcgccggcggccgcattgctcccgccgctgaagaagatgcggagccccgactgccgcctccgccgctccgtgtcctcgctgtcgtcggctcctgcttcccctgactcctcctctgtttccaaccccctctcgccgcccgcgacgtccttgccgccccacgtgtcgtcgacgcggcagatactcccgttcgcgtacgatccgtcccccgcggcggcaccgaggctcctgcagctgttgcggtactcctccagcttgtaccagcaacccatgctgccgcagcagctccagcagcac

SEQ ID NO: 25620 - DNA, 515 bp, Triticum aestivum
  unsure (1)..(515): unsure at all n locations
  Clone ID: PAT_TA_25620
tttttgccttctatgttaactcttcttctattattatattacatgggatgtttgtgaagattgcctaactcgcgacatatgccttcaatgcgattatgtctctaattcgtgcctcaacacgtgggagctatagtcacatcgagggtgtgacacacgcgcgcttcattacaactctgacaacctcgctgatgcttcaccgcaactccggcgagccccctctgcttcattggctgttgcagcccgccggccagccttcaacacctcacccttgcatcaccagtggagcaccgacgtcccgatgcgatgccggcgaagctccggtggccctatgcagcaccaacagagctcaacaccccccgacgnngatgctacgatagnnngtcagttgcannccgacgacaagcctcggacgnnnnngctgcactgcggcgcgaaaaaaaactccgatgcagcaccatggacgtcccccgcgnnnntncattgcagccgcgacggagctccaacgactccccanc

SEQ ID NO: 25621 - DNA, 2193 bp, Triticum aestivum
  Clone ID: PAT_TA_25621
cgatccaccccttggatcgactagacccgcctcgatatccagccggggacatacccgtaggcacgtacccgcgtacgtacacagccagagctgtatacaggcgggccggcaaacgcgggggggacgtggtccgtggtggtgtccccggtgtccgcgtagatggcgtggttctggcggaggtcgcgggggctgcgcgggccgcgggtttcgcccgggctccgcggggtgccggggctggtgcagcacgccgaggacatggacgagtggctggccgggaaccggccgcgcgcgggcggcacgtaccagaccggcatcttcgccctgcccgcgggcgcccgccgcggcgccctcgtcaccgtcgcctccgggccgcgcaacctggagcacgtgctcaagccgcgcctcggcacctgcgcgaagcgtgtctcctcccagtggatcggacggcggacattcaatgtggccatatggcagccgggcaagtccgtaagtaacacggaggataggacttcgtctcaacagtcaactccctgctcgcccagaacgtccgtgccgcgctggagatcccgggccactctccacagcccaccacaagacctagccagccgggcatctgacagggccgcgtccgctccgtcctcgccggcgcggccgaccacgggggacagcatgatctcccggaccttctgcgaggactctccgtcgttctcacctggggcgtgggagacggcaaggacctggagacgctcgcccagcacctgcccgaggatgagttcccctccgtgtccgaccgcgctatcgaggtcaagctcatccgcttcatcttgccggagttcctgtggcgctgcaagaagtggctgggtctcggagtgcataccacgcgtcctcgcagcgtggcacacgtcgaccgccacctccccgccctcatcaagaagcgcaagctcgagctcgcccctgctctcccggttcatgcggaagggttcctactcggacgagtcgctccagcacgtggcgctcaacttcatcctcccgaccagtcactccagcacgtggcgctcaacttcatcctcgccgctcgtgtccacccaccctgcggtggagcgcaagatcgtgcgcgagctctgctccgttctcgccgcgtcacggggcgcccatgacccggcattgtggctggcggagcccttcaccttcgaggagctcgaccgcctggtctacctcaaggcggcgctgtcggagaccctccgcctctacccctccgtccccgaggactccaagcacccctccggctgtacccgtccgtgccgcggcaccttcgtgccggccgggtcgtcggtcacctactccatatactcggcggggcgcatgaagggggtgtggggggaggactgcctcgagttccggccggagcgatggctgtcggccgacggcaccgagtgcgagcagcacgactcgtacaagttcgtggcgttcaacgccgggccgagggtgtgcctgggcaaggacctagcctacctgcagatgaagaacatcgccgggagcgtgctgctccggcaccgcctgaccgtggcgccgggccaccgcgtggagcagaagatgtcgctcacgctcttcatgaagggcgggctacggatggaggtacgtccgcgcgacctcgcccccgtcctcgacgagccctgcggcctggacgccggcgccgccaccgccgccgcagcaagtgccacagcgccgtgcgcgtagaagaccgcggaccccgccgtcgcgggcttgcgcgtagaatactaactggtgaagggaccccggacattgcatgcatacatagggcagcagtgcaagaccgtaagtaaaattgatgatgggtttggtgacaacattgaagccactcctttccagaatttacgacccggataggagaaacagggaaactttgcagatcacaacacaagatctagccagccggggatctgatctgatttgcgtctgctcggagcacgggtgcatgggagaccaaggaggaaaacaaaaaataacagaaacagagtgagcaatatttgtgattgtagccacgggaaagagagaggagtaattagtaattcagatttgtttgcagtagctcggtgttggtgaccagatcatagccaactaggctattctattctattctatttttgaagatgatttttctaaaaactccgt

SEQ ID NO: 25622 - DNA, 736 bp, Triticum aestivum
  Clone ID: PAT_TA_25622
cggacgcgtgggttgttgcaataagggatattatacctcctgcacaaaggactgcattcaatgatgtctatattgcatatgaattgatggacaccgatctgcatcaaattattcgctcaaatcaagctttgtcggaggagcactgccagtatttcctttatcagatcctacgtggcttgaagtacatacattcagcaaatgttctccaccgagacttgaagcctagcaatcttcttttgaatgcaaactgtgacctaaaaatttgcgattttgggcttgctcgtaccacctcagaaactgattttatgaccgagtatgttgtgacaagatggtacagggcaccagagcttttgttgaactcctccgaatacactgcagcaattgatgtgtggtctgtgggctgtatatttatggaactgatggaccggaaacctttgtttccaggaagagaccatgtccatcagctacgtctactaatggagctcattggaacaccaaatgaggccgatttggattttgtaaatgaaaacgcaagaagatatatccgccaacttccccgtcatgcaaggcaatcattatctgagaagtttccacatgttcacccttcagcaattgacttggttgaaaagatgctgactttcgatcctagacagagaataacagttgaaggcgcacttgcgcatccttacctggcatcgctgcatgatataagtgatgagccagtctgcacgatgcc

SEQ ID NO: 25623 - DNA, 1806 bp, Triticum aestivum
  Clone ID: PAT_TA_25623
ctcccaactgcatcctccctccccctcccgtaggccggcacggcagcccatttcaatactatcccaatttcccgaaccgagacacggacgcgaggagagagagtaggggagctaccacaccacctaaacaaacaagaggcggaaagcgaccaaatctcgcgagccaaatccaccgcacgggctttcccctcccctccccacgcgcgcgatccgggcggagatggacgccggcggggcgcagccgccggactcggagatggcggaggccggtgcgggcgctgcggcggcggcggggacggcgccgggcggcgcgatggataacatccaggccacgctcacccacggcgggaggttcatccagtacaacatcttcggcaacgtcttcgaggtcaccgccaagtacaagccccccatcctccccatcggcaagggcgcctacggcatcgtctgctccgcgctcaactccgagacgggggagcaggtggccatcaagaagatcgccaacgccttcgacaacaagatcgacgccaagcgcacgctgcgggagatcaagctgctccgccacatggaccacgagaatattgttgcaataagggatattatacctcctgcacaaaggactgcattcaatgatgtctatattgcatatgaattgatggacaccgatctgcatcaaattattcgctcaaatcaagctttatcggaggagcactgccagtatttcctttatcagatccttcgtggcttgaagtatatacattcagcaaatgttctccaccgagacttgaagcctagcaatcttcttttgaatgcaaactgtgacctaaaaatttgcgattttgggcttgctcgtaccacctcagaaactgattttatgaccgagtatgttgtgacaagatggtacagggcaccagagcttttgttgaactcctccgaatacactgcagcaattgatgtgtggtctgtgggctgtatatttatggaactgatggaccggaaaccgttgtttccaggaagagaccatgtccatcagctacgtctactaatggaggttttcccttgtggtatttcctcgttgcagctcattggaacaccaaatgaggccgatttggattttgtaaatgaaaatgcaagaagatatatccgccaacttccccgtcatgcaaggcaatcattatctgagaagtttccacatgttcacccttcagcaattgacttggttgaaaagatgctgactttcgatcctagacagagaataacagttgaaggcgcacttgcgcatccttacctggcatcgctgcatgatataagtgatgagccagtctgcacgatgcccttcagctttgacttcgagcagcatgcgttgtcggaagaacaaatgaaggatctaatccaccaggagggcatcacgttcaaccctgattaccagtaggtggagttcctttgatcggcttcattcatatggaaagttttcggtcctcctgccgccataaaatgtcgctagctgtaaataattgcctcacccagagaatcaaaaggagatggcgtgttaagggtagatgacaagagctgtggtggtcaaatttccgcgtagcctatggattcttgtgcttgtgtatgttgttttatgtggatttttttcccttctgcttaaagatgtttcagcattttccgtaagatgcgatagtccgtgaacgatggctgcctaatttctgtggccgtcatgagatttttacattgtggtcgatgatggattatgtaatgttgtcctggttttaatgaacctccactgactgattggaatat

SEQ ID NO: 25624 - DNA, 608 bp, Triticum aestivum
  Clone ID: PAT_TA_25624
tgaccgcgcccccggagccccacgcactcgtctccctctcctttcctctgcgcgcgcaccgtgaccggagatgccgacggcgaccccgacggcgacgggcctggcgacggcaccgggcagccgcgtgacgcggtacgccaagtcgacggcggcgtcggtcacgccggtgcgccccggcaagacgcacgagctctcggcgctggacaacgccatgggccgccacgccgtgcacctggtgctctactgccgcgccgcgcccggcgtcgaccgggacccgctcaaggagtcgctctccgaggcgctctcgctctacccggccatggtcggccggctcacccgccccgaaggagagggcggccccgcggccggctccgggtggattgtcaaatgcaacgacgccggcgtgcgcaccgtggacgcgagggcgtcggtcacgcttgacgagtggctcgccacggcgtccggcgacgacgagatggacctcgcctacttcgagcccatggggtccgaggcttacatctggtctcccttctacgtccagctgacggagttcgcggacaagtcgtacgcgctggggctgagctgcacgcactaccaccacgacccca

SEQ ID NO: 25625 - DNA, 497 bp, Triticum aestivum
  Clone ID: PAT_TA_25625
tgcccggggccacgggatcatgggaacgacaaccgcaatgacctgtaaaaacatagaacatcctattaactgaaacatgcttgcactaactttaattcagtcgtcaaacaaattaaagggaaagggatcaattgttttccatttatagcccagtaggaaataacacgcaaggtacaaccaacacaatcaccactttgaacctttcaactcttctcagcctcaaaaaggtgtcatggttttgatgatgtcctcatccaagcgatgcaaattatttgtagagaatgcatattagtaaataaaaagaaattccaaagcagaaaacaccaagcttgctaggatatttgtcactcaaggcatcattttttcatgcaaaagatataaaggtccaatgtccaataacaactcaaccttatttatttttcagaatcctttgatacacactataagttgccgaacaaaatctttgagcatgcacagctggcataaaaaattgatat

SEQ ID NO: 25626 - DNA, 424 bp, Triticum aestivum
  unsure (1)..(424): unsure at all n locations
  Clone ID: PAT_TA_25626
tttttttttcaatcagctcacaaaggtcctttattgttacgtaacttgtcattacacatacaagcacaacagctccgttattctgcagcgtagatagcgagagacgcatgcatgtttttatccaggacagaccacaactccacatcgtttcttcagtagatacgtacgcacgcatgggtaggtatgggtatgtgtatgtcgatcttctggacgcggacgtgcacgatcgtatgagatatgcgcgcggcgcgcgctggctggtccaagtanacggctggganttcccagcgttggttgtcnccctcgnacactttccaaganacactcggggccgtnncgaagccccgtggacttgcccnttttaggcncaantttaggtaattttccacaagcgcaanacctgagccttgccaanccctgtccc

SEQ ID NO: 25627 - DNA, 548 bp, Triticum aestivum
  Clone ID: PAT_TA_25627
gcctgacgcaaacattaccatcacttcacacagaatcatatatatagagtacaagtgcactgcataaacttggttcaagaaagaaacacacacactttgcatagtttgcagctaattaacctgctcgactcagtggctcaactccaatcaatagtactaagggagcatgcaacagaacagagtactcgagactgattgcgacgacgattcctgccgctgcttgttattcatggccttggagtttactagatattatattatggacccccatgacgtccgattgttcgggatttgaccttggcaaatcgaatggttctatgggttagtgatgggagaacgttaagtttagttgataaacatgcaagtctgggctcagtgtattttgtgccagaaaattgccatgcatgtcaactaaacttgctatcctcgtgtctctagagttgccatcgaacatgttcgatttgccatgatcaaacaccagacattttggatttattatttccatatattattaggggtgaagtctagtagatggaccgttggatcag

SEQ ID NO: 25628 - DNA, 640 bp, Triticum aestivum
  Clone ID: PAT_TA_25628
gctcccgcgcccggtgatgaagaacatcacactccgtttccgccggcgacagcaccgctcgccatcggttcggtgcgtcgcacacaacacaaccggccgcgacgccaccgccggttcggcccgggcccgtgcaccccccggcggcggcgccgccgcccgcgcgccccgccggcccccccctccacgccgagggccgccggagctgcagctgcttctcgccgcttgctcggccaccctctctcccccgccggggcctcccacttctctcgtgcttgtgccagctctccctagccgggtccttgcccttcactggccggtggcctggcgggtcctgccccttgccttcccctccgtcccccttgtcctcgctgttccgtgctgcccctgcctcggccggcgcgtgtgcctcgcctaggccgtccccttgcgtcctcatccctaagtttccttatggatatcatgatgaggaggatgctcccaagcctggctttttgtggtctggctcccagatacggccagcgtgggcacccaagaactacaaggacttgaaactggaacatagttttttaccaacgacccccaccagatcccgtcccaccagccgcgtcaccatttcaacagatcgtctcccctggcattt

SEQ ID NO: 25629 - DNA, 550 bp, Triticum aestivum
  Clone ID: PAT_TA_25629
ttctctttttgtcccgggccgctaccttgtaggcgtaccagctttatcttatgacacattacagttaggagctgggagcaataatggtggtatatcagatctgcgtgaaagtgacacacgataaaactgccgcacactatactacctccgagcctgaccagaacatactgccgggcagtactgctgtacctaccggctgttgatcctggcgagcttgctggccaccacgaagtcgagctacccgtcacgctaaacgatttacttaatcttcctgcgggcgacgagaggggcgatctgcgtacagcgcgacctggggtgcattataagccactgcaactgacacacattgatggcaacaaacttcctgaacttgatagaaaggcagcgcctggtcctctctgcataaccgcagccagcgaaaggcatgaatgatcatgccttgaactgtctcctaacacgagattcattaccctttggcctgtcccacttccgcttgatgccactgtagcgcacgctatggtccctattgaagcgcatgaccctcatcttc

SEQ ID NO: 25630 - DNA, 534 bp, Triticum aestivum
  unsure (1)..(534): unsure at all n locations
  Clone ID: PAT_TA_25630
gcacgaggccgtgacgaaaaaaaatgtccaccctccctcgatccagcaccttccccgatctcccacatcccgcacctcccgcacccgacagcgacgcgcccgccgccccgtccccaaccggcggcgccgccaccaccaaccccacaaccagagacgcgaccgtcgctgccccgccacgccccaaccggagataccgccgccccaagatcccgccgccgccaccacctgcgcacatcgccggcgttgtggtccccggctttccccaccgccgcgcccagcctcccacgcgctcgcctcctgcctctgcgcaccgccgccctacctcccgcgcgctgcagcctgctaccgcgcaccaccgtcccccatccagccatcccacgcgctgcttcacctccgtgcgcttctgccttcttccactgcggggatgccctccctctccccggcgttgctggaaaaacaccggcgacaggctcctctgtgaccgcngacctcaccagtgcgacttttattnnntttgttgannntcanntttaa

SEQ ID NO: 25631 - DNA, 574 bp, Triticum aestivum
  unsure (1)..(574): unsure at all n locations
  Clone ID: PAT_TA_25631
gcacgaggcaacgtattaacgagggcgaggagacaagcgagtggagaatggcttacctccagcaagcgccggcatggttcctctggctggcctccctcggcgccctgtacgtcgcggcattcttgccccgcctcctcgtctacctcacgcactgcctgcgccggcccgaggacctccgcctgcgctacggcacgtgggccgtcgtcaccggcccgacgtctggcatcggccggtccgtcgccctggagctcgcacgccggggcctcaaccttgttctggttgacctcgacgccgccaatctccacgaagtctccggcacgatcatgtctcgacacgccgtgcagaccatggccgtggtattcgacctctcgctcgtctccactcctaaaggtgacgaggcgttgcggcggctccgggatgccgtgaagaagctggatgtggggattctggtgaacaacgccgggatagcgaagccgggtgcggtgttcctgcatgaggccgacgtggaggcgtgggtgaggatgattcgcgtgaacctgtgggcggtgacggaggtgaccgccgcggtgctgnn

SEQ ID NO: 25632 - DNA, 727 bp, Triticum aestivum
  Clone ID: PAT_TA_25632
gcacgagggtgggtttcgtcgctgtggggcgacgttttaaaacgcaccggccgcagaggccagcacctgtcctccgctaccacccctctcgccgtcgtggtcgcgcccgcggccaacgaccgccttccacctcgcccacctccgatctctatccctctgtctctctacgcgcgcgcgccaatcgctccttgtagcagcagcagccgccgcggatctgctcttgctaaattcggcactgccgcccatacttaatccagcccggccgcgccgtcctgtcctcctgctttaaagcagctcgagctcgctcgctcgctccccctcgcccgcccgctgctccccatcacgactaccacggccgctgtgtctgtcaggctggagctcgcacacctgtgacgccctcactcgtgcctgcctgtgtgctttctgattcggttcggctgattggcgggagtgagtgaggggatcgggtccgatggactttccgggagggagcgggaggccgccgccgccgccgcagcagcaccagcaccagctgctgccgccgatgacgccgctgccgctcacgcgccagggctcctcggtctactcgctcacgttcgacgagttccagagcgcgatcggcgggccgggcaaggacttcgggtccatgaacatggacgagctcctccgcaacatctggacggccgaggagtcgcaggccatcggcgccggccccaacgccgccgct

SEQ ID NO: 25633 - DNA, 844 bp, Triticum aestivum
  unsure (1)..(844): unsure at all n locations
  Clone ID: PAT_TA_25633
gtccggtgttttcatatgcaccgtttatacatatttcaattacaaatccatgcgattatttgagttcagaggcacacacaattatatnccagagagaacgcgtcgggtttaaaaacaactatatataagttaacatttggaataacaaggtaggtgtcccaaacatgcactcctacttgaggtttctgcattgcccacactcaatcctcacacagcgcctatttacctcctctcttcagacaagccagatcttgagacaacttaagtcaagtgaagaggcgcctcctgccgcgcctgccagcccttgcctgtggcccgtcggcagcctcgccacgaaccacctcgtcgacgagctccttgaatattgacctctcgatctccagtatcatcccggggagctgctgctggccgaagctcgtcgtccacccttccagcctgtgcaggatctctgcgtcaggtatcacactgctgctcttctcctggcacatccgcgatctctctgtcttcaggtactcgatctctgagcaaatggccttcaccagctgctgaccgctggacacctccctggctccggtgagcgagctagccgcatggaccgaggtttctttctcaaacttgtcgaggaggagcatgttcaacggcgtcgaacattagcttcccggtgagctctcttggggtcgtcggaccttctgctttgatggacgcccctcaggtttggaggtccatccggacttgcgttgctccagcacgaggaacaagtcaggattgatggggtagccggaggcgtggagctggatttgcgacaggcccgtacccaggtctttcatcagaaggcccgaggcca

SEQ ID NO: 25634 - DNA, 1740 bp, Triticum aestivum
  unsure (1)..(1740): unsure at all n locations
  Clone ID: PAT_TA_25634
attatttcccctcagatgaaaacaagaggaacgaatttcttcagcagcagctaaatgaactgaaggtcgataaggagatggtagcaactaccatggaagagttacataaggaattaagtgagaagaaagcagagttgagatgcctgcaagatgagttgagtacaagggacaatgagcgtgcatcagatggatctcttcagagccttcgaagtatggtgatggctctacagaaggagaattcagatttgaagatagcgaagggcagcctttacaaagagcttgttaatatggaaagcacaacacaaaaagttgacaatagtacttctgatgttgacaatttttctgatgtggagaaggtcaaggacgagatggcttcattgaagaaagctttacagggtgcttttcacgagcgagacagagcattacaaaatttgtctcggctgaagcagcatttgttagataaggaccttgaagaccaagaaatgctggacgagcttgccaacggcatggatgcgctgcgggcaatcggtcagcagctgcgtgctctgctggggccccttgggcgggcctctgccgtgggggtgacaaagcaggaggagagtaagaagaccataaatgatgaacactcgaggtcaaatgaacagatagaagatctgcaatacaagcttgcaaactgtatgaatgcacttgaatcaaaagatcaggaactgcttaatctgcagagtgcccttggacagtactatgccgagagtgaagcaaaggagcgacttggggatgatttagctatggctagagaagcattggctaaattatctgagtcactgaaggtggcaaatcaaggaattgaaatttcaagaagggaaaaggacgaggtagttgccaaacttactcaagccgagaagatgttagcggacgggaagcgctccctgcagaagcttgaggatgacaattcaagattaaggcatgcgctagaacaaagcatgacaacagtcaataggatgtcacttgattcagataactctgttgacagacgaattgtgatcaaactactagttacatacttccaacggaatcacagcaaagaggtattggatcttatggttcgcatgcttggcttctccgaggaggacaagcaaagaattggttctgcacagagcaatgttggtaaggttgttgtccgtggtgttttgggtcttcctgggcgtctagttggaggatttgttggtggaaattcagcaggaaaatctacacatgcaccccaggataaccagtccttcgcagatctctgggtggactttctactcaaggagacagaagaaagggagaaacaaaaagcttcggaagccgctgcaaggctttcacatgaagaaaaccaaactaccagtaggagtgcatcaaatttacaagcgtcacagcacattgcaaatcctggcctttccacaaagccacatcagtttgatcgtccagattccgatgaattccgcatggttccacttgcgcccatgtatcatccatgcagacgcctttaaaatgatctgaaccaagtatatagtgctggatgacttatttcctttgagctattcatttcatttgttgacaatgtggcaattttagtcaattcgaagtttttattctctctcccctcttggtggcatgctaaggaaatatgtaaatgggcccctgtcagtcaacaaaaggaacaattcactatacaatgtatgtatgcntgctgncnnccgg

SEQ ID NO: 25635 - DNA, 747 bp, Triticum aestivum
  unsure (1)..(747): unsure at all n locations
  Clone ID: PAT_TA_25635
ttcccgggtgcacgggcaggttttcaatgtgaaggacatgtctaccaagccgagaaaaagaaaagataaggaagcgaatgcatcgtacgatgagccaaagcggcacatagttctttctgggaagagaaacatcgtgggagtggatgacaagacagacatgtcaggagattatgaaaagtttgatgaaattgctccattcacagtgaatattgacccgagcatccagttaaatgatgaagattttccatggctacggcgcaaagggacacacgcgaagaaaaagtttcacacccaaagatctgggatgtgatcggcttaactatcatcactttcttctgtgtttcacacccaggagggaatctctgtaatgaccctgaaactgagaagcatgttttgtcaactcagaaaaggataaaagttggcatggtatcatatctttccccccatatcatgtgtttaaaagtagagaggattaccgcaaaaactggatgcacttcgtgtacaaaatggacaatctgtttcgaagtatcaaggtttcggacgaaaaccatccgttacaaaggaattcanttttaaataacttaagcattaccaaattgaatataatntaaacacactaatatnaacataagaaaaagaacacgggaaagtatttaaagtaagtatcaaaactatgatcaacaattcaataatcanatttactatcaattaaaacacggacaacgaagntcaaaacacaaattcaag

SEQ ID NO: 25636 - DNA, 650 bp, Triticum aestivum
  unsure (1)..(650): unsure at all n locations
  Clone ID: PAT_TA_25636
gcacgagggcccgtccagcgttcagctcagctcgctcaatccttgcactgttccgctctgctcctgggttttgtttcgagcaggaaatcagtaaaagtcgagtgttatgtgtgattgattgatttctggagcaatggatcttgagttcgggaggggcatgagatccccgcagagggactcatggaagacgaccatggtcctggcataccagagcctgggggtggtgtacggggacctcagcatctcccccctctacgtcttcaagagcaccttcgccgaggacatccagcactcggacaccaacgaggagatcttcggcgtcctctccttcgtcttctggacgctcaccctcatccctctcatcaagtacgtctccattgtccttcgagcccacgacaatggcgagggagggacgttcgccctctactcgctgatttgccggcacgccaatgtgagcctcctgcccaacaggcagattgcggacgaggagctctccacctacaagctggagcgcaaccctgagaccgtggacaagncncgcgtcaaggtgtggctggagaagcacaagaacctgcacaccgccctcctcatcatggttctcattggcacctgcatggtcattggggannntgtcctcacgccggctatat

SEQ ID NO: 25637 - DNA, 1012 bp, Triticum aestivum
  Clone ID: PAT_TA_25637
tcggcacgagggctacagttcagttcgacaatcttctagagacgggcacatcatccgcccgtgaggcttccagctccggcgaacccgcccgctcggccgagagataccgcgaccatgtccatctcgctgcgcctcgtgatccccatcgcagcgccctgccccgtgccgccgccgcggacggcgcggaatgcgggctgctctccgctctctgcggccgccgtgccggtgcggaccacgggcgcgctcaggggatgcgccgctctgccgctgaggccgcagtcgctggtccggccatgccggagccgggggagcggcatcgtctgcaacgcgtcggcgtacctcagcccgccgacgacgcagtgggtctccgtcgcggccgccgcagtgctattgcttgctaaaggcacaggcatacacaaatctttcctcgtgccattgtttgttctgcaagcacctaccgccgtaatctcatggatcaagagtgaatatgggctgtggactgcttttcttgcgcttgtggtgcgtttgttcttaccctttccaggtgagctagagcttccactgtcaacaatgctggctgtcagcgttgctccttaccaggtgatgaatgtgaggggaactcaaggtggcgcgatagtgtcgttggcactagctgcgtatctcgcctttcagcacttcaccaggaccggaggaataggaaaagcctttgatcagggatcgatagttgcgaccatggccatcatctgtatcgcagttatcaatgtgatcctgctgttctgagttgccaagggctactccagagcgcagatgaataaagagaaaccttgtagtgcatcatcctgtcggaccttgtagcttgttttatcgtaataagaatgacctgtgagttgtgacatgactgaaagtatgtatcttcatgtatggtatggtttgcgcagtagttgtgtcttgtgtgatacagtgttagtgttcagtcttcttgatggccagttcaaaaaaaaaaaaaaaaaaa

SEQ ID NO: 25638 - DNA, 477 bp, Triticum aestivum
  unsure (1)..(477): unsure at all n locations
  Clone ID: PAT_TA_25638
ttcccggggccacgggcgagccattaatcacggatgctatgcttaaaggccgttagggcttcggcgtctgggcaatcgacaatctggttctttttaatgaggaacctagtccagaattttcgggcggactctccgggctgctggacaatatgactgaggtcatcagcatctggaggccgaatgtaggtgccttggaagttttctctaaaggcatcctccagatcttcccagctaccgatagagttttctgggaggctatttaaccagtgtcgagctggccccttaagttttaggggaggtatttgatggagtgtagatcgtcaccgcgagccatgtgaatgtggagaagaaaatattcagtccatactacgggatctgttgtgccatcatatgattcaatgttcacgggtttaaaacccttctgggaactggtgctccattacctcatcagtgaagcatanggggtgtgcggtgcct

SEQ ID NO: 25639 - DNA, 808 bp, Triticum aestivum
  unsure (1)..(808): unsure at all n locations
  Clone ID: PAT_TA_25639
ccaccagcgcgcgcatcgcctgccatggattgcgccgccgccctgctccctactgccgtcgtcgctccgtttcccatccgccgccgccgtccaccgcgtccagcctctgtcgcatcccatcgtctccaccgccaccacgaaccatctctctccttggtcgtctctcttggaccagcacgcggcggcggattcttccgatggcgtgtggcgacgcgtccggtcgagggaacgggggtgaggcagactgcgtcccgttcatcgatctgtccccacctcatgttcctcctctccattgaatttcacgtccccagttactgcgacacaggacgctctccactctttgacaacaatggtgcccgtcctgttgtgcctctccacacttaccatcgaggcgcaaaaatatttggagaaagatcgcgctccctgtagaaaattcggcccgggttctaagtggctacccagcaagataattttctgctctgaagttctctcatggaacttgggtgggattggcgaaacgtgctaggtggagtacgtgccactggatggcantgttagtgggcagaatctcctctccttcagacacaaacttgggtttggcaaggaactggacccgtgccggatgttcttccgccgccagcaggggttaaggttctgnggactatggatannngnatggccttatgnttganagttttngacatttatgcccantnngtanggtccccangtnttggattgtttntggatggtaaaantcacaaatggnatgttttttttatttnnntaaantnaanttttttcngcc

SEQ ID NO: 25640 - DNA, 583 bp, Triticum aestivum
  unsure (1)..(583): unsure at all n locations
  Clone ID: PAT_TA_25640
ggaaggctctggagtattccattgagaaagcaaccaacttgctccccaagtgcataatccgtgtcagcagagtctgtgaagatcagatgtataaggatgacaaggagtggaccagaaacgaggggcaatttttattcactcctacgagtagcaattttttataatatgtcctacacccatcttgaacagcagttcgtggatccaagtcaagtaatgcatctggagaatccaagtcctgctacttaatctgcaaagtctgcaattcaactggccagccatcagcatttggttccaaaaagtgactctgttgagcgggatcaacatgtactcaaggggatttatctgtaagtggtgaagctaagtattttttttcctcctaaatctgtcgccaacctccctccgtttgctgggttgcctgagttaagaacaagacattagtagtanaatatgtttttttaattcccctgttggggaaaccttgtggttgtgtaacaacccntgaggttcaatttaactcctggggggggaaaaccaaaaaaangttgttggtggggtacaatttacgcacggcaaactgagctta

SEQ ID NO: 25641 - DNA, 600 bp, Triticum aestivum
  unsure (1)..(600): unsure at all n locations
  Clone ID: PAT_TA_25641
gccgcgccccgcgcgacgaccaccgccccctccatccacctcccgccacnaccgccttccctccctcctccgtctttgccaatccgtcgagtttccccggagtttccgccaccctctttcgagctttttcttgccggttaaatgcatggtcctggggatgggcggcggcgtcttctcttgtccggtggcggcgatctgccgatgtggcggccgcgtgggcggcgggaggaggagcacctgagactctgccgccgctctgccgccgtgttgccttccctttgaccgaaaggtgccgctcctttccggaaagggggaatttgtttctgctcttctggcgacttcctttgccccgnattccagtccttgttgcctcgctaaatctcgctcggatttcttctccttacccttggacctccctcccggccgcnagatcctttgcccccctgcccgcccaatcctggctctgcttcttcaaaccgctcctgcaantggaaaccnttaggttttgcagantttgttgggcaaagaaaattanatctgggaaaaggatgggtccaaattctanaccaaaccncttggnngctcccccgngggggtnna

SEQ ID NO: 25642 - DNA, 802 bp, Triticum aestivum
  Clone ID: PAT_TA_25642
tcggcacgaggcagttttgacacctcgtgtagatggcatcgatacaacagcaagtcaccgtggaaaccatttctatattacaaggagaagtgaagaattctacaactccgaattggttgcttgcccattgaataatgtagctgagaccactgtcttgctaccgcatagagaaagtgtgaaaattcaggatgtccaactctttgagaatcacattgctgtatatgagcgtgagaatggtctaccgaaagcaactgtctatcgcctaccaggcactggagaggcagttgggcaacttcagggaggacgggcaattgattttattgatccagcatatgcagtggaacctgagccatcgcagttccattcgaatgttgttcggtgggcggatgggtgggtgaggacgccaccctctatctttgactatgacatggatacgggggtgtcggtattgaagaaaattgacactgttttaggtggatttgatgtgtcaaactatgtaacggagagaaaatgggctgctgcttctgatggaactcagatccccatgtccattctttacagaaaagatatggtgaagcttgatggctcagaccccatgctgctatatggatatggctcatatgagatatgcatagatccgactttcaggggatctaggttctctctggtggacaggggttttatatacgtgatagctcatatccgtggaggtggtgaaatgggccggaattggtatgaagatggaaagctattgaagaaagaaaacactttcactgatttcattgcctgtgctgagcacttg

SEQ ID NO: 25643 - DNA, 502 bp, Triticum aestivum
  unsure (1)..(502): unsure at all n locations
  Clone ID: PAT_TA_25643
ggcgcgctctctctctttctccattgctgcccccttgattctcgcacaggaggccacggctcgcgctctccctggctgacacggcggtgggctgctcaggcgcgtggtgcggcgggcgctggtgtggtttggggctgttgatactgccgtgagctagtgatggcgactgcggtgttcgccggggaggggaccgccgcgcgcggggggtgctcggcggaatgcgccggcgggatcgagaggccgccggatctcgggagcaagggccccgtgcccgcgggggaacgggtgccctnaagaggagcgtgtaccttatnggagttgcgtttgccgctgttggggctgcccccccccgccccgccgcgccgcccccaccggggacgcgggcgccgcccccccgcccccccctgccccccccgcgcccttgcccccgtgcccccgggagcgggtcgggcccccgggcgacccctttaacctgggaccgggaatttggggggtggaaatt

SEQ ID NO: 25644 - DNA, 502 bp, Triticum aestivum
  unsure (1)..(502): unsure at all n locations
  Clone ID: PAT_TA_25644
gagagaactagtctcgagttttttttttttttttttattcgtttctctctcggtacgtaccgtggaggaaaaatcatcttgatgccaaccaaaacaatcaacaattacatccactagctaatccaccggcaattaacacctacaggctgatcgctagtgctaatactaccactgtacaagcatctgatgatccatgtatttgtctccctccatcaagcccactagcctacgtacatcggcgcacagtgccagccattgacagggagcagagccagcttgtcctttgctactgtgggcgcnagagcgagctaccccgaaanccaagagggccgaggctgtcgagggcgcgcgcgcccgccagggcnaggggcatggcgatcaggccccccccgtgcgcccggccccggccccaccccccccgccggcaccnccaccagcgcccacgccagccccgcgcacaggaaccccnccgtntcgtagacggcggtgtcggccggctcgt

SEQ ID NO: 25645 - DNA, 668 bp, Triticum aestivum
  unsure (1)..(668): unsure at all n locations
  Clone ID: PAT_TA_25645
gaagggccgaagggagcgggcagcgagagagacctagcccgcgtctcccccacgacccttgttcctcttgccgccgccgccaccgctgcccacgatggagcctacgcccacccctctctcgctcgattcctcacctctcctcgctcgattcctcgtctctcctcgctcaagtcctctctctctccctttcctgacaccaccgccctccccgtccagtgaggggtccgtagacgtcgtctttctggacgccgacttcgcccagccggctgggacgctgcctccggcgaccagggccccgttgatgtcgccaactttgcccagcaaggccttccaccatgtcgtctcccttcggcgctatgagccagagggcgtgtttcccgttcaaggggtcaatggataagccaacaggggggggggccgggccgggggcggctggcccctacgctcccgtccgggggctgtacgccagcggcattacgcctccccccctcatcccccccgcccccccctcaaaaccccaaagaaaantaaacctanttccggntttcnaaaaaantttcaaanngggttaatttcaangtgttaaaattcgttnttttcccaaantttataacaaatnctggattanaattnnaacaacctttgnanttacgggaacttatanggct

SEQ ID NO: 25646 - DNA, 552 bp, Triticum aestivum
  unsure (1)..(552): unsure at all n locations
  Clone ID: PAT_TA_25646
gcacgagggtcgtctctccctctcgccaacgccagccaaatcttcgcttcccaaagctctcccctccctccctccccccgtcgcttccccatcacgcctgctccacgcggcggccgcgattgagcccgccgccgccgccgccgccgagcgcgcgacgacatgggcgccgccgacaacaacgccgcgccgcggcatgggcagcagccggatggggcccgagggcgggcgccggcgccggagcagagggaggtgaaggtggtggtcgtggacgggccggcgccggccgtgtccagagctgcaggcgcagcggcccgtggcgccgctgcaggtgaccacgcaggcgccgccgccgcccaatgtcggtggcctccggcggcgaggacccgccgccccgcgggcggcctaacccgccgctcaatgcagcagacccccccacagccaccggcggcggtggactcgcccctgcgcgccttccacatcccgctgtgcccctgccgcctcctcctgnctgcggccgggcccgggggcgggggctcccccttccgctttttc

SEQ ID NO: 25647 - DNA, 821 bp, Triticum aestivum
  unsure (1)..(821): unsure at all n locations
  Clone ID: PAT_TA_25647
gatctccgccccgggccacagcccgctggcctgaatatataccgactctctccccgcacgcacgcgccgcctagaagctcgcgaggacgaggagcggataccgagaagagggaggtcggccgctgtcgtttgcaccagggcgaagcgattcttgctcgaggggtgggtggttacatggcggtgacggcgacgacggccgcggccgcggccaccatgctggcggcggtgatggccatcttcctctccttcgtgctctgcttctacatattcctctgcgccaagaggtcccggggagagggcgccgcccccgccggggagcggcgtcatggcgcacctgcgcttcctgttctgccgcggggaccggagggcccgggcgggggaccgcgtcccccccgttgccagcccaataaaccaggggggtccatcaatagaaatatttacataagtttatttattttttaagaaatatttttttactacactatttacaagctattgggaaaatttcaaggtggtccatgggccaccccggcaccccctactacgccactgctggntctacgacgggggcctcgacgaccgtncatggcgtcgcttgccccgccgggaggtggcccaanggcnaggccatggacttgcgcggtcttgnatnacggaacttcgccgccgggganacggcncgcgtgcttgccccgnttgngggccacgggtttccacgtcnaattggcgtnnacatgngggctnaaggncggacttcaacttgnccggttttgcccgttgcccncccttaannccnccgccctttccgncccnncccgnnt

SEQ ID NO: 25648 - DNA, 988 bp, Triticum aestivum
  unsure (1)..(988): unsure at all n locations
  Clone ID: PAT_TA_25648
gcacgagggcaccacccgcctccgaagaggagacaagagaaaaaaacgctcccctttctttctctctctcccccgtccaaaactaaactgcgtcgtacttgagtaggcggtannnttgcccgggagttacaccgcccggcgccgtaaaagctctgcggaaccgcacgagcggcagggcgacgagcagagcgctcctctgtttccctccatgacgtcctgcggaggcgccaccgcggcatgcccggacggccgcgtcatcaccgcccccctgctcgccaagccgggggaggtcgtcgtccaggtctgcggtgacgaggcggccgcgccggtgctcacgtgcaagccgcccggccggcttgccagggcggtgaaggaagcctggtccgtttctttgggcatcgcgctcccgatgatgccgcccgtgtcggccaccgcggcccgcgacgaggcgcgctccattctcggcctcgcattcccgatgatcctcaccgggctgctgctctacctccgctccatgatttcgatgctcttcctcggccgtctcggcgggctggcgctcgccggcggttccctcgccatcggcttcgccaacatcaccggatactctgtcctctccggcctcgccatgggcatggagccgatatgtggccaggcattcggcgcgggtaactactcgctcattggtgtcaccgtgcagcggacggtgctcctcctcatcgcggccgccgtccctatcggtggcctgtggatgcacatgcggcctctgctcctcctctgcggacaggacgccgccatcgccgccgtggcggagacctacattcttgcctcactgcctgacctcctcctccaggcattccttcaccccgtgagggtatatctccggatgcagtccataaacctgccactcaccgtgtgcgccacgctcgccattgccatccacctgcccatcaactacgtgctggtgaccgtgctcggcctcggcgtcnnn

SEQ ID NO: 25649 - DNA, 639 bp, Triticum aestivum
  Clone ID: PAT_TA_25649
gcacgaggcgccgacgatgacgccggccgccgtcccgtccactcccaacggcagcaagcatgtgccagtttccccaacgcagcaaccgtagccggcagggagctgacccccggccgtcgctctccacatcggtgactgaatcggcggtcaggcagcagcagtccgccgccccgtccaccccaacggcatcaggaagaagtcatagtccaagatcttggccaatagatgagataagtgaaataagtgaatgtggatcacattcaccttgtgctgggaagggaaagctccgtcagatatcacttgaagtgcaaagaggagattcactaactgtcagatacggacggactacaattcagagaaaatatgggaatggagaccgaataatcaaggttcattctcagatgagacgaatggcttcgggggcatctgcagattctgcaacctccatgttgtcatatgtggccagtttcttgggttccactggtatggtagtctctttctcttcttgggttgtttcaactcaaatccatgaccaataggcactacttcaccaaaccactgcttagattttcgattccacccacagtttcatattttgcttgttataagttgaaataagcgaagcttgaactgatgtgg

SEQ ID NO: 25650 - DNA, 976 bp, Triticum aestivum
  unsure (1)..(976): unsure at all n locations
  Clone ID: PAT_TA_25650
ctggacctgcgtcatgcagctcaccgccgtcggcgagacgtgggggccccgggtgctcaagggatggccctcctgcctcacggcccccgaggaggccgctgccgtgcgcccggccgtcgtcgacagggccgcgttgctgccgcccaaaaggctcgacgggaacaatggttatttgatggtctcatgcaatggtggtcttaaccaaatgcgagctgctatatgtgacatggttgtaatagcaagatatttgaatgtcactttggtggtcccagagttggacaagacttcgttttggaatgacccgagtgagttccaagatatatttgacgtcgaacactttataacctccttacgagacgaagttcgcatactgagagaactgcctccaagggtaaagcgaagagttgaacttggtatgttccactcaatgccacctatcagttggtctgatatctcctattaccataatcagattcttccgtttattcggaaacacaaggttctgcatttgaatagaactgacgctaggctagcaaacaatggtttacctatggagattcaaaaactgagatgccgagtaaattatgcctctctaagattcaccgccgagattgaagatctgggcaagcgtgtaattagaatacttcgccaaaatggtcctttcttggtacttcatttacgttacgaaatggatatgctggctttctctggttgtactcaagggtgcagtaacgaagaggcagaagagctcacaagaatgaggtatgcttatccgtggtggaaagagaaaatcattgactcggatttgaaaagaaaagatggcttttgcccattgacgccagnnnagaccgctcttgttctcagagcattggatattgatagaagtatgcaaatatacatcgcagctggggaaatatacggtggaaaacgcnnnntggcagctctcacttcagcttatccgaatgtggtgaggaaa

SEQ ID NO: 25651 - DNA, 302 bp, Triticum aestivum
  Clone ID: PAT_TA_25651
gcgttcgatctctcatgctcattatccctcttcaattctattccttttagctttttttttaaaatatattttgcctactcttggatcctgattttcatgtctaaagtttaaaaaatacctgtgtagctgttctgcgctgcagccatcgtgctaatgaacgttgaaccaactgcttcataatctgtagcactctggatcgccggcagaagtgaaattgtaaataacagatgtaactcaggaagtcaggatgtttgacgacttgacgtcgtggatgcctggttgagtctctttttcttttttag

SEQ ID NO: 25652 - DNA, 742 bp, Triticum aestivum
  Clone ID: PAT_TA_25652
gcacgaggggcgaaacatcacggcactcccaccactattcatcattaaccttagggatcatccatcacgcaatgcacaagggttctattcgcgacgtggaattaaactgtttcccctaaaactccatcgaaattcccgtgacttctcatgcaccccaaatggcacactaaccttaatctctagtcaaaacaatgaaaacatgcacggtaaagttgcctacccacctcgacgatctgctcatcctctaatctaacacaagttagtagtactgattagtatactaagcacgacctacgcccgtttgatcatttctccatcgcattctgagcaggcggcggcttctgaaaggagaaactatcacggtgatccggcgtcgccgcgtccacgtccacacggacctccgagtccaggctcctctgcttcgtgggcgggatcaggtacctcgtctgcgcctcggcatccgtgtcggagcagtccgagtcggagagcgccctggtggcgccgacgtgcgctatggtcttgtagcggtggaggtgccggttcgccaccggcgccgcctcggcgacgaactggcactggctaagccggcctgcctcgggcgtgtccgtggttggcgtctctgaggaggcatgcgatgatcccttctgctgctgttgctgctgctgcttcttcttcaccgtcttgtgccacttcttcagggccttcgacgtctgctcgtcgaagatggttcgcttcatcgaag

SEQ ID NO: 25653 - DNA, 652 bp, Triticum aestivum
  unsure (1)..(652): unsure at all n locations
  Clone ID: PAT_TA_25653
ggaattcggcaccaggctcactgggcggggttgatctctgtcgtggtattctgctctgcaatgtcctcgatgacaatcccaaccctgtgttgcgtttcattccattacctaaggaagcggccattaacagggatatcaaaaattgtccttggttataccgggatgtcacctacatcaatggtcttatcaaatttgttgctatggaaacatgggaaagcagcacgcttacaagtaaaaggacgtgtggctcctctgatgatatcacagatatgcaattcgattcagactcggagttggacgacgacaacatgtatgtcatggatgacaccttcagctggaatgctgttgcatgggtcangaagacttcccaggaggcttggacctgtaactgtgacgtcagtgttgatgacattgccattgacaacataaagcatttgcctccactgaataaactcagaatatctgcccctaccctgagtattcatggtgattgatgctgttatttatctcacgtctaagtttgaacatcgacgatgataatgcctgggtcctttacagtcaacattgacaaggaagaactttggaagatgttgtaatggtttctgccccaagagacttcttctggtcatcacgcaccgtccccgttcatgga

SEQ ID NO: 25654 - DNA, 636 bp, Triticum aestivum
  unsure (1)..(636): unsure at all n locations
  Clone ID: PAT_TA_25654
caacaccgcgccgccacacctgtcttctcccacatcgggatccacgagcccccaatcccctcgcagcctccaacccctccgcgatctgacttccaccatcacgtgccagggagagcagctcatgtgcgcctcgtcctccgctcccgaccaacgagcgcccgagaccgccttcgacccgcgcctcctttagattccctcgtccaccaacctgagttgcagcaccgccgccttgctccgccctcgccgtcctcccgccgctgaggagcttcaccatcgtcgtccgagtcaccccgccccggtcatcacttctctccatcgaccagccggccacccagggaccatacgccagggacagccgcgccgttccggctgcgtcggcgacgggactcgccaagacctgccccgagctcctccttttgctcgattctgagcagagcaccgtaggtccagcgctatgcccctgccttctcctcgttttccccatcccaccaaccagcaaacccccacctctccttctcagatcgaccctgcgctcgatcccgaatggatcaaggcgctnnnttcgctcccgtgcccgagcancnnntggagctcaagtgctcaacctcgcgcgggccnnnaacctcctcgtcgtcc

SEQ ID NO: 25655 - DNA, 809 bp, Triticum aestivum
  Clone ID: PAT_TA_25655
gcacgaggggccgctacccggcgatggcgcggacgcagctcgccaacttcgcggcgctcctgctcgccaacgcggccgtgttcgccgcgctgctcgcggccttcaatgccgcggaagcgctgcggctgggctccgacggcagggccgtgctggcgctctcggccgcgggcgtcatcgtctactccgtcgcgctcgccaacgccgccgccgtctgcaacctcgccaccgtcgtcgcggccgccgagggccggggcggctgccacgcggtcctcaaagcgctgctgctcgtccggggcgacgccgccaccgccgtcgccgtggcgctgccggccagcctcgccaccaccgccgtggaggggctgttccagctcagagtcatgaagctgtacatgatcgacggcaggataagctcggccatggtttgcgaagggctcctcatcgcctacattcactccatgatctgtgttcttgacactgtcatcacatacatggtctaccagacctgcaaggccacacattattctcgtgatctgttggagttggaagagaaaggggatttcattgcctgagtatcatcagacttctcacatgatgatggtgatgctcattgcttttttatatatagtttttatccttttgttaatgctggttctggggacataggtgctgttagtataattagggagtgcatcaggtccatcagatggctaaggaggtcaatctgtaaataattggaaaactggggttgttaccataaagatttgttatccatcagagtttggttaaactaagcatgtcatttggttgct

SEQ ID NO: 25656 - DNA, 655 bp, Triticum aestivum
  unsure (1)..(655): unsure at all n locations
  Clone ID: PAT_TA_25656
gcacgaggattagagaccagcctagctagagcacagttatgttctggaccaccccaaaggcggtgaggttcttggtgttcttggccatctttctcttcgtggaaccaacgacagatggcagggaagcccagcctgccgtgccgggggtcatgttgttcggggactcgctggtcggtgtgggtaacaacgattatctagccaccttggtgaaagcaaacatggctccctatggcagggacttcaaggaccatatcgctacagggaggtttggaaatggaaagctgcttagcgatatcataggtgagaaactagggtttaatggctctcctcctgcatatcttagcccacaggcatcaggacagaatcttttgattggagcaaacttcgcatcagctggatcaggctactacgaccccacagcacgtatctatcatgtaatacctttatcccgacaactggagtatctcaaagagtaccaatcgaagctacgcgtggtggctgggaatgaccatgctcaatccatcatctcagactcactctatattattagcgctggatcaaatgacttcggcttcaactactacatcaaccctttgctcttcttgacacagaatgctgatcagttctctgatcgcctcgttggcatctttannnn

SEQ ID NO: 25657 - DNA, 604 bp, Triticum aestivum
  Clone ID: PAT_TA_25657
gcagaggagaacgaaggagagacagagtgatcgagcgtacgtgaagagacacgcttgcactcgatggaagccgccgcgggtcagggagagcgcccgacgccgccgccgctgccgctgggggtgcggctccagctggcgggcctcacggccgccatcgacgccgtggagcgcagcgacggcaccgtcaaccgctgcctctactcggtgatcgaccgcctgctgagcgcgcgcgccaacccgcgcccggacggctccggcgtgcgctcctacgacttcaccgtcgacgcctcccgcggcatctgggcgcgcgtcttcgcgccggtctcctcggcggtgccgctgcccgtcgtcgtctactaccacggcggcggcttcgcgctcttctccccggccatcggccccttcaacggcgtgtgccgccgcctctgcagcgacgtcggcgccgtggtcgtgtccgtcaactaccgcctcgccccggagcaccgctacccggcggcgtacgacgacggcgtcgacgcgctccgcttcctcgacgacgccggcggcgtcccgggcctcggcgacggcgtccccgtcgacctcgccagctgctttctcaccgggg

SEQ ID NO: 25658 - DNA, 1460 bp, Triticum aestivum
  Clone ID: PAT_TA_25658
ggcgcccctcgccaaccccacctccttcccagcctcgtccaagccccctgccgccctacctacctcgcgccttgcccccaccttcctccctcccagcctcgtccaaaccccctgccgccccacctacctcgcgccttgcccccacctccccatggcacttcaccggctgcaggtggcctccgcgccccataccgcgcggatctagcatgccctgcaaccggcggccttccaccatggccaccgcacccgccgacacgggcgcgtgccctcccctgggaggcgcggctcctcccctcggccgcgccccgaggagctacacggaggtgttcttgcgccgccccgtgcgtacctcccttccccagcccagatccgcctccaaggcggccggatccgcccgaatggcgcgcggcacggcccctgcctacccccagtgcgaccttctccctcctcacgagctcaacccctccccaaattattctctgcggcagcctaccttgcatggctttcctcggcagccgtcgcaccagttcgctagcgcaagggcgcgtgcagttctgcccgcgggggcgagcagtgcacttggctcgtccctatgaaacagtagtgacctcctccctaccagggggcgaggagatccggcggtctccgactgtggtcgaggtcgtggccaccacacgcgtcaacaatagcgagattccaccccttggatgcactgcagttcagttttggtgggcgccactgtcctctggcaggcgtgtgtgcagtgcggtccggtggcggggtagccaccactggactccggcggtcctcttcccgtcacgtacaaaaagccatgcccaggtccaattttttcgttgttgttatccactgacggcaagcagtgcaacttgctatcattgcaggtgagttggggcgtccgtgcagtgcgcaagaacttgaggacgattgacacgcacttcggcaggaggttcgccaattggattgttgctacaattttctggattgttgctacaattttctggattgttgctgcagtttacttggtgtggacaggaggttctccagctggctcatgcagcgagcagtgcaggttgctcttcactgcaggtcggttggaccattggtgcagtacccaaatcgctactgtttttgctgttgctcacacacatcaccggtggttcaccggagcaccccctcgcagctctctccttccccaacatgcagttcaccggcgacggccttcagttcgttttggttgctgtcgatgccatccccactgtagtacagtgtatgtgcgtgttttgcgtggtatccggctgggggcctatgttccttaacaatgtaaaaaatagcatgaaaatgaagtgcacttctgttgtatccaagtttcagttccccctcaatatgaaggaatatgtcctagaggcaataataaagttacttatttccaagagaggtaa

SEQ ID NO: 25659 - DNA, 1260 bp, Triticum aestivum
  unsure (1)..(1260): unsure at all n locations
  Clone ID: PAT_TA_25659
tatatacatataaaatccaatataatttcgcntataaaagaaggattactttccccccgtaatatataggaagaaggggtcatctttttcttttttagggataggaaaatttcgtcgatatggttcattttatatatagcataacaatcttgggcaagagtttatgatcatatatgtattccaacaaggaaggaggattttcaatgcgggatataaaaacatatctctctgtagcacccgtgctaagtactctatggtttggtgctttagcaggtttattgatagaaattaatcgtttattcccagatgctttgtcattcccttttttttaattctagttattgctatggaagggatagatttcttcgtgatatgacaaaatttgatccttttcaatctttttttagtatcggaaggaaaaagaaagaaaagatggattgggttgagactcagggtcattaaaaatttggtcattcccatttttgaaaatagaaattcaatttaaaggggtacccaagctaaataaggcctcagaaatcagagcatagaaaaggcggggctggctaattaaatgaaaggatttcgacccaaaatctttgctaattcgacaaggattgtattctttaattatttctctattttttattacttaatttaagaatagatccgtatccctcgatcggttttctttcttcttctccgcctccagatccgttgggtttgtgcgttcgttgaataattaagttaagtcaatccaaaaagaaaaggaggttcatggccaagggaaaagatgttagaatcagagttattttggaatgcatcagttgtgttcgaaaaggtgccaatgaggaatcgacggggatttctagatatagtactcaaaagaatcgccgccgttcccccggtcgcttagaattcaaaaaattttgtcgttattgtcgcaagcatacgactcatcacgaaataaagaaataggaacatcgtgtgttcgatctttccaaacaacagaaagagtaagaacttcatatttaatatataaagaaaacatagtatagaatacaaaatacaaatcaactcatctgatttccggtagatattatttcatatgtatagagggtattcatatactataatatgaatcaaataagatatggatcaaagaaaaactacttcntctggatcctaaattaataaaataaagaagtgaattttcaaaattttcaaattttaaataagggataaatcaagtntacatctaaa

SEQ ID NO: 25660 - DNA, 928 bp, Triticum aestivum
  unsure (1)..(928): unsure at all n locations
  Clone ID: PAT_TA_25660
cggcgtcgggatcgacaangtcgacctcgccgccgccaccgagcacggctgcctcgtcgtcaacgcgcccaccgccaacaccgtcgccgctgccgagcatggcatcgcgctgctcaccgccatggccaggaacatcgcgcaggccgacgcgtcccgctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcggctacggaggcggtggcggctacggcggtcggcgcgagggtggtggtggcggctacggcggcggcggcggcggctggagggactgatgtgtgggcccatcctggcttcggccgagttatcttatctatctatagtatcgtgttaccgttcgcttctgtcaccgtgttagtgtccgttctacctttggattaggtgttggtacccctgttgttccctttgtttgctcccgctatgaaacgagacgagagaagaatgagcaaggtttttgttcgcagctatttttgtccaatgatattgatatgttgttcccctgtc

SEQ ID NO: 25661 - DNA, 798 bp, Triticum aestivum
  unsure (1)..(798): unsure at all n locations
  Clone ID: PAT_TA_25661
gccgctgcttactcccatgagttgcctcgctatggtcttgaagttggcctcaccaactatgctgcagcctactgcactggtctgcttttggcccgtcgtgtgctcaagaaccgtgatcttgatgaggagtatgaaggcaatgttgaggccactggcgaggacttctctgttgagccttctgatgagaggaggcctttccgtgcgcttttggatgttggtcttattaggaccaccactggaaaccgtgtgtttggtgcccttaagggagctttggacggtggtcttgacattccccacagtgacaagagatttgctggtttcaaaaaggatgagaagtcgctggatgctgagattcaccgcaagtacatctttggagggcatgttgctgactacatgaggtcactagcagatgaggaaccagagaantccaaactccacttcaagtgagtacatcaaagaggggaactcaagctggatgacatgggaagcagttttacaagaaggtcatgctgccatcccgtgctgatcccaccatggccaatcaaccaaagggcctcccaaagactccacaagagatacaaccccaagaactgacctatgagcagaggaagncacctcgttgaaaggtcaacccctcaacaactctgcgggtgccgccgatgacgatgaggacgacgacgagtgaagactcttgtcaaccagtgtatcttcaagtgcttttgtaaatcggaccncacatgactgttcaatgantcgttgncgctgantanaaatggtaccggttagtnctgcngaatt

SEQ ID NO: 25662 - DNA, 637 bp, Triticum aestivum
  unsure (1)..(637): unsure at all n locations
  Clone ID: PAT_TA_25662
cttggatgttggtcttatcaggaccaccactggaaaccgtgtgtttggtgcccttaagggagctttggatggtggccttgacattccccacagtgataagagatttgctggtttcaaaaaggacgagaagtctctggatgctgagattcaccgcaagtacatctttgggagggcatgttgctgactacatgaggtcgctagcagatgaggaaccaagagaaatccaaactcacttcaagtgagtacatcaagaggggaatctccgctggatgacatggaagcattttacaagaaggtcatgccgccatccctgctgatcccaccatgggcaatcaaaccaaggcgcctcccaaagactccacaaagaggtacaacccccaaagaactgacctatgagcaagaggaaggcaacctcntccaaaaggtcaaacgccctcaaacaatctgcccgggtgccgccgatgatgacgaggaggacgacgattgaaaacttcttgtcacccaatgtatatgcaactgcttttgttgaatctggcacctgccaacggctgtccttgaatttggtaagtcctgantananatggtacngataagtcctcngaattgtntacctaaccttaccngaccttctaaaaaa

SEQ ID NO: 25663 - DNA, 482 bp, Triticum aestivum
  Clone ID: PAT_TA_25663
tagcgtggtcgcggccgaggtaccatctccaggtcgccctggagcacttcaagggctggaaggtccccgaaaccatgaccagcgtccatgcctacaccgaggctctcttcagccgcgagtcgttcgtcaagaccaaggcgaccaaggagaacctgatcgccgggtgggcgccgaaggtgcacgcgtaagctctcccgccgctgctcggccgtcgtgagagtagtgatgggcagtagtaggcctcatctgtctaggttggaataatgcgagcgagccttgatgtgctctggttgtcgcaagcgtgcacttgctgcgtcgactgtcccctgcctggcttgtgtgtgtgggtgtgttatgtgcgtgtgtgctctggacctctggtgcaagtaatggtgcatgaattgtggttgtgaaccttttgtcgtgtgatggatgaataatggagctgcataaaaaaaaaacctgcccgggcggccgctcga

SEQ ID NO: 25664 - DNA, 561 bp, Triticum aestivum
  Clone ID: PAT_TA_25664
gcacttcagcagctcccctcacatcccacgccaagccccacgctcgaaccaccaccaccaccagcacccatggcacccaaggcggcggagaagaagccggtggcggtggccgcggagaagacggcggcggggaagaagtcccaaggcggagaagcgggcggcggcgaccaaggaggccggcggcgaggggaagacgaggggccggaagaagggcagcaaggccaagaagggcgtggagacgtacaagatctacatcttcaaggtgctcaagcaggtgcacccggacgtcggcatctcctccaaggccatgtccatcatgaactccttcatcaacgacatcttcgagaagctcgccggcgagtccgccaagctggcgcgatacaacaagaagcccaccaaggccgtcaccaagttcacatcatcataggtttcgtcgtctgtttcatggattgatggcggcaggcgtcgtgcatgtagttggcagcagtacgatgttacaatctctgtaagaattgtgctgcttgcggccttgaagaaatagtgatgttgctgtttgaatca

SEQ ID NO: 25665 - DNA, 616 bp, Triticum aestivum
  Clone ID: PAT_TA_25665
acaacccacccctcccacgcttcgatcaccaccagcagcagcacccatggcgcccaaggcagcagagaagaagccggtggcggccgtggccgagaagaccacaacggggaagaagcccaggcggagaagcgggcgccggcgtccaaggaggccggcggcgaggggaaggtgaggggcaggaagaagggcagcaaggccaagaagggcgtggagacgtacaagatctacatcttcaaggtgctcaagcaggtgcaccccgacgtcggcatctcctccaaggccatgtccatcatgaactccttcatcaacgacatcttcgagaagctcgccggcgagtcggccaagctggcgaggtacaacaagaagcccaccatcacctcccgggagatccagacctccgtccgcctcgtcctccccggcgagctcgccaagcacgccgtctccgagggcaccaaggcagtcaccaagttcacctcctcctaggcttgggcttggtcctcgtcgtctcatgcattctgtatgtacgtagttggcagtacgatgttacaatctctgtaaggattgtgctgcttgcttgtggccttgaaagaaaatagtgatgttgctgtttgaattt

SEQ ID NO: 25666 - DNA, 754 bp, Triticum aestivum
  unsure (1)..(754): unsure at all n locations
  Clone ID: PAT_TA_25666
gccggccgggcctgcaactctcgcggccccaggagaagccgccgccgccgccgccgctgccgctgcgtgcgcgtccgcaggccgcagccacagcaggcgaccgagatggcgggagggttcgtcaagacccagaagaccaatgcgtacttcaagcgtttccaagtgaagttcaagagaaggcgtgctggtaagacagactacagggcaaggataaggttgattaaccaagacaagaacaagtacaatacgcccaaataccgattcgttgtgcgatttaccaacaaagacatcactgcacaaatcgtatctgcaagtattgcgggtgatatggttcttgctgctgcctattcccatgagctgccacgatacggtctagaagttggtctgaccaactatgctgcagcctactgtactggtcttcttttggctcgtcgcgtgctcaagatccgtgatttggatcaggagtatgagggcaatgttgaggccactggtgaggacttctctgtcgagccagctgaagggaggaggcctttccgtgcactcttggatgtcggcctaattaggactaccactggaaaccgtgtctttggtgccctgaagggagctttggatggtgngtctggatattcctcacagcgataagaggtttgctggctttaagaaggatgataagcagctggatgctgatatccaccgcaagtacatctatggtctccatgttgctgaatatatgaagaatctggctgatgaggag

SEQ ID NO: 25667 - DNA, 745 bp, Triticum aestivum
  Clone ID: PAT_TA_25667
ccccacttagctctgcttggtgactgctgctggtgctcatcggactccccgacgacgccgtcgccgtcaacatgaccgaggtctgtgcctcggtcgccatgggccaccccgacacgctcggcgactgtgccttgtcccacacggtgctgctcacgctgctggacctgaaggcgccctaccacttgaagctcatcgacgtcagcaacaagcccgactggttcctgaagatcaatccggagggcaaggcgcctgtgtataacggtggtgacggcaaatggattgctgattctgatgtgatcactcaagtcattgaggagaagtacccaactccatcacttgtgacccctcctgagtatgcatcagtgggatcaaagatcttctccaccttcgtcacgttcttgaagagcaaggatgccagcgatggttcggagaaggcacttgttgacgagctgcaggcactcgaagagcacctgaaggcccatggaccctacatcaacggggcgaacatctccgccgtcgatctcagcctggctccgaagctctaccacctccaggtcgccctggagcacttcaagggctggaaggtccctgaaaccctgaccagcgtccatgcctacaccgaggctctcttcagccgcgagtcgttcgtcaagaccaaggcgaccaaggagaacctgatcgccgggtgggcgccgaaagtgaacccgtaagccctcccgctgcttggagacccgacccaccccca

SEQ ID NO: 25668 - DNA, 946 bp, Triticum aestivum
  Clone ID: PAT_TA_25668
ccgctactgttggtattgacagtgattttgcttatgtcaaaattatatctgcggagacaatgattggtttcagtgaaagcagcaagtgtgcacagatttgcaaggtttttgaggatgcttacaaatctcagttcagtatcataattcttgacgacattgaaaggttactggagtttgttgccatcggaccacgtttttcaaatctgatatcgcaaactcttatggtcctcctcaagagggttcctcctaagggaaagaacttgcttgttattggaacaacaagtgagacaacatttctagactccattggtatgtcgggtgtgttctcggtaacctatgaggttcccaaactgacaaaggaggatgctgcaaaggtgttgcgacatttgaatgtgttcgacgaaggggatgttgagacagcagcagaagcgctggacgatatgccgatcaagaagctgtacacgcttgtcgagatggctgcgcaggggccacaagggggaagcgcggaagccatctatgccggagaggaaaagatagacctcaaccatttctttagcatcttgagcgacatcatccgctactgatcacacgtacatctgaggaccctaggctccactataggaatttgtttactccagtttccccggcttgctatcttcacagggtagagtggttggatcccgagtggcctttcattgtcacggttcggccagagttgtctctttgccatgcttccgtcgatataaatattctgttatctgaagcctgagggcttgttttgtttgagaccttgggcgccgtgcctgagaaatatttacctggggcatgctatttggtgaatgggtgttgttgatgactagggataccaatccatagctcccggatgtgcttttagagtttggttgatttgatatagataattggcatttcatctaaaaaaaaaaaa

SEQ ID NO: 25669 - DNA, 822 bp, Triticum aestivum
  unsure (1)..(822): unsure at all n locations
  Clone ID: PAT_TA_25669
gcccgcccgcccccgccgccgccgccgcctccttccgcaggagctccctcctcgcaggcgagatggtgtacatcaagaaccagaagacaagggcgtactccaagcgtttccaagtcaagttcaagagaaggcgccagggcaagactgactacagggccaggctgaggctcacaaaccaggacaagaacaagtacaacactcctaagtaccgttttgttgtgcgatttaccaacaaggatgtcactgcacaaattgtttatgctaccattgctggtgatattgtgatggccgctggctactcccatgagttgcctcgctatggtcttgaagttggcctcaccaactatgctgcagcttactgcactggtctgcttttggctcgtcgtgtgcttaagaaccgtgatcttgatgaggagtatgaaggcaatgttgaggccactggtgaggacttctctgttgagccttctgatgagaggaggcctttccgtgcgctcttggatgttggtcttatcaggaccacactggaaacggngggttggtgcccttaagggagctttggatggtggccttgacattccccacagtgataagagatttgctggtttcaaaaaggacgagaaggctctggatgctgagattcaccgcaagtacatctttggaggccatgttgctgactacatgaagtcgctagcagaagaggaaaccgaaaaaattcaaactcacttcaaggagaacatcaagaaggggaatttcggtgatgacctggaacaagttaccagaaaggttatggccgcttcccggctgatccaccaggggccaacg

SEQ ID NO: 25670 - DNA, 800 bp, Triticum aestivum
  Clone ID: PAT_TA_25670
cgctcgccctctctggtttcctactgctggtgatactcaccggactccccgccgccgccctcgccgccaacatgaccgaggtctgcgtcaaggccgccgtcggccaccccgacacgctcggcgactgtcccttctcccagagggtgctgctcactctggaggagaagaaggtgccctaccagatgaagctcatcgacgtcagcaacaagcccgattggttcctgaagatcaatccggagggcaaggtgcctgtgtataacggtggtgatggcaaatggattgctgattctgatgtgatcactcaagtcattgaggagaagtacccaactccatcacttgtgacccctcctgagtatgcatcagtgggatcaaagatcttctccaccttcgtcacgttcttgaagagcaaggatgccagcgatggttcggagaaggcacttgttgacgagctgcaggcactcgaagagcacctgaaggcccatggaccctacatcaacggggcgaacatctccgccgtcgatctcagcctggctccctcctcgcaggcgagatggtgtacatcaagaaccagaagacaagggcgtactccaagcgtttccaagtcaagttcaagagaaggcgccagggcaagactgactacagggccaggctgaggctcacaaaccaggacaagaacaagtacaacactcctaagtaccgttttgttgtgcgatttaccaacaaggatgtcactgcacaaattgtttatgctaccattgctggtgatattgtgagggccgctgcctactcccatgagttgc

SEQ ID NO: 25671 - DNA, 571 bp, Triticum aestivum
  unsure (1)..(571): unsure at all n locations
  Clone ID: PAT_TA_25671
atggtggccttgacattccccacagtgacaagagatttgctgggttcaaaaaggacgagaagtcgctggatgctgagattcaccgcaagtacatctttggagggcatgttgctgactacatgaggtcactagcagatgaggaaccagagaagttccaaactcatttcagtgagtacatcaagaggggaatctcagctgatgacatggaagcagtttacaagaaggttcatgctgccatccgtgctgatcccaccatggccaaatcaaccaaggcgcctcccaagactcacaagaggtacaaccccaagaagctgacctatgagcaagaggaaggcacctccgtcgaaaaggtccaacgccctcaaacaatctgcccggtgccgccgatgacgaacgaaggacgacgacgagtgaagacgtcntgtcaacccaatgtatcctgcaactgctttttgttaaatcccggactctgcacaatgactgtcctttgattttgtttgccttgctggattataatgtgttactccatattgccntgctggcattgggtctaacctaaccgtcgtccggc

SEQ ID NO: 25672 - DNA, 612 bp, Triticum aestivum
  Clone ID: PAT_TA_25672
attcggcaccagccacctcacatcccatctccccacacgctcgaaccaccagcagcagcagcacccatggcacccaaggcggcggagaagaagcccgcggagaagacgacggcggggaagaagcccaaggcggagaagcgggcgccggcgtccaaggaggccggcggcgaggggaagacgaggggcaggaagaagggcagcaaggccaagaagagcgtggagacgtacaagatctacatcttcaaggtgctgaagcaggtgcacccggacgtgggcatctcctccaaggccatgtccatcatgaactccttcatcaacgacatcttcgagaagctcgccggggagtcggccaagctggcccgctacaacaagaagcccaccatcacgtcccgggagatccagacctccgtccgcctcgtcctccccggggagctcgccaagcacgccgtctccgagggcaccaaggccgtcaccaagttcacctcctcctaggcagctaggattgatcgccgcttcatgaactgatggcggcatcagtacgatgttacaacctttgtaagaattgtgctgcttgtggttttgaagaaatagtgatgttgctgtttgaatcgg

SEQ ID NO: 25673 - DNA, 1024 bp, Triticum aestivum
  Clone ID: PAT_TA_25673
gcacgagcgccctctccgctttcctgctgctggtgctgttaaccggactccccgacgccgccgtcgccgccaacatgaccgaggtctgcgtcaaggccgccgtcggccaccccgacacgctcggcgactgtcccttctcccagagggtgctgctcacgttggaggagaagaaggtgccctaccagatgaagctcatcgacgtcagcaacaagcccgactggttcctgaagatcaatccagagggcaaggtgcctgtgtataacggtggtgatggcaaatggattgctgattctgatgtgatcactcaagtcattgaggagaagtacccaactccatcacttgtgacccctgctgaatatgcatcagtgggatcaaagatcttctccacctttgtcacgttcttgaagagcaaggatgccagcgatggttcggagaaggcacttgttgatgagctgcaggcgctcgaagagcacctgaaggcccatggaccctacatcaatggggcgaacatctccgctgtcgatctcagcctggctccgaagctctaccatctccaggtcgccctggagcacttcaagggctggaaggtccctgaaaccctgaccagcgtccatgcctacaccgaggctctcttcagccgcgagtcgttcgtcaagaccaaggcgaccaaggagaacctgatcgccgggtgggcgccgaaagtgaacccgtaagccctcccgccgctcggagacccggcccacccccgtcgtgtgagagtagcgacgggcctcatctgtctaggttggaataatgcgagcgagccttgatgtgctctggttgtcgcaagacgtgcacttgctgcctgggctgtgccctgcctggcttgtgtgtgtgggtgtgggtgatatgtgtgtggtctgtcctctttcgtgtgaatgaataatggagctgcgtaaaattcagatttgttatgctgtagagagtggaggagcgcctccgaggaagtgatgtggtacgccgttaaaaaagaaaaaaaaaaaaa

SEQ ID NO: 25674 - DNA, 1247 bp, Triticum aestivum
  Clone ID: PAT_TA_25674
ccgactcttctcccccgcgcggccccacgcgagatctctctcccgctgcggcgaccgccatggcggggaggggctaccagggccgcggcgcgggcgccggcgccggcgtgtccttggccgtggtgagcacgcccagccaggagctggcgctgaccaactgcgcctacgtctcccccgccgacatccgccgtttccccaccgccctcgccctcgtcggcgacgtcctcgtcttcgccctgcgtgcccacgatgccgttgctactggaagcatcgccttgaatgccattcagcgtcgacaggtgaaggtttcggctggggattctattaccgttagcagttttgctcctcctgatgatttcaagctggcattgctcacattggagctagagtatactaaggcaaggtccaaccgagctgaggatctggatgccgtattgcttgcccaacaactccggaagagatttctggatcaggtcatgacaagtgggcaacgagtgccatttgaattttatggaacaaactacatattcagtgtcaatcaagctttgctagagggtcaagaaagttccacgccgttggacagaggattcctgtcaagtgatacatacatcatatttgaggcggctcctaattcaggaatcaaggttatcaaccaaaaggaagcagctagcagcaagcttttcaaagataaagagtttaacttggaaaaattggggataggtgggttaagttctgaattcacagacattttccgtagggcatttgcttcaagggtgtttcctcctcatgttgtcagcaaattgggcattaaacacgtaaagggtatgttgctatatgggcctcctggtactggcaagaccctcatggcccgtcagattggaaaactgttgaatggaaaggacccgaagattgtgaatggacctgaagtgttgagcaaatttgttggagaaacagagaagaatgtgagggatttgtttcttgatgctgaaaatgaccagaaggcacaaggtgatcacagtgacctccatgttatcatttttgatgaaattgatgctatctgcaagtctagaggatctagcagagatggtacaggcgtacatgatagcattgtaaaccagctgcttacaaagatagatggtgttgaggcgttgaataacgtgttgcttattggaatgaccaaccgtaaggatttacttgacgaagctttattgagaccaggacgactggaagttcatatcgagataaac

SEQ ID NO: 25675 - DNA, 692 bp, Triticum aestivum
  unsure (1)..(692): unsure at all n locations
  Clone ID: PAT_TA_25675
tccccacacgctcgaaccaccagcagcagcagcacccatggcacccaaggcggcggagaagaagcccgcggcggtggccgcggagaagacgacggcggggaagaagcccaaggcggagaagcgggcgccggcgtccaaggaggccggcggcgaggcgaagcagcggggcaggaagaagggcagcaaggcgaagaagagcgtggagacgtacaagatctacatcttcaaggtgctgaagcaggtgcacccggacgtgggcatctcctccaaggccatgtccatcatgaactccttcatcaacgacatcttcgagaagctcgccggggagtcggccaagctcgcccgctacaacaagaagcccaccatcacgtcccgggagatccagacctccgtccgcctcgtcctccccggggagctcgccaagcacgccgtctccgagggcaccaaggccgtcaccaagttcacctcctcctaggcagctaggattgatcgccgcttcatgaactgatggcggcatcagtacgatgttacaacctttgtaagaattgtgctgcttgtggttttgaagaaatagtgatgttgctgtttgaatcgatgttcatgtgtgcttgtgtcgcttcagactcttcttcctgccgtttgtttatgccagtaagtttctactgnnatagttcatctaattttaatttgct

SEQ ID NO: 25676 - DNA, 621 bp, Triticum aestivum
  Clone ID: PAT_TA_25676
gccacacatcccacccaaacttaacctccccacacgctcgaaccagcggcacccatggcacccaaggcggcagagaagaagccggtggcggcggcggagaagaccccggccgggaaaaagcccaaggcggagaagcgggcgccggcgtccaaggaggccggcggcgaggggaagacgaggggcaggaagaagggcagcaaggccaagaagggcgtggagacgtacaagatctacatcttcaaggtgctcaagcaggtgcaccccgacatcggcatctcctccaaggccatgtccatcatgaactccttcatcaacgacatcttcgagaagctcgccggggagtccgccaagctcgcccgctacaacaagaagcccaccatcacgtcccgggagatccagacctccgtccgcctcgtcctccccggcgagctcgccaagcacgccgtctcagagggcaccaaggccgtcaccaagttcacctcatcctaggcttcgtcgtcgtttcatgagttgatggcatcgtgtaggtagttggcagtatgatgttacaatctctgtaagaattgtgctgcttgcggccttgaagaaatagtaatgttgctgtttgaatcaaaaaaaaaa

SEQ ID NO: 25677 - DNA, 1031 bp, Triticum aestivum
  Clone ID: PAT_TA_25677
tcgagcggccgcccgggcaggttctttctcagatcgaacttatggttcattttatccacatccactgatgatgcaccacgaagcaactacacatccactgatgactcgaaggagggattcttttacagctcgaggaccagagatgaggcatgactcctgctaaaaccacacttgacattgtaatccagcaacctatactctaagagccaactgatcctgccatgagatcttcctcttcccggcggcgcgcgccgccgcagagttccgggcatcccagaacgccggcattttcgagtcactaggaccggcgacaacattgccctctaacatgtacttgttcaccttgtctgccctagcagtctcctggtaaccatgaaattcttcggtctcctcagaggaactcagctcacaagcctcgttgaggtcgataaccggagacgcccgtggaaccggatgctgcctttgctgctgtgcgggctgatgacctttgcttgaactcccaacagcctgaacggaccggtggtgatcaacccacacggctgtccgggaagtaggcgccattgccgggttcttcaatctataaacagcagtctgagatggattttcggacatcgatgtgtaccttctccgcaaaaacttgacttcagccgaaagcctttgcttcttcagcttctccaaatgcaatctgttcttctttgctgcagtttccttgaggagctccttgtagtcctggaggaggctctggtacctctggctcgccctgaacgcctcgcccccgtcgccgcggacgggccggggcgcgcgaggcagcggccgaggcgtcatcgcagcagccgccgccggctgggccaggaccaccttgtgagccctcttcatcgccgcctcacctcaccgcggttgggaacaagaagaagcccggcggatcgtggagagacggaggagaaagcgagaggggacgggaccgagggagggaggggggaaggaaggagataatctaataaagggaaacccgcccgccgcctgagcggccg

SEQ ID NO: 25678 - DNA, 1154 bp, Triticum aestivum
  unsure (1)..(1154): unsure at all n locations
  Clone ID: PAT_TA_25678
ccgcaacgacgccgttctaaaccctcccttctcccacttctccacccctctccctcggcaagaaaagccgccgccgccgcatccgcagcaggcgagcgagatggtgtttgtgaagaaccagaagaccagggcctactccaagcggttccaagtgaagttcaagagaaggagacaggggaagaccgattacagggccaggctcaggctcactaaccaagataagaacaagtacaacacgcccaagtaccggtttgttgtacgatttaccaacaaagatgtcactgcgcaaattgtgtacgctaccattgctggtgatattgtgatggctgctgcctattcccatgagcttcctcggtatggtcttgaagttggcctcaccaattatgctgcagcgtactgcactggtctgcttttggcccgccgtgtgctcaagtgccgtgatttggatcaggaatatgagggcaatgttgaggccaccggggaggacttctctgttgagccagctgatgagaggaggcctttccgcgcgctcttggatgtcggccttattaggaccactactggaaaccgtgtgtttggtgccctcaagggagctttggatggtggtcttgatattccgcacagtgacaagagatttgctggcttcaagaaggatgagaagcagctggacgctgagattcaccgcaaatacatctatggagggcatgttgctgactacatgaagtcactgggctgatgaggagcctgagaagtaccaatctcacttcaagtgagtacatcaagaaggggattgagattggatgacatggaagcactggtacaagaaggtcatgctgctattcgtgctgatcctacccgtggcaaatcaaccaaggaactccaanagacgcacaagagtacaatcccaagaactgactacgagcagaggaaggcatctcntggacggtcaacccctcaatcatctgctggtgctgattcnatgangacgacgacgaatgantgtatcgacctatcccctatatgcntctcaatgctcaaatgaactgcccaancataaggacatttcncaganctatatcatatgtnctgccctggttgatacaanccgatttggtaccncatgcaaggggtgatttactgcaaanaaanaaaaa

SEQ ID NO: 25679 - DNA, 771 bp, Triticum aestivum
  Clone ID: PAT_TA_25679
gccggccgggtttggatctcagcatcagcagcccccctcatcacatcccaccccaaactcaacctccccacacgctccaaccagcagcacccatggcacccaaggcagcagagaagaagccggtggccacggcagagaagaccaccgcggggaagaagcccaaggcggagaagcgggcgccggcgtccaaggaggccggcggcgaggggaagacgaggggcaggaagaagggcagcaaggccaagaagggcgtggagacgtacaagatctacatcttcaaggtgctcaagcaggtgcaccccgacatcggcatctcctccaaggccatgtccatcatgaactccttcatcaacgacatctttgagaagctcgctggggagtccgccaagctcgcccgctacaacaagaagcccaccatcacgtcccgggagatccagacctccgtccgcctcgtcctccccggcgagctcgccaagcacgccgtctccgagggcaccaaggccgtcaccaagttcacctcatcctaggcttcgtcgtcgtttcatgagttgatggcggcaggcgtcgcgtacgtagttggcaacagtacgatgttacaatctctgtaagaattgtgctgcttgtggttctgaagaaatagtgatgttgctgtttgaatcgatgttcctgtctgctaatgtcgcttcagactcttcttgctgccgtttgtttatgtcagcaagtttctactgtgatagtttatctaattttaatttcccgccattttaaaaa

SEQ ID NO: 25680 - DNA, 672 bp, Triticum aestivum
  Clone ID: PAT_TA_25680
accgcagcatcagcagcccgcctcacatcccacccaaacccagcctccccacacgctccaaccaccagcacgcatggcacccaaggcggcggagaagaagccggtggtggccgcggagaagaccccggcggggaagaagcccaaggcggagaagcgggcgccggcgtccaaggaggccggcggcgagggcaagacgaggggcaggaagaagggcagcaaggccaagaagggcgtggagacgtacaagatttacatcttcaaggtgctgaagcaggtgcacccggacgtaggcatctcctccaaggccatgtccatcatgaactccttcatcaacgacatcttcgagaagctcgccggggagtcggccaagctggcgcggtacaacaagaagcccaccatcacgtcccgggagatccagacctccgtccgcctcgtcctccctggggagctcgccaagcacgccgtctccgagggcaccaaggccgtcaccaagttcacttcatcctaggcgttgtcgttgtttcatgagttgatggcggcaggcatcgtgtatgtagttggcagcagtgtgatgttacaatctctgtaagaattgtgctgcttgcggccctgaagaaatagtgatgttgctgtttgaatcaatgttgctgtgtgcttgtctgtcgcttcagt

SEQ ID NO: 25681 - DNA, 1338 bp, Triticum aestivum
  Clone ID: PAT_TA_25681
ccacttctcccccctctccctcggcaagaaaagccgccgccgccgcatccgcagcaggcgagcgagatggtgtttgtgaagaaccagaagaccagggcctactccaagcggttccaagtgaagttcaagagaaggagacaggggaagaccgattacagggccaggctcaggctcactaaccaagataagaacaagtacaacacgcccaagtaccggtttgttgtacgatttgtatccttaagttgtccattgtcacacgttgcgctggttaatcgtctattcatctccattgtgattatctatggccatagtttttagtactagtagatggatattgtatctcttaacaatagtaccttagaccaacaaagatgtcactgcgcaaattgtgtacgctaccattgctggtgatattgtgatggctgctgcctattcccatgagcttcctcggtatggtcttgaagttggcctcaccaattatgctgcagcgtactgcactggtctgcttttggcccgccgtgtgctcaagtgccgtgatttggatcaggaatatgagggcaatgttgaggccaccggggaggacttctctgttgagccagctgatgagaggaggcctttccgcgcgctcttggatgtcggccttattaggaccactactggaaaccgtgtgttttggtgccctcaagggagctttggatggtggtcttgatattccgcacagtgacaagagatttgctggcttcaagaaggatgagaagcagctggacgctgagattcaccgcaaatacatctatggagggcatgttgctgactacatgaagtcactggctgatgaggagcctgagaagtaccaatctcacttcagtgagtacatcaagaaggggattgagattgatgacatggaagcactgtacaagaaggttcatgctgctattcgtgctgatcctaccgtggcaaaatcaaccaaggaacctccaaagacgcacaagaggtacaatcccaagaagctgacctacgagcagaggaaggccagtctcgtggagcggctcaacgccctcaactcatctgctggtgctgatgtcgatgaggacgacgacgaatgagtgtaatcgaccctagtccccctatagtgctgtcttcatgcttccaaatgaacttgctccatgcattaaggagcagtatcgcgagagacatatatgcatattgtacctgccccttggttttgagtaccatgctggagttttggattatcttacattgtacaaggtgctggcattttgacgttgcttcagagtttgttgatctggatctcaaaaaaaaaaaaaaaaaaggccccta

SEQ ID NO: 25682 - DNA, 812 bp, Triticum aestivum
  Clone ID: PAT_TA_25682
acaccacagcatcagcaacccccctcacatcccaccgaaaccccatcttcccacacgctccaaccaccagcacccatggcacccaaggcggcggaaaagaagccggtggccacggccgagaagacgacggcggggaagaagcccaaggcggagaagcgggcgccggcgtccaaggaggccggcggcgaggggaagcagcggggcaggaagaagggcagcaaggccaagaagggcgtggagacgtacaagatctacatcttcaaggtgctcaagcaggtgcaccccgacgtgggcatctcctccaaggccatgtccatcatgaactccttcatcaacgacatcttcgagaagctcgccggcgagtccgccaagctggcgaggtacaacaagaagcccaccatcacgtcccgggagatccagacctccgtccgcctcgtcctccccggcgagctcgccaagcacgccgtctccgagggcaccaaggccgtcaccaagttcacctcatcctaggcttcatcgtcgtcgttttaacgaatcgatgatgatgttctgtatgtagttggcagtacgatgttacaatatttgtaaggattgtgctgcctgtgtgtttgaagaaatagtgatgttgctgtttgaatcaagggagcaaagttcgtttttgttatccggttccgttctgtacgtcttgcttttctgtggaactaaactgtatttgctctgatttttgtttactgtttactgcgacagaaacctctaaatttaattttacacctctttgaggtttgaaaaaaaaaaaaaaaaaaaaaaaaaaa

SEQ ID NO: 25683 - DNA, 657 bp, Triticum aestivum
  Clone ID: PAT_TA_25683
ggctcacatcccacaccaagccccacgctcgaaccaccaccaccaccagcacccatggcacccaaggcagcggagaagaagccggtggccacggccgagaagaccaccgcggggaagaagcccaaggcggagaagcgggcgccggcgaccaaggaggccggcggcgaggggaagacgaggggcaggaagaagggcagcaaggccaagaagggcgtggagacgtacaagatctacatcttcaaggtgctcaaacaggtgcacccggacatcggcatctcctccaaggccatgtccatcatgaactccttcatcaacgacatcttcgagaagctcgccggcgagtccgccaagctggcccgctacaacaagaagcccaccatcacgtcccgggagatccagacctccgtccgcctcgtcctccccggcgagctcgccaagcacgccgtctccgagggcaccaaggccgtcaccaagttcacctcatcctaggctggcttcgttgttgtttcatgagttgatggcggcaggcgtcgtgtacgtagtcggcagtagtacgatgttacaatctctgtaagaattgtgctgcttgtgtttctgaagaaatagtgatgttgctgtttgaatcgatgttcctgtctgctagtgtcaaaaaaaaaa

SEQ ID NO: 25684 - DNA, 1240 bp, Triticum aestivum
  Clone ID: PAT_TA_25684
gtctctgccacgacgccgttctaaaccctcccctctcccacttcaccactcttctccctcgccaatagaagccgccgccgccgccgcagcagcaacagcaggcgagcgagatggtgtttgtgaagaaccagaagaccagggcctactccaagcgcttccaagtgaagttcaagagaaggagacaggggaagaccgattacagggccaggctcaggctcaccaaccaagacaagaacaagtacaatacacccaagtaccggtttgttgtacgatttaccaacaaagatgtcactgcccaaattgtgtacgccaccattgctggtgatatcgtgatggctgctgcctattctcatgagcttcctcgatatggtcttgaagttggcctcaccaactatgctgcagcttactgtactggtctgcttttggcccgccgtgtgctcaagtgccgtgatttggatcaggaatatgagggcaatgttgaggccactggggaggacttctctgttgagccggctgatgagaggaggcctttccgcgcgctcttggatgttggccttattaggaccactactggaaaccgtgtgtttggtgccctcaagggagctttggatggtggtcttgatattccgcacagtgacaagagatttgctggcttcaagaaggacgagaagcagctggacgctgagattcaccgcaaatacatctatggagggcatgttgctgactacatgaagtcactggctgacgaggaacctgagaagtaccaatctcacttcagtgagtacatcaagaaggggattgaggctgataacatggaatcactgtacaagaaggttcatgctgccattcgtgctgatcctaccatggcaaagtcaaccaaggaacctccaaagacgcacaagaggtacaatcccaagaagctgacctatgagcagaggaaagccaatcttgtagagcggctcaacgccctcaactcatctgctggtgctgatgatgatgaggacgacgatgaatgagtgtaatcgaccctaggccccctatagtgctgtcttcatgcttccaaatgaacttgctcggcattaaacagtagtatcgcgagagagacatatatgcacattgtacctgcctcttggttttgagtaccatgctggagttttggattatcttacattatacaaggtgctgggattttgacgttgtttcaaagtttgttgatctggatctctgttggttgctgttt

SEQ ID NO: 25685 - DNA, 812 bp, Triticum aestivum
  unsure (1)..(812): unsure at all n locations
  Clone ID: PAT_TA_25685
ttcggcacgaggttatcccccctcacatcccacacctccacacgttcgaaccaccaccaccagaagcagcacccatggcacccaaggcggcagcagaagaagctggcgccggccacggcagagaagacgacggcggggaagaagcccaaggcggagaagcgggcgccggcgaccaaggaggccggcggcgagggcaagacgaggggccggaagaagggcagcaaggccaagaagggcgtggagacgtacaagatctacatcttcaaggtgctcaagcaggtgcacccggacgtcggcatctcctccaaggccatgtccatcatgaactccttcatcaacgacatcttcgagaagctcgccggggagtccgccaagctggcgaggtacaacaagaagcccaccatcacgtcccgggagatccagacctccgtccgcctcgtcctccccggggagctcgccaagcacgccgtctccgagggcaccaaggccgtcaccaagttcacatcatcctaggctggcttcgtcgtcgtcgtttcatgagttgatggcggcaggcatcgtgtatgtagttggcagtagtatgatgttacaacctttgtaagaattgtgctgcttgccttgtgggcactgaagaaacagtgatgttgctgtttaaatcaatgttcgtgtgtgcttgcgtgtcgcttcagagttcagactgactcctcttgatgccatttgtttatgtcagcaagtttctaccgtgatagtttatctagtaattttaatttgctgtcattttatnctactgtgattgtttnccaagtnctgca

SEQ ID NO: 25686 - DNA, 1354 bp, Triticum aestivum
  Clone ID: PAT_TA_25686
cgtccgccgcaactccaagtccctccgcaacgacgccgttctaaaccctcccttctcccacttctccacccctctccctcggcaagaaaagccgccgccgccgcatccgcagcagccgcatccgcagcaggcgagcgagatggtgtttgtgaagaaccagaagaccagggcctactccaagcggttccaagtgaagttcaagagaaggagacaggggaagaccgattacagggccaggctcaggctcaccaaccaagacaagaacaagtacaacacgcccaagtaccggtttgttgtacgatttaccaacaaagatgtcactgcccaaattgtgtacgctaccattgctggtgatatcgtgatggctgctgcctattcccatgagcttcctcggtatggtcttgaagttggcctcaccaactatgctgcagcgtactgcactggtctgcttttggcccgccgtgtgctcaagtgccgtgatttggatcaggaatatgagggcaatgttgaggccactggggaggacttctctgttgagccggctgatgagaggaggcctttccgcgcgctcttggatgttggccttattaggaccactactggaaaccgtgtgtttggtgcccttaagggagctttggatggtggtcttgatattccgcacagtgacaagagatttgctggcttcaagaaggatgagaagcagctggacgctgagattcaccgcaaatacatctatggagggcatgttgctgactacatgaagtcactggctgatgaggaacctgagaagtaccaatctcacttcagtgagtacatcaagaaggggattgaggctgataacatggaagcactgtacaagaaggttcatgctgccattcgtgctgatcctaccatggcaaagtcaaccaaggaacctccaaagacgcacaagaggtacaaccccaagaagctgacctacgagcagaggaaggccagtctcgtggagcggctcaacgccctcaactcatctgctggtgctgatgtcgatgaggacgacgacgaatgagtgtaatcgaccctaggcccctatagtgctgtcttcatgcttccaaatgaacttgctccatgcattaaagagtagtatcgcgagagagacatatatgcacattgtacctgcccttggttttgagtaccatgctggagttctggatcatcttacattatacaaggtgctggcattttgacgttgcttcagagtttgttgatctggatctctgttggttgctgtttatcaaggtctgtttgccgtggatgtgatgttctgctaaatgttttctcttttcatttatatgcggttgttggcttatttatgttg

SEQ ID NO: 25687 - DNA, 1259 bp, Triticum aestivum
  Clone ID: PAT_TA_25687
ccggccgggccgggaggttctctgccccgacgccgttctaaaccctcccctctcccacttctccactcctctccctccccaagaaaaaccgccgccgccgccgccgcagcagcagcagcaggcgagcgagatggtgtttgtgaagaaccagaagaccagggcgtactccaagcggttccaagtgaagttcaagagaaggagacaggggaagaccgattacagggccaggctcaggctcactaaccaagacaagaacaagtacaacacgcccaagtaccggtttgttgtgcgatttaccaacaaagatgtcactgcccaaattgtgtacgccaccatcgctggtgatatcgtgatggctgctgcctattcccatgagcttcctcggtatggtcttgaagttggccttaccaactatgccgcagcgtactgcactggtctgcttttggcccgtcgtgtgctcaagtgccgtgatttggatcaggaatatgagggcaatgttgaggccactggggaggacttctctgttgagccggcagatgagaggaggcctttccgtgcgctcttggatgtcggccttattaggactactactggaaaccgtgtgtttggtgcccttaagggagctttggatggtggtcttgatattccgcacagtgacaagagatttgctggcttcaagaaggatgagaagcagctggacgctgagattcaccgcaaatacatctatggaggccatgttgctgactacatgaagtcactggctgatgaggaacctgagaagtaccaatctcacttcagtgagtacatcaagaaggggattgaggctgataacatggaagcactgtacaagaaggttcatgctgccattcgtgctgatcctaccatggcaaagtcaaccaaggaacctccaaagacgcacaagaggtacaatcccaagaagctgacctatgagcagaggaaggccagtctcgtggagcggctcaacgccctcaactcatctgctggtgctgatgtcgatgaggacgacgacgaatgagtgtaatcgaccgtaggcccctttagtgctgtcttcatgcttccaaatgtacttgctccatgcattaaagagtagtatcgcgagagagacatatatgcacattgtacctgcccttggttttgagtaccatgctggagttctggattatcttacattatacaaggtgctggcattttgatgttgcttcagactttgttgatttggatttttgttggttggtctt

SEQ ID NO: 25688 - DNA, 1919 bp, Triticum aestivum
  Clone ID: PAT_TA_25688
aggtacaagatctacatcttccaaggtgctcaagcaggtgcacccggacgtcggcatctcctccaaggccatgtccatcatgaactccttcatcaacgacatcttcgagaagctcgccggcgagtccgccaagctggcgcgatacaacaagaagcccaccatcacgtcccgggagatccagacctccgtccgcctcgtcctccccggcgagctcgccaagcacgccgtctccgagggcaccaaggccgtcaccaagttcacatcatcataggtttcgtcgtctgtttcatggattgatggcggcaggcgtcgtgcatgtagttggcagcagtacatgatagcattgtaaaccagctgcttacaaagatagatggtgttgaggcgttgaataacgtgttgcttattggaatgaccaaccgtaaggatttacttgacgaagctttattgagaccaggacgactggaagttcatatcgagataaacttgcctgacgagaatggtcgtttgcaaattcttcaaattcatacaagcaagatgagggagagctctttcctttctccagatgttaatcttcaagagctagctgcacggacaaagaactacagtggagcagagttggaaggtgttgttaaaagtgcagtttcatttgctttgaaccggcagataagcatggatgatctcactaaacctttggacgaggaaagcattaaggttactatggatgattttgtgaatggacttcatgaaattactcccgcatttgggtgcttcaactgatgacctcgaaagatgcaggttacatggtattgttgactgtggcaaggcacaccagcacatttttcagagagctatgcttctggtggaacaagttaaagttagcagaggtagcccacttgtgacctgtctattgcaaggttctgctggaagtggtaaatcagctttggccgctactgttggtattgacagtgattttgcttatgtcaaaattatatctgcggagacaatgattggtttcagtgaaagcagcaagtgtgcacagatttgcaaggtttttgaggatgcttacaaatctcagttcagcatcataattcttgatgacattgaaaggttactggagtttgttgccatcggaccacgtttttcaaatctgatatcgcaaactcttatggtcctcctcaagagggttcctcctaagggtaagaacttgcttgttattggaacaacaagtgagacaacatttctagactccattggtatgtctggtgtgttctcggtgacctacgaggttcccaaactgacaaaggaggatgctgcaaaggtgttgcgacatttgaatgtgttcgatgaaggagatgttgagactgcagcagaagcgctggacgatatgccgatcaagaagctgtacacgcttgtcgagatggctgcgcaggggccacaagggggaagcgcggaagccatctatgccggaggaggaaaagatagacctcaaccatttctttagcatcttgagcgacatcatccgctactgatcacacatacatctgaggaccctaggctccactataggaatttgtttactccagtttccccagcttgctatcttcacagggtagagtggtttgatcccgagtggccttttattgtcacggttcggcgagagttgtgtctttgctatgcttccgtcgatataaatattctattatctgaagcctgagggcttgttttgtttgagaccttggcgccgtgcctgagaaatatttacctgggccatgctatttggtgaatggtgttgttgatgactagggataccaatccatacctccaggatgcgcttttagagtttggttgatatatagataagttgccagtttcatctatatatcggacagttactttcttgccatactaacttcgaagct

SEQ ID NO: 25689 - DNA, 704 bp, Triticum aestivum
  Clone ID: PAT_TA_25689
tcgaccccgcgtccgatcagcacttccgcagctcccctcacatcccacgccaagccccacgctcgaaccaccaccaccaccagcacccatggcacccaaggcggcggagaagaagccggtggcggtggccgcggagaagacggcggcggggaagaagcccaaggcggagaagcgggcggcggcgaccaaggaggccggcggcgaggggaagacgaggggccggaagaagggcagcaaggccaagaagggcgtggagacgtacaagatctacatcttcaaggtgctcaagcaggtgcacccggacgtcggcatctcctccaaggccatgtccatcatgaactccttcatcaacgacatcttcgagaagctcgccggcgagtccgccaagctggcgcgatacaacaagaagcccaccatcacgtcccgggagatccagacctccgtccgcctcgtcctccccggcgagctcgccaagcacgccgtctccgagggcaccaaggccgtcaccaagttcacatcatcataggtttcgtcgtctgtttcatggattgatggcggcaggcgtcgtgcatgtagttggcagcagtacgatgttacaatctctgtaagaattgtgctgcttgcggccttgaagaaatagtgatgttgctgtttgaatcaatgttcgtctgtgcttgcgtgtcgcttcagagttcagactcttc

SEQ ID NO: 25690 - DNA, 1268 bp, Triticum aestivum
  Clone ID: PAT_TA_25690
cgtgcgcgcccgcccgcgccgccgccgccgcctccttccgcaggagctccctccccgcaggcgcgatggtgtacatcaagaaccagaagacaagggcgtactccaagcgtttccaagtcaagttcaagagaaggcgccaggggaagaccgactacagggccaggctgaggctcacaaaccaggacaagaacaaatacaatacccccaagtaccgttttgttgtgcgatttaccaacaaggatgtcactgcacaaattgtgtatgctaccattgctggtgatatcgtgatggccgctgcctactcccatgagttgcctcgctatggtcttgaagttggcctgaccaactatgctgcagcctactgcactggtctccttttggctcgtcgtgtgctcaagaaccgtgatctcgatgaggagtatgaaggcaatgttgaggccacgggtgaggacttctctgttgagccttctgatgagaggaggcctttccgtgcgctcttggatgttggtcttattaggaccaccactggaaaccgtgtgtttggtgcccttaagggagctttggatggcggccttgacattccacacagtgacaagagatttgctggtttcaagaaggatgaaaagtcgctggatgctgagattcaccgcaagtacatctttggagggcatgtcgctgactacatgaggtcactagcagatgaggaaccagagaagttccaaactcacttcagtgagtacatcaagaggggaatctcagctgatgacatggaagcagtttacaagaaggttcatgctgccatccgtgctgatcccaccatggccaaatcaaccaaggcgcctcccaagactcacaagaggtacaaccccaagaagctgacctatgagcagaggaaggccagcctcgtcgaaaggctcaacgccctcaacaactctgccggtgccgccgatgacgacgaggacgacgacgagtgaaatgcgtttttgttaaagtctggcaccctgcacaacggacctgttcctttgagttttggttattatcttgctggagttatagattgtgttatcgggattatgtgccgtgctggcatttggatattgatcttaatccgttcgtctggcacccttgtgttgtttttgtggctgtgtcgtgctggtgttggccttgggtcatggcctaaaactcttgtcatttcatcgtattcctaaccaatgtaggaatagattttaactatggtgttggacccttaaaaaaaaaaaaaaaaaaaa

SEQ ID NO: 25691 - DNA, 1247 bp, Triticum aestivum
  Clone ID: PAT_TA_25691
aggaattcggcacgaggcccgcctgcccgcgccgccgccgcctccttccgcaggagctccctccccgcgggcgcgatggtgtacatcaagaaccagaagacaagggcgtactccaagcgtttccaagtcaagttcaagagaaggcgccaggggaagaccgactacagggccaggctgaggctcacgaaccaggacaagaacaaatacaatacccccaagtaccgttttgttgtgcgatttaccaacaaggatgtcactgcacaaattgtctatgctaccattgctggtgatatcgtgatggccgctgcctactcccatgagttgcctcgctacggtcttgaagttggcctcaccaactatgctgcagcctactgcactggtctgcttttggctcgtcgtgtgctcaagaaccgtgatcttgatgaggagtatgaaggcaatgttgaggccacaggtgaggacttctctgttgagccttctgatgagaggaggcctttccgtgcgctcttggatgttggtcttattaggaccaccactgggaaccgcgtgtttggtgcccttaagggagctttggatggtggtcttgacattccccacagtgacaagagatttgctggttttaagaaggacgagaagtcgctggatgctgagattcaccgcaagtacatctttggagggcatgttgctgactacatgaggtcactagcagatgaggaaccagagaagttccaaactcacttcagtgagtacatcaagaggggaatctcagctgatgacatggaagcagtttacaagaaggttcatgctgccatccgtgctgatcccaccatggccaaatcaaccaaggcgcctcccaagactcacaagaggtacaaccccaagaagctgacttatgagcagaggaaggccagcctcgtcgaaaggctcaacgccctcaacaactctgccggtgccgccgatgatgacgaggacgacgacgagtgaaatgcgcttttgttagtgtctggcaccctgcacaacggacctgttcctttgagttttggttattatcttgctggagttatagattgtgttatctggattatgtgccgtgctggcatttggatattgatcttgatccgttcgtctggcacccttgtgttgtttttgtggctgtgtcgtgctggttggccttgggtcatggcctaaaactcgtcatttcatcgaatttgtaaccaatgtaggaatagattttactgatgttgcgg

SEQ ID NO: 25692 - DNA, 1078 bp, Triticum aestivum
  unsure (1)..(1078): unsure at all n locations
  Clone ID: PAT_TA_25692
ttcggcacgaggatactggtgcgcccaagcctcgccgcagatcgaccgcgctcgccctctccgctttcctgctgctggtgctgttaaccggactccccgacgccgccgtcgccgccaacatgaccgaggtctgcgtcaaggccgccgtcggccaccccgacacgctcggcgactgtcccttctcccagagggtgctgctcacgttggaggagaagaaggtgccctaccagatgaagctcatcgacgtcagcaacaagcccgactggttcctgaagatcaatccagagggcaaggtgcctgtgtataacggtggtgatggcaaatggattgctgattctgatgtgatcactcaagtcattgaggagaagtacccaactccatcacttgtgacccctgctgaatatgcatcagtgggatcaaagatcttctccacctttgtcacgttcttgaagagcaaggatgccagcgatggttcggagaaggcacttgttgatgagctgcaggcgctcgaagagcacctgaaggcccatggaccctacatcaatggggcgaacatctccgctgtcgatctcagcctggctccgaagctctaccatctccaggtcgccctggagcacttcaagggctggaaggtccctgaaaccctgaccagcgtccatgcctacaccgaggctctcttcagccgcgagtcgttcgtcaagaccaaggcgaccaaggagaacctgatcgccgggtgggcgccgaaagtgaacccgtaagccctcccgccgctcggagacccggcccacccccgtcgtgtgagtagcgacgggcctcatctgtctaggttggaataatgcgagcgagccttgatgtgctctggttgtcgcaagacgtgcacttgctgcctggactgtgccctgcctggcttgtgtgtgtgggtgtgggtgatatgtgtgtggtctggttctagcgggagtgcaagtattgtggtgtgaacctctttcgtgtgaatgaataatggagctgcgtaaaattcagatttgttatgctgtagagagtggaggagcgccnccgaggaagtaagatgtgggacgcc

SEQ ID NO: 25693 - DNA, 1458 bp, Triticum aestivum
  Clone ID: PAT_TA_25693
gggtacgatcaggattccatctttctctgccttgatgagcatatgattcatcactagcctttggtgggttcatgacaagactagcaaggatctgaccggtgatattggaacataggttcactgatgctattttgtagatctgctctcttaattggagcactgaagccagtaatctcccatgtaaccacctcttttacccacactcacccataatatccctttagaaacagattgatatgatactagagggagatcctcctcgccgtatccccaaggatctcactatcttctttgaaagagtggaatttcttgttgtccagcgtagatgttctcttggtatacctcgtcagccagaagaacaagaccctcatttttgcagaacttcactatgtcatattggttttcctcagcaagtacctgtccagtaggatttcctggattgataaccaccaaagccctaacgtcaatgcctcttgagcgagcatcttcgagttgcttcttaacatcagagatttccaaaccccagcccgtcgattcattgagatagtatgggacaagagatccgccatgaagagctatagaagccgagtacaaagggtactgaggaatcgggacaagaatgccatctttctcattccttatcagtaattgcatcatcaggtgcaccccagggcttgctccatctgtaagaaaaatatcatcagcattagcagggaatccatctcgtgaagcgatcccagaagcaattgcatcacgaagtccttttataccctggctatgactgtatgctcctgttgctcttccaggtatcaaggcaagaatctgctttgctcgagaaatagaatcagcactgaacaatgttttgatttcctcttttttcaacaggtctggatgatcacaaagtgcaagaacctccctgaagaatgtaactggttgctgaccaagagattgtgggttcccaatgttacaatagaggatctcatcaaaaggtagagatcctggttgagtttttagctgttgctgcaagcgctgcaaaaacaaaattacctggttaatcaatttctaaatacttaatggcacatgaactgtcgtctttcaggaaatgccaggtaacaccctctgtttttaaagcgtatcaaactgttactaataccaaacaaatccttgtcaaaattcagaataaaaagtgcatcctactaaacttttattagacttggtgattatctaaaaacatgagtaaagagttagctaaactctgaatacaggagatttcaaatgactgaaataacacttgttggtcagttgaaatacctgagcatggatgacaatctctccacgcacagcatactcacattttaaaaccttggggttcaggttgtccacggcgacggtggcagccatggcgagatcaactaaaggcgaagggggcggcagagcagcgagtatatcctgtccgtc

SEQ ID NO: 25694 - DNA, 1270 bp, Triticum aestivum
  Clone ID: PAT_TA_25694
gctgatgctcaccctcccgtgcgtcaccacccctcctcatcacgctccaccgacccggccggtccggtccggtccggtcccggctcccgaagtctccagaacccgaaccaccaccgccacgcgggcccgcatggcagggtcacgccccccacgcgccgctgcctccggcgagacctcctctttcctccccctcataaatattggtacgcccaagcctcgccgcagatcgaccgcgctcgccctctctggtttgctactgctggtgctcatcggactccccgacgccgccgtcgccgccaacatgaccgaggtctgcgtcaaggccgccgtcggccaccccgacacgctcggcgactgtcccttctcccagagggtgctgctcacgctggaggagaagaaggtgccctaccagatgaagctcatcgacgtcagcaacaagcccgactggttcctgaagatcaatccggagggcaaggtgcctgtgtataacggtggtgatggcaaatggattgctgattctgatgtgatcactcaagtcattgaggagaagtacccaactccatcacttgtgacccctcctgagtatgcatcagtgggatcaaagatcttctccaccttcgtcacgttcttgaagagcaaggatgccagcgatggttcggagaaggcacttgttgacgagctgcaggcactcgaagagcacctgaaggcccatggaccctacatcaacggggcgaacatctccgccgtcgatctcagccctggctccgaagctctaccacctccaggtcgccctggagcacttcaagggctggaaggtccctgaaaccctgaccagcgtccatgcctacaccgaggctctcttcagccgcgagtcgttcgtcaagaccaaggcgaccaaggagaacctgatcgccgggtgggcgccgaaagtgaacccgtaagccctcccgctgcttggagacccgacccacccccattgtgtcggtagtgatgggcagcagtaggccctgtctaggttggaataattcgagccttgatgtgctctggttgtcgcaagcgtgcactctgcgtggactgtcccttgcctggcttgtgtgtgtgggtgttatgtgcgtgttctggtgcaagcaagggtgcatgaattgtggtgtgaaccttttgtcgtatgatggataaataatggagctgcataaaattcagatttgccatgctgtagagtggatgagcgcatctgaggaagtaacatgtggtatacgctgttcttcagggc

SEQ ID NO: 25695 - DNA, 1396 bp, Triticum aestivum
  Clone ID: PAT_TA_25695
atatgccctttcgctcgcccgcccgcccccgccgccgccgccgcctccttccgcaggagctccctcctcgcaggcgagatggtgtacatcaagaaccagaagacaagggcgtactccaagcgtttccaagtcaagttcaagagaaggcgccagggcaagactgactacagggccaggctgaggctcacaaaccaggacaagaacaagtacaacactcctaagtaccgttttgttgtgcgatttaccaacaaggatgtcactgcacaaattgtttatgctaccattgctggtgatattgtgatggccgctgcctactcccatgagttgcctcgctatggtcttgaagttggcctcaccaactatgctgcagcttactgcactggtctgcttttggctcgtcgtgtgcttaagaaccgtgatcttgatgaggagtatgaaggcaatgttgaggccactggtgaggacttctctgttgagccttctgatgagaggaggcctttccgtgcgctcttggatgttggtcttatcaggaccaccactggaaaccgtgtgtttggtgcccttaagggagctttggatggtggccttgacattccccacagtgataagagatttgctggtttcaaaaaggacgagaagtctctggatgctgagattcaccgcaagtacatctttggagggcatgttgctgactacatgaggtcgctagcagatgaggaaccagagaaattccaaactcacttcagtgagtacatcaagaggggaatctccgctgatgacatggaagcagtttacaagaaggttcatgccgccatccgtgctgatcccaccatggccaagtcaaccaaggcgcctcccaagactcacaagaggtacaaccccaagaagctgacctatgagcagaggaaggccagcctcgtcgaaaggctcaacgccctcaacaactctgccggtgccgccgatgatgacgaggaggacgacgagtgaagagcgttcttgtccaccccagtgtagtattgcaacgtgcgtttttgttgaagtctggcaccctgcccaacgggcctgttcctttgagttttggttatgtcgcttgagttatagattgtgttatctggattatgtgccgtgctggcatttggatcttaatcttaatcctttagtctggcaccctttctttattttttgtggctgttccatgctggttggccttaggttgacatgaccttcgttgaggtcttttcagtttattactaaccatactaagtttatgattttaaatgttgctgcgaagtcatttcttgtttcgcagacagattttgatcgtaagcaaatgctagccacaaacttctattgtaaataaagttgcataattaccaataaaaaaaaaaaaaaaaaa

SEQ ID NO: 25696 - DNA, 1300 bp, Triticum aestivum
  Clone ID: PAT_TA_25696
ttaaacctttaaatctcctagctcgacctaaccctcactaaagggaacaaaagctggagctccaccgcggtggcggccgctctagaactagtggatcccccgggctgcaggaattcggcacgaggcccgcgccgccgccgcctcctccatccgcaggagctccctcctcgcaggcgcgatggtgtacatcaagaaccagaagacaagggcgtactccaagcgtttccaagtcaagttcaagagaaggcgccaggggaagaccgactacagggccaggctgaggctcacaaaccaggacaagaacaaatacaatacccccaagtaccgttttgttgtgcgatttaccaacaaggatgtcactgcacaaattgtgtatgctaccattgctggtgatatcgtgatggccgctgcttactcccatgagttgcctcgctatggtcttgaagttggcctcaccaactatgctgcagcctactgcactggtctgcttttggcccgtcgtgtgctcaagaaccgtgatcttgatgaggagtatgaaggcaatgttgaggccactggcgaggacttctctgttgagccttctgatgagaggaggcctttccgtgcgcttttggatgttggtcttattaggaccaccactggaaaccgtgtgtttggtgcccttaagggagctttggacggtggtcttgacattccccacagtgacaagagatttgctggtttcaaaaaggatgagaagtcgctggatgctgagattcaccgcaagtacatctttggagggcatgttgctgactacatgaggtcactagcagatgaggaaccagagaagttccaaactcacttcagtgagtacatcaagaggggaatctcagctgatgacatggaagcagtttacaagaaggttcatgctgccatccgtgctgatcccaccatggccaaatcaaccaaggcgcctcccaagactcacaagagatacaaccccaagaagctgacctatgagcagaggaaggccagcctcgttgaaaggctcaacgccctcaacaactctgcgggtgccgccgatgacgatgaggacgacgacgagtgaagagctctttgtccaccccagtgtagtcttgcaacgtgcgtttttgttaaagtccggcactctgcacaatgacctgttccattgagttctgtttgtcctgctggagttatagattgtgttatctgggttatgtgccgtgctggcatttggatcttaatcttaatccgttcgtcttgcaccctttctaatgttgtttttgcggctgtttcaaaa

SEQ ID NO: 25697 - DNA, 1256 bp, Triticum aestivum
  Clone ID: PAT_TA_25697
gccggccgggtcgggagcccttccgcccgcgccgccgccgcctcctccttccgcaggagctccctcctcgcaggcgcgatggtgtacatcaagaaccagaagacaagggcgtactccaagcgtttccaagtcaagttcaagagaaggcgccaggggaagaccgactacagggccaggctgaggctcacaaaccaggacaagaacaaatacaatacccccaagtaccgttttgttgtgcgatttaccaacaaggatgtcactgcacaaattgtgtatgctaccattgctggtgatattgtgatggccgctgcctactcccatgagttgcctcgctatggtcttgaagttggcctcaccaactatgctgcagcctactgcactggtctgcttttggctcgtcgtgtgctcaagaaccgtgatcttgatgaggagtatgaaggcaatgttgaggccactggtgaggacttctctgttgagccttctgatgagaggaggcctttccgtgcgcttttggatgttggtcttattaggaccaccactggaaaccgtgtgtttggtgcccttaagggagctttggatggtggccttgacattccccacagtgacaagagatttgctgggttcaaaaaggacgagaagtcgctggatgctgagattcaccgcaagtacatctttggagggcatgttgctgactacatgaggtcactagcagatgaggaaccagagaagttccaaactcatttcagtgagtacatcaagaggggaatctcagctgatgacatggaagcagtttacaagaaggttcatgctgccatccgtgctgatcccaccatggccaaatcaaccaaggcgcctcccaagactcacaagaggtacaaccccaagaagctgacctatgagcagaggaaggccagcctcgtcgaaaggctcaacgccctcaacaactctgccggtgccgccgatgacgacgaggacgacgacgagtgaagagcgctcttgtccaccccagtgtagtcttgcaacgtgcgtttttgttaaagtccggcactctgcacaatgacctgttcctttgagttttgtttgtcttgctggagttatagattgtgttatctcgattatgtgccgtgctggcatttggatcttaatcttaatccgttcgtctggcacccttcgtaatgttttttttgcggctgtttcatgcttgttggccttaggttgacatgaccttcgttggtaggtcatttcagcttattcct

SEQ ID NO: 25698 - DNA, 1537 bp, Triticum aestivum
  unsure (1)..(1537): unsure at all n locations
  Clone ID: PAT_TA_25698
ctcaccctcccgtgcttcacgaccccttgttatcatgttacaccaccgacccggccggtccggaccggtccggtcccggctccggaagtctccagaacccgcacaaccaccgncacgcgggcccgcatggcagggtcacgccccccacgcgcctatgccttcggcgagacctctttcctccccctcataaataccgcgcccaagcctcgccgnagatcgaccgcgctcgccctctctggtttgctactcctggtgctgctaatcggactcccggccgcccccgccgtcgccgccaacatgaccgaggtctgcgtcaaggccgccgtcggccaccccgacacgctcggcgactgtcccttctcgcagagggtgctgctcacgctggaggagaagaaggtgccctaccagatgaagctcatcgacgtcagcaacaagcccgactggttcctgaagatcaatccagagggcaaggtgcccgtgtataacggtggtgatggcaaatggattgctgattctgatgtgatcactcaagtcattgaggagaagtacccaactccatcacttgttactcctcctgagtatgcatcagtgggatcaaagatcttctccaccttcgtcacgttcttgaagagcaaggatgccagcgatggctcggagaaggcgcttgttgacgagctgcaggcactcgaagagcacctaaaggcccatggaccctacatcaacggggcgaacatctccgccgtcgatctcagcctggctccgaagctctaccatctgcaggtcgccctgggagcacttcaagggctggaaggtccctgaaaccctgaccagcgtccatgcctacaccgaggctctcttcagccgcgagtcgttcgtcaagaccaaggcgaccaaggagaacctgatcgccgggtgggcgccgaaagtgaacccgtaagcccctccgcccgccggagacccggcccaccccgtcgtgtgagtagtgatgggcagtagtgggcctcatctgcctaggttggaataattcgagccttgatgtgctctggtcgtcgcaatcgtgcacttgcttgtgtgtgtgtgggtgtgggtgttatgtgcgtgttctggtgcaggcaagagtgcaagtatatgtggtgtgaacctctttccgtatgaatgaataatagagctgcgtaaaattcagagttgccatgtcaggtgtagttatgatgtagagagtggacgagcgactcggaggaagtaacatgtggctcgcctgtttcttcaggccaatggtgtctccaatgtgactcgtgagatgggggcaggcagcagcttctgcatcaggagtgggaaataattaacactggagacgtgtaaccgtggatcgattcctcctaataatcaagtaatcattctccgttagaaagaggaaaagtgatcgggttcgttgatgggtacgtttataggtttgtcgcgtctctcaactgttcccagatgcaatggttattgggctaaagcccagttcctcgttnctatacgacttcaacccacgtat

SEQ ID NO: 25699 - DNA, 551 bp, Triticum aestivum
  unsure (1)..(551): unsure at all n locations
  Clone ID: PAT_TA_25699
caaagggccataaaataaaaagatcatgtagtttttatgcagccttctaccaatttgtacaacatagcagtttacaaaatcctccatgaaatgataatttaaaacacgatttgacaaattacaccacatagcaggtttaggaccaccccaatccattttacatcaacaacatatttaaaagtttcttattcaatttcttgcaatcaatgctcttcatggcaactatcatctcgggcagttgggaaaggcaacaagtaggattaatatatctatgttaatatggctctgcttgcgtgtcatgaatatcttgggcaaagtacccaaggaatcttgcttatatcctgtacaaatacggcagggggcttgtttctgggttgggctaaatttcaaaaaaaaaagtcaactgatttaacaggataaacaacaacagtcttactttaccacaggaacagaattaaaacgagccagggaatgcaaaaaaaattaaaatgaaacagggaatgatattttacaacnnattttgnnaaatgatccagatnnnaaacagcaan

SEQ ID NO: 25700 - DNA, 667 bp, Triticum aestivum
  Clone ID: PAT_TA_25700
cggacgcgtgggcggacgcgtgggttcgtcaccactggagaaaacacggcatctcctcagattacgtaaagccatcactggtgaaacgctatctgaatctccggttctttccacatggcgcaaggaattgctacaccctgagatccttggtgatgggaaacaagtaccttgttcgtgccgccttctactatggaaactatgatggcctgggcaaacctcctgtctttgatctgtacctggggacaaactactggcatgaagttagcttaagtgatgcaggagcattcaactggatggacatcatagttgtggctcctgatgattacttgcaagtttgtttggtgaacaaaggtatgggtaatccatttatttctgggctggatttgaggccaatgaagaataccctttacccagaggtaaatgcaactcgatcgctcgtgctggttaattctaatcggttccacatggggcccacagacggttcagtaatcaggtacccctcggattcccatgaccgcatctggacgacatataatgcaattccaaactgtatccagatatctgcaacatctgtaattcagaataacctcagggatgtctacgatgtgccatcgtctgttatgcaaaatgcagtgactgctaatagctcaagaattgtttttcatgg

SEQ ID NO: 25701 - DNA, 640 bp, Triticum aestivum
  unsure (1)..(640): unsure at all n locations
  Clone ID: PAT_TA_25701
gcacgaggaccacttcccccaaagtctcctcctttctcccttcccaacccaacgcccacccaaatccatcgccgatgaagagggagggcttccagcacggcgccgtccgggtcaaccgcaacaagctgctgcgggtggccgccggcaccggcggcgacgcggcggccgcggcgctggagctcgccggcgtggcgtacgccagggcgccgtccaagccgaccaacgcgtccagggacacgggccggtgccgccggccccgctgcgccggctgccacgcgcaccccgccgccaaggcccgggacaaggccaagggcgcccacaagctgcgcgcctccgacgtcgccctcaaccaccgcctcgtctcctggcgcctcgtcgacggcgttgggaacgctccggctggcaccggcggcgtgcccgactacaagggcgcctccgcctccgccgtgctcgcctacctcgccggcggcaacagctggcacgccgaggacgaggacgacgacgacgaggaccangacgacggcaccgaccttcnnagccccccnnngnggatctccgacctgtacgacctcatcgccggcctccaggccagcgcggcccctgcgccggacnnnnnnnnnnntngcaacaanntatcagn

SEQ ID NO: 25702 - DNA, 928 bp, Triticum aestivum
  Clone ID: PAT_TA_25702
cattttttttcataatataggtagatagtaacagacgggcatcctatagcacgctgtttccgttttccgtgtacacaatcaattactcctactccattagcataaagaaatccgaattcatgaaaacaagagccggggccgagcgccgcttcgccataatcaccaactcctatgccgcaggcccacacgacgccctggcgaggtaccgtccattccacggcaccctccaggtgaacggcgaggcgcgctttgccggctaggtggtcgccaccactgacgcctggctggcccgaacagggggggctaactgcactccttgcaggcctagctaatggggtgacacccagttctaaagaacatgatggccaatgacgagtgcctaaaggtgtccacctcctaccaccttgcaggtcctgcgcctcagtgtcccgtgagggcttgggcgccacggggcctgccgccgacgacgaccgccgttgttttgctggttgaacgacctcatcatggcacgagcagatctccctggcacttgtcgaggagaggcggtcgacatggtgaggtcgttcaaaccgggcaaaaacgccggctcctcgtcgggaagctcatcgtcatgttcttcttcatcctcgcccacgatgtacgggaagatatgtctctgatcatggcctgggacctgcagattcgcaaacagacacaagtggacgacaacaggtgcctctcaagaatgtcagtggcatgccaaggtccaatgctgccactttttacactaaccacatagtaagtcgtagagcagcagcagctccacattccccggtgatggcagagaagcttggtgggttgatgtcgtgttgtgatgttgatctgttggatgtgagagatcggtggatattggcgaggtattaatggaggcagactagttctagatcgc

SEQ ID NO: 25703 - DNA, 915 bp, Triticum aestivum
  Clone ID: PAT_TA_25703
gcgtgggtgtgaggtaggccggtctgcccaggcatggaggggcactctgcctaggctgcgccatgcccgggctgcgacgacggccggggtcttcgagtctgggtcggggcgaaatccccgcgcggcgacgacctgcgctgtctccggcgacggctgagggtgctgtgacctggttgcatgcgttggcacgacccagtcccgtcgtccgcctcgacgtccgggtgccgttctaggcccggccgcccggaccgggcagcggcggcgtcttaacgccgctcccgtcttgatgtcgctgctttgtctgcaggaggagttctcgatgcgacagatggtggttggcgatgcatcgctctggcgtagactgctacacaaggagcaggtcgcaacgtttgcctgcgctggcgctccccaatgaatgctacaccagttccaatcaggccctgccttcacccgccgactctctaggcacatgggtgcgaggtacgtcggcctgggcagtcctgaagctgcattcgtccctggaagtgtcttgcaatggcagcgatgctgccctgttgctccgagtctcggtgcttcgccattttggctggaggcaaggctgggcgaggcctaatgtcgttgagtgtctgtagttgagggcacctcctcacctagctgtagtcacttggtgaggacggtcgtgtgtgtgtgtgtgtgtgttgccctccgttctggaggttgtacccccgatgtcttcctgttcaatgcaatgaaacgcaactcttttgcgtttgctcgaaaaagagataatggttttgggaataccatgtagtttcaccactgtccctcctttctggaggttgtacccccgatgtcttcctgttcaatgcaatgaaacgcaatcttttgcgtttctcgaaaaaaaaaaaaaaaaaa

SEQ ID NO: 25704 - DNA, 622 bp, Triticum aestivum
  Clone ID: PAT_TA_25704
atgaacttcatgttactgtctttgatgtatgcctactactgcttcgagtacaagtggcggacgcgtggggtgagcctgaaccaccggcttgatttctttgagtcaaattgggctttctttgccggatttggtagtccatgtgtacttccgattttcttcttctctcctcttacaagttatggtgtgatggcaatactatacccactgtttgtcatgacagctgctggtacacaagaagagcaaaccattgatgaactgaaatctttgcatggagggaaactgaatagaatacccttgttctttgtcgcgaagcgactaacgacgcaagcgctgcagttgttcccagaggcacaaaaggagcaatgagtggtccacataatcacatgaactcagaggtgcatagttagttctcatggaagtgatcatgttgaagctgcatctgagaggtgcatagttcacgcgaaagcgcggctgctcatgtgcgccacgccgcaatgtaaatattctgtaccattgccgctgtacatatacatatattgggccaataaaaaagaatctatggttgcccacgggatacatgctgcaattgaagaaggaaatatacaaaaaaaaaaaaaaaaaa

SEQ ID NO: 25705 - DNA, 302 bp, Triticum aestivum
  Clone ID: PAT_TA_25705
cccacgcgtccggtacaaaaggcgtgttcgggcgcaggcaaaccagtatcccgcattggtctgagaggaaggaaggattggcaagcgtaatgatccatgctctgcacatccgcatagttattggaagtagatctaaaatgaatgcctcttgcatacatggagttagaccaagtaaaaccaacccggaaaagggtgccttgagaagtattcatcgtctgtcattgtggaccagtcgcgacttaagattcgtgttggttgtaatcgggttccataacggtgattcctgaactgttcggagtgct

SEQ ID NO: 25706 - DNA, 1008 bp, Triticum aestivum
  unsure (1)..(1008): unsure at all n locations
  Clone ID: PAT_TA_25706
gccggccgggccgtcacgcttgacttcagcgctctctccgcccccaaatcgtccaccgccggctccaccccacctaccagccggagtccaccgccgccgccgccatgtcttccggtgggatcgcgcgcggccgcctcgccgaggagcgcaaggcctggcggaagaaccacccccacggcttcgtcgccaagccggagacgctgggcgacggcacggtcaacctcatggtctggcactgcaccatccccggcaagcaagggactgattgggaaggtggatacttccctctcacccttcatttcagcgaggattaccccagcaagcctcccaagtgcaagttccctacgaacttcttccacccgaatgtctacccttcggggacagtctgcctttcaatcctcaatgaggacagcggctggagacctgctattactgtgaagcaaatccttgttggaattcaggacttgcttgatcagcccaacccggctgaccctgcccagactgatggttatcaccttttcatccaggatccagctgagtacaagaggcgtgttcgggtgcaggcaaagcagtatcccgcattggtctgagaggaaggattggcaagcttaatgatccatgctctgcacatccgcatagttattggaagtagatctaaaatgaatgcctctgcatatatggagttagaccaagtacaacccggaaaagggtgccttgagaagtattcatcgtctgtcattgtggaccagtctcgacttaagatccgtgttggttgtagtcgggtttcataacggtgatccctgaactaagtgcttgttttgtgggttaaatgtctgtcttgaggtggattgccgtgtgcggtactagtcggttctaaatgcgtctgttggctgcaatataacattttgccatgtgccatgtttctgtcatttttctaatctgtatcctagcaaagcatttgttttgctcccctaatggcgtcatttaaactctgacgggaaaaccngn

SEQ ID NO: 25707 - DNA, 612 bp, Triticum aestivum
  unsure (1)..(612): unsure at all n locations
  Clone ID: PAT_TA_25707
anaccccanangnacagagaacaganagagagaganagagagagagagagagagagaggaaggagagagcctgagcagcgacgatggcgagcttgatgacgaagaaggagatcgggcagacccacgacgtgctccgcttcggcgtcaacgacagcgtcaggggcgacctcgcgccgccgcaccccgtccaggccaccatccataaggagaccaagttctgggacgacaagaagaggttcgggaccgaggccatctacgggtccgccttcaacatccgcaaggatctggacgcacaaatcctctccaggttccaaaggcccccaggtgcattgccatcatcgatgctaggatatgaggcaatgacaggttccttggatgattttggatttgaagattaccttaacttgccccaggactctgacagcctgcgcataccggacatgcaccacgggatggaggttcggcttggcctgtcgaaggggcctgtctgccccagcttcagttgattccttccacccatgtatttgtcttgtgcttcccgtccagcatctatggcagtttcatggattggtgaaacgtgagaagtaaataaatgggtattgcattagtttg

SEQ ID NO: 25708 - DNA, 1049 bp, Triticum aestivum
  Clone ID: PAT_TA_25708
gagccggccgaagtgcgcttcgagaaacagagaacagagagagaaagagggaaaaaaagagaggctcagcagcggcgatggcgagcggcggcggcccgatgacgaagaaggagctgggcgagcacccacgcacgtcctccgcttcggcgtcaacgacaggcgtccgcggcgacctcgcgccggcgcaccccgtccaggccaccatccacaaggagaacaagttctgggaggagaagaagaagttcgggaccgaggccatctacggatccgccttcaacatccgcagggatctcgacgcccagatcctctccaggttccaaaggcccccaggtgcattgccatcatctatgctaggatatgaggcgatgacaggttccttggatgattttggatttgaagattaccttaacttgccccaagactctgacagcctccgcataccggacatgcaccacgggaatggaggttcgccttggcctgtcgaaggggcccatctgccccagtttcaattgattccacccatgtattagtcttgtgatacgtcgtgctccccgtccagcatctataaccagtcactagactgtatcatggatttgtgaaacgtgagaactaaattggcattgcatcagtttgaaattccttaacttcgattgtactgactctgtgatttcagtttttgatctctatttatttgcatgctgtcctcgctattcaataaggaagtcttttcattgtgctataagtaaacatagccatcccgtccaactggtgcttcacagccctcgccttgctccaaaacgggtgccctgcctcctgctctgcacacaggcggttgttcgcggggccgctggatctgccggttggttcggttcctgtgtcgtgtctgagcggttggaagctgctggctgcgttgcgctgctgtgtgggcgtttcccgtgttcggccctgtaccgctttttgtttcaaacgtttttttgctgactgacctcaaaactttattcattcataaacagcataaacagggttatatcattgataagcagaggtac

SEQ ID NO: 25709 - DNA, 837 bp, Triticum aestivum
  Clone ID: PAT_TA_25709
ttttttttttttttttttttagatagcaacacgacgatatggaagcatcttatcggcataaaatgcctaaacacgtatagctgaagacaggtgcatgtatgacaccgttattattccgaccactgcaccaaggcgtgcatacagaccatgatgcaaaaggaataaatactatgcgcacagtttacttatctgctgtaccatgattacttagcggacagaggatgcctcgacttcttcctgaagagcatgaaagccagggagccaagcagcggccacgacgttaccaaggctacgtacgcgaggagccagactgacctcccttggtaccgagcgagcttgtttacggatctcttgacgggagccatggcgtcgcggatcttatcagcgtagcgttcctccccttgctgctttgtggaccctgcagctgcagggctttgagcgggcattgcatctccatcagtgccgcttctgttctccacttccttggcttcttcatcttcttgcgtgctgttcaccgtggcattcggcttcagatcatcgctgatctggctagaaggggggccatcgtttccgaccggagctatcattccgtctccaaggatgttgacgtacgggctcttgtcaatggacgactccagtgaagaatgcagaacatgttcttccgccttttgttgatgcatgtacgagctgtcatgcagagcacataggaactcagacacagctccgacccaccatagttttccagcagttagtccttgaaaaaatgcaagatggccgccattctgagtagttgccaaaacaatgttcttgttcgctctgcattcgtcccaaggaatc

SEQ ID NO: 25710 - DNA, 533 bp, Triticum aestivum
  unsure (1)..(533): unsure at all n locations
  Clone ID: PAT_TA_25710
acggcacgaggaacatagacagagattctaacaccaacatccatcaagactctcctgtcgcagcttcagtgctcccgcggcctattggcactcctgagagggcgtatggtgtaaatagttctccagcaaagaagataaaagttcccggtgcggcaacttcttatactgttgcttcgctccaagttgctacaaacagcttctgtcaagataccctactcggtgagggttcacttggtcgtgtgtacagagctgatttccccaatggaaaggtgcttgcggtgaagaagatagacagtgcttccctttccttgtatgaagaggatcattttcttgaggttgtatcaaacatttctcggcttaggcatccgaacatcgtgtcgcttacgggctattgcgctgatcatggccaaaggcttcttgtatatgagcacatcggaaatggaacactacatgaannnntgcacttctctgatgaggcgaacaagnnccnnncttggaacacccgtgtgnnnntagcgctaggcaccgctcga

SEQ ID NO: 25711 - DNA, 632 bp, Triticum aestivum
  unsure (1)..(632): unsure at all n locations
  Clone ID: PAT_TA_25711
gcacgacgccctctccttgccggaacttccggcgctgggctcctcctccctctccctctccgcggcccgcgtctccggcagtgtgcgcagcgtacgtgccaacaagaagtataatatggcgatcctcaagagttgttccgtcgacagcgacgcgagtgccaggggctttgctccggaagagatcgacctgggcgacgacgtgctcgccgagatcatcctgcgcctgcccctggactccgtcgcgcgctccaggtgcgtctccaagaactggtgcgccgccatcgccgacggctacctccgccgccggctccccctgcacatgtccatgatctgcttccccgacgacgacggcgcccttggcggcggcggcaggcccgtgtacgcgtgcgccggcgagggccgccggctcgaggtccgggaccttagcttcttcgcgctgcacgacagcgtcatcttctgcgacgggtgcaacggcctgctcctctgccgcgcccccggctcgccggagttctacgtcgtgagcccggtgaccaggagctgggtggcgctcccgannncggccaaggacgcgcggctctccgtgctggcgttcgacccgctcggcgggcagcactaccacgtgatcaactncn

SEQ ID NO: 25712 - DNA, 783 bp, Triticum aestivum
  Clone ID: PAT_TA_25712
gcacgagggagaggagccttcatcctcatctggacagagatacccgccctgagttcatcaaaagaagaatcgcaaagtggattccaaaaggtcgcactcttttcattgcttcaaatgaaaggacaccaggcttcttctcgcctctatcagacaggtacaagttggcatactcatctaacttcagtagcatattggagccaataatcgagaacaattaccagttattcatggtggaaaggttaatcatgcaaggagcaaagacatttgtgaagacaatgaaagagctggatagtgatcttgccctctgcgacgaccccaaaaagaacaccaaaaactgggaagtaccagtttacactagatgacctgcgtgaatctgtcattgacattaatggttagaaacgatgacctgctctccttaccatgagacataattgtctcacatagacacggcaaaatgtttggatatatgcagttgattacacacactctagcctgtactgagctgctgatccacctgctatatgttgtaatatccagacaagatatatctttgtagttgggaccagaagagagatcacgacttatttttggtgttgtatactgatcttgctggatctgtcagctaagaaaacaaatacactacatcatacaactacacttttgttgcgttaccttgttatctgtacttgatcattttttgcaaaatgttatctgaacatgtatatatttacttggaattatattgctccctctttccccaaaaaaaagtcgacgcggccgcga

SEQ ID NO: 25713 - DNA, 622 bp, Triticum aestivum
  unsure (1)..(622): unsure at all n locations
  Clone ID: PAT_TA_25713
ttgctgtattgcttctgtacccagattgacgcccatgatgtcttgatttgtcattcgcattgctagttttgagactaaagtctctgtgaaagatactccttccggagatctcacttgaaacggcaaacattgcaaattcctccagatttagcaatgataaatccataatttcctggcttgctaaaattgttagcacattgggctttctcttggatttggttactagcaccttttatccacagattagtgtgctcactttgtggtgtcactaatgtgtggttccattggcgttacttgccttatcctgttttctatcttgttttggttatcttatgtagtcttgcaatcttgacacatgccatttgagttgtccatgtattcttgtctaaagtttccttcgtggtctgatattttgctgtctctgttctggaatttgctgtcttaaattgacttgacaattgctatgttttttgtttaactgttctctgcctggtaatgtgtcttctgggtagtatagttgtgcaaattttgatgtgctctaattctttgattctatgtacctccgccgcgtccacgctatgactaactgtgtaaagaagatacagggtanannncaagggta

SEQ ID NO: 25714 - DNA, 479 bp, Triticum aestivum
  Clone ID: PAT_TA_25714
ggggcgacggggcgtcttactcaacattaagtagttgagacacgtgttgagcgataatttgctgaatcgtgcatggcatgctacgtcgttgtcgctggacgtgtagtttagagaaagaacccatttcatatatagaatagatagtgaaacaaactagtaggaaaaaaagaaatggcaaagaagcataccagtctaacaccagcgtcaggtatttcaccttggacgagcctatattcatacatgacccagtcggtccttgtacccttgggcgccttgccagcgtgaaacaccagggtcctcttcatcccaacagtgcgattttcatacaccacctgcctgtcctttccagtagccttccagtagccaccttcggttgaacggttagctctatgcccaacagagtactttctgccacgggtgcaaaagaagtaccactggagatccccggtcggcattgacgatttcgctgaagcaagttg

SEQ ID NO: 25715 - DNA, 577 bp, Triticum aestivum
  unsure (1)..(577): unsure at all n locations
  Clone ID: PAT_TA_25715
gcacgagggccacattgcgtgattgctcgcgtccatggaaatggtagagtgctccctggccgcctcccgcgccgcgaggcccgtgcccggccgggtcccgaggtccccggcgcctgttcttggtgttggcgccgggagagccaggctccgggtgcggtccgagaggcgggagcagcctccgccggtcatcagggcttccgcgccgccggagcacgacggaggggcgctggcgaaggcggccgcggggctcgccgccgctgccgtggtgtcgctgaccgggttcgccggggacttggccccgccgccggcgctggccgagtcgctcacggtcgccttccccgtctccaaggcccgagaggtgaaccgggtgcagaggacgctggtggaggcatggggtttgatccgtgagaccttcgtcgatcccaccttcaaccaccaagactgggaccagaaacttcagcagacgatggtggagatgttcccgctgaaatcggcagacgcccgcctacggcaagaatcagcgggatggtgtccacgctaggcgaccccttcacaaggatcatcacccccannnaat

SEQ ID NO: 25716 - DNA, 395 bp, Triticum aestivum
  Clone ID: PAT_TA_25716
ccacaattcgcgcaaaggcacccagggccggacccccccgacccgccccacccccaccccccaccccgcccaggccggcggcgatgcccccgacgacgccccagcgccggaggcaggacgaatcgggcggcggcgacaactggcgcgaggaggccgtgtccgccggctcgctgcgccaggtggacctcgacaggggctgccaacggctgggccgcgccgccgggggacctgttccagctgcgcgcgcgcggctacttctccggcggcggcgggaagcgcggcaagtcggccgcgtcggccgactggctcctccgccccgccggcgtcgactggctccgctcccacgcgcgcctcgtccacctgctcgcccgcgacgacgtccccgtcgccgccgc

SEQ ID NO: 25717 - DNA, 958 bp, Triticum aestivum
  unsure (1)..(958): unsure at all n locations
  Clone ID: PAT_TA_25717
gcgggggtcccattttaagtttcagaggatatgctcggttatctgttcttttgtagggatttgagaaaaaagaaaagaaaaaacacttataataaggcaatggcttcgtgagaaagcacaagaaatatcgttgcgcggcagcaaggcataccttaatttgcttcatggtgaactggaaatgtgcttttatgtcaaactgaaaaaaaatatgttgtctgctagcaccgtaatatgtccatccattaaccactattttgtcgaaatacaggcctctgtttctggttattacaagctaggtagtattgtggcagtgatcgaaaacttctacacgactcatcgcccgcgggtccatgccccagacttgggaagaattttgtagttccactgttggattccaagcaggcaattcatgatcagccttgcgcaagctatggagtttcaataaatcgattgacaggtagagtgactgctggggtcataaacgaagaaacaatgaagtcactggacaacaaaacggattatttattcccaatgtcgttgctcttgcaaaattgcaggcctattggttatgtggtggttatgttggttttatcttccggttggttgttagtcccctacaagagttgtcacaatatgaaaaggctccaaaaggtgtcacggtcaggaatcttttttccaggcatcccgtgatgattagggaaccgggccacagcacaagtggtgtgtttgtgtggtctggcaaagtaatgctcttcttttgtggtatgtggaaagtaatgctctctttgttattcatttttggagccgttaaatatttttgccctcgtaatagttttagatgttatgccttagcatattatatcaacgagaagtgaatgtgttttagctcgtatcttctaaattagtgtcttccaccgatatcagaaattagtggttcatatcatgttttgtatttcnn

SEQ ID NO: 25718 - DNA, 429 bp, Triticum aestivum
  unsure (1)..(429): unsure at all n locations
  Clone ID: PAT_TA_25718
tctcgatacactagccttagtggaggcagctggtgtaaagcgtcttctcttttgtggtgtcggttgtcaagtgcaagctttgagatctgtagagaagtaccttggcttggaaaagctttatgtgcttggcacaaactgtgtggacaacggcactcgtgaaggacttgataaatttttgaatgctgcaagcagtgaaccagaaactgttctgcattacgaatttatgcaagactacaaggttcacttaaagcatttggatgggcatatacaagaggtcccttatttttccctgccagccaatgatttggtggatgtcattgcaccatcatgctacagctgctttgactacacaaatggcttggcgggatttagtggtgggctatatgggagtaccccagccgcctgccctctntatgactcannncccnn

SEQ ID NO: 25719 - DNA, 615 bp, Triticum aestivum
  unsure (1)..(615): unsure at all n locations
  Clone ID: PAT_TA_25719
gcacgaggtcggccaagcccggcccgacaccggagctctcgccactcccgccgcagatccctcccagccgctcgcccctctcgctcagcctcagcctcagcccgccaccgccatgccgtcctagcgcgccgcccgatttagcacccccggcccacttcttttatggagcccccgcgcagccggcgcactcgcaatgccgccgtccccaccgcctgcttcctcctcctcctcctaaccctccccctctccgctcgccaccacgactccaccgccgtgcccaccctccgtcacgccgtgcaccgggcggccctctcctccccgttctacgccgccaggccgcggggggactgccaggagctgcagtccctcgacggcgcggaggcccggtgcgcctacctcctgtcgcacacgccctgcgcgccggcgggctacgtcgactacctccgcctcttctactgcggcttcgccggcgcggggcacccggcggcgggctacgcggcgtccctgctctggctcgtcgtcctcttctacctgctcggcgacaccgcgtccgagtacttctgcgcgtcgctcnnnnncctctccgccnnnctgcgcctgccccccgccgtcnnn

SEQ ID NO: 25720 - DNA, 708 bp, Triticum aestivum
  unsure (1)..(708): unsure at all n locations
  Clone ID: PAT_TA_25720
gacctttgttaaaacattctntcatggcattanccaaaattttcnccaatcgnttcaaccaaacggtttcagctttcgttcttagctcacaattatttcttcacagctcactgctcgcataagctttttcagaatccacctgagccaaacaccacgtactccgtttttgtccatggcatcacttagacacatgctctggaaatgtaactttattattgcccaatttacatatttccttctagacgcacatgcatgcgctcgctcatcgacgagatgaaccgatattcagcgtacaaacataagttgaggtctctagctaggatcgatcatatgggcctgaactcgatgccttccacgatgagcccacgcttggggtaccaccccaatatctcgaagctcactgccacctcctcccccgccgttgccttgtcgcgggtgcgcaacagccccatctccacctcccaccacccatcgccgcgcagcaccgggccccttacgtggacgccgtccataactttgtcgtctctaaacctgcgcgcatcggtggggtcggggcggaggcacacggcatggcgcgacggagcgctaccgcccacgctcacggtggtctcctggtctgggaagctcaggccgcggtgggcgtcttcggtggcgaagacgaggtacgccgcgtaagcggtggccggcgtgagcgcggcggtggggagc

SEQ ID NO: 25721 - DNA, 605 bp, Triticum aestivum
  unsure (1)..(605): unsure at all n locations
  Clone ID: PAT_TA_25721
gcacgaggcagcaccgcaggtcttggaggacctgccgggcgtcctcaagctcctcagcgacggctcggtcgtccgcggcgacgaagccgtgctctggccagaggacccgttgccggacgtccccggcgtgcagtggaaggacgcccagtaccacgcgccgcgcggccttagcgtccgcgtgtacaggccgtcgtcgtcggtgacggaagccggcggccctaagctcccggtgctggtgtccttccacggcggcggctactgcctcggctccttcgcgcagccacacttccacacctactgcctccgcgccgctgccgagctcccggcggtcgtgctgtccgtccagtaccgcctcgcccccgagcaccgcctccccgcggccatcgaggacggtgcggctttcctctcctggctgcgcgaccaggccgagctcggcgttggcgctgacccctggctcgccgaaacggccgattttgnccggacgttcatctccggcgcatcggcgggcgccaacctggctcaccacgtcacggtccaggccgcctcggcgcagcgagacgtccacccggtgcgcgtcgccgggtacgtcctcatctctgcgttct

SEQ ID NO: 25722 - DNA, 312 bp, Triticum aestivum
  Clone ID: PAT_TA_25722
atgatttgcatgcctacatgatggaatagatacgaatgggagaatatgtagctatgatgactcaacaagatcgtggcatggggcaatggatggccgcagtcaaagtccaacgaactcctcctgtacgatgtgagacatcgggatccagataacctctgcgagcaacgaatccaggctggagaagcgccagcgacgcggctggtttagtctagaccaacgcatgttcacaggttcatttcctgtttttttaataagtagttcacgaatcaaatccttttctgagaccagactcatctgcatccgtgttgaagg

SEQ ID NO: 25723 - DNA, 724 bp, Triticum aestivum
  Clone ID: PAT_TA_25723
tcgtgggccgacgtgcggcttcaatgcccgttgaaatttgatcttggcagattccttctagagttgtgatcctggaggccagcggagtgcatgggacgaacatggagtgaccagcagcgacaactttgcttgggcagatggattccgctgcggcggagttagaggtaagtacccttgctggattcatcttcatggtacatgcatgcggcgatagatgtgtcgatttgactctctccgtgccatgctaggctaattaaatcattgattgttacattgttctgctatgatttgcatgcctacatgatggaatagatacgaatgggagaatatgtagctatgatgactcaacaagatcgtggcatggggcaatggatggccgcagtcaaagtccaacgaactcctcctgtacgatgtgagacatcgggatccagataacctctgcgagcaacgaatccaggctggagaagcgccagcgacgcggctggtttagtctagaccaacgcatgttcacaggttcatttcctgtttttttaataagtacctcacgcaataaattttctatcatttgtttttggaactttttaaaatttctttgaatttttaatttttttgtgaatcttctttgatcagagcccgggcaccaaatcactgcaaagacttgtttatgtgcatacattacttgtagtatggtagagatgaaaagaaattttgagttaagcacatg

SEQ ID NO: 25724 - DNA, 804 bp, Triticum aestivum
  Clone ID: PAT_TA_25724
cggccgctcaggcggcgggcgggaaaaaaaaaaaagccgtcttccccgcggaacccgcacaccctcgctctctcgagttcctcttcttcttcccccgagcaaggaggaggctgcatccgcacagccctgcgtcatggccgcctgcgccttcttcttcgacgcggagccgctgggcgagcccgggctgcagctgcacgggccggagctggagctggacgcctgcgcgctctgcaccaagccgctgcagggcaacagcgacatcttcatgtataagggggacacccccttctgcagcgaggactgccgctacgagcagatgcacttcgacgccgccatggccaggcagcaggccagcgccaggcggaagcagcagcagcagcaggcccaggcgcagcccagcgtgccggcgccggcgcccgtgtccgccaaggccgacgtctccgtggcgagctagtcgagccgcgccgcatcgggctggctagctagtaggaactatgtaccctttttgccttgggttgaaggaggaggacgcggggttctttggacggccagtgttcttgcctggcatccggtgccgatcgatcaatctattgatctgcacaggactatcagtccaggatcaccgcgggcttttgattggcccccttttggggtttgggtttggctatgagaggagagagcgggtgtgcaagagcaccgtcgctgtgtaattattcaaggcaagcgatgtaaagtatttctccaaatttcgaaggaaatatgatcatgtttattattcaaaaaaaaaaaaacaaaaaatcgcgc

SEQ ID NO: 25725 - DNA, 707 bp, Triticum aestivum
  unsure (1)..(707): unsure at all n locations
  Clone ID: PAT_TA_25725
tagcgtggtcgcggccgaggtacnnnngcaagatttgtcagtttggaggtgccatgcgctcctccactggccagaaaaggagtttgaaggattggtatccttgaggaagcttgtgattcaccaatgtgagaatctgactggatatgcacaagcttctaccgagccatcaacatcgtcagaaaagagtcagctccttccacgtctagagttactagtgataaggaaatgtgaaagtttggttgaggtcttcaatgtccctgcatctctcagggtaatggaaattctttattgcaagaagcttgagtctatatctggcaggaggctgctgcagggacagtcagcatcgtcgattcaccaagggccatctagtatagcagaggtgtcatcatcaccatcatctggagttggggtggagaatttagaaacgttaaaattagtcgagtgtcatagcttaacaggggtcctgcgtctcccttcgtccctcaaggttctagacattgatagctgcagtgggctgacatctctggaatctcactccggagagcttccatcattggagtacctgcccgggcggccgcgcaataaactgtcatccctactggatgggccacgagcatactcttatctccaaagtctttacattaagaactnnnctggtataaanncgttccctacaagcctgcagcnnnnncngggcagcatccagn

SEQ ID NO: 25726 - DNA, 576 bp, Triticum aestivum
  unsure (1)..(576): unsure at all n locations
  Clone ID: PAT_TA_25726
gtaccctcgcggcaatggcaacggcgtcgagcatgcagcagccggcgctgcttcttcttcggcagctgacgcaggacccagtgacggcctccctcctcgcggtcgcgctcgccaccgcggtccttatgatcgccgccttgagcagaggcgggggccggaagccgcggctgccgccgagcccgaggggcttcccggtgatcgggcacctgcacctggtgcgcccgccggtgcaccgcaccttccacgacctggcggcccggctgggcccgctgatgcacatccggctcggctccacccactgcgtggtggccagctcggccggcgtcgccgccgagctcatccggacccacgagggcaagatctcggagcggccgctcacggccgtggcgcgccagttcgcgtacggcgacgacggcttcgccttcgcgccctacggcccgcactggcgctccatgaagcgcctctgcatgtccgagctcctcggcccccgaaccgtcgagcagctccgccccgtccgccgcgccggcctcgtctcgctgctgcagagcgtgctgcaccnnncgtcgggtgctgnnn

SEQ ID NO: 25727 - DNA, 1954 bp, Triticum aestivum
  Clone ID: PAT_TA_25727
gacccggggcccgcgcctcctcctggacggggaagacgacctggtgctcgtgcctccccccctcctcctcctccaaaacccgcgccccgccagtcccgttcctcccccgctccgtccggcggcccccggccacccccggtcccccgcgccgctcgaggcgcgccgtcccacccccccccgccggggcgcgggcgtcccgggcgcgctgcccggggcggcgtcggccatctacttcctcagccgccgccgccgcccccccacctcccccccctcccccggcgcggccgcggcaaccgccgttgccgcgttcaggtcgcgcgttatgcgatcgatgcagcctggttcctcccctggccgacaaatgggcttggtacatgccctgttcgacaaataggaggctgttccttcctttacatgaggatcaataatgtttacattgtgatcgtggttagcagcaatgctaatgtttcttgtgctttcaagtttgttgtggaggcagtggcccttttcaagtcctactttggtggaacttttgatgaagatgctatcaggaataactttgtgttaatatatgaacttcttgatgagattatggacttcggttatcctcagaatctctcccctgaaattttgaagttatatataacccaggaaggcgtacggtcgccattttcctccaagccttcggataagcctgttccaaatgcgaccctgcaagttaccggtgctgttggttggagaagagagggtctggtgtacaagaagaatgaggttttcttggacattgttgagagtgtaaaccttcttatgtcttctaaagggagtgttctacgatgtgacgtgacagggaagattcttatgaagtgcttcctttctggaatgcctgatctgaagttgcggcagtacgacaaaattggacttgaaaaggaagccgaactcgatgatgtcacgttccaccagtgcgtcaacctaacaagatttaacttagaaaatacagtcagctttgtgccaccagatggtgaattcgaatagatgaaatatgctttgtgccaccatgtaatgaattcgttttgatgaaatatcgaatcacagagggtgtaaatcttccattccgtgttctgcccacaattaaggagttgggccgaacacgcatggagattaatgtgaaagttaagagtgtttttggtgctaaaacatttagaattggtgttttggtaaacgtcacagttccaaagcaaatagcgagctccagtttcctcacaacatctggcgaagccaaatataatgcttcaattggatccctggtgtggaagagcaggaaatttcatggctacaccgaggcaacgatgatgtgcaaaagttgaactgattctcaacaatgggggaaatgaaattagcgaacagtctagcttacctgttggaattccaggttccgatgttcactgcttctggtttacgtgttcggttcctcaaggtgtgggaaaagagtggatacaacaccgttgagtgggttcgctacatcacaagggcaggatcatatgaaatcaggtgttagtgaccaagaaagatggcgtggcctcattatttcgtggatttgcggagctctttttgtactcatcatgattgatcagaaggcacgtaaattatgacccagttgcctgcaagtttgtacttcagcagagggcagatcagagcaggcagttttccgatgttccttattttcatgttgacatgggatatgtattctccccccgtgtcctgtttgtcatagggcatatttttattgtatatttggaagtagcattcgttctcgttgatcaatacacccccttgccagttcgtggtgttttctcccttgaatgggtgtcaaatcgcttgcaaaacggtgtataaatatatgatgataatgttgttggcttgctgtgcctgtgtttgttgtaagggctatgccatt

SEQ ID NO: 25728 - DNA, 1690 bp, Triticum aestivum
  Clone ID: PAT_TA_25728
ttgcgtggccgcagcggcgggagtgagtcgaggagcttaaagcatgaaaggagacagcacctccaggtgcaagcgtaagccatggcgacgccccaggtcttggaaatgtggcccgatctagttgaggccgtcaagcgaagcctcgcatcggcgcaaacagccccgccatcgtcccctgccgcgttggcgccgggcaatgccattttggagaaagagccgcgtcctggtgcaacatcatagcagccgctctgtaccgttcatgatggtcactggctgatatcgaggcaccctaacggaaggaagacaactctcctcgccacggtgttcctattgaggctgaggcttgtttggatcttcatctgctgcctgcatgcatactttccgtggatcacatgctgctatgttacggcatgggctgctactagggctcattattgtgtttgcgttcatccttggttgagagaaaccaggaccccctagtttgtactgtactatgtatgtaccttttgtgccgcgtgtgggttctgggatatccaccgccctttgcgtataccgtgtgtcagacttccacttgtaacaagaatccctttatacctccgttgctgaaaaacacgagaccaggtccaaccagcactgcgagacccctgaagtcaaggagatggaaaaatgggggaaggaaatgcgggcaaggaacattggtcaccacacccttgggagccgtggttacccagggaagaagccgaagtgggacaagcaggacgctgagtttgctgcagcaggcataccaaaccccttcaaggaatttgaaaacccgcgtgaaaatgattacatcaggggccggtgcaaatacgatgaagagactaagacatgggtcttggacgagaaaacggcgaaagtcaaggaactcctgaggcagtatcatgtggaatctcaaagctcccaggagtcagagtcctcggcaaggtgggacgaccctctaaacaggtcgattaacgtggtgctcggcaaggacccgaaaacgaggccggcttatggtcgcgtgaacggcgttgggctcaaagaaaaatgggacacacactatcccgaagaccgcgagcttgcgaggcagagaaggagagccggccgagctagttttgaatccagattggctggaatgagagaagaacttaaagaagaaatgagagaggaagtcgaggtgaaagccaaagccatggcgacagcccaagtcatggaaatgtggcccgatctaattgaggccgtcaagcgaagtttagcatcgggtcaaacagcggcaccatcatcctctgtcacattggcgccggccaatgttattttggagaaagagccgcgtcctggtgcacatcatagcagccgctctgtccctttcatgggctagaggtcgtcactggctgatattgagccctaacggaccaaacggcacgatgctgaacctaacgagttttatgcaagtttggattttcatctgctgcatgcatactttctgtggaatactgctgctatgttacattggctgctagggctcattattccgtttgtgttcatcctttgttgagagaaaccaggaccccctagtttgtatgtaccttttgtgcctggagaagtatctgtaatgaccgacctttgaataaactgaatttcgaacatgcacttctaacaagaatcgctttat

SEQ ID NO: 25729 - DNA, 910 bp, Triticum aestivum
  unsure (1)..(910): unsure at all n locations
  Clone ID: PAT_TA_25729
cgtcaaccctggtttctagtacctcgtagctaagcttccatatgggttcgagagtctttcttgtcgcggccgtggtggccgtggccgtggcggcggcgggggcggacgtcgcggcggaccgggcggagtgctccgacaagctggtggcgctggcgacgtgcctgacgttcgtgcaggggcaggggcaggcgccgacgccggactgctgcggggggctgaagacggtgctgcagaccaggccccaagtgcctgtgcgtgctcgtcaagggaccgcgacgatcccggcctggacttgaagctcaacgtcacgagggcgctcggcctccccgccgcctgcagcgcgcccgccaacatctccgactgcccaaggctactgaacctgccgcccaattccaaggacgcggaggtcttcgagcagtttgccaagcagcaggcagcccagagcagcccaagtggcgcgtcgagtgcgccgagcacgggcgcacagaagaacgcggcggcgaggatgaggtggttgggagtgggcggagttggtgtggccgcacgcgcagcgccgctcctcttcttcgccgtgcctttcttgctccttctgcgctaaatacagaaacggaagcctatgctgcaggtcatcattattgtgtaagatggaccgagtggttgatgagtgcatgctccatctggtgcatgcgtgcgcgtgagtgcgtgtgtattggtatctcttaatctgcgtgtgaaaagctgaaccgatatgcaacgaaaacggtatccattatatacatgttgccggctgggatttcttctcgggttatgcctgcctggtcatttgtaacagacatatcatgtcaagtaattactcacaatgcattaaaaaaatgaaaaaaaaannaaaaaaaactcccanggggggggg

SEQ ID NO: 25730 - DNA, 1187 bp, Triticum aestivum
  unsure (1)..(1187): unsure at all n locations
  Clone ID: PAT_TA_25730
gccccgcttccgctcgctgcccctccctccggccctcccgccccccctcccgacccgtctcgccgcctcctccacccgaccaccgcctcgacggcgagcagccccccccttcctcctcccggactcttgtctgccatgggtgacttcacaatccggttaagcaccagcttgatcgagcagctcgcgcgcgatgccgagaagcaggtgaagaggagggccaggaaacccaagcctaggaaggtcgtggagcaacccgaggagcctcaggacaatggcagggaactaacaactgaacccaaccaaaggcctgctcctttcttgcctttcccttcccccatccacgttccagtgaccccccctcctgccccccccccgcccgtcatccaggcgggggaaggcatccccgccgtggtgggggggagagaggaggagctggacgagctgcaggcgaaggaggggaggatgcgcgaggagctcaccaagcaagaagggcaactgcatgacaaggaatgcaatctagcctaccagacccccgcgccgtgcaccgaccagagggcgggccgggccgagcgctacaggaacgacgtacagggccggctcaagtgagccgagccgggcaggcaagagggtccaggcgttcgcttggcgggccggggcggggcgggccgccgaggggccctgtagaagggaggggggttgcgcggcggggcggagtgaggggggtgtggcgtacaggatttggtttttgttcggacggtatgtttaattggataaccggattgtagttttggttgaacctaaaaaccggtaactgtttgataattttggtgatgccatgagttcagttgtattctagagggggggctgcgtgtccatggctttatgcaaaaagtaccatggaatacatctggctgcaggggcctggcttaatgtttactacatgcattctactgcataatttgcggggtagagcggttcgggaccccccgggccgtccgcccccgtgggggtcccccccccccggcccggggctccccatggggaggcggtttccccatatcttgcccgtggtangnggnggnnntnttttaccaaattnccctngggcngncgntttntnaaaaccgnntnngngaacttggggaaaaaaacctttgggnggttnnccccaacnttnantcgncnnt

SEQ ID NO: 25731 - DNA, 1232 bp, Triticum aestivum
  Clone ID: PAT_TA_25731
aacacacccccgccgcgacgggcttggcaccacgcgccttgatggattaagttctatgcccaaggaatgcggctcggctaacggtgccaggtaggtcaccgtggcgtatgctgcaacgacaaccacagcaaatgccccaccgtttcataggacagtatttaacaagttgtatgccaaggaattgggctaggcgaacgggggcaccaaggaaatagtggtgcgtgctcctccgctgcagctggtgactggcaagccgcacttgcacaaggacacatatcggtcgatacaagctcttcatttattgcattatttgagagcgaacaaagcaacctctgcttcgggtctccgtggcgccttttctctacctccgacagaaacgtcatccatagtagcaattggtcttcgatccccggcatgtttaagttcctaaggcgtgttccaggccggattgagaaatgggttctgccttaggcatttgatgatgatgcagaatccctatttacccaagcacattctttacaggcaaaaggaacaattcagccatggtgttgggtacagttggattgatgggttgaaggaccatgctaatgcacatgtgtcggattccatgatgacgaacgccagctttgtttaccctgacaacacacccacaacaaaagaagcctactattataggacagtattcgagaagttttatcccaagaatgctgctaggctaacggtgcctggaggccccagcgttgcatgcagcaccgcaaaagctgttgaatgggacgccgcctggtcaaagctcctcgacccgtctggccgtgctgctctcggtgtgcatgacgcggcatatgaagaagaaaaggcccctgcatcggttgaccccgtcttggagaacgccttccatccaccagcccacggagagagcaccctagtcaaaagcgctgttccagcagctgctgtttaaccttccattccatggtttcatgaaatgcttgagaaaatgttgtcgcttagtttaattctagcttccttgcagcttcagccactcagtgtagaaattgctttcctctattttgcttgatgctttgtcgtaatgttttgctttcgcatgtatgtactaagtttgtgtatgtggcgagcatcgcattgtaaatatttcaccatggttgtgccatccttgagttgctcaacgtttagtttgcaaactgcaaagtttcattaataaattcccatggggtttc

SEQ ID NO: 25732 - DNA, 600 bp, Triticum aestivum
  Clone ID: PAT_TA_25732
aaaactttcaacagtggaagggagcattatgcgagctgttagtgagttgcaagcacttcaggatgaaagaaagaaagtggatcctcaaaaggctgaagctattgaacagttcttagtaaaattgagatctcttggatcaggggaagctgcttttacctttattcttgatgatgcttctggtaacagcttcatcgagaacccgaatgcaccttcatcagatcctttgttatctttgagattctatgagaggacatatgaacaacaagcagcactcggttttcttgctgaaccaaccaaagaatctggagactcttctcaggatgcttcaacagtggaaggaaactctggtgggccgcaaaggattccacatggttcagttggagctgttgcaggtcgccgtgctatagctcagggaaactctgatgaaattactacagcactgtgtagatattcagcaccagaagaggttgatactttaccatcaacatgtgcggcttgtgctactgagtgtgtcacacgattcttttctacaaaaatcccatattttcgagaggtgattgttatggctacatcatgtgatgcttgtggctatcgcaactc

SEQ ID NO: 25733 - DNA, 758 bp, Triticum aestivum
  unsure (1)..(758): unsure at all n locations
  Clone ID: PAT_TA_25733
gtgcacgagnaagcgcacggcctggagcgcagcggccaccgcttcctgtgggtgctgcgcggcctgccggtggacaccacgatgggcgcgagagaaccgacagacgcgaacctcgccgagctgctcccggagggcttcctggagaagacgaaggggagagggctggtgtggccgacgagggcaccgcagaaggagatcctggcgcacgccgccgtcgggggcttcgtcacgcactgcggctggaactccatcctcgagagcctctggttcggcgtgcccatgctgccgtggccgctcgccgccgaccagcacctcaacgcgttcgcggtcgtccacgggatcggcgccgccgtgccgttggagatggacagggagcgcgggaactacgtcgaagcggcgcagctggagcgagcggtcaggtccctcatgggcgggggcggcggcgaggagggggttaataaggcgagggagaaggccatggagatgaagcgcgcctgccgccatgccgtggagcagagcggttcttcccacgcttcgctgcagaggctctccgaggagctcgtcggaggtgcggtgctgcccaaaagaggaacgtagtcggatcacgtgtaatgtttcttttatccaactactatgctgtgctttcgggaataaattcaccgtagttctcgctgttgctttcatttctattctgtttggggaatacattcaccgtcgtgtctatcttcanaaaatactacatatattttgttctgttt

SEQ ID NO: 25734 - DNA, 641 bp, Triticum aestivum
  unsure (1)..(641): unsure at all n locations
  Clone ID: PAT_TA_25734
cacgagaacaaattaaacgtcacacacaacgatctgatcacagagactagtggagagcaagggaaaaacttgcactatgagctcatgatggcgctggccaagacgatcgcgctgctggtgtgcctcctaggcacagcgggaggcacatcgggaggcacatcgggggcaaattgcatcccgcggccgaaggtcggcgaccttcacgccgcgctcagccgctagtttctttactgctcgcacaccgccgcccacggtcgactggcgtgcgcatggtgctgtcacgccggtcatggaccagggagttctcggctcctgctgggctatctcgacggcgggcgccatcgaggggctgcacaagatccgctccggaagacttgtccgcctatcgagccagcagatatacgactgctccaacaaaagcatgatcgagtcgcacctcagggcgtacgactgggtcctccgcaacggaggcgtcgcctccgaggagacgtacccgtacgtggaccgagtccaggactgcaagcgggagaagcttgcatatgatctcttgcgtccatcacaagctttctcgggaccatacgaaccgagcaagagcttttggttcgccgtctnttnaacaacccggtgggccgtcaagatgt

SEQ ID NO: 25735 - DNA, 734 bp, Triticum aestivum
  Clone ID: PAT_TA_25735
ctcttatggactggtccaaatttggttgagaacaagaagaactttgatctcacgaaggccttgaccttggtggcagaggtgcagcctatcagaatagacagtgacgtcataaatgaggtagtacaatttgtaacacggagactggaacaacttttggtggatgaaggaattaactatgaaatagtccggtcagtgcttatggagcgtgcaaactgcccttatctagcatcacaaacggcagctgaaatggaagctttttcaagaactcaagattttccaaaaattgtcgaggcgtattctaggccagttcgaattatacgtgggaagcaaattgagtctgcttgggaggtcgacgcaagcgtattcgagaaagaagaagaaaaagccttgtggagcgcctacttggaggctgccgataagatccaccctggcgtcgacgtcaaaaccttcgccgaggcctccctgcttctgatacaccccctggaggatttcttcaacaacgttttcgtcatggcggaagatgagaggatccgtaacaaccggctggcgctgctacaaaaggttgcgagtttgaccaaggggattgccgacctatcggttttaccagggttttaattacccttggagcacgcaggagatcgagttgagagcacacgtcccatttttgagctggtgtcgttgagttgtagacatttttttcttttttgaaaaaggggtcccctgctttgtattgc

SEQ ID NO: 25736 - DNA, 726 bp, Triticum aestivum
  Clone ID: PAT_TA_25736
ccaaccaccaccaccagtaaaccatgacgacccggagctcattcctcctcgtccttgcgctagcgctggccgtccaagccgctccctccgccggcgcgccggtcgccgacacggtggcggactcgtgcaacgcgatccgcgacttcgtggactacgccttctgcgccgcggcgctgcggtccagcgggccgggcgcctccacggcggaccgccacgcgcacctcctcgtcgcggcggacctcgccgcggcgcgcggcacgtcggcgcgggacgccgccaccgccatggcgcgcgacgagcgggacccgggcgcgcgcgacgggttggaggcgtgcgggatcctctacggggccacctccgtcccggcgctgcagttcatgcgcggctacgcggcggcgcgggcgtgggaccgggcgcgctcgctgctgtcgctcacggggcaggccgggatcggctgcgaggcggcgctcgccggcgcgccggcggccaaggggaggatggccgcggccaaccgcgagttcgaccagctcaccaccatggccaccgcgctgctcaacagggtcgatcatgtgggatgacgaccggcgcaccgcagttctttgttaataaccagagtccttgtgttgattattacgtactcctagttagccttgatcaaactagtaagcgcgcatgtaaagtttagattatgaatgaacactcaaggctcacagtttgaattcacac

SEQ ID NO: 25737 - DNA, 720 bp, Triticum aestivum
  unsure (1)..(720): unsure at all n locations
  Clone ID: PAT_TA_25737
cccgcgcctggccagctaaggggacagccaaaacctttgttaccaggtcagagctagagcggaaccatgccggtcacccaggcgccggggcggagcacggggccagtgagcgtggcgcggcgcgagctgagcagccgcgcgtggtcgctgtcgtcgcctgccagcccgcagccgcgctacgggagcatccggcccgtgctcagcatcgacggcggcggcgtccgtgggataatcccaggcaccatcctcgcgttcctcgaagaaaagcttcaggagcttgatgggccggacgtgaggatcgcggattacttcgacgtggtcgccgggacgagcaccggaggcctggtggcggccatgctcaccgcgcccaacaccgagggccgcccactcttcgccgccaaggacgtcaacaagttttacctggagcactgtccgaatatcttccctgccgtctgcaaaggacctctgggctggctcaagagcatgatggggcccaagtacagcggccaccacctgcactcggtcgtgaaggagctgctcggagccacgcgcgtcaatgagacgctcaagaacattgtcatccccacttttgacatcaagctactccagccttccctcttcgctgccgacgacccctcggccgctgcccccgggcatgcgcctcggtcgggtgtccccgctagcccgtcggnggtcccgtaaatcacnttgatacattaa

SEQ ID NO: 25738 - DNA, 1669 bp, Triticum aestivum
  Clone ID: PAT_TA_25738
gctcgctccgaccgaccgccacgccctcacatccccatctccatctctctccgcgttgctctgcctctgccaccgcttcacccgcgcgcggtcgggctcctagctagctgctgcctcttctccccttgatgtggcgccgggcgccgagctgctgctgctcgcgcaccagaggcgccggaggcgagctcctcggacgcctggcggcctagcctcctcgcgctcctacaagagggagatccgggctttcttgttaagtgtttggtggggccgtgtgaccccacgggacccaaagtggatccactctggcggaaatggagtcggggagcacattctatgcgggtgaaggtcttcacattgatcccagctggctcatcgacccaaagcttctctttgttgggccacggatcggtgagggtggacatgcaaaggtctacgaggggaagtaaggtgacgaagtacaagaaccaaaatgttgctatcaagattgtgcacaaaggggacacccctgaagaggtcatcaagaggcagggtaggttcttgagagaggtgaccatgctgtcaagggtgcagcacaagaaccttgtcaagtttattggagcttgcctagagcctgtcatggtggtggtgactgagctattagtggggggctctttgcggaagtatttggtcagcttacggcctaggaacctggagcctcgtgttgcagttggatttgcattggacatcgcccgagccatggaatgtttgcatgcacatgggatcattcatcgtgatcttaaacctgagaatctgctgcttacagcggaccagagaacagttaagctcgtcgaccttggtttagcaagagaagagacgttaacagagatgatgaccgcagaaacaggaacatatcgttggatggctcccgagttgtacagcacagtcacattaaggcacggagaaaagaaacattacaaccacaaagtagatgtttacagctttgcgattgtgttatgggaactactacacaatagactaccctttgagggcatgtctaacctgcaagctgcatatgctgccgctttcaagaacatcagaccaagtgcagataatttgccggaggagctgtcagagatcctaacatcctgctggaaagaagacccaagcgacagaccaaacttcacccagatagttcaaatgcttctccattacctctcaaccctttcaccgccagaacatatggccccggctcgcacattcagttcggagaatgcaatcttacctcctgaatcgcctgggacgagctctctaatggcttctcgaggtgatatcacgcctaaaggcaatattgaagacaagccaaggggcttctttttctgcttcagccagtgttattagcctcacagatggaacaagggaactcccaagatgatgcaaaacatcaaaagaacacacccatagtccatacccaaagcatggcaggagtccctgaaaactgttgtttctgctcatcaggccaccccttcttctctgacatgtttgaacatatcggcagggtagatctgagtaaccttttggctcctgctagtaatggtgaaaatagttactatatcgtatattttccatgaaccttccatatcaaaattgcgcgcccatcgtatagatataatggcattaatcatttactcac

SEQ ID NO: 25739 - DNA, 729 bp, Triticum aestivum
  unsure (1)..(729): unsure at all n locations
  Clone ID: PAT_TA_25739
gcgttcgtggttgacccaacgaatcaatctgatccaacctctctggagtcgaggagaacaacagagcctaacaagcatagtgtgaggctggctgttgtctttggtctgatatcatccgaggccagaaccccaattcttgtcaagaagaatgtgcgtatatgcaacgactgccatcatgcgctgaaattgatatcgaaatattcaggacggagaattgttgttggcgacacaaatatctatcaccaattctcagatggctcttgctgctgtggtgactactggtgaacagaatggttatggttgatggcaaagcttgaaagcatttcagcaagatcaagtgaacgccagggtgcagatataatttcatgacaagctgcagctgtatgtcacagattcagaccttgcacggcttctgaattctgatgctcctttgctctaaacaaaagcttctgaatccagatgccagcaccagtacaatcttcagggagcatacatgagggatcaactctcatgtactcgtgactcgtcgcatcggctcgacgaacagggtttgtcttgccgctggcaatggaggttacacactgattggaagaagcgtcgccttttgacttttgtaactgacaatgatgtgatgtacaaagtcatcttctcactgactgtttgaaggggggccggnaccaantcgcctataggagcgattagcgcgctcctggcggcgtttacacgtcg

SEQ ID NO: 25740 - DNA, 282 bp, Triticum aestivum
  Clone ID: PAT_TA_25740
tagcgtggtcgcgcccgaggttgcggtccaagtgtcaaaatgagattacggagacattatcatcagagaagtatgtgcttcatcagctaccagcagtagagacttaggtcgatgatccttttgaaggcttgaaccgtaggaatcatctgtgtagccataggagatggtcattttcacagtccgctcaactgagtttctttttttgagttgatcgaatactgccttccttatcaagggcccaataaattgtaacacaagtacctgccccgccggccgctcgaa

SEQ ID NO: 25741 - DNA, 611 bp, Triticum aestivum
  unsure (1)..(611): unsure at all n locations
  Clone ID: PAT_TA_25741
gcggccgcccgggcaggtacaaggagtaatgcccctggtcaaggctgctgtccagctctctgccgcgtgacgatgggaagacaatccagtcccctttcggcgaccactggcagtgggtatctgtccatgggcctctcgtcagccgcatcacccaaccttcctcggatctgagtccaggctggacgtctgagttcagcattatgtataggttcttgtgatattccttggttccatcaatctcctcctggtcctggtgcgaatttttttcctctttccttctttgcgatgggctgccaagagctttcttccccaaaagaaggatcactcccataagttggatccttttttgtcggaaaaaaatccctcgtggacagtgaattatctttacaaaaaatccctcgtcgactgggaaaacgaatttattcccgtccgggctactcgacagtgacgcgttgttcaaccctccatacccgaccctttgggcctggccctgcgcccccgctcccctgcccttgcccctccagtagggcgccggcgcctcggcggagctcaaggaatggccaatgcagaagtaaaggacatccttgtcnnnnttctggttccacacanng

SEQ ID NO: 25742 - DNA, 399 bp, Triticum aestivum
  Clone ID: PAT_TA_25742
tcgagcggccgcccgggcaggtaccacaaacaatagggattgctcttgatggacacgatgatccatagcatactgcacagattgctaacttcttcaggaattgattgtcgatggtcgtcttgtaggtagacacggcctgctacaatgcaagcttctccctgcaaattccggtgcaagcccatcgaacacaaaaaaacgcggtggtcaagcttggacgaaaacttctccgccttgtaaaaccaacatgaatcaacccaccactcacaagatccgacgaaccaagcccgacctcgcttgtctccaacaactgcccatggccgcagccaatgccacaactctggcgggccgcgtccgaacaccaccaaggagatctcacacctcggccccgcccacgccgct

SEQ ID NO: 25743 - DNA, 368 bp, Triticum aestivum
  Clone ID: PAT_TA_25743
ggcaatgttcatgatactcataagtgggaggcacaaatatggagaaggaagagtacgtatttgaccccctggctcattactcaaaatttcctcaatagaggttctatgccatgactgagctaccattaacggggtcgagccactagcatctttggcagcaaggttggctcctcgagcaataagaagttgacaacatacagcatttccaccacacgcagcgtaatgaagtggggtgctacctgatcctataaggtcgatagttgttccatcttcaatggtgacctcagaaactgatgctcccaggtccaataacaactgtactcgcccgccatcgccctttaacgctgccatagaagcggggtaggctc

SEQ ID NO: 25744 - DNA, 271 bp, Triticum aestivum
  unsure (1)..(271): unsure at all n locations
  Clone ID: PAT_TA_25744
ttcgagcggccgcccgggcaggtacaagtggctggtttttggttgtgctgcacttactcatgatgcacaaggtgggctccaattttgtttacgtatctaatctgtttgtgttgaatgtaaacatgtttcatgcagaacagaaaataacatttaacaattttcctttcctgctgtgatgatatagntgatacacagaactaagattccatgttttttttgggctagcaaagggttcacactaagcttctgtacctcggncgcgaccacgcct

SEQ ID NO: 25745 - DNA, 385 bp, Triticum aestivum
  Clone ID: PAT_TA_25745
tagcgtggtcgcggccgaggtacctcgacgtcccgtcttgcgaacggagactcaaggctctgttgcatcagctgctcccagctacgcgagtaatgcgccgctgatgtcgaatactggattcgcagataatgactacaaccactatgacggtccactacctcccccccctcacatgaggtccgagtcgcaaagcacattaaactctcagcgatcctatcgaccaggcggccttccaggcggacctccaggacctggtccgagaatgcctcctcagcgttccaacacaggcttcagctttgagcagattcaacaagccactcccaccacaacccggctatcctcgcgctccgccccaagccgcgtacctgcccgggcggccgctcga

SEQ ID NO: 25746 - DNA, 477 bp, Triticum aestivum
  unsure (1)..(477): unsure at all n locations
  Clone ID: PAT_TA_25746
ccgaggtactttgacaaaatctgacttcttcgtgttgtattctaataacattgggagatacattaatcaaattaacgtccactatatttattttcttggcaaattaaactaaccttcctcatttggaaaccgcttcttcccctgggaatcataagtgtcattctgaatttaaaatgcaaaaacagagaaacttaaaatgtgaacttataacactgcattaactatccaaagcatttgggaacttaaaatgcaaaagcaggagaaacaacaagatagttcaaaaacagtgcaagagtaatccccacatagcatcaatgcatttttacgaaacacaaatgcatccggggaagactgttatatgctcaccanaccnggcatatgtatctgaatatgcccacaatttaatccgttagaggattccacatatggcatncnacttgatcttattgttacaaaattactaaagcatccggccaa

SEQ ID NO: 25747 - DNA, 524 bp, Triticum aestivum
  Clone ID: PAT_TA_25747
aaatccctccaattttgcccccgaaatcatcaatttccgcccaaaatcgcgacaggcacagttgagaaaccaaaatctgaccacaaccaagcaaaccctaactaaaacgtcagattgattccttattacggataatcgaacaaaccctaactaggtggtgttaccaaacaaaccctaactaattaataattaaatcctatcctagtcgaggtaggttcctcatacgaatagaataggatacaagacggcgctggctggatccgagacgtatgaaccccgcgccgcgccgcgcttaccaaccacaatcgggaacgagcaaactccggagggagaccacgcttggctggatccgagacctatgaaccagacacttaccaaccaatcggaacgaactccaagctgatcgggatgtacaagtgctcacctcgggcgggcgggcgggcgtaagatcccgatctggagaggacgaggcgccgtcgggtgattgatgtgagattgggtcgacaggttgcggggaacggcgg

SEQ ID NO: 25748 - DNA, 398 bp, Triticum aestivum
  Clone ID: PAT_TA_25748
gagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcggcggtgctggccccaagatcgaggaggtcgactaagttagtcgctttcatatacgccatttgattcagtcctgggtgccaatcatatcacctgggctggaagttttgttgtacttttggtctgtagcatcagtgtcgtaaacaatgcaatgatgcatgttttggctcattgttgatttcagcttaatgcttattgtttgtactacctacacctgtgatttcattctgaattcttagagcttaaaaaaaaaa

SEQ ID NO: 25749 - DNA, 996 bp, Triticum aestivum
  unsure (1)..(996): unsure at all n locations
  Clone ID: PAT_TA_25749
ttctctcccacctcccgtgatctccgccatcccacctcccccgattcatctgcagttcaaggtttctagaggctacatccagagcccagacaagctacttcatgcccaactccgctccctcccggcactaacccgtgctccgccaatcgggtcgaggaaaggacatcgccccaccgcacttgccggatctgccgagccagtggccagatccgccgagccagtagccgaatccatcgaggtcgcgtctggatcttgatcttctagtcctccccgccttctcctccgtcgatggcaggcggcagaaacatgcaaggcgcgtgtgactgctccggccagagaaaggcgcgaggtgcgaggcgatggcgcgtggtccagccgggcacggcaccggcgggcaccactttaccggggcgcgactccggtagccaacaccggcgcccaaattggatccaccgaacccaggcgcggcctccgacttgcatgcagttttgagttcatcaggagagcgtgcgcgcgagagagcgctgctcccgtcttccagcgaaccccaaggagagcagaggaggagatgaccaagggcgaggatgtgtggcagcaggtcgacatcatgggcaactaccaggccaccagggcaaccgcaccacgccctcctacgtcgccttcaccgacactgaacgcctcaccagcgacgccgccaagaaccaggtcgcaatgaaccccaccaacaccgtcttcggttcgccgcggttgagtactggagatggagtgtgattggaatagcgtcgacccccattggcatttatcttagcgagttgctggcctcaaacatgttttgtactgagatttctataatgttggcctcaaacatgttttgtactgagatttctataatgtttcatgtgatgtttctgtagtgtagatataggctctgttatggttgcgcatgtttctcgtggtgttgtaaggttgtcttaatgnaccttaatagcttaatgt

SEQ ID NO: 25750 - DNA, 580 bp, Triticum aestivum
  Clone ID: PAT_TA_25750
ctactcatcagaatactcatcagaagactcatcagaatcacagaaatgaaccggggtctccaacacatcggtgaccagctggaccagcaacgggacacgctcctgaagccagacaatgttgcatttacctttgagtacatgaacaacaatatcctttagcattttgctcagctttttgactttggctgtgaccagataatcctcgcgaagcaatacgcccaaggcttccttaaagctcttcctcatatgtaagagcgcaacagctgagttcttcatgagtaggaaggcttccagggcgtcccgttccagcttggcctcctgaaccatgagctggggtaacacatcatgctcgagcttttggatttccaccgacaagcctgccaccttcgagaggatttacagccccgagcatgaccagaacatcgactccatgatcagcgggcggaggagtgcatacgactcgcacgctatgcgcaccgactccagagagacaagtctcacaagcatggactcatcggagcgggcctgcaggtcttggatttgggcatgggagtggatttggtagagcatcatttccttt

SEQ ID NO: 25751 - DNA, 484 bp, Triticum aestivum
  unsure (1)..(484): unsure at all n locations
  Clone ID: PAT_TA_25751
ccgccagcagctgcgcaaaggctcgacaaaccctaaccctagtccatagctagcttagcttccttcctctcgatctagctagagccatggcgccgaccaagggcgaagggccggccatcggcatcgacctcggcaccacctactcgtgcgtcggcgtgtggcagcacgaccgcgtcgagatcatcgccaacgaccagggcaaccgcaccacgccctcgtacgtcgccttcaccgactcggagcgcctcatcggcgatgccgccaagaaccaggtcgccatgaaccccatcaacaccgtcttcgatgcgaagcgtcttattggcagaaggtttgctgatgcccctgtccagagtgatattaagatgggccgtacaaggtatttctgccccgcagancagctatgattgtgtgcagtccaaggtgaggacaaccagtctcacttgaggaaattctttcatgggcttattaagaaggcgagaatggt

SEQ ID NO: 25752 - DNA, 620 bp, Triticum aestivum
  unsure (1)..(620): unsure at all n locations
  Clone ID: PAT_TA_25752
aaaatccataggagggtccaagaaatacatcggaacatttgattctaaactgtttgccacgcccctaagaaatactcatcaccaagaagtagccaaggtacatagccatggctgccatgcacgagagcactccgtcgctccttgtgctcttcttgtcgctaatgctctttttcacggcgtcttccgcgcgccacatgactggtgatccaccgccggttattccttccccgccgccccatatggcttctccaacaatggaggaggcgtgggaaggcgtcatggtggcaccgaggccagttccttctggaccggaccctatacaccatcgtcctcatgcccccccgccccacagggcctccccatcaacggaggaggcgagggaaggtgtcatggtggcaccgaggccggttccttcntgtccgaaccctatacatnacttntccgccccggcgccacaaaccccaccattnataaccgatgtcatgacctaccggccgcattcacagaagaggcgtgcgaaggcgatattttgcgccgaagccagttcttttgataacacccatacatancaccctggtcagtgcctaacccaaccagaacgtgacgcaggcccaaccgtt

SEQ ID NO: 25753 - DNA, 659 bp, Triticum aestivum
  unsure (1)..(659): unsure at all n locations
  Clone ID: PAT_TA_25753
tgcagcagccggcggcagcagctgcgcaaaggctcctcaaaccctaaccctagtcctagcttcgcttccttcttctcgatctagctcgagccatggcgccgaccaagggcgaggggccggccatcggcatcgacctcggcaccacctactcgtgcgtcggcgtgtggcagcacgaccgcgtcgagatcatcgccaacgaccagggcaaccgcaccacgccctcgtacgtcgccttcaccgactcggagcgtctcatcggcgatgcgccaagaaccaggtcgccatgaaccccatcaacaccgtcttcgatgcgaacgtcttatcggcagaaggtttgctgatgccctgtcagagtgacattaagatgtggccgtacaaggttattcctgggccagcaagacaacctatgattgtagtgcagtacaagggtgangacaacattttcaactgaagattcttcaatggcctcaatcaanatgcgtgaatcnccnaggttactaagganaactattaagatgctgttgcacgtgctgctactcaatgatccaaangcaggaacaaggatncggtgttatgcggctaagtgagctacacaanagcaaagaagtgaatgccagggcttaaagagntacatttcgtaaaaatggtttcttgcntgg

SEQ ID NO: 25754 - DNA, 738 bp, Triticum aestivum
  Clone ID: PAT_TA_25754
tctgagagcattccttcccaaatttgagctcatggacaggataagtacgtttacagacttgaaaaacaacgttagtcgcagcatatgtgtgtgcattataaggctagacgaagaaactaatgacctcgtagttagcgagaagaaagcatgggaaatgacatatcttaaagaaggagctcttctaaaagggaatgtacacaagatttttccatatggtgcgcaagttaggataacggggaccaacagaagtggattactgcacatctccaacattagtcaaggccgtgtcttgtcagtaagcgacatcctaaaagtagatgatgagctgaaagttctggtgatcaagtcaaatgtttctgacaaaattgcactcagcatagcagacctggagagtgctcctggtttatttctgtcagataaagcgaaggtgttttcagaagctcaggaaatggcaaagaggtaccgggagcagcttccagttgtctctcggaacactaaattagattatgaccttcgaggggaaactattccgtttgataatgaagcgacactttatgcaaactggaaatggttcaaatttctgaggcatgccaaatctggtgacgaaaatgatagaacataattgcagctgatgtttatttcatgcgctgtatattgtaaggagaatttggtccccctcgaagaagagaatgtctgtgacgacctgaattgaaacagtattaacgattcttaaaaaaa

SEQ ID NO: 25755 - DNA, 777 bp, Triticum aestivum
  Clone ID: PAT_TA_25755
cacatccaaacataaagggttgattctaaactgtttgccacgcccctaagaaatactcatcacaacagcctcgagctggctgataagtctactcatcagaatgcttatgcttatgagtatcacagaaacgaaccggggtctccaacacatcggtgaccagctggaccagaaacaggacacactccttaaacaagcgagtgttgttagctttgagtacatgaacagcagtatcgtttagcatcatgctcagccttttgactttggctgagaccagatcctccttggcaagcaatacgcccaaggcttcctcaaagcacttcctcaaatgtaagagcttacttgctgagttcctaatgagtaggagggcttccagggcaccccgttccagcttaccctcctgaagcttgagctggggtaacacatcatgctcaagcttttggatttccagcgacaagcctgccacgtccgagagggaatccagctgcgggcattcccaggacctcgactccatgatcagcgggcggaggagtgcatacgactcgcgcgctatgcgcaccgactccaaagagacaagcttcacatccatgtgctcattggagtggcccagctcatcggtgcgggcctgcagggcttggatttcggcatgggagtggattttgtagagcatcttttccttttggcggcgaaggagactcgggcgggcgagaggaggatgtgagattgggtcgacagggtgttgcggggaacggcggcgaggcgatcgggagcccggccggc

SEQ ID NO: 25756 - DNA, 749 bp, Triticum aestivum
  Clone ID: PAT_TA_25756
aggtaaaggaagtagaacagcgtgcacaacatggtgtacatgaaccaaaagaactttgctgctgtccactcgtaccctatcatcggatatgctatcaacatgaagatcactacctgcaccagcacataaggtatctccatggcaacctgcgcaaaggagtaggcccaaggagagtacatccctgcgaacctctccctgtacacgacggagcgttcaacggagacaaaaggcatcactgattggcagttgttgatgccactgaacagagtggttccatacatgcaccccaatatggtgatgagaccttgctggtcgtttatgtggttgatgttgcctttctgccagaataacacaccaaagaaaatgcaggccactgttatgaataccatccgcaccaggttgtaagaaggagttctccaatatgacaaacactgcttccagaggcaagctttgaattgctcccgaaacttctgcggaaactgggttgggaaatggaggtcacttgtaccaggaactggtatgctcaagcgcttcaccagcatgtccttgtccttgcacattgatgattccctgtacatttgtgcaaaatctactcccagttgaagttccatagatgtagaagtaacttctagcatccatgttgatgggttgtacttgtccttgatcctgggaaccccaggtattgcctggaaatactggataacttcacatgaatggtgtccaactggcccagcatagatcaactctcc

SEQ ID NO: 25757 - DNA, 530 bp, Triticum aestivum
  unsure (1)..(530): unsure at all n locations
  Clone ID: PAT_TA_25757
gctcatccaggtgtttgagggtgagaggacaaggaccagggacaacaacctgctcggcaagtttgagctctctggcatcccgcctgcgcccaggggtgttccccagatcactgtctgcttcgacattgatgccaacggtatcctgaatgtctctgctgaggacaagaccactggccagaagaacaagatcaccatcaccaacgacaagggcaggctgagcaaggacgacattgagaagatggtccaaggacgcaagagaagtacaatctgaggacgaggagcacaagaagaagtttgacgccaaagaatccctgggagaactacgcctacaacatggaggaacaccatccaagacgagaagttccctcccaagctgcctgctgatgacaagaagaagtccgagacccgtttgacgcgcgatccagtggttgacgcaacantcngtaggttnncagttntggggaaagatnaggactggnggctctgaaccataacccaagnntcaagggcccnngttgaatccggggatg

SEQ ID NO: 25758 - DNA, 912 bp, Triticum aestivum
  unsure (1)..(912): unsure at all n locations
  Clone ID: PAT_TA_25758
ccccactgtctcttggtcttgagactgctggaggagtcatgactgtgctcatcacccggaacaccaccatccccaccaagaaggagcaggtcttctccacctactccgacaaccagcctggtgtgctcatccaggtttttgagggtgagaggacaaggaccagggacaacaacctgcttggcaagtttgagctctccggcatcccgcctgcacccaggggtgttccccagatcactgtctgcttcgacattgatgccaacggtatcctgaatgtctctgccgaggacaagaccactggccagaagaacaagatcactatcaccaacgacaagggcaggctgagcaagaactacgcctacaacatgaggaacaccatccaggacgagaagattgcctccaagctgcctgctgacgacaagaagaagattgaggatgctgtcgacgccgcgatccagtggcttgacgccaaccagcttggtgaggttgacgagtttgaggacaagatgaaggagctggagggcctctgcaaccccatcatcgccaagatgtaccagggtgccggtgctgacatgcccggaggcatggacgaggacgcgccggctgccagcggcggtgctggccccaagatcgaggaggtcgactaagttattctctttgatatagtgagaaaatacactatacgccatttgtttcagtcctgggtgccaatcatatcacctgggctggaagttttgttgtacttttggtctgtagcatcacgagacttgtgtgtaccgtaaacaatgcaatgatgcatgttttggctcattgttgattcagcttaatgcttantgtttggctaaaaaaaggggggccggtaccaatcgcctatatgatcgatacgcgcgctcactggcgtcgttacaactctga

SEQ ID NO: 25759 - DNA, 1098 bp, Triticum aestivum
  unsure (1)..(1098): unsure at all n locations
  Clone ID: PAT_TA_25759
cggacgcgtggggggttttgctacgtggcatggaattcatggcatagttggttctttcttcttcctcttcctacctctgcctcttgctcttccttcttcgcaagcagcagcctctccgccctcgcagccagccgctgtcgataggggggaggtcgccaccgccggctgctctctgccacgccgcttcgaccagagacagacggcggcaagccccaggaagtgaagctgcgggaggccggccatgggcgtcgcttctgggacgtgaaggtggtgttggacgccgacggccacatgtacctagagcgcggctgggagcagttcgcccgtgcgcacgacctgcggctcgggtacttcctcgtgttcagctacgacggcgacgccgtgctcaccgtcaaggtgttcgacgtgagcatgtgccgcaggcactacaagcacgacggtgacaccagcagtgagagcagcagcgacggtgacagtgggagcagcaacaccagcgacggcggcagtggtggcaacaacaggagcctggtggagatggacgtcgaggatgggccgacggggcagttcagcgccatgctgaggaaatgcaacctaggcatgaagcaggaacagtacctgaacgtgccggtggatttccagctcgcgcacgggtacgccgagaggagcaaggtggagctgcggatgcgcggcaagtcgtggctcgtgcacctgaagcacaaccccaagacgggtggcaggtcccgcgcgtcgtttaggtacgggtggcaccagttctgcgtcgacaacgccctcggcgagggcgacacctgcttcttccgagcgctccggcaaggcagcgccggcggcggcggcgaggaccacctactcaaggtggaggtgaggaggcgagacggcagcttcctggtctgaggcgagggcggtggcagccggcctcccgttgcaccagcctggttggccggcgtagcctcgtccgtggccatcggccggcacgactcagtgcgttattatgcttgcttaataangattgtaagaccttaattctcggtagtccactgccgatgtactagcaggagcgtagtaactagagagngagtctaa

SEQ ID NO: 25760 - DNA, 802 bp, Triticum aestivum
  Clone ID: PAT_TA_25760
acatatcacttaaaatccattaataacacatccaaacataaagggttggttctaaactgtttgccaccccctaagaaatactcatcacaacagcctcgagctggctgataagtctactcatcatcactcttccactcatcaggatcagagaaacaaaccggggtctccaacacatgggtgacctgctggaccagcaacgggacagactcctgaagcatgttgcaattaccttcaagtacatgaacagcagtatcctctagcattatgctcagcttttcgactcggggtgagaccagatcctcctcggccaatacgcccaaggctaacttaatgagtaggagggcttgcagggcgccccgttccagcttggcctcctgaaccatgagcttgggtaacacatcacgctcgagcatttggatttccagcgacaagcctgccacgaccaagaggatttccatctccgggcatggccagaacatcacgtccatgatcagcgggcggaggagtgcatacgactcgcgcgctatgcgcaccgactccagagagacaagcttcacaagcatgggattattggagtggcccagctcatcggagtgggcctgcaggtcttggatttgggcatgggagttgattgtgtagagcaccatttccttttggcggactgcagcagaacagttgctgctaccagctcgggcgggcgggcgggcgggcgtaagatctggagaggacgaggcgtcgggtgatgtgagattgggtcgacagggggttgcggggaacggcggcgaggcgatggagtgcgggc

SEQ ID NO: 25761 - DNA, 688 bp, Triticum aestivum
  Clone ID: PAT_TA_25761
ctttgacgcattacagtctgcactggtagcaaaaaggttggaataacagatatccctgacagtcacacaacgaagaacagcggaatactttcctacatacgaaccagaccaaaacatagttctgacagacagtctactcatcctcctggctgcggagcctggcaagcttgttcgtaaccacgatgtcgagctgcgcggcacgctcaacaatgtccttgcgcttctttgtggagacgttgtgggcaatctccgcacagtaggtcctgttgtgcatcataagcagctccagctcagacacattgtggacaacaaacttcttgaacttgttgggaaggtaatgcctggtcttcttgtcagaaccgtagccaatgttgggcatcaaggtgcatcccttgaactttctcctgacacgggaatcaatgccctttggcctgcgccagctttgcttgaggccaatgtagcggtcgctatgggccctcttgaagtgcttgaccctcttcttcacgatcttcctggtcagaagcggcaccgccatctctgatctgtcgggcaaaaccagcagaaggagtttgaatcagacgacgaggataaaatcacccgggaaaacgaggtgcgagctcgtctgcgagcttgcttgctaccttagggagcgaacgaccctaaccctaacacagagagaggtgcaagc

SEQ ID NO: 25762 - DNA, 886 bp, Triticum aestivum
  Clone ID: PAT_TA_25762
tcgagcggccgcccgggcaggtaccatcatcaaagaaaacccggaacgctgcactgtttacttcagaggcaatctttgtaatcagcccaaacatccttttatcccaaaaggaagatagctgattagttgcatttgggaccaagaaaatgtgaccatattcaacaggatatgcattcgcaatcagcagtacgagggtgagaggacaaggacccgtgacaacaacctccttggcaagttcgagctgtctggcatccctcccgcacccaggggagttccccagatcacggtctgctttgacatcgatgccaatggtatcctgaacgtgtctgctgaggacaagacgactgggcagaagaacaagatcaccatcaccaatgacaagggcaggctgagcaaggaggagatcgagaagatggtccaggaggctgagaagtcgcgcaccgccgctgacgcatctcgagtagtttccagttcgccggagaaggagcaagatggccggaaggaagggcggcgacaggaagaaggcggtgacccgctccgtaaaggccgggctccagttccccgtcggccgcatcgggcgctacctcaagaagggccgctacgcccagcgcgtcggctccggcgcccccgtctacctcgccgccgtcctcgagtactactgcaaaatgtccacgaagatcttggacagcaactttggccacatcaaaaccgtctactaagatgcgaccattgcatattggagttaaacggaaaagtgcattcagtatactggattttcctgctccggtccttcctattattccaacctgcatgccagattcaatatggaatgagatttcattcaaagccggtggtaggtccgctttgtacctgcccgggcggccgc

SEQ ID NO: 25763 - DNA, 769 bp, Triticum aestivum
  unsure (1)..(769): unsure at all n locations
  Clone ID: PAT_TA_25763
cgtccgattgctggcatcaatgtcctccgtatcatcaatgagccaacagccgctgccattgcttatggtcttgacaagaaggcttccagtgttggtgagaagaatgtcctcatctttgaccttggaggtggtacctttgatgtctctcttctcaccattgaggagggtatctttgaggtcaaagccacagctggtgacactcatcttggtggtgaggactttgacaacaggatggtcaaccactttgtccaggagtttaagaggaagaacaagaaggacatcagtggcaacccagagctcttcggaggctgaggacatcctgtgagagggcaaagagaaccctctcctccactgcccagaccaccattgagattgactcgctgtttgagggcattgacttttacttcacaccatcacccgtgccagttttgaaggagatgaacatggttctgttcaagaagtgcatggacctgtggagaatgttttgagggacccaaagatggacaagacactgtgcacatgttgtcctgttggtggttccactagatcccaagangcancacttctccaagatncttcatggcaaggacttncnagncacaacctgatagntntgcctatggacaactncaagcgcactttaacggaaagnaacaaaaggcaagactgcgcnttggttcacctcttcctggncgananaccgggttgatnnatctatcaaggaaacatccacagaggcagntccactatcgnacanctgntgcacatg

SEQ ID NO: 25764 - DNA, 885 bp, Triticum aestivum
  Clone ID: PAT_TA_25764
gatgccaagatggacaagagcaccatccatgatgtcgtgcttgttggtggttccaccagaatccccagagttcagcagctgttgcaggacttcttcaacgggaaggagctctgcaagagcatcaaccctgatgaagccgttgcctacggtgctgccgtccaggctgcaatcctcagtggtgaggggaacgagaaggtgcaggaccttctcctccttgatgtcaccccactgtctcttggtcttgagactgctggaggagtcatgactgtgctcatcacccggaacaccaccatccccaccaagaaggagcaggtcttctccacctactccgacaaccagcctggtgtgctcatccaggtttttgagggtgagaggacaaggaccagggacaacaacctgcttggcaagtttgagctctccggcatcccgcctgcacccaggggtgttccccagatcactgtctgcttcgacattgatgccaacggtatcctgaatgtctctgccgaggacaagaccactggccagaagaacaagatcgaggaggtcgactaagttattctctttgatatagtgagaaaatacactatacgccatttgtttcagtcctgggtgccaatcatatcacctgggctggaagttttgttgtcagaagtggattactgcacatctccaacattagtcaaggtcgtgtcttgtcagtaagcgacatcctaaacgtagacgacgagctgaaagttctggtgatcaagtcaaatgtttctgacaaaattgcactcagcatagcagacctggagagtgctcctggtttatttctgtcaaataaagcgaaggtgttttcagaagctgaggaaatggcaaagaggtacctcggccgcgaccacgcta

SEQ ID NO: 25765 - DNA, 1248 bp, Triticum aestivum
  unsure (1)..(1248): unsure at all n locations
  Clone ID: PAT_TA_25765
cctgctcgaaattaaccctactaaagggaacaaaagctggagctccaccgcggtggcggccgctctagaactagtggatcccccgggctgcaggaattcggcaccaggagggcaaagaggactctctcctccactgcacagaccaccattgagattgactcgctgtttgagggcattgacttctactccaccatcacccgggccaggtttgaggagatgaacatggatctgttcaggaagtgtatggagcctgtggagaagtgtctcagggatgcaaagatggacaagagcaccgtgcacgatgttgtccttgttggtggttccactaggattcccaaagtgcagcagcttctccaggacttcttcaacggcaaggagctgtgcaagagcatcaaccctgatgaggctgttgcgtacggggctgctgtccangctgccatcttgagcggagagggcaacgagaaggtccaggacctgctgttattggatgtcactcctctttctcttggtctggagacagctgggggtgtgatgacagttttgattccaaggaacaccaccatccccaccaagaaggagcaggtcttctccacctactcggacaaccagcctggtgtgctcatccaggtttttgagggtgagaggacaaggaccagggacaacaacctgcttggcaagtttgagctctccggcatcccgcctgcacccaggggtgttccccagatcactgtctgcttcgacattgatgccaacggtatcctgaatgtctctgccgaggacaagaccactggccagaagaacaagatcactatcaccaacgacaaaaaaaaaattgaggatgctgtcgaccccgcgatccagtggcttgacgccaaccagcttggtgaggttgacgagtttgaggacaaaataaaggagctggagggcctttgcaaccccatcatcgccaaaatgtaccagggtgccggtgctgacatgcccggaggcatggacgaggacgcgccggctgccaacggcggtgctggccccaagatcgaggaggtcgactaagttattttttttgatatagtgagaaaataccctatacgccatttgtttcagtcctgggtgccaatcaaatcacctgggctggaagttttgttgtacttttggtctgtagcatcacgagacttgtgtgtaccgtaaacaatgcaatgatgcatgttttggctcattgttgatttcagcttaatgcttattgtttgggct

SEQ ID NO: 25766 - DNA, 916 bp, Triticum aestivum
  Clone ID: PAT_TA_25766
gccggccgggtcgggggtcccagccgccgccgccactagcttccagcgaacagagccaagggtttgggagagagcgatggagggaggagtgatctcgttgccggcgccggcgccggtttcttgcctcgccaacagggagttccaggccacccccacccccagcccgtccgacgagtcgacggtcctccgcgagctgaacgtttccgtctccctcgccggtctggacatctcccgcggccaccacggcgagccggacgtcctgggccagagacgcagcaagtgcaagcccaaggtccggacagtctccaagatgcacatggcggccaaggccaaggccagggcggagaaggcggcggcggcggcggtcgacaaggccaaggcggagaagaaggcggcgctcgacaaggccaaggcggagaagaaggcggcggcggcgaacgacaaggcaaagacggagacgaaggcggcggcggcggactacaaggtcaagccggagaaggaggcggcgcctgctggtggtgctgctgcatcccccgagaggttgaagctcaacccgtacgaggggtatgcgatcaaggagaagaggatggtgaagatggaccatcggaacagctacatcaagtggctgctcgagtgggacaagaagcctcgccctcccctgcccaacctccccgagacgctccgctccatggtcgccatcaaggccgagcgagcccaccatgagagggtcctcgccgacttcaagctcgacgggcacgcctacgtccaggtcgacgtcttctacgacgacgacccaagggccaacctccccgacgaccagttcgaggtcatccaccacgacagcgacgaagaagcttgatctacttagctgagcgagatctatctacctatctatctatctaatgtgcgccatgga

SEQ ID NO: 25767 - DNA, 989 bp, Triticum aestivum
  Clone ID: PAT_TA_25767
ctggacgtcacccctctgtccctgggtctggagactgctggaggagttatgacagtgctgatcccgaggaacaccaccatccccaccaagaaggagcaggtattctccacctactcggacaaccagcccggtgtcctgatccaggtctacgagggtgagaggacccggacacgcgacaacaacctgctgggcaagttcgagctctccggcatcccccctgcaccccgtggtgtgccacagatcaccgtgtgctttgacatcgacgccaacggcatcctgaacgtgtctgccgaggacaagacaacggggcagaagaacaagatcacaatcaccaacgacaagggccgtctctccaaggaggagatcgagaagatggttcaggacgctgagaagtacaagtctgaggatgaggagcacaagaagaaggtggaggccaagaactcgctggagaactactcctacaacatgcgcaacacgatcaaggacgagaagattgcgtccaagctgccggccgatgacaagaagaagatcgaggacgccatcgacgcggccatcagctggctggacgccaaccagctcgccgaggcggacgagttcgaggacaagatgaaggagctggagagcctctgcaaccccatcatcgccaagatgtaccagggcgcgggtgaagacatgggcggcgctggcggcatggacgaggacgcccctgccggcagcggcggccctggccccaagattcgaggaggtggactaagcggtttgttgtcagtcttgagtgtgctgcagttgctggctgggcccagttgctgccgagagttatcgtcagttggtgcggtgtgtccgcttaaactttatttgtggttggttggtacttttgtggtggttatttttttggacctcgtgatagtcggtcggttcaatgttatcgcggctactggcaaaccttaagtgatacggtattcttctaaaaaaaaaaaaaaaaaactcga

SEQ ID NO: 25768 - DNA, 959 bp, Triticum aestivum
  Clone ID: PAT_TA_25768
gcacgaggaacgcttcgaacagccgccgccgcccactagcttccagcgaacagagccaagggtttgggagagagcgatggagggaggagtgatctcgttgccggtgccggtttcttgcctcgccaacagggagttccaggccacccccacccccagcccgcccgacgagtcgacggtcctccgcgagctgaacgtctccgtctccctcgccggtctggacatctcccgcgcccaccacggcgagccggacgtcctgggccagagacgcagcaagtgcaagcccatggtccggacagtctccaagatgcacatggcggccaaggcggagaagaaggcggcgctcgacaaggccaagtcggagaagaagtcggcggcggcaaagaaggcgtcggcggctggtggtgcggcatcccacccgtggttgaggttcgacctgtatgtggaggggtatcctatcaagaagcagaagacggtgaagctggaccatcggaacagctacatcaagtggctgctcgagtgggacaagaagcctcgccgtcccctgcccaacttcccggagaggctccgcaaggtcacggacgccatcaaggccgaccgcgacgagaacgagagggtcctcgccgacttcaagcgcctcggctacgcctacgtccaggtcgacgtcttcaacgacgacgacccaagggccaacctccccgaccaccactacgacatcatccaccacgacagcgacgaagaagcttgatctactgagcaacatctatctatctatctatctatctatctatctatctaatgtctgctatggattagtgtatgattcctcctggcgatgtactgcgtcctaaacttctgtctgcaattgatgatgatgttgtatcgtagttatgtagtgtgtcctctgcctttgtaacccggcaagctactattctcctagtgttatttatgtgccactcatg

SEQ ID NO: 25769 - DNA, 791 bp, Triticum aestivum
  unsure (1)..(791): unsure at all n locations
  Clone ID: PAT_TA_25769
acatttctcctccaccgggcgtgaagaatgctatggagatgcaagcagaggcagaaaggagaaagcgtgctcaaattctccagtcagaaggggctatgttggatcaggcaaaccgcgcaaagggtgaggctgaagcgattctctccaagtcacaagctaccgccgaagggattagaatggtctcagagtccatgagagctgaaggcagtgctgaggctgcaaaactgagaatcgctgaacagtacatcacagcatttgctgctctggccaagaataccacgacaatgcttcttccaagcgacgctgggcaacccatcatctatgatagcccagtctctccagatatacaagcacataagccagtccagcagcccgaaaggagggaaccaacaggcagaagaagttgaggaagcaggaccgcaagaagaggccgatacgttcggcctgccttctgtgacgagcgcgatgccacccagcacgcaaacaggccatggcagcacgttctccctgcagaagcgtaaagaatgatcagcctgttcaagtaccgaagggaaccctttttagataggagggtgtcactgaaaacaccagcagcatttgaggtttcgagcttaattcatgtgatgtcgagtcggcttaggttgatatggcaattgacctgacattagttatccaggcgccaaatgcaaaggaggctaggcgactggggagattttgacggcagcctgcaagacttgtgtaatgcaagtatatcgctcacgatgtcagcatactatnaggcaattttcacc

SEQ ID NO: 25770 - DNA, 1498 bp, Triticum aestivum
  unsure (1)..(1498): unsure at all n locations
  Clone ID: PAT_TA_25770
tacctaggaagtaactattaagcaatgctgttgtcaccgtgcctgcttacttcaatgattcccagaggcaggcaaccaaggatgccggtgttattgctggtcttaatgtgatgcgtatcatcaacgagccaacagcagctgcaattgcctatggtcttgacaaccgtatggtgaaccactttgtccaagagttcaagaggaagcacaagaaggatatcagtggaaaccccaggtctttgagaaggctcaggacttcttgtgagaggncgaagaggaccctttcttccactgcccaaaccaccattgagatcgattcactcttcgagggagttgatttctattccaccatcaccagggccaggtttgaggagctcaacatggacctcttcaggaagtgcatggagccagtggagaagtgcctgagggatgccaagatggacaagagcactatccatgatgtttgtgcttgttggcggttccaccagaatccccagagttcagcagctgctgcaggacttcttcaacgggaaggagctctgcaagagcatcaaccctgatgaagctgttgcctacggtgctgccgtccaggctgcaatcctcagcggtgaggggaacgagaaggtgcaggaccttctcctcctggatgtcaccccactgtctcttggtcttgagactgtctgcttcgacattgatgccaacggtatcctgaatgtctctgctgaggacaagaccactggccagaagaacaagatcaccatcaccaacgacaagggcaggctgagcaaggacgacattgagaagatggtccaggacgcagagaagtacaagtctgaggacgaggagcacaagaagaaggttgacgccaagaactccctggagaactacgcctacaacatgaggaacaccatccaggacgagaagatcgcctccaagctgcctgctgatgacaagaagaagatcgaggacgccgttggacgccgcgatccatggcttggacgccaaccagctcggtgaggttgacgagtttgaggacaagatgaaaggagctggagggctctgcaacccatccatccgccaagatgtaccaaggcgccgggtgctgacatgcccggaggcatggacgaggacccgcccggctgccaaccgcggtgctgggcccaagatttgaggaagtccgactaatttatccctttttatatagtggagaaatacactatacacatttatcatcctggtgccatcatncaccgggctggaattttggtgtacttttggtctgtacatcacgagactgtgttgtcgtgaacaatcatgatcattttggccatgtgantcagctaagctatattggctaaaaccggnatgnttcgcccatnanccganttcccgcttttgtgacgntcaatcttgancgcggtaaaattttcgtcaggtcccccacacctggntnnacgaagnttccnnggccaaggtattcgganccctcancnaaattagg

SEQ ID NO: 25771 - DNA, 1282 bp, Triticum aestivum
  Clone ID: PAT_TA_25771
gcggcagcagttcgccctcgctcgcaggctgccgttgtcaagacggggtgatccaggccaccaccgccggctgcgctctaccacgccgggggtccgccgcttccaccaggcaagagacacgtgagatggacagcgtggaaagttttcaattcttccagatcatacttgagaactcctggactaggctgaggctgcctgacaagtttacgagggtgctgctagagctagacggcggcaagccccaggaagtgaagctgcggaatgccggccacgggcgtcgcttttgggacgtgaaggtggtgctggacgccgacggccacatgtacctagggcgcggctgggagcagttcgcccgtgcgtacgacctgcggctcggctacttcctggtcttcagcttcgacggcgacgccgtgctcaccgtcaaggtgttcgacgtgagcatgtgccgcaggcactaccagcacgatgacgatggcagtaccagcagtgggagcagcagcgacggcgacagtggcagcgaagatggcagcagcaacggcgacggtggcggcaacagcagcagcatggcggtgatggggatcgacgacgggccggcgtcgctgttcaccgtcatgctgagggagtgcaacctgggcgtgaggcagaagcagtacctgaacgtgccggtggagttccagaacgcgcacgggtacgcggagaggagcaaggtggagctgcggatgcgcggcaagtcgtggttcgtgaacctgaagcacagcccccggagccgtggcaggccccgcgcgtcgctcaggtacgggtggcaccagttctgcgtcgacaacggcctcggcgtcggcgacacctgcttcttccgagctctcggcgaaggcagcgccggcgaggtccaccttctcaaggtggaggtgaggaagcgagacggcagcttcctggtctgaggcgagggcggtggcccccgacctccgttgcatgcgtcagcctggttggccggcgtgacctcgtccgtggccatcgaccggcaccactcagtgcgttattatgcttgcttaataataattgtaagaccttaatcctcggtacctcgactgatggtgctactagcagagtgagtaactagagagtgaacctggatgatgaaattgttcttgttgagattgtggctttttcaaacaggatgagtggcatctagtaaatcccgcaatgatgatacgaacaacgagtcaaagactcccttgtctgtaccagtttcaccaagaactcagtgctacagcgtcattttttt

SEQ ID NO: 25772 - DNA, 809 bp, Triticum aestivum
  unsure (1)..(809): unsure at all n locations
  Clone ID: PAT_TA_25772
gaaggaggaagaagagggttttgctacgtggcatggaattcatggcatagttggttctttcttcttcctcttcctacctctgcctcttgctcttccttcttcgcaagcagcagcctctccgccctcgcagccagccgctgtcgataggggggaggtcgccaccgccggctgctctctgccacgccgcttcgaccagagacaggtgagatggaaggtttcgagttcttccagatcgtacttgacaactcctcgagcaggctgaggctgcctgacaagtttaccatggtgctactagacggcggcaagccccaggaagtgaagctgcgggaggccggccatgggcgtcgcttctgggacgtgaaggtggtgttggacgccgacggccacatgtacctagagcgcggctgggagcagttcgcccgtgcgcacgacctgcggctcgggtacttcctcgtgttcagctacgacggcgacgccgtgctcaccgtcaaggtgttcgacgtgagcatgtgccgcaggcactacaagcacgacggtgacaccagcagtgagagcagcagcgacggtgacagtgggagcagcaacaccagcgacggcggcagtggtggcaacaacaggagcctggtggagatggacgtcgaggatgggccgacggggcagttcagcgccatgctgaggaaatgcaacctangcatgaagcaggaacagtaccctgacgtgccgntgggatntccagctcgcgcacgggtacgccgagaggagcaagggtggagctgcggatgcgcggcaagtcgtggctcgtgcacctg

SEQ ID NO: 25773 - DNA, 462 bp, Triticum aestivum
  Clone ID: PAT_TA_25773
cggaatagggattgaataacttggcgtgcttcacccggcaccccgcacggggggcagtaaggagtagagactgaaggaatttggagtccacccagcggggttcccaggccacccagaatgggccggccggcggaatgggccattgaaggagtttggagtcaccggggttcccataaacggggtggcggtgaccggtggcggcgggcgcatgaataggggttgaaagacatgggcggaggaatcctaggaacagggaatccaggacctggagtgtccactgttggccccgtgcaccggcgacggaggagtccctgattctcggcctccgtcaagagcaactcggtcagccgccaggcatgacagggagcaacataggagagcaaggatcggtgcacttcgtaccaaggaagaatctctctctctctacctcggccgcgaccacgctaatcacttagtgaattc

SEQ ID NO: 25774 - DNA, 782 bp, Triticum aestivum
  Clone ID: PAT_TA_25774
acataaaggaggttacaagaaatacatcgcaacattcgattctaaactgtttgccacgcccctaagaaacactcatcacaacagtctcgagctggctgataagtctactcatcagaagactcatcagaagactcatcagaatcatcgaaatgaaccggggtgttcaacacctcggtgaccagctggaccagcaaccggacacgctcctgaagcccgacaatgttgcattcacgctcctgaagcaaccggacagcaatatactttagcattttgctcagccttttgactttggctgagaccagatcctccttggcaagcaatacgcccaagtcttccttaaagcacttcctcaaatgtaagagcgcaacagctgagttcttcatgagtaggagggcttccagggcgcccctttccagcttagcctcctgaagcttgagctggggtaacacatcatgctcgagcttttggatttccagcgacaagcctgccacgtccgagaggatttccagctgcgggcatacccaaatccacgactccttgatcagcgggcggaggagcgcatacgactcccacgctatgcgcaccgactccagagagacaagactcacaagcatggacttattggagaggcccagctcatcggagcgggcctgcaggtcttggatttgggcatgggagcggattttgtagagcatcatttccttttggcggcgaagaagactcgggcgggcgagaggaggatgtgagattgggtcgacagggtgttgcggcctcgtgccgaa

SEQ ID NO: 25775 - DNA, 1184 bp, Triticum aestivum
  unsure (1)..(1184): unsure at all n locations
  Clone ID: PAT_TA_25775
cggacgcgtccgcccacgcgtccgccttcttcgatcgcaagcagcagcctgtccaccctcgcagccagccgctgtcgagagcggggcggtcgtcaccgccggctgctctctgccacgccgcttcgaccaggtgagatggaaggtttcgagttcttccagatcatacttgacaactcctcgagcaggctgaggctgcctgacaagtttaccagggtgctactagacggcggcaagccccaggaagtgaagctacgggaggccggtcataggcgtcgcttctgggacgtgaaggtggtgctggacgccgacggccacatgtacctagggcgcggctgggagcagttcgcccgtgcgcacggcctgcggctcggctacttcctcgtcttcagctacgacggcgacgccgtgctcaccgtcaaggtgttcgacgtgagcatgtgccgcaggcactaccagcacgacggtgacaccagcagtgggagcagcagcgacggtgacagtgggagcagcaacaccagcgacggcggcggtggtggaaacaactggagcctggcggagatggacgtcgaggacgggccgacggggcagttcagcgccatgctgaggaaatgcaacctaggcatgaagcaggaacagtacctgaacgtgccggtggatttccagctcgcgcacgggtacgcggagaggagcaaggtggagctgcggatgcgcggcaagtcgtggctcgtgcacctgaagcacaaccccaagacgggtggcaggtcccgcgcgtcgtttaggtacgggtggcaccagttctgcgtcgacaacgccctcggcgtgggcgacacctgcttcttccgagcgctccggcaaggtagcgccggcggcggcggcgaggaccaccttctcaaggtggaggtgaggaagcgagacggcagcttcctggtctgagacgagggcggtggccgccggcctccgttgcaccagcctggttggccggcgtagcctccggcacgactcagtgcgttattaataatgattgtaagaccttaattctcggtagtccactgccgatggtactagcaggagcgtgagtaactagagagtggagtctaaacctggctgtgtttatccgtgtgcaaatgattattgttgagcatctttgtcaaaaaaaaaaaaaaaaaaaaactcgangggggggg

SEQ ID NO: 25776 - DNA, 1150 bp, Triticum aestivum
  Clone ID: PAT_TA_25776
atatatatatatgtatgtagtcgaagagccattcattgttgtacttgtagggtgaaaaacaaaataaatataaaaaagtcgagttagtgatctgaatctgaatctgagacggtattgcttgatccatgtagtaggatatgtgctagctggaaagaaacaaacagacagacagacaggcccattcatcaagttgaggagcagttcagccacccctggaactggagttggagttggagttgaaattgggtctcttgagcttgacaatgaattctttgtcgtcgtcgtcgctgctgtactcgactcttctcttggccttggcggcggtatgatccgtgttgtgacgcgctgtggaagaagaagaaaccactggtgccggtttcttccaggtctctgcaggtttgttgttgttgtgtttgctgacagtgttggaatttgacgacttgatcggggtccctgatttgatctgctgctgccgtttgagctttctgtcataggctttcttggctctctccggagataacagcccatgctccattaaccagaattcggccatgtcgctggatgggatctgcttggagagcgattcgtagaagatccgaaggggctccctctcctctgggatatcgaacttctggcccggtgagggagaagaccttcttggcggccttgcccttgcccttgccccgcccgctagctgtagtagcagctgctttcttggcgctggcggtggccgcggcgagcttggccctggaggcggccagcgatatggatctcccggctccgccgcctcctactcctttaccctcgaatctggccttggagaaggaggaggacgacatggctccggcagctcgcagctcaagcaagagaaattcagatcaacaagaagaagaggaaaggggaaattcagccaagatcgaggaggtcgactaaacagtcagttgttctgttgcagaggcggcgaagcctgctgcttattataccgtgtctgtgttatctgagacttgaggttgtggtggttattgttttgcttccgagtggtcggagttattccgtgcgagttgcaacattcgtggtagtggatcaagggttatgatgtctcacgtctaagtatattattagtttgttggtaaaaaaaaaaaaaaaaaac

SEQ ID NO: 25777 - DNA, 2153 bp, Triticum aestivum
  unsure (1)..(2153): unsure at all n locations
  Clone ID: PAT_TA_25777
ttgtacgcacaacaggggtttaaagtcaggagggaccatacagcaccaagttctacttaattagttaggacagcatcatatttgcattgtgcgacataatagttattaatatgaagtgaaagcaattcaaccatgtatactgataggcaactaaacaaaataaatgaatacactcgatcacccaaaacagaaaaataattaacagagggaatacaatttggttcaaaatacatagagatcccatcattcattgtattactgtgagcaagaaaattgcatctccagaattaatgcctcgccatcaaaggaaacaataaactaaacagctgggaaataaaaaattgaatcccatgtgcaagggcatagtgaggacctaaaaagcacggacacggggacggaaagacggggatacggatacggggattttccaaaaacagccattcggggatacggagtatatataaaataaaataaaaatatgccatgtaatatagagttaagacagaaaattaaagagaaatagatcaaaataaagaatagactagagtactgccccatttggtgtctcttttatcaagtgcttgatcgatcctcgtccccccatctcattgtaagttgcatcttgcaaaacacatcaaacacaaattggctaccagctgtggcgctcccagatgccatgccacttgctagttgctacaggctacagctgcgaggagccgaggaggcgaggagagagagagactgctgctgctggtgcttgatggaggagtcgccgtcgaatccaggagtcgccggcgccggcggcggcgagcccaggtggtgggaacttcgatccagaaggtggcggctccttctgttcgagctgggaagcagggagcagctcgtatggcacgctggagaccctgcaaaatagggttacatattgggccgtggctggcccgggggtgtgtttttgggccaggccgtatccctaacgtgtccctgcgtatcccggcgtatcccagtcgttttttctttttttttaattcgaatttcggggatactccaaaattcgcgtatcccgcctatcccgccgtatccccgtatcccgccgtatcaggacggcagttcggcgattcctggcgtgtccgtgctttttaggtgaggacagaaaaccaaaccagcatttacagtcctcaagaagaagactagagattggttggcaaaagatacatcatcattggcaaatattagtatcacatataataaataaacccaaacgataaccaaatacctatccaaacaacagagctggaaagcagcacatacgactacaacattaatcagcagctgcaggttaagtgctgccagtgcataaatattttaggatccaaaaaaatattgttacctatccaaacagagctagaacatgaatatgcaacaaatctactacgctcaaacacagttgataaaaaaaatttaacattctggcaggcataaactgaaatcaaacaacatagcatgaattccatccaaattaatattcgatttctagcttgattttgttgtttttcgtcctaattcgaaatttccccaccaaaaatagccccaatttttttttttgtgatttgttggcatgatgaagttttgttgattttgatccatggatttgcttggtttccccaagtttccccatctttcatccacaaattacctcggattttgcccccgaaatcaatcatcaatttccgcccaaaatcgcgacaggcacagttgaagaattcatgagaaaccaaaatctgaccacaaccaaccaagcaaaccctaactaaaacgtcagattgattccttgttacggataatcaatcgaaccctagctaggtggtgttaccctaatacaaaacctaactaattanatcctatcctagccgaggttccacatacgaataggatacagacggcgctggatccgacacctatgaacccgcgccgcgccgcgcctaccaaccacaatcggaacgagaaactccggatgcacgcggagggagaccacgctggctggatccgagacctacgaaccagcgcctaccaaccaatccagaggaactacaagtgctcacctcgggcgggcgagaggaggatgtgagattgggtcgacagggtgttgccggacg

SEQ ID NO: 25778 - DNA, 809 bp, Triticum aestivum
  Clone ID: PAT_TA_25778
ttttttttgagaaaacactacccaagatacatatcatttaaaatccattaataacacatccaaacataaagggttgattctaaactgtttgccacgcccctaagaaatactcatcacaacagcctcgagctagctgataagtctactcatcagaagactcatcagaagactcatcagaatcatcgaaatgaacgggggtgtccaacacctcggtgaccagctggaccagcaaccggacacgctcctgaagcccgacaatgttgcattcacgctcctgaagcaaccggacagcaatatcctttagcattttgctcagccttttgactttggctgagaccagatgatcctcgcaaaacaatacgcccaagtcttccttaaagcacttcctcaaatgtaagagcgcaacagctgagttcttcatgagtaggacggcttccagggcgcccatttccagcttagcctcctgaagcttgagctggggtaacacatcatgctcgagcttttggatttccaatgacaagcctgccacgtccgagaggattttcagctgcgggcatacccaaatccacgactccttgatcagcgggcggaggagcgcatacgactcccatgctatgcgcaccgactccagagagacaagactcacaagcatggacttattgggagaggcccagctcatcggagcgggcctgcaggtcttggatttgggcatgggagtggatttttgtagagcatcatttccttttggcggcgaagaagactcgggcgggcgagaggaggatgtgagattgggtcgacagggtgttgcc

SEQ ID NO: 25779 - DNA, 1242 bp, Triticum aestivum
  Clone ID: PAT_TA_25779
gaggaagaagagggttgtgctacgtggcatggaattcatggcatagttggttctttcttcttcctcttcctacccctgcctcttgctcttccttcttcgcaagcaccagtctctccgccctcgcagccagccgctgccgagagggggccgggaggtcgccaccgccggctgctctctgccacgccgcttcgaccagagacaggtgagatggaaggtttcgagttcttccagatcatacttgacaactcctcgagcaggctgaggctgcctgacaagtttaccagggtgctgctagacggcggcaagccccaggaagtgaagctacaggaggccggccatgggcgtcgcttctgggacgtgaaggtggtgctggacgccgacggccacatgtacctagggcgcggctgggagcagttcgcccgtgcgcacgacctgcggctcggctacttcctcgtcttcagcttcgacggcgacgccgtgctcaccgtgaaggtgttcgacgtgagcatgtgccgcaggcactaccagcacgacggtgacaccagcagtgggagcagcagcgacggtgacagtgggagcagcaacgccagcgacggcggcagtggtggcaacaactggagcctggcggagatggacgtcgaggacgggccgacggggcagttcagcgccatgctgaggaaatgcaacctgggcatgaagcaggaacagtacctgaacgtgccggtggatttccagctcgcgcacgggtacgcggagaggagcaaggtggagctgcggatgcgcggcaagtcgtggctcgtgcacctcaagcacaaccccaagacgggtggcaggccgcgggcgtctttcaggtacggatggcaccagttctgcgtcgacaacgccctcggcgagggcgacacctgcttcttccgagcgctccgccaaggcagcgccggcggcggcggcgaggaccacctactcaaggtggaagtgaggaggcgcgacggcagcttcctggtctgaggcgagggcggtggccgccggcctccgttgcatgcatcggcctggttggccggcgtgacctcgtccgtggccatcggccggcacgactcagtgcgttattatgcttgcttaataatgattgtaagaccttaattctcggtagtccactgccgatgctactagcaggagcgtgagtaactagagagtggggtctaaacctggctgtgtttatccgtgtggaaatgattattgttgagc

SEQ ID NO: 25780 - DNA, 880 bp, Triticum aestivum
  Clone ID: PAT_TA_25780
aaaaaaaaaactgaaagtaattccaagttgtacccgactagcacagaatgggaaaacactacccaccaaagatacatatcatttaaaatccattaataacacatacaaacataaagggttgattctaaactgtttgccacgcccctaagaaatactcatcacaacagcctcgagctggctgataagtctactcatcagaagactcatcagaagactcaccagaatcacagaaatgaaccggggtctccaacacatcggtgatcagctggagcagcaacgggacacgctcctgaagccagacaatgttgcattcacgctcctgaagcaacgggacagcaatatcctttagcattttgctcagctttttgaatttggctgagaccacataatcctcgcaaagccaaacgcccaaggcttccttaaagcacttcctcatatgtaagagcccaacagctgagttcttcataagtaggagggcttccagggcgcccgtttccagcttagcctcctgaaccgtgagctggggtaacacatcatgctcgagcttttggatttccagcgacaagcttgccacctccgagaggatttccagctccgggcaaaaccacatcctcgactccatgatcagcgggcagaggagtgcatacgactcgcgcgctatgcgcaccgactccagagagacaagcttcacatccatgcgcttgttggagtggcccagctcatcggggcgggcctgcaggtcttggatttgggcatgggagtggatttcgtagagcatcgtcatttgcttttggcggcgaagaagactcgggcgggcgggcgtaagatctgatctggagaggaggacgaggcgtcgggtgatatccctgtgatgaattgg

SEQ ID NO: 25781 - DNA, 1076 bp, Triticum aestivum
  Clone ID: PAT_TA_25781
ttttttttttttttttttttacagaatgtgttcatttattcattcattattttcaccaggcattgcttacaacaaaaaggtagtaaatgtctatcttgtctctgaactcaaatacacagacaggcatatatatgtatgtagtcagaagagccaattcattgttgtacttgtagggtgaaaaacaaaataaataaaagtcgagttagtgatctgagtctgaatctgagatggtattgcttgatccatgtagtaggatatgtgcttagctggaaagaaacaaacagacagacgggcccattcatcaatgttgaggagttgttcagccacccctggaattggaattggagttggagttgaaattgggtctcttgagcttgacaacgaattctttgtcgtcgtggtcatcgtcgctgctgtactcaactcttctcttggccttggcggcggaatgatctgtgttgtgacccgctgtggaagaagaagaaaccagtggtaccggtttcttccagctctctgcaggtttgtgtttggtgacagtggtggaatttggcgacttgatgggggtccctgatttgatctgctgctgccgtttgagctttctgtcataggctttcttggctctctccggagataacagcccatgctccattaaccagaattcggccatgtcgctggatgggatctgcttggagagcgattcgtagaagatcctcaggggctccctctcctctggggtgtcgaacttctggccggtgagggagaagaccttcttggccttggccttggccttgccccggccgcctccggctgtactagtagtagctgctttcttggcggcggcggtggcggcggcgagcttggccctggaggcggccagcgatatggatctcccggatccgcctgctcctcctcctcctttaccctcgaatctggccttggacaaggacgacgacgacatctccggcagctcaactgcgagcgacagacacaagaagaagaagaagaagaagaagaagcagcagcagcagaggaaaggggaaattcagatcaggagcagcacgcgctcggacgcgtgg

SEQ ID NO: 25782 - DNA, 974 bp, Triticum aestivum
  Clone ID: PAT_TA_25782
ctaacatactatattcttttggcatatattcccccaaaagactaataccttcatgtgactgtacagtaaaacacagaatggatgtttctcaaaaaaaaactgaaagtaattgcaagttgtaacataatgagaaaacacatccaaacataaaggagggtccaagaaatacatcgcaacagttgattctaaactgtttgccacgcccctaagaaatactcatcacaacagcctcgagctggctgataagtctactcatcagtcctcatcaggatcacagaaacgaaccggggtctccaacacattggtgaccagctggaccagcaacacgacacgctcctcaagccaggcaatgttaccattacctttgagtacagcatcagcagtatcctttagcattatgctcagctttttgactcgggctaagaccagatcgtcctcggcaagcaatacgcccaaggctaacataaagcgcttcctcagatctaagaggataattgctgagttcttcatgagtaggagggcttccagggcgccctgttccagcttggcttcctgaaccttgagctggggtaacacatcatgctcgagcatttggatttccagcgacaagcgtgccacgaccgagaggttttccagctccgggcatgccaagaacacaaactcctcgatcaccgggcagaggagttcatacgactcgcacgctatgcgcaccgactccaaagagacaagattcacaagctgtatgtctttggagtggcccagctcatcggagcgggcctgcaggtcttggatttgggcatgggagtggatttcgtagaccatcatttccttttggcggcgaagaaggctgcagcagaagagttgctgctaccagctcgggcgggcgggcgggcgggcgtaagatctggagaggacgaggcgtcgggtgatgtgagattgggtcgatagacaggttgcggggaacggcagcgagg

SEQ ID NO: 25783 - DNA, 878 bp, Triticum aestivum
  unsure (1)..(878): unsure at all n locations
  Clone ID: PAT_TA_25783
tttttgagaaaacattacccaagatacatatcatnttaaaatcctttacatacaaacataaagggttggttctaaactgtttgccacgcccctaagaaatactcatcacaacagcctcgagctggctgataagtctactcatcagaataacagaaacgaaccgggatctccaacacatgggtgacctgctggaccagcatcgggacacgcggctttagccagtcaccgccgcaattattttcaagtacaggaacagccatatcctttagcaatatgctcagcagatcgacatgatttgtgaccggatcctcctcgaaacgagatatgcccaaggcttccttaaagcacttattcagatgtaagagcttaattgctgagttcttcacgagtaggatggcttccagggcgccccgttccagcttggcctcctgaaccatgagctggggtaacagatgatgctcgagcttttggatttccagcgacaagcctgccacgaccgagaggatttccagctccgggcatttccaggacgactccatcatcagcgggcagaggagttcatacgactcgcacgctatgcgcaccgactccagagagacaagcttcacaagcatgtgctcattggagtggcccagctcatcggagcgggcctgcagggcttggatttgggcatgggagtggattttgtagaccatcttttccttttggcggactgcagcagaacagttgctgctaccagctcgggcgggcgggcgggcgggcgtaagatctggagaggacgaggcgtcgggtgatgtgagattgggtcgacagggggttgcggggaacggcggcgaggcgatggagtgcgggggggctcgtgccgaattcggcacgag

SEQ ID NO: 25784 - DNA, 734 bp, Triticum aestivum
  Clone ID: PAT_TA_25784
ccgccgcaacccacaagccagatcgggaaggggatcgccagacctagggtttcgacgaaatcgatctacatggagaaggaggcttcgatcccgattgacaaggaggattcgatccagacggagaaagaggcggcgcctgctggtgggtgctgcgacccccgattggttgaggctcgacctgtatctggttgatggatacgggttcaaggagcagaggatggtgaagatggaccatcggaacggctacatcaagtggctgctcgagtgggacaagaagccgcgccctcccctgcccaacctccccgaggagtgccgcgaggccatggacgccatcaaggctcagcgcgaccacgacgagagggtcctcgcccgacttcaagcgcgacgggctacgcctacgtccaggtcgatgtcttcaacgacgacgacccaagggccaacctccccgaccaccactacgacatcatccacgacgacagcgacgaagtaggccaagaagcggaacgcatcctaggccgtctctaatcttattagaagatccgtcgatgcgtcctaaatattgaagttccatagacgacgatacttagttgtgctattagatcgaccttaattagttagttgtgttgtatgttgctgtccttgtaccttttcagtttaagatgtttgttgaacgatgtgcgttgcgttgtttgctttcacagcttgctggtgtcgtttaattgctgatgtttgtt

SEQ ID NO: 25785 - DNA, 1001 bp, Triticum aestivum
  Clone ID: PAT_TA_25785
cgatggagggaggagtgatctcgttgccggcgccggcgccggtttcttgcctcgccaacagggagttccaggccacccccacccccagcccgtccgacgagtcgacggtcctccgcgagctgaacgtttccgtctccctcgccggtctggacatctcccgcggccaccacggcgagccggacgtcctgggccagagacgcagcaagtgcaagcccaaggtccggacagtctccaagatgcacatggcggccaaggccaaggccagggcggagaaggcggcggcggcggcgctcgacaagggccaaggcggggaagaaggcggcgctcgacaaggccaaggcggagaagaaggcggcggccgacaaggccaaggcggagaaggcggcggcggcggcggacgacaaggccaaggcggagaaagaggcggcgcctgctggtggtgctgcaacccccgattggttgaggctcgacctgtatctggttgacgggtacgggttcaaggagcagaggacggtgaagatggaccatcggaacggctatatcaagtggctgctcgagtgggacaagaagccgcgccctcccctgcccaacctccccgaggagtgccgcgaggccatggacgccatcaaggctcagcgcgaccacgacgagagggtcctcgccgacttcaagcgcgacggctacgcctacgtccaggtcgacgtcttcaacgacgacgacccaagggccaacctccccgaccaccactacgacatcatctacagcgacgaagaagcttgatctactgagcaacatctatctatcgatcgatctatttatctaatgtatgccatggattagtgtgtgattcctcaggatctactgcgtctttaagtttatgtctacaaggacgatgttatatcgtagctctgtagtgtgtcctctggcttttgcaacccggcaagctactatctatctatctaaaaaaaaaaaaaaaaaaactcgagggggggcccgggtac

SEQ ID NO: 25786 - DNA, 999 bp, Triticum aestivum
  Clone ID: PAT_TA_25786
gagcagaacagcaagctttattcatcaacccggatgtcttcagacatatgtttcatagtatttaggcataacacgccaaacacggggaatgtaagagcatgatacacgatatgtttatagttgcagtaacattctgggtgattttacataatgaaccgctacacaaactgttgatggttgcatatgccgcaggcttaggtaacgaggtcatcagctatagcacagcagagtttcttcaggtcttcaaattcaccatcttggaacgagaacgaagccatcctattggaaattccggtctcagaagctcggtcaaaatcaactttggtttgataaacaaagtagccgcagcactcccaggcagaaagatagcagccagtgaccagatttttcacctgggggaataagaaaacatttctgccattgttggacatcattaggctgtgcacagtatttttctcatgcaaagctaaacatgcttcactgactacatcgacaagtgcatttacattggtgcggtgaacacaagtgcttttagagggtaatcaactatttcagacacacaaatgcctgatctggttgccccatcatataatgcaacagttgaggcagactccactggtaaaggattagcaaagtaacaggcctgaaaaaacatgtgctttggcacaatagatgtaccatcatcaaagaaaacccggaacgctgtactgtttacttcagaggcaatctttgtaatcagcccaaacatccttttatcccaaaaggaagatagctgattagttgaatttgggaccaagaaaatgtgaccatattcaacaggatatgcattcgcaatcagcagtaccccattgtttgggggtgtagttgaaggaacaacctccggttcagatcttctccttctgcaatgcacaaaagtaattcctcaagcttttagcagaatttggcttcaagcatccaaaaggatggccgaacttgtcatttttttgaggggaaatgtat

SEQ ID NO: 25787 - DNA, 992 bp, Triticum aestivum
  Clone ID: PAT_TA_25787
ctagtctcgagtttttttttttttttttgagaaaacactacccaagatacatatcatttaaaatccataggagggtccaagaaatacatcggaacatttgattctaaactgtttgccacgcccctaagaaatactcatcacaacagcctcgagctggctgataagtctactcatcagaatcacagaaacgaaccggggtctccaacacaatggtgaccagccgggccagcaccgggagacgcacctgaagccagaaaatgttacctcggagtacattaacaacaatatcatttaacattctgctcacatcttcggctcggcctgagaccagatcctgcaatacgcccttggcttccttatagcacttcgccagatgtaagagcttaattgctgagttctgcatgactaggagggcttcccaggaagccccgttccagcttggactcctgaaccatgagcttgggtaaaacatcatgctcgagccttttggatttccagcgacaaaggttgccacgaccaagagggaatccagctccgggcatgccaaggacatcggctccttggtcagcggccagaggagtgaatacgactcgcgcgctatgcgcaccgactccagagagacaagattcacaaccatgtcctcattggagtggcccagctcatcagagcgggcctgcagggcttggatttgggcatgggagtggatttcgtagagcatcttttccttttggcgacgaagaagactgcagcagcagaacagttggttgctgcataccagctcgggcgggcgggcgccccgccgtaagatttggagaggacgaggcgtcgggtgatgtgagattgggtcgatagacaggttgcggggtgttttggtacgagtggtcagggttattctgtgcgagttgacattcgtggaacatcagtggattatgggtcacgtcacgtctaagtaatacaagtattattctaaatcaaaaaaaaaaaaaaaaaaa

SEQ ID NO: 25788 - DNA, 1239 bp, Triticum aestivum
  Clone ID: PAT_TA_25788
ccacgcgtccgagaagtagccaagatacatagccatggctgccatgcacgagagcactccggcgctccttgtgctcttcctgtcgctgatgctcctttccacgccctcttccgcgcgccacatgactggtgatccagcaccggttatcctgcccccgccggacatgcccggcgacccattaccggttattccatccccgccgccccacatggctcctccaacaaaggagggagggtgggaaggcattatgatggcaccgaggcccgttccttctggaccagaccctatacaccattgtcctcccgccccggctccctgcaggcctcctccatcaacggaggaggcgaggaaaggtgccatggtggcaccgaggcctgttccttccgggccaaatcctatacaccatcgtcctccccacaggcctcctccatcaatggaggagatgagggaaggtgtcatggtggcaccgatgcctattccttccgggccagaccctatacaccattgtcctcccgccccggctccctgcatgcctcctctatcaacggatgaggcgaggaaaggtgtcatggtggcaccgaagcctgttccttccgggccagaccctatacaccatcgtcctcccaccccgggctccccacaagccccctccatcaacggaggaggcgagggaaggtgtgatggtggcaccgaggccggttccttctggtccgaaccctatacatcactttcccgccccggcgccacaaccccaccatcattaccgatgtcatgccccaccgcctgcatcaacagaggaggcgagggaaggcgatgtcatggcgccgaggccggttccttctggatcgaacttcatacataatcaacccactctagcgctgcaacccaaccatcatcgccgatgcaaggccccaccgccggcatcgatggaggaggccagggaaggcgacaacatgtcaccatggaggccacttcctgtttccggaccgaacccaaaccacaaccaccacgcaaaggcaccggctcctcctcatgagtaacgattgccctcgtggtgacacatgcgccttttacatttagttacaccagaagcactagcaaataagagataaattagtgcaccgattgaataatgggcatgtaacctggattgttatctttgatcattctatcggcactccatttcgccatgtctgaatattatcgagtgataacatgcaagatgattttactataaaa

SEQ ID NO: 25789 - DNA, 889 bp, Triticum aestivum
  Clone ID: PAT_TA_25789
gccggccgggtctggaaacacagtatccaccgccgcaaccaacccagccagatcgaaaaggggatcgagaggtccaaaaagaaaaggggatcgagcgacttagggtttcgatggagaaggcggcttctttctcgacggagaaggcggcggcgcctgcatcccacccgtggttgaggttcgacctgtatgtggaggggtatccgatcaagaagcagaagatggtgaagctggaccatcggaacagctacatcaagtggctgctcgtgtgggacaagaagcctcgccgtcccctgcccaacttcccagagaggctccgcaaggtcacggacgccatcaaggccgagcgcgacgagaacgagagggtcctcgccgacttcaagcgcgacggctacgcctacgtccaggtcgacgtcttcaacgacgacgacccgagggccaaccttcccgaccaccactacgacatcatccatcacgacagcgacgacgaccaaggcgaacaagcggagcacattctaggccgtctctgatcttgttagaagagacgacgatgcgtcgttcaatatcgaagttccaacataagacgacgatacacgacgtcttggctgctagatagtgttacctagtcgtgcttaatgttgtcttaatcatcctattaaagctatcttaattagctgcgttgtatgatggtctgttgtctttcttataatgttgtgtgttatctcagttcttctttcttatatatagcaattccatgtctcgtgtctgctattgggcttctgtatctatgtttcgctttctgccggtgagattgctctgaaagcaaatttccagaaatctaaataataaaaagttcagaaagcaacaaaaaaaaaaaaaaaaaaggccccta

SEQ ID NO: 25790 - DNA, 1480 bp, Triticum aestivum
  unsure (1)..(1480): unsure at all n locations
  Clone ID: PAT_TA_25790
taccggtccggaattttccggtcgacccacgcgtccgtcacacttccttacgtctacccgagtcgcccgaaaagcccagcactttcttcccttccgatttctcacgatggcgactctcctccgccgatccgccgcccccgcgcggcagctcctcctccttccccgccagctcggcggcgcccgctccatgtcccgctactacgcccgtgacgaggtttcacggttcgacgcgctgagcacgccggtgaactggggcgtgagcatcgtgccggagaagaaggccttcgtgattgagcgcttcggcaagtacctcaagacgctcgactccgggatccacggactcgtccccctcgtcgaccgcatcgcctacgtgcactctctcaaggaggaagccatccccatccccgaccagtccgctatcaccaaggataacgtggtcatccagatcgacggcgtcctctacgtcaagattgttgatccctaccgtgcttcatatggcgtggagaatcccatttttgcagtcattcaacttgcgcagacaactatgagaagtgagcttggaaagataaccttggacaagacttttgaagagagggacacattgaatgagaagattgtgaggtccataaatgaggcttcgacagactggggcttgaagtgtcttcgttatgagatcagggacatttctcctccaccgggcgtgaagaatgctatggagatgcaagcagaggcagaaaggagaaagcgtgctcaaattctccagtcagaaggggctatgttggatcaggcaaaccgcgccaagggtgaggctgaagcgattctttccaagtcacaagctacggccgaagggattagaatggtctcagagtccatgagagctgaaggcagtgctgaggctgcaaaactgagaattgctgaacagtacatcacagcatttgctgctctggccaagaataccacgacaatgcttcttccaagcgatgctggcaacccatcatctatgatagcccagtctctccagatatacaagcatataagccagtccagcagcctgaaaggagggaaccaacaggcagaagaagattgaggatgctgtcgacgccgcgatccagtggcttgacgccaaccagcttggtgaggttgacgagtttgaggacaagatgaaggagctggagggcctctgcaaccccatcatcgccaagatgtaccagggtgccggtgctgacatgcccggaggcatggacgaggacgcgccggctgccagcggcggtgctggccccaagatcgaggaggtcgactaagttattctctttgatatagtgagaaaatacactatacgccatttgtttcagtcctgggtgccaatcatatcacctgggctggaagttttgttgtacttttggtctgtagcatcacgagacttgtgtgtaccgtaaacaatgcaatgatgcatgtttggctcattgtnatttcagcttaa

SEQ ID NO: 25791 - DNA, 874 bp, Triticum aestivum
  Clone ID: PAT_TA_25791
agccaagatacatatcatttaaaatccattaataacacatccaaacataaaggagggtccaagaaatacatcgcaacatttgattctaaactgtttgccacgcccctaagaaatgctcatcacaacagcctctagctggctgataagtctactcatcagaatactcatcaggatcacagaaacgaaccggggtctccaacacatcggtgaccagcttgaccagcgattgggcacgctcctgaagacagacaatgtcgcaattacctttgagtacatcatcagcagtatcctttagcattatgctcagctctttgactcgggctaagaccagatcctcctcggcaagcaatacgcccaaggataactgaaagcacttcctcagatctaagagcgtaattgctgagttcttcatgagtaggagggcttccagggcgccctcttccagcttggcctcctgaaccatgagctggggtaacacatcatgctcaagcttttggatttccagcgacaagcctgccacaaccaagaggattttcagctccgagcatgcccagatccacgactcgttgatcagctggcggaggagtgcatacgactcgcacgctatgcgcaccgactccagagagacaagattcacaagcatggacttattggggtggcccagctgatcggcgctggcctgcaggtctaggatgtgggcatgggagtggattttgtagaccatcatttccttttggcggactgcagcagaagagttgctgctaccagctcgggcgggcgggcgggcgtaagatcccgatctggagaggacgaggcgccgtcgggtgattgatgtgagattgggtcgacaggttgcggggaacggcggcgaggc

SEQ ID NO: 25792 - DNA, 1080 bp, Triticum aestivum
  Clone ID: PAT_TA_25792
cattgggaagaaacagactgagtgtgttcatttattcattcattcattattttcacaatataggcattgcttacaacaaaaaggtaaggtctatcttgtctctgaaatcaaatacacagacagacatatatatgtagtcagaacagaagagccaattcgttgttgtacttgtagggtgaaaaacaaaataaataaaagtcgagttagtgatctgaatctgaatcagagatggtattgcttgatgatccatgtagtaggatatgtgctagccggaaagaaacaaacaaacagacagacaggcccattcatcaagttgaggagcagttcagccacccctggaagtggaattggagttggagttgaaattgggtctcttgagcttgacaatgaattctttgtcgtcgtcgtcgtcgtcgctgctgtactcgactcttctcttggccttgccggcggaatgatctgtgttgtgacgcgctgtggaagaagaagaaaccactggtacaggtttcttccagctctctgcaggtttattgttgttattgtgcttgttgacagtggtggaatttgacgacttgatggggatccctgatttgatctgctgctgccgtttgagcttcctgtcgtaggctttcttggctctctccggagataacaggccgtgctccattagccagaattcggccatgtcgctggatgggatctggttggagagcgattgatagaagatcctcaggggctccctctcctctggtgtttcgaacttctggccggtgagggagaagaccttcttggccgccttgcccttgccccgcccgcctccggctgtactagtagtagtagctttcttggtggctgcggcgagcttggccctggaggcggccagcgatatggatctcccggctccgcctcctttaccctcgaatctggccttggacaaggaggaggacgacatctccggcagctcaactgcgagctgcgagcgacgaggatcaagaagaagaagaacaagaagaagaagaggaggaggaaaggggaaattcagatcagcaccggtgcagaggatataatcggacgcgtggg

SEQ ID NO: 25793 - DNA, 655 bp, Triticum aestivum
  unsure (1)..(655): unsure at all n locations
  Clone ID: PAT_TA_25793
cagcagccgccgccagcagctgcgcaaaggctcgacaaaccctaaccctagtccatagctagcttagcttccttcctctcgatctagctagagccatggcgccgaccaaagggcgaggggccggccatcggcatcgacctcggcaccacctactccgtgcgtcggcgtgtggcagcacgaccgcgtcgagatcatcgccaacgaccaagggcaacccgcaccacgccctccgtacgtcgccttcaaccgactccgggagcgcctcatccggcgatgccgccaaagaaccaaggtcgccatgaaccccatcaacaccgtcttccgatgcgaagcgtcttattggcagaaggtttgctgatgcccctgtccaagagtgatattaagatgtggccggtacaaaggttattccctgggccccgcaagacaagcctatgattgtagtgcagtacaagggtgaggacaagcaattctcaactgaagaaattcttcaatggcctcatcaagatgcgtgagatngctgaagcttactaggagtaactattaagaatgcgttgtcacgtgcctgctactcaatgatcccanagnaggaacaagatgcggtgtattccgggctaagtgatcgntcanaacgaccaaagaactcaatgctatggct

SEQ ID NO: 25794 - DNA, 1587 bp, Triticum aestivum
  Clone ID: PAT_TA_25794
ccgggctgcagcagtgtgtgagaagaacgtcctcatctttgacctcggtggtggtacctttgatgtctctcttctcaccattgaggagggtatctttgaggttaaagccacagctggtgacactcatcttggtggtgaggacttcgacaacaggatggtcaaccacttcgtccaggagttcaagaggaagaacaagaaggacatcagtggcaacccgagagctcttcggaggctgaggacatcctgtgagagggcaaagaggactctctcctccactgcgcagaccaccattgagattgactcgctgtttgaaggcattgacttctactccaccatcacccgggctaggtttgaggagatgaacatggatctgttcaggaagtgtatggagcctgtggagaagtgtctcagggatgcaaagatggacaagagcaccgtgcacgatgttgtccttgttggtggttccactaggattccaaaagtgcagcagcttctccaggacttcttcaacggcaaggagctctgcaagagcatcaaccctgatgaggctgttgcctacggggctgctgtccaggctgccatcttgagcggagagggcaacgagaaggtccaggacctgctgctattggatgtcactcctctttctcttggtctggagacagccgggggtgtgatgacagtcttgatcccaaggaacaccaccatccccaccaagaaggagcaggtcttctccacctactcggacaaccagcctggtgtgctcatccaggtgtatgagggtgagaggaccaggacccgtgacaacaaccttcttggcaagttcgagctgtctggcatccctcctgctcccaggggagttccccagatcacggtctgctttgacatcgacgccaatggtatcctgaacgtgtctgccgaggacaagacgactgggcagaagaacaagatcaccatcaccaacgacaagggcaggctgagcaaggaggagatcgagaagatggtccaggaagctgagaagtacaagtccgaggacgaggagcacaagaagaaggtggagtccaagaacgccctggagaactactcgtacaacatgcgcaacaccatcaaggacgagaagatcgcctccaagctgccggcggacgacaagaagaagatcgaggatgccatcgatgctgccatccagtggctggacacgaaccagctcgctgaggcggacgagttcgaggacaagatgaaggagctggaggccctgtgcaaccccatcatcgccaagatgtaccagggtgctggtgctgacatggagggcggcatggacgacgacaccccagctgcgtccggcggccccggccccaagattgaggaggtggactaaacagtcgatgttatgtggtggaggcgacgaagcctgctgctagttattattatgtcgtctcttatccgagacttgaggttgtgatggttattgtttcgctccgagtggtccgagttattccgtgcgggttggaacattcgtggattaaatgggccacgatgtcacgtcttagtaatatattattctagttcgttggtaaaaaaaaaaaaaaaaaa

SEQ ID NO: 25795 - DNA, 828 bp, Triticum aestivum
  Clone ID: PAT_TA_25795
gaattcactaagtgattaagcgtggtcgcggccgaggtgagaactagtctcgagttttttttttttttttttagaagaaatagcaacagcaccacaaaacgttacaggaacaataacagcaattgcatcaaccaaaacacacaggtctctactcaaatttcaagtgcatacttcaagacgtttgcgtaattcaacacgtgcaaccgacaaaaccagatagtacatttcaccattgctcacaccaaaaaggcagttcatacatgaaatcttgcaaaatggcagtatttttcttctcaaacagggatgtaacgtctactacaaaggtagcaaccaagactagttgactagataatgctttactcgtcctcctggctgcggagcctggcaagcttgttggtgaccacgacatccagctgcgcagcacgctcaacgatcgccttgcgcttctgtgtggacacattgtgtgcgatctcggcacagtaggtcctgttgtgcatcataagcagctccagctcagagacattgtggacaacgaacttcttgaacttgttgggcaggtagtgcctggtcttcttgtctgaaccgtacccaatgttgggcatcaaggtgcatcccttgaacttccgcctgacgcgggagtcgataccctttggcctacgccagctttgcttgaggccgatgtagcggtcgctgtgcgccctcttgaagtgcttcaccctcttcttcacgatcgccttcttcagcagaggcaccgccatcttgggagaactgcggcggagcgggcgggcgggcgggcggcggcggcggcggcgtaggggggagggagaa

SEQ ID NO: 25796 - DNA, 745 bp, Triticum aestivum
  unsure (1)..(745): unsure at all n locations
  Clone ID: PAT_TA_25796
ttttttttttcaagtgcatacttcaagacgtttgcgtaattcaacacgtgcgaccgacaaaaccagatagtacatttcaccattgctcacaccaaaaaggcggtccatacatgaaatcttgcaaaatggcagtatttttcttctcaaacagggatgtaatgtctactacaaaggtagcaaccaagactagttgactagataatgctttactcgtcctcctggctgcggagcctggcaagcttgttggtgaccacgacgtcgagctgcgcagcacgctcaacgatcgccttgcgcttctgtgtggacacgttgtgtgcgatctcagcacagtaggtcctgttgtgcatcataagcagctccagctcagagacattgtggacaacaaacttcttgaacttgttgggcaggtagtgcctggtcttcttgtctgaaccatacccgatgttgggcatcaaggtgcatcccttgaacttccgcctgacgcgggagtcgataccctttggcctacgccagctttgcttgaggccgatgtagcggtcgctgtgcgccctcttgaagtgcttcaccctcttcttcacgatcgccttcttcagcagaggcaccgccatcttgggagaactgcggcggagcgggcgggcgggcgggcggcggcggcggcggcatagggtatgtggtcgacatccaacaattatctaagaacctagttacatgcagctaattgtaaagctccctancaggcancagc

SEQ ID NO: 25797 - DNA, 758 bp, Triticum aestivum
  unsure (1)..(758): unsure at all n locations
  Clone ID: PAT_TA_25797
atctattatctttactatattatatcattttggcagtttgcaagaatngggaaaaggcggtacagaaaatctttccataggtgataaataaaggcaaacccggacttcacatcaaagtcgacgtgcccatggtacgatagcatgaccagcatcgatagcaaggtgttcaacagcgtcgaatcctcgaggcgaacagaagagaaaattccagattcggcattaagtctgctacagggaacaaaacgatccaaaagcgctactgttcgaaacatttcactcatcctcctggctgcggagcctggcgagcttgttggtgaccacgacgtcgagctgggcggcgcgctccactatcgccttgcgcttctgggtggacacgttgtgcgcgatctcagcacagtacgtcctgttgtgcatcataagcagctccagctcagagacgttgtgcaccacaaacttcttgaacttgttgggaaggtagtgcctggtcttcttgttagaaccatatccaatgttgggcatcaaggtgcatcccttgaacttacgcctgacacgggagtcgataccctttggcctgcgccagctttgcttgaggccgatgtagcggtcgctgtgcgccctcttgaagtgcttcacccgcttcttcacgatcgccgtcttcaggataggcaccgccatcttgcgaggcgagcggcggcggcggcggcggggatgggagggagtgtgaggggaggaggatgggtctaggtggtgggcaacac

SEQ ID NO: 25798 - DNA, 1396 bp, Triticum aestivum
  Clone ID: PAT_TA_25798
tgtcaaccactttgtccaagaattcaagaggaagaacaagaaggatatcagcggcaatcccagggctctccgtaggctgaggacagcttgtgagcgggcgaagaggaccctctcctccactgcgcagaccaccattgagatcgactcgttgtatgagggcatcgacttctacacgaccatcacccgtgccaggtttgaggagttgaacatggacctcttcaggaagtgcatggagcctgttgagaagtgcctgagggatgctaagatggacaagagcactgtccatgatgttgtccttgttggtggctccaccaggatcccaagggtgcagcagctgcttcaggacttcttcaatggcaaggagctgtgcaagaacatcaacccggatgaggctgttgcctatggtgctgcagtccaggcagccatcttgagtggagagggcaacgagaaggtccaggacctcctgctgcttgatgtcacgcctctttctcttggtctggagactgctggaggtgtcatgaccgttttgattccaaggaacaccaccatccccaccaagaaggagcaggtcttctccacctactctgacaaccagcctggtgtccttatccaggtttatgagggcgagaggaccaggacccgcgacaacaacctgctgggcaagtttgagctctccggcatccctcctgcccccaggggtgtgccccagatcacggtctgcttcgacattgacgcaaatggcattctgaacgtctctgcggaggacaagacgactgggcagaagaacaagatcacaatcacgaatgacaagggcaggctgagcaaggatgagatcgagaagatggtgcaggaggcagagaagtacaagtcagaggacgaggagcacaagaagaaggtggagtcaaagaatgccctggagaactatgcctacaacatgcgcaacactatcaaggacgacaagatcgcctccaagctagctgcggacgacaagaagaaaatcgaggacgccattgaccaggccatccagtggctggacggcaaccagcttgctgaggcagatgagtttgacgacaagatgaaggagctggagggcctttgcaaccccataatcgccaagatgtaccagggtgccggagctgacatggcgggtggcatggacgaggacgatgcgcctccggctgccggcggcgctggccccaagatcgaggaggtcgactaagcgagcacttgtaccagtcttttaccctaaagtttatcccgttcgttatgttggatgctactgcagtacgtggtgttggatgtgagctttgtgtgtgtgaactgcgtttgctgctgcctgcttttctgttaatgttagttacatctggtgatatgctgctattgctcttgtcccctg

SEQ ID NO: 25799 - DNA, 955 bp, Triticum aestivum
  Clone ID: PAT_TA_25799
aaattaaccctactaaagggaacaaaagctggagctccaccgcggtggcggccgctctagaactagtggatcccccgggctgcaggaattggcacgagagccaaggtacatagccatggctgccatgcacgagagcactccgtcgctccttgtgctcttcttgtcgctaatgctctttttcacggcgtcttccgcgcgccacatgactggtgatccaccgccggttattccttccccgccgccccatatggcttctccaacaatggaggaggcgtgggaaggcgtcatggtggcaccgaggccagttccttctggaccggaccctatacaccatcgtcctcatgcccccccgccccacaggcctcccccatcaacgggaggaggcgagggaaggtgtcatggtgggcaccgaggccggttccttctgggtccgaaccctatacatcactttcccgccccggcgccacaaccccaccatcatcaccgatgtcatgacctaccgcccgcatcaacagaggaggcgtgcgaaggcgatatcgtggcgccgaggccagttccttttggatcacaccccatacataaccaccctgctccagtgcctcaacccaaccaagcatcgtcgacgcaaggccccaccgcctgcatctttggaggaggggagggaaggcgacaacatgtcaccaaggaggccacttcctgttttcggaccaaacccaaaccataaccaccccgccaaggcaccgggctcctcctcatgagtaacgattgccctcgtggcaacacatgcgccttttacatttagttacaccggaagcactagcaaataagcagataaatcattgcatcgattgaataatgggcatgtaacctggattgttatctttgatcattgtatgggcactccacttcgccatgtctgaatattatcgagtgataacatgcaaggtgcttccct

SEQ ID NO: 25800 - DNA, 1109 bp, Triticum aestivum
  Clone ID: PAT_TA_25800
gcgaatacctcctgtgactgtacagtaaaacacagaatggatgtttctcaaaaaaagaaaaaaactgaaagtaattgcaagttgtaccctactagcacagaatgagaaaacactacccaagatacatatcatttaaaatccattaataacacatccaaacataaaggagggtccaagaaatacatcgcaacatttgattctaaactatttgccacgcccctaagaaatactactcatcacaacagcctcgagctggctgataagtctactcatcgtcctcatcaggatcatagaaacgaaccggggtctcccagcacattggtgaccagatggaccagcaacaggacacgctcctcaagcccaggcaatgttaccatcacctttgagtacagcatcagcagtatcctttagcattatgctcagctttttgactcgggctaagaccagatcgtcctcggcaagcaatacgccccaaggctaacataaagcgcttcctcagatctaagaggataactgctgagttcttcatgagtaggagggcttccagggcgccctgttccagcttggcttcctgaaccttaagctggggtaacacatcatgctcgagcatttggatttccagcgacaagcgtgccacgaccgagaggtttttcagctgcgggcatcccccagaacacaaactccttgatcagcgggcagaggagtgcatacgactcgcgcgctatgcgcaccgactccagagagacaagatccacacccattatgccttcgggggtggcccagctcatcggagcgggcctgcaggtcttggatttgggcatgggagtggatttcgtagagcatcatttccttttggcggcgaagaaggctgcagcagcagaacagttggttgctgctaccagcacaatcggaacgagcaactccggaggcggagggagaccacgctggctggatccgagacctacgaaccagcgccgcgcctaccaaccaatcgtaactccaagctgatcgggatgtacaagcatgtgctcacctcgggcagggatctgatctggagaggaggacgaggcgtcggttgatgtgagattgggtcgatagacaggttgcgg

SEQ ID NO: 25801 - DNA, 1473 bp, Triticum aestivum
  Clone ID: PAT_TA_25801
ttaataacacatccaacataaaggagggtccaagaaatacatcgcaacatttgattctaaactgtttgccacgcccctaagaaatactcttcacaacagcctcgagctggctgataggtctactcatcagaatcacagaaacgaaccggggtctccaacataatggtgaccagcccggccagcaccgggagacgcgcctgaagccaggaaatgttacctcggagtacatgaagaacaatatcatttaacattttgctcacatcttcggctcggcatgagaccagatcctccttggcaagcaatacgcccaaggattccttaaagcacttcgccagatgtaagagcttaattgctgagttcttcatgagtaggagggcttccagggcgccccgttccagcttagactcctgaaccatgagctggggtaacacatcatgcttgagcttttggatttccagcgacaagcctgccacgtccgagagggaatccagctccgggcatctccaggagctcgactccatgatcagcgggcagaggagtgcatacgactcgcgcgctatgcgcaccgactccagagagacaagcttcacatccatgtgctcattggagtggcccagctcatcagagcgggcctgcaggtcttggatttgggcgtgggagtggatttggtagagcatcatttccttttggcggtagcagcaactcttctgctgcagtccgccaaaaggaaatgacgaagctctacaaaatccgctcccatgcccacatccgagccctgctggcccgcgccgatgagctgggccgctcccataagttcatgcttgtgaatcttgtctctctggagtcggtgcgcatggcgcgcgagtcgtatgcactcctctgcccgctcatcatggaggcgatgttctggtcatgcggggagctggattccctctcggtcgtggcaggcttgtcgctggaaatccaaaagctcgagcaagatctgttaccccagctcatggttcatgaggccaagctggaacggggcgccctggaagccctcgtactcatgaagaactcagcaattacgctcttacatctgagtaagtgctttaaggaagccttgggcgtattgcttgccaaggaggatctggtctcagaccgagtcgaacagctgagcataatgctaaaggatactgctgttaatgtactcgaaggtaaatgcaacggtgtctggcttccaggggcgtgtcctgtggctggtccagctggtcaaccatgtgttggagaccccggttcgtttctgtgatcctgatgagtttcctgatgagctagacttatcagcctgctcgaggctgttgtgatgagtatttcttaggggcgtggcaaacagtttagaatcaaatgttgcgatgtatttcttggaccctcctttatgtttggatgtgttactaatggattttaaatgatatgtatcttgggtagtgttttctc

SEQ ID NO: 25802 - DNA, 1781 bp, Triticum aestivum
  Clone ID: PAT_TA_25802
tgaggagaacagcaagctttattcatcaacccggatgtcttgagacatatgtttcatagtatttaggcataacacgctaaacacggggaatgggagagcatgatacacgatatgtttatagttgcagtaacattctgggtgattttacataatgaaccgctgcacacattgcttgatgcttgcatacggtgcaggcttaggtaacaaggccatcagctatagcgcagcagagtttcttcaagtcttcaaagtcaccatcttggaacgagaacgaagccatcctattggaaattccggtctcagaagctcggtcgaaatcaactttggtgtgataaacaaagtagccacagcactcccaagcagaaagacagcagccagtgaccagatttttcacctgggggaataagaaaacatttctgccgttgttggacatcattaggctgtgcacagtattgttctcatgcaaagccaagcatgcttcactcactacatcgacaagtgtatttacattggtgctcgtgaacacaagtgcttttagagggtaatcaactatttcagacacacaaatgcctgatctggttgccccatcatataatgcaacagttgaggaagactccactggtaaaggattggcaaagtaacaggcctgaaaaaacatgtgctttggcacaatagatgtaccatcatcaaagaaaacccggaacgctgcactgtttacttcagaggcaatctttgtaatcagcccaaacatccttttatcccaaaaggaagatagctgattagttgcatttgggaccaagaaaatgtgaccatattcaacaggatatgcattcgcgatcagcagtactccattgtttgggggtgtaatcgaaggaacaacctccggttcattattttctccttctgcgatgcacaaaagtaattcctcgtagcttctagcagaatttggcttcaagcatccgaaaggatggccgaacttgtcatgtttcttgaggggaaatgtattccatttatcattcatctgaataacaaaatccctttgaccttcaatgaccttaagttcacaagcagtaacatcatatcccatgtggcccttctgggcaaagttctcccactgagaaagaatgagtgtatcaagtaaacttgggctgccttgaccagcatatgcaaagcttttgagggcatcgtgttcacgctgttctataccaagacggtaaagatgtatcttcacaccttcaggttgatccagaggagagttcttgctgtgaaaacaatatccaccttctagtttggtggctgacaccatacttacaattcttattattatggactactaactgaactaactataatgctaaaggcctacttcagacttgtgcagcagcaccaccaccagcaaggtaggtgagatcagaaggatgcccccctgcagatgggagggcaccacggccaccgtggaaagaaggcgatgcaagcagaaacttaggaaagcgatggacacattgtcttccccttcttagtgtaacacgggttgctttccttagagccgtggctgatcttctgaagccagccctgccggaccagctatccaattttgcaggatcaacttggctcttcttctaggagctccccacaagttctccgatcataaaatgcagtatttttgcaggacaatctggctcgggtgggtgggtgggtgtccgtccgtccggccaagaagtagaagaggaaagggagcgggggagagggatgtttgcgctggagaggagaggagtttggag

SEQ ID NO: 25803 - DNA, 1118 bp, Triticum aestivum
  Clone ID: PAT_TA_25803
ttttttttttaaaacaaagcagtagagcatttacggattcaccaaactaagggacgaacacacaccacttagacaaaaggtggtagtaaaagaaacttgaaaccgaaggacatttatggattcaaactaagggacgcgcacacactacactacttagacaaaaggtggtagtaaaagaaacttgaaaacgaaggctctactggacctccactaggagttaaagtttattgtcgccgccatgctcggagtgacggcatggatggcacgagaacgcgatacgtgtgcacgtcgcaccgaggacgcgcccgcggtcggtcacgtgggacgcccggccgctcacatcttgcccttgcggtgggcgcaggaggaactcaccctcctttttaagccgttgtgtacgcacctgtcccagcgatccagtgtacgtagttttgttttggctgtttgctgtcttcaagagacaaagcaagtttctgatttagaggttgataccattaacaaaattttagcctgctagtcgttactgataataacagcatgttcatatcataaaagtaacagatgagtaaacaagctcccagagcaaacagtttccaacaagcaaagcggccataatagcactggaagaacatttcactcgtcctcctggctgcgaagcctagcaagcttgtttgtgacaacaatatccagctgtgcagcacgctccacaatgtccttccgcttcttggtagagacgttgtgggcgatctcagcacagtatgtcctgttgtgcatcataagcagctccagctcggagacattgtggacaacaaacttcttgaacttgtttggcaggtaatgcctggtcttcttgtcagaaccatagccaatgttgggcatcaaagtacatcccttgaactttctcctcacccgggaatcaataccctttggcctgcgccagctggtcttgaggccaatgtagcggtcgctatgggccctcttgaagtgcttgaccctcttcttcacgatcttcctcgtcagaagcggcaccgccatctctgatctgagaaggacgaccctctaacacgaagcgaggaggaagaagaacggcggcggcggcagggttccggacgcgtggg

SEQ ID NO: 25804 - DNA, 658 bp, Triticum aestivum
  Clone ID: PAT_TA_25804
cagcaattggcaatcggatctagattataaaggcaatagtagatctttgacacattacagtcggcactggtagcaaaaaggttggaataacagatacccctgacagtcacaaaacgaacagcggaatactttcctacatacgaaccagaccaaaacatacttctgacagacagtctactcgtcctcctggctgcggagcctggcaagcttgttcgtaaccacgatgtcgagctgagcagcacgctcaacaatgtccttgcgcttcttggtggagacgttgtgggcgatctccgcacagtaggtcctgttgtgcatcataagcagctccagctcagagacattgtggacaacaaacttcttgaacttgttgggaaggtaatgcctcgtcttcttgtcagaaccgtagccaatgttgggcatcaaggtgcatcccttgaactttctcctgacacgggaatcgataccctttggcctgcgccagctttgcttgaggccaatgtagcggtcgctatgggccctcttgaagtgcttgaccctcttcttcacgatcttcctcgtcagaagcggcaccgccatctttgatcttcgggagcgaacgaccctaaccctaacacgaagagcggaggaagaagagcggcggcgggccggcccggccggc

SEQ ID NO: 25805 - DNA, 1413 bp, Triticum aestivum
  Clone ID: PAT_TA_25805
ttttttttttgtaaaacaaagcagtagagcatttacgattcaccaaactaagggacgcacacactacttagacaaaggcagtagtaaaaggaacttgatcctcaaaaaaagtaaaaaggaaattgaaaacgaaggttctactggagctccactaggagttaaaagtttattgtcgccgccatgctcggagtgacggcatggatggcacgagaacgcgatacgtgtgcacgtcgcaccgaagacgcgcccgcggtcggtcacgtgggacgcccggccgctcacatcttgcccttgcggtgggcgcaggaggagccgacgcacccttccacgcacttctcgacgcacttgtccacccgctccgccgcgcgctccttggccagccggtccttctcctcgaagtacacggacgccgccttctccgccgcgcgctccttcaccgcgcgctcgtcctcgctgcccagccggaggccgtgccctccagcgtcgtgctgctgcgtgcccgagccaaccgtcagcttctccttgatcgcgcccgtcatgttgcccagcgccccgaacagaccggtcccttgctgacccctatcggcatcgtgggtctgcgtggtcgccatggacctgtccctggcttcctgcgcggtccccttggtggcgtccgtgtactcgccggccttctgctgtgtcacgtccttggcctgcctcgccttctcggcggcggcgtccttcgtctggtgggccttctgcatggtgctgtccttggcctcctgcgtcttcccggcacaaggcgtccttgtactctcccagcttgttcttggtagcctcagcggtctcactcgtcttctgcgccacggtgtccttggcctccgtcgccttctcgacggtgtagtccttggcctcgccgagcttgttcctggtggcctccgccgtctcgctcgtcttgtgcgcgacactgtcgttgctctccttggccttctcggcggtgtagtccttgtactcgccgagcttgttcccggtggcgtccgccgcctggtaggtcttgtctgcggcggtgtccttggcgccgccgaacgtgcggccaaccgcgcttgccagggacttggcgccctcctgcatgctccccaggatgccgccgacgccgccgctcgggtgctcggcgtaggcaccgccgcccagtgcgccgtgctcgcgatccgcgcgggcgcgcgcgatctcgtccgccgcgcgtcgcgcgtccatctccgcctgcatcacccgctcgtcccgcgcgcgcgcgatctcgtccgccgcgcggcgagcgtcggcctcggccctcgcctcacgctggtcctgcctcgacgacatggtcgcgcgctgtggttgaacttctctggaacttgctcgctcgtgctggtgctgtagtgttggctgtagtgttgc

SEQ ID NO: 25806 - DNA, 2004 bp, Triticum aestivum
  Clone ID: PAT_TA_25806
tctatggtcctcatcaagatgcgcgagattgcagaagctttccttggcaccactgtgaagaatgctgttgtcactgtacctgcatacttcaatgactcgcagaggcaggctaccaaggatgctggtgtcattgctggcatcaatgtcctccgtatcatcaatgagccaacagctgctgccattgcttatggtcttgacaagaaggcttccagtgttggtgagaagaacgtcctcatctttgaccttggaggtggtacctttgatgtctctcttctcaccattgaggagggtatcttcgaggttaaagccacagctggtgacactcatcttggtggtgaggactttgacaacaggatggtcaaccactttgttcaggagttcaagaggaagaacaagaaggacatcagtggcaacccaagagctctgcggaggctgaggacatcctgtgagagggcaaagagaactctctcctccactgcccagaccaccattgagattgactcgctgtttgagggcattgacttctactccaccatcacccgtgccaggtttgaggagatgaacatggatctgttcaggaagtgtatggagcctgtggagaagtgtttgagggacgcaaagatggacaagagcaccgtgcacgatgttgtccttgttggtggttccactaggattcccagagtgcagcagcttcttcaggacttcttcaacggcaaggagctctgcaagagcatcaaccctgatgaggctgttgcctacggagctgccgtccaggctgccatcttgagcggtgagggcaacgagaaggtccaggacctgctgctattggatgtcactcctctttctcttggtctggagacggctggaggtgtaatgacagtcttgatcccaaggaacacaaccatccccaccaagaaggagcaggtcttctccacctactcggacaaccagcctggtgtgctcatccaggtgtatgagggtgagaggaccaggacccgtgacaacaacctccttggcaagtttgagctgtctggcatccctcctgcacccaggggagttccccagatcactgtctgctttgacatcgacgccaatggtatcctgaacgtgtctgccgaggacaagacgactgggcagaagaacaagatcaccatcaccaacgacaagggtaggctgagcaaggaggagatcgagaagatggtccaggaggctgagaagtacaagtctgaggacgaggagcacaagaagaaggtggagtctaagaacgccctggagaactactcgtacaacatgcgcaacaccatcaaggacgagaagatcgcctccaagctgccggcagacgacaagaagaagatcgaggacgccatcgatgctgccatccagtggctggacacgaaccagctcgctgaggcggacgagttcgaggacaagatgaaggagctggaggccctgtgcaaccccatcatcgccaagatgtaccagggtgctggcgccgacatggagggcggcatggatgacgacaccccggctgcatccggcggcgctggccccaagattgaggaggtcgactaagctagtcgatgttctgtggcagagacctgctgcttagttattattatgtcgtgccctatcgttatctgagactgggttgtggtggttattgttttggtccgagtggtcagggttattccgtggagtaaacattcgtggaacatcagtggattatgggtcacgtcacgtctaagtaatatattaatctaaatcatccagtggattatgctgcttgtagcaatcaagcttatactttgtgcaagccagttgttttagcacttgttgctgatactgtgtgccgatttgaacacttctggactgacctttggattggcgtcatttaatttttgcgctgatggctcttttgagatccatctgcttttttagttctagtttacttctgtacatcttcgaagttcaatgtttttttaatacaaaaaaaaaaaaaaaaaa

SEQ ID NO: 25807 - DNA, 1582 bp, Triticum aestivum
  Clone ID: PAT_TA_25807
tagcgtggtcgcggccgaggtacctttgatgtctctcttctcaccattgaggagggtatcttcgaggttaaagccacagctggtgacactcatcttggtggtgaggactttgacaacaggatggtcaaccacttcgttcaagagtttaagaggaagaacaagaaggacatcagtggcaacccaagagctcttcggcggctgaggacatcctgtgagagggcaaagagaactctgtcctccactgcccagaccaccattgagattgactcgctgtttgagggcatcgacttctactccaccatcacccgtgccaggtttgaggagatgaacatggatctgttcaggaagtgtatggagcctgtggagaagtgtttgagggacgcaaagatggacaagagcaccgtgcacgatgttgtccttgttggtggttccactaggattcccagagtgcagcagcttctccaggacttcttcaacggcaaggagctctgcaagagcatcaaccctgatgaggctgttgcctacggagccgccgtccaggctgccatcttgagcggagagggcaacgagaaggtccaggacctgctgctgttggatgtcactcctctttctcttggtctggagacggccgggggtgtgatgacagtgttgatcccaaggaacaccaccatccccaccaagaaggagcaggtcttctccacctactcggacaaccagcctggtgtgctcatccaggtgtacgagggtgagaggaccaggacccgtgacaacaatctccttggcaagttcgagctctccggcatccctcctgcacccaggggagttccccagatcactgtctgctttgacatcgacgccaatggtatcctgaacgtgtctgctgaggacaagacgaccgggcagaagaacaagatcaccatcaccaacgacaagggcaggctgagcaaggaggagattgagaagatggtccaggaggctgagaagtacaagtctgaggatgaggagcacaagaagaaggtggagtcgaagaacgccctggagaactactcgtacaacatgcgcaacaccatcaaggatgagaagatcgcctccaagctgccggcggacgacaagaagaagatcgaggacgccattgacgctgccatccagtggctggacacaaaccagctcgctgaggcggatgagttcgaggacaagatgaaggagctggaggctctgtgcaaccccatcatcgccaagatgtaccagggtgctggtgccgacatggagggcggcatggacgatgacaccccggctgcttccggcggtgctggccccaagatcgaggaagttgactaaacgagttgatgttctgttgcaaaggcggtgaagcctgcttcttagttattatgtgtgttctatcgttatcttagactgggttgtggtggttattgttttggtacgagtggtcggggttattctgtgcgagttaacattcgtggaacatcagtggattatgggtcgtcacgtctaagtaatatatattattctaaatcatctggtgcttttgggtactatcaaaaaaaacggacgcgtgggtcga

SEQ ID NO: 25808 - DNA, 1595 bp, Triticum aestivum
  Clone ID: PAT_TA_25808
gttgatcagggaaccggaactcgctgccgaaaccacgagactgctgcagagtctgcgcaaaggcctggtacctcggccgaggtggagggtatcttcgaggttaaagccacagctggtgacactcatcttggtggtgaggactttgacaacaggatggtcaaccacttcgtccaggagttcaagaggaagaacaagaaggacatcagtggcgacccaagagctctgcggaggctgaggacatcctgtgagagggcaaagagaactctctcctccactgcccagaccaccattgagattgactcgctgtttgagggcattgacttctactccaccatcacccgtgccaggtttgaggagatgaacatggatctgttcaggaagtgcatggagcctgtggagaagtgtttgagggacgcaaagatggacaagagcactgtgcacgatgttgtccttgttggtggttccactaggattcccagagtgcagcagcttctccaggacttcttcaatggcaaggagctttgcaagagcatcaaccctgatgaggctgttgcctatggagcagctgtccaggctgccatcttgagcggagagggcaacgagaaggtccaggacctgctgctgttggatgtcactcctctttcccttggtctggagacagccgggggtgtgatgacagtcttgatcccaaggaacacaaccatccccaccaagaaggagcaggtcttctccacctactcggacaaccagcctggtgtgctcatccaggtgtacgagggtgagaggaccaggacccgcgacaacaacctcctcggcaagtttgagctgtcgggcatccctcctgcacccaggggagttccccagatcacggtctgctttgacatcgacgccaatggtatcctgaacgtgtctgctgaggacaagacgaccgggcagaagaacaagatcaccatcaccaacgacaagggcaggctgagcaaggaggagattgagaagatggtcaggaggctgagaagtacaagtcagaggatgaggagcacaagaagaaggtggagtccaagaacgccctggagaactactcgtacaacatgcgcaacaccatcaaggacgagaagatagcctccaagctgccggcggatgacaagaagaagatcgaggaggccatcgactctgccatccagtggctggacacgaaccagctcgctgaggccgatgagtttgaggacaagatgaaggagctggaggccctgtgcaaccccatcatcgccaagatgtaccagggtgctggcgccgacatggagggcggaatggatgacgacaccccagctgcatctggcggtgctggacccaagatcgaggaggtcgactaaacgggtcgatgttctctggcagaggcggcgaagcctgctgcttggttattatggtgtcctattgttatctgagactagttgtggtggttattgttttggtcccgagtggtcgggggttatgctgtgcgagttaaacattcggtggaacatcaggattatgggtcacgtcacgtcgaagtaatatagtattattctaaatcatccggtgcttttgggcagttcact

SEQ ID NO: 25809 - DNA, 1496 bp, Triticum aestivum
  Clone ID: PAT_TA_25809
tacaggttaattccgttaacgaacgagacctcagcctgctaactagctatgcggagccatccctccgcagctagcttcttagagggactatcgccgtttaggcgacggaagtttgaggcaataacaggtctgtgatgcccttagatgttctgggccgcacgcgcgctacactgatgtattcaacgagtatatagccttggccgacaggcccgggtaatcttgggaaatttcatcgtgatggggatagatcattgagattgactcgctgtttgagggcattgacttctactccaccatcacccgggccaggtttgaggagatgaacatggatctgttcaggaagtgtatggagcctgtggagaagtgtctcagggatgcaaagatggacaagagcactgtacatgatgttgtccttgtcggtggttccaccaggatcccaagggtgcagcagctgcttcaggacttcttcaatggcaaggagctgtgcaagaacatcaaccctgatgaggctgttgcctatggtgctgcagtccaggctgccatcttgagtggagagggtaacgagaaggtccaggacctcctgctgcttgatgtcacacctctttctcttggtctggagactgctggaggtgtcatgaccgttttgattccaaggaacaccaccatccccaccaagaaggagcaggtcttctccacctactctgacaaccagcctggtgtccttatccaggtttatgagggtgagaggaccaggacccgcgacaacaacctgctgggcaagtttgagctctccggcatccctcctgcccccaggggtgtgccccagatcacggtgtgcttcgacattgatgctaatggcattctgaacgtctctgcggaagacaagaccactgggcagaagaacaagatcacaatcacgaatgacaagggcaggctgagcaaggatgagatcgagaagatggtgcaggaggcagagaagtacaagtcagaggacgaggagcacaagaagaaggtggagtcaaagaatgccctggagaactatgcctacaacatgcgcaacaccatcaaggacgacaagatcgcctccaagctagctgcggacgacaagaagaagatcgaggacgccattgaccaggccatccagtggctggacggcaaccagcttgctgaggcagatgagtttgacgacaagatgaaggagctggagggcctctgcaaccccataatcgccaagatgtaccagggtgccggagctaacatggcgggtggcatggacgaggacgatgcacctccggctgctggcggcgctggccccaagatcgaggaggtcgactaagcgagcacttgtaccagtcttaccctaaagttattccgttcgttatgttggatgctactgcagtacgtggtgttggatgtgatgtgtgtgaactgcgtttgctgctgcttttctgttaatgttagttgcatctggtgatatgctgctattgctctcgtcc

SEQ ID NO: 25810 - DNA, 709 bp, Triticum aestivum
  Clone ID: PAT_TA_25810
cttgaaaagcggcccagaaaatctttccatagctgatgattaaaggcaacccggacttcacgtaaagtcaatgtgcttatagtacgagagcatgaccagcatcgataaaggtgttcaacagcgtcgaatcaacaaggcgaacagagaagaaaactccagattcggcattaagtctactacagggaacggaacaaaatgatccaaaagcgctactgtttgaaacatttcactcatcctcctggctgcggagcctggcgagcttgttggtgaccacgacgtcgagctgggcggcacgctccactatcgccttgcgcttctgggtggacacgttgtgcgcgatctcagcacagtacgtcctgttgtgcatcataagcagctccagctcagagacgttgtgaaccacaaacttcttgaacttgttgggcaggtagtgcctcgtcttcttgttagaaccatatccaatgttgggcatcaaggtgcatcccttgaacttccgcctgacgcgggagtcgataccctttggcctgcgccagctttgcttgaggcccgatgtagcggtcgctgtgcgccctcttgaagtgcttcacccgcttcttcacgatcgccgtcttcaggataggcaccgccatcttgcaaggcgagcggcggcggcggcggcggagatgggagggagtgtgaggggaggaggagtctaggtggtgggcaacgc

SEQ ID NO: 25811 - DNA, 2374 bp, Triticum aestivum
  Clone ID: PAT_TA_25811
ccacgcgtccgcgaaatcagagagaagagaggcaaagcaaatcgcaccaggcgaaacacagagagcgccgccgttaccgtcttccggcgaacccccaaagcgagcgagcgattccaaggagaggagaggaggcggagatggccaagggcgaggggccggcgatcggcatcgacctcgggacgacctactcctgcgtcggcgtgtggcagcatgaccgcgtcgagatcatcgccaacgaccagggcaaccgcaccacgccctcctacgtcgccttcaccgacaccgagcgcctcatcggcgacgccgccaagaaccaggtcgccatgaaccccaccaacaccgtcttcgatgcgaagcggctgattggcaggaggttctctgatccctccgtgcagagtgacatgaagctgtggcccttcaaggtcatccctggcccggcagacaagcccatgatcgtcgtcaactacaagggcgaggagaaacagttcgcagcggaggagatctcctccatggtgctcatcaagatgagggagattgctgaggccttcctcggcaactctgtcaagaacgccgtggtcaccgtcccggcctacttcaacgactcccagcgccaggccaccaaggacgcccggtgctatcgccgggctgaacgtgctgcgcatcatcaacgagcccactgctgctgccatcgcctatggccttgacaagaaggcgaccagcactggcgagaagaacgtcctcatctttgaccttggtggtggcaccttcgatgtgtctctgctgaccatcgaggagggcatcttcgaggtgaaggccaccgccggtgacactcacctgggtggagaggacttcgacaaccgcatggtgaaccacttcgtccaggagttcaagcgcaagcacaagaaggacatcaccggcaacccccgcgctctgcgtcgtctccggacggcgtgcgaacgtgccaagcgcacgctgtcgtcgacggcccagaccaccatcgagatcgactcgctgtacgagggtgtggacttctacaccaccatcacccgggctcgctttgaggagctcaacatggacctcttccgcaagtgcatggagccggtggagaagtgcctccgcgacgccaagatggacaagagcaccgtgcacgacgtggtgctggtcggtggctccacccgtatccccaaggtgcagcagttgctgcaggacttcttcaacggcaaggagctgtgcaagagcatcaaccctgacgaggcagtggcgtatggcgcctccgtccaggccgccatcctgagcggcgagggcaacgagaaggtgcaggacctgctgctgctcgatgtgacgccgctgtccctgggtctggagaccgccggcggcgtcatgacgacgctcatcccgaggaacaccaccatccccaccaagaaggagcaggtcttctccacctactcggacaaccagccgggcgtcctgatccaggtgtacgagggcgagcgcgccaggaccaaggacaacaacctcctgggcaagttcgagctgtcgggcatcccgccggctccccgcggcgtgccccagatcacggtgtgcttcgacatcgacgccaacggcatcctgaacgtgtcggcagaggacaagacgacggggcagaagaacaagatcaccatcaccaacgacaaggggcggctgagcaaggaggagatcgagaagatggtgcaggaggcggagaggtacaaggcggaggacgaggagcacaagaagaaggtggacgccaagaacgcgctggagaactacgcctacaacatgcgcaacacggtcaaggacgacaagatcgcctcgaagctcggggcggacgacaagaagaaggtggaggacgcgatcgagggcaccatcagctggctggacgccaaccagctcgccgaggccgacgagttcgaggacaagatgaaggagctggagggcatctgcaaccccatcatcgccaagatgtaccagggcgctgcgccggacatgggcggcggcatgggcatggacgaggacatgccggccggcggcggtggcgccggccccaagatcgaggaggtggactaagcttttgttgttccgtggtggtctccggtctgcgcgttgcttgatgggtgtcctttcgatgccgctcggtggtgtcagtcgtctgtcgtcgtgtcatctagtagctggaagtagtagtagtagtggttcgttggagtcgttggtctgaaggacatgatggatcatgatgtttgcttgttgttttggaacccttgaagcttagagcttctcgtttaaatttggtgcttccctacttttgatcttttcttactctgttttattttagttcatctgtggttttgctcaaaac

SEQ ID NO: 25812 - DNA, 2317 bp, Triticum aestivum
  Clone ID: PAT_TA_25812
gcctcgtgccgaattcggcacgaggcagagagaggcaaagcaaatcgcaccaggcaaatcacacagagagcgccgccgtcccaatattccggcgaaccccaaagcgagcgagcgattcccaggagaggagaggaggcggagatggccaagggcgaggggccggcgatcggcatcgacctcgggacgacctactcctgcgtcggcgtgtggcagcatgaccgcgtcgagatcatcgccaacgaccagggcaaccgcaccacgccctcctacgtcgccttcaccgacaccgagcgcctcatcggcgacgccgctaagaaccaggtcgccatgaaccccaccaacaccgtcttcgatgcgaagcggctgattggcaggaggttctctgacccctccgtacagagtgacatgaagctgtggcccttcaaggtcatccctggcccggctgacaagcctatgatcgtcgtcaactacaagggcgaggagaagcagtttgctgcggaggagatctcctccatggtgctcatcaagatgagggagatcgctgaggccttcctcggcaactccgtcaagaacgccgtggtcaccgtcccggcctacttcaacgactctcagcgccaggccaccaaggacgctggtgccatcgctgggctgaacgtgctgcgcataatcaacgagcccactgctgctgccattgcctatggccttgacaagaagggcgaccagcacgggcgagaagaacgtcctcatcttcgaccttgggtggtggcaccttcgatgtgtctctcctgaccatcgaggagggcatcttcgaggtcaaggccaccgctggtgacactcacctgggaggggaggacttcgacaacccgcatggtgaaccacttcgtccaggagttcaagcgcaagcacaaagaaggacatcaccggcaacccgcgtgctctgcgtcgtctccgtacggcgtgcgagcgtgccaagcgcacgctgtcgtcgactgcacagaccaccattgagattgactcgctgtacgagggtgtggacttctacaccaccatcaccagggctcgcttcgaggagctcaacatggacctcttccgcaagtgcatggagccggtggagaagtgcctccgtgacgccaagatggacaagagcacggtgcacgacgtggtgctggtcggtggctccacccgtatccccaaggtgcagcagttgctccaggacttcttcaacggcaaggagctgtgcaagagcatcaaccccgacgaggcagtggcgtatggcgcctccgtccaggctgccatcctgagcggcgagggcaacgagaaggtgcaggacctgctgctgctcgacgtgacgccgctgtccctgggcctggagaccgccggcggcgtcatgacgacgctcatcccgaggaacaccaccatccccaccaagaaggagcaggtcttctccacctactcggacaaccagccgggcgtcctgatccaggtgtacgagggcgagcgcgccaggaccaaggacaacaacctcctgggcaagttcgagctctctggcatcccgccggcgccccgcggcgtgccccagatcacggtgtgcttcgacatcgacgccaatggcatcctgaacgtgtcggcggaggacaagacgactgggcagaagaacaagatcaccatcaccaacgacaaggggcggctgagcaaggaggagatcgagaagatggtgcaggaggcggagcggtacaaggcggaggacgaggagcacaagaagaaggtggacgccaagaacgcgctggagaactacgcctacaacatgcgcaacacggtcaaggacgacaagatcgcctccaagctcggcgccgacgacaagaagaaggttgaggaggcgatcgagggcaccatcagctggctggacgccaaccagctcgccgaggccgacgagttcgaggacaagatgaaggagctggagggcatctgcaaccccatcatcgccaagatgtaccagggcgccgcgccggacatgggcggcggcatgggcatggacgaggacatgcccgccggtgctggcggcgcccggccccaagatcgaggaggtggactaagctgttcgtccaatgtctgcgcgctacttgatgggtgttctgtctcggtgtcctctggatgccgttcggtggtgtcagtcgtctgtcgtcgtgtcatctagctgcaagtagtagtagtggttcgttggagtcgtttgatctgaaagacatgatggatgatgatgtttgcttgttggtttggaacccttgatgcttagagcttctcgttttttaagtttaaaatt

SEQ ID NO: 25813 - DNA, 848 bp, Triticum aestivum
  Clone ID: PAT_TA_25813
cttggaatccctctagaagcgcgcccgccctctttttcttttctttttctttttattttcttttttctttttttttctttttttttttttttttttttttttttttgaacaataacagcaaatgcctcaaccaaaacgttttgaggcacaaggggaaaaccaacacacaggtctctactcaaattcaacacatgcgaccgacaaaaccagatagtacatttcaccattgctcacaccaaaaaggcggtccatacatgaaatcttgcaaaatggcagtatttttcttctcaaacagggatgtaatgtctactacaaaggtagcaaccaagactagttgactagataatgctttactcgtcctcctggctgcggagcctagcaagcttgttggtgaccacgacgtcgagctgcgcagcacgctccacgatcgccttgcgcttctgggtggacacgttgtgtgcgatctcggcacagtaggtcctgttgtgcatcatgagcagctccagctcagagacattgtggacaacgaacttcttgaacttgttgggcaggtagtgccttgtcttcttgtctgaaccgtacccgatgttgggcatcaaggtgcatcccttgaacttccgcctgacacgggagtcgataccctttggcctacgccagctttgcttgaggccgatgtagcggtcgctgtgcgccctcttgaagtgcttcaccctcttcttcacgatcgccttcttcagcagaggcaccgccatcttgggagaactgcggcggagcgggcgggcgggcggcggcggcggcgtatgggggagggagaagccgttcgtgcggggggtgtgcctcgtgccgaa

SEQ ID NO: 25814 - DNA, 732 bp, Triticum aestivum
  Clone ID: PAT_TA_25814
caaacggatgtttcaaaattttatccaccgggaatattaaagcaggaccccaaaacccccaatttaacacacgcttttccagccattggcaatgggatctagattataaaggcaatagtagatctttgacacattacagtcggcactggtagcaaaaaggttggaataacagatatccctgacagtcacacaacaaagaacagcggagtactttcctacatacgaaccagaccaaaacatagcacctgacagtctactcatcctcctggctgcggagcctggcaagcttgttggtaaccacgatgtcgagctgcgcagcacgctcaacgatgtccttgcgcttcttggtggagacgttgtgggcgatctccgcacagtaggtcctgttgtgcatcataagcagctccagctcagacacattgtggacaacaaacttcttgaacttgttgggaaggtagtgcctggtcttcttgtcagaaccgtagccaatgttgggcatcaaggtgcatcccttgaactttctcctgacacgggaatcaataccctttggcctgcgccagctttgcttgaggccaatgtagcggtcgctatgggccctcttgaagtgcttgaccctcttcttcacgatcttcttcgtcagaagcggcaccgccatctctgatcttcgggagcgaacggccctaaccctaacacgaagagaggaggaagaagagccctcgtgccgattcctgc

SEQ ID NO: 25815 - DNA, 2191 bp, Triticum aestivum
  Clone ID: PAT_TA_25815
cgaattcggcacgagcaacgacacaggtatactaataatcaagtgaaagctgacattgacatgttcggacaaactgcaactcacttcattcctgaagaaccccacaaaccaaaccattcaagaattgtcccctaaatgcctcgcagagttgcagaagcttaaactcaggctatacagtagcaaaatagtgcacaccatactaaagatgcaacccctacatagtagcctgataaaaaagacccagactcctcaagtttgacgattatactcctcttacaaacgctgcgatattgatacccaggaccagttgcttccttgaaaatcttcagcttattggacccaccacaaccatgaccttaccccacgcaccgactaccaaatggtggcaactgcagcgacaagggaattaccaccattggtcaaatctgtattcagcccaggttcagatcagggttgccaccttggccaaagtcaaaggcaacacctgtcggagcttccatagttgcccccatcgcatcatcttcctcctccatccagtaagcctcaagaatcttcacagccttctcatagatttcattgttatcatggctctgcaggttctcaatcttttccaggccctctgcttcatcaatcatctgcgcatagacattgccctccccagaagcacccaaattcttatcagtttctccaactttgagaatgttctcaagaccctccaagcaaacagtaacaatccttggatctgggcaaagcaggaggtcacacagtggcttgatgcagccctcgctaaccaaatacttgatttggtcgtgggaaccaccggaggtagcattcgagatggcccaagcagcctccttcttgatatcgaattcagccgtttgcagcagatgcaccagaggaccaataattccagcagtaatcacagcctgtatctgatctttgttaccagcagtgatatttgaaacagtccagcaggcctctttcttaatgcttttcttgtgattttgtgtcaacagacttaggagacacccaagagcttgatgatcaatgatgcactgagtttgcgagtcatctcctgtgacaatatttccaacagttcgtagtgcaggtataagcactgaaggtgatggatggaggagaagctccacaagccggggacagacaccagcatcaatcacagattggatcttgtcattggtgccatcagagagatacgaaagagcccagcatgcatcagttaaaacttcctcatcattggaatggataagtcgtgcaagtgctggcagagcaggcttagtctgatcaaatgctggctgtggctttcctctgcagaaatttgataaagtccaggtcgcattccttaacatggagagtttagcatgctcattcaactgtgctagcagaggcatcaatgcaccatttgcgagtacaaggtcgcggcactttggggagtcaccagcaacattgcccaatgcccagacagcctgctcacgaacatcatcgctgccagatgcaagaagcttcacaaatattggaactgccccatgatcaatgacaaccttggtattctctgatgtgccagacgcaatgtttgtgagtgcccacgctgcttcaaactggagttgggggaaatcctctctagtaagaaactgcacaaatcgaggaacaacgcctgattggataacttcttcgattggggggctcctttctatagaaagcaacttgcggaattgtgtcgttgcctcaagctgcaggttgttatcctcggaataaaccccaccaaccatagcaggtaagctttcaagcttcttctcgacgccggcggcagggataggagcctgggcctggagcccctcgcggcgcttcttgaggaggctctcctcgcggcggttcttgcggatctccaccatgttgtcctcgcgccgccgccgcccctcatcggcgtccaccgtcaccttgtagcggttccgccgcgcgtcggcccgctcgctcggacgcaccgacatggctgggttggtcgctgtggtctctctctcgcgcgcgcgcggcggtggcggcggggaggcaaaaaccctagctaggcgacggggctctgggggtggggaggagcgcgcgaggggaggggagaaaagagggagaggagaaaccctagcgtgccgctgcgaaagggagttaaagctcaccctcgtgc

SEQ ID NO: 25816 - DNA, 2711 bp, Triticum aestivum
  Clone ID: PAT_TA_25816
ccgaacataagtcacatttcctcatggcactcatcaagagaaacacaaggatggtcatgtacaacatagttgttgctttattggtcactgtgttcatgttctcaacgttgccgtcctgccaagcgattcaacgacgcttatgcagagatttagcgggttgcactgatgtgtcgtgccagagtgactgcttagaaagaggctttcgcccaccttatcaattggaatgtgaaaccaaccaccatcatcttcagtgttgctgtagacagttcggttccatattaaaatgagagccacaaagtttctcagcttatgcaatgcaatgatgtatactgatgccaataattgaataaacttatattttctgataaaaacaaactcagagggtcttccggcgaaccccaaagcgagagagcgagcgagcgattcccaggagaggagaggaggcggagatggccaagggcgaggggccggcgatcggcatcgacctcgggacgacctactcgtgcgtcggcgtctggcagcatgaccgggtcgagatcatcgccaacgaccagggcaaccgcaccacgccctcctacgtcgccttcaccgacaccgagcgcctcatcggcgacgccgccaagaaccaggtcgccatgaaccccaccaacaccgtcttcgatgcgaagcggctgattggcaggaggttctctgacccctccgtgcagagtgacatgaagctgtggcccttcaaggtcatccctggccctgcagacaagcccatgatcgtcgtcaactacaagggtgaggagaagcagttcgcagcggaggagatctcctccatggtgcttatcaagatgagggagatcgctgaggccttcctcggcaactctgtcaagaacgccgtggtcaccgttccggcctacttcaacgactcccagcgccaggccactaaggacgccggcgccatcgccgggctgaacgtgctgcgcatcatcaacgagcccactgctgctgccatcgcctacggccttgacaagaaggcgaccagcaccggtgagaagaacgtcctcatcttcgaccttggcggtggcactttcgatgtgtcgctgctgaccatcgaggagggcatcttcgaggtgaaggccaccgccggtgacactcacctgggtggggaggacttcgacaaccgcatggtgaaccacttcgtccaggagttcaagcgcaagcacaagaaggacatcaccggcaacccccgcgctcttcgtcgtctccgcacggcgtgcgagcgtgccaagcgcacgctgtcgtcgacggcccaaaccaccatcgagatcgactcgctgtacgagggtgtggacttctacactaccatcacacgggctcgctttgaggagctcaacatggacctcttccgcaagtgcatggagccggtggagaagtgcctccgcgacgccaagatggacaagagcacggtgcacgacgtggtgctggtcggtggctccacccgtatccccaaggtgcagcagttgctccaggacttcttcaacggcaaggagctgtgcaagagcatcaaccccgacgaggcagtggcgtatggcgcctccgtccaggctgccatcctgagcggagagggcaacgagaaggtgcaggacctgctgctgctcgacgtgacgcctctctccctgggtctggagaccgccggcggcgtcatgacgacgctcatcccgaggaacaccaccatccccaccaagaaggagcaggtcttctccacctactcggacaaccagccgggcgtcctgatccaggtgtacgagggcgagcgcgccaggaccaaggacaacaacctcctgggcaagttcgagctctccggcatcccgccggcgccccgcggtgtgccccagatcacggtgtgcttcgacatcgacgccaacggcatcctgaacgtgtctgcggaggacaagacgacggggcagaagaacaagatcaccatcaccaacgacaaggggcggctgagcaaggaggagattgagaagatggtgcaggaggcggagaggtacaaggcggaggacgaggagcacaagaagaaggtggacgccaagaacgcgctggagaactacgcctacaacatgcgcaacacggtcaaggacgacaagatcgcctccaagctcggcgcggacgacaagaagaaggtggaggaggcgatcgagggcaccatcagctggctggacgccaaccagctcgccgaggccgacgagttcgaggacaagatgaaggagctggagggcatctgcaaccccatcatcgccaagatgtaccagggcgccgcgccggacatgggcggcggcatgggcatggacgaggacatgccggccggcggcggcggcgctggccccaagatcgaggaggtggactaatttgttggtccgtgcccgtggtggtctccggtctgcgcgctacttgatgggttcgctgtctcggtgtccgtcctttggatgccgctcggtggtgtcagtcgtctgtcgttgtgtcatctagctggaagtagtagtagtcgttcgatggagtcgttggtctgaaggacatgatggatcatgatgtttgctttggtttggaacccttgaagcttagagcttctcgtttttaagtttgaatttggtgcttccctacttttgatcttttctggctctgttttatttttgttcatctgtggttcgtttctcgtccaatcg

SEQ ID NO: 25817 - DNA, 705 bp, Triticum aestivum
  Clone ID: PAT_TA_25817
cagggaaaacgcggcgcagaaaatctttgcatagctgataattaaaggcgatccgcacttcacatcaaagtcgacatgcttatagtacgataacatgaccagcatcgatagcaagatgttcaacagcgtcggatcctcgaggcgaacagagaagaaaactccagattcggcattaagtctactacagggagcaaaacgatccaaaagcgccactgttcgaaacatttcactcgtcctcctggctgcggagcctggcgagcttgttggtgaccacgacgtcgagctgggcggcacgctccactatcgccttgcgcttctgcgtggacacgttgtgcgcgatctcagcacagtacgtcctgttgtgcatcataagcagctccagctcagagacgttgtgcaccacaaacttcttgaacttgtttggcaggtagtgcctggtcttcttgttagaaccatatccaatgttgggcatcaaggtgcatcccttgaacttccgcctgacgcgggagtctataccctttggcctgcgccagctttgcttgaggccgatgtagcggtcgctgtgcgccctcttgaagtgcttcaccctcttcttcacgatcgccgtcttcaggataggcaccgccatcttgcgaggcgagcggcggcggcggcggagatgggagggagtgtgaggggggagaggagtctcccggcccggccggc

SEQ ID NO: 25818 - DNA, 668 bp, Triticum aestivum
  Clone ID: PAT_TA_25818
acttatcagcaattggcaatgggatctagattataaaggcaatagtagatctttgacgcattacagtctgcactggtagcaaaaaggttggaataacagatatccctgacagtcacacaacgaagaacagcggaatactttcctacatacgaaccagaccaaaacatagttctgacagacagtctactcatcctcctggctgcggagcctggcaagcttgttcgtaaccacgatgtcgagctgcgcggcacgctcaacaatgtccttgcgcttctttgtggagacgttgtgggcaatctccgcacagtaggtcctgttgtgcatcataagcagctccagctcagacacattgtggacaacaaacttcttgaacttgttgggaaggtaatgcctggtcttcttgtcagaaccgtagccaatgttgggcatcaaggtgcatcccttgaactttctcctgacacgggaatcaatgccctttggcctgcgccagctttgcttgaggccaatgtagcggtcgctatgggccctcttgaagtgcttgaccctcttcttcacgatcttcctggtcagaagcggcaccgccatctctgatcttagggagcgaacgaccctaaccctaacacagagagaggtgcaagaagagcggcggcgggcccggaccggccggc

SEQ ID NO: 25819 - DNA, 1867 bp, Triticum aestivum
  Clone ID: PAT_TA_25819
agaagcagtttgcagccgaggagatatcttctatggttctcatcaagatgcgtgagattgctgaagctttccttggcagcactgtgaagaatgctgttgtcactgtacctgcatacttcaatgactcgcagaggcaggctaccaaggatgctggtgtcattgctggcatcaatgtccttcgtatcatcaacgagccaacagctgctgccattgcttatggtcttgacaagaaggcttccagtgttggtgagaagaatgtcctcatctttgatcttggaggtggtacctttgatgtctctcttctcaccattgaggagggtatctttgaggttaaagccacagctggtgacactcatcttggtggtgaggactttgacaacaggatggtcaaccacttcgtcttggagttcaagaggaagaacaagaaggacatcagtggcaacccgagagctcttcggaggctgaggacatcctgtgagagggcaaagaggactcttctcctccacttgcgcagaccaccattgagattgactcgctgtttgagggcattgacttctaactccaccatcacccgggccaggtttgaggagatgaacatggatctgttcaggaagtgtatggagcctgtggagaagtgtctcagggatgcaaagatggacaagagcactgtacatgatgttgtccttgtcggtggttccaccaggattcccaaagtgcagcagcttctccaggacttcttcaacggcaaggagttgtgcaagagcatcaaccctgatgaggctgttgcctacggggctgctgtccaagctgccatcttgagcggagagggcaacgagaaggtccaggacctgctgttattggatgtcacccctctttctcttggtctggagacagccgggggtgtgatgacagtcttgatcccaaggaacaccaccatccccaccaagaaggagcaggtcttctccacctactcggacaaccagcccggtgtgctcatccaggtgtatgagggtgagaggaccaggacccgtgacaacaaccttcttggcaagtttgagctgtctggcatccctcctgctcccaggggagttccccagatcacggtctgctttgacatcgacgccaatggtatcctgaacgtgtctgccgaggacaagacgactgggcagaagaacaagatcaccatcaccaacgacaagggcaggctgagcaaggaggagatcgagaagatggtccaggaggctgagaagtacaagtccgaggacgaggaacacaagaagaaggtggagtccaagaacgccctggagaactactcatacaacatgcgcaacacgatcaaggacgagaaggtcgcctccaagctgccggcggacgacaagaagaagatcgaggatgccattgatgctgccatccagtggctggacacgaaccagcttgctgaggcggacgatttcgaggacaagatgaaggagctggaggccctgtgcaaccccatcatcgccaagatgtaccagggtgctggtgctgacatggagggcggcatggacgacgataccccagctgcgtccggcggccctggccccaagatcgaggaggttgactaaacagtcgatgttctgtgacagaggcggtgaagcctgctgctagttacagtattattatgtcgtgtctgtcatctgagacttgaggttgtgatggttattgtttcgctccgggtggtcggagttattccagtgcgagttggaacattcgtgggttaaatgggccacgatgtcacgtctaagtaatatattattctagttcgttggtaaaaaaaaacctcgggccgcgaccacgcctaatcgaattccccgcggccgccatggtg

SEQ ID NO: 25820 - DNA, 2633 bp, Triticum aestivum
  Clone ID: PAT_TA_25820
gccaagcccatgatcaatgtccagtacaagggtgaggagaagcagtttgcagctgaggagatatcttctatggtcctcatcaagatgcgtgagattgcagaagctttccttggcaccactgtgaagaatgctgttgtcactgtacctgcatacttcaatgactcgcagaggcaggctaccaaggatgctggtgtcattgctggcatcaatgtcctccgtatcatcaacgagccaacagctgctgccattgcttatggtcttgacaagaaggcttccagtgttggtgagaagaacgtcctcatctttgaccttggaggtggtacctttgatgtctctcttctcaccattgaggagggtatcttcgaggttaaagccacagctggtgacactcatcttggtggtgaggactttgacaacaggatggtcaaccacttcgtccaggagttcaagaggaagaacaagaaggacatcagtggcaacccaagagctctgcggaggctgaggacatcctgtgagagggcaaagagaactctctcctccactgcccagaccaccattgagattgactcgctgtttgagggcattgacttctactccaccatcacccgtgccaggtttgaggagatgaacatggatctgttcaggaagtgtatggagcctgtggagaagtgtttgagggacgcaaagatggacaagagcaccgtgcacgatgttgtccttgttggtggttccactaggattcccagagtgcagcagcttctccaggacttcttcaacggcaaagagctctgcaagagcatcaaccctgatgaggctgttgcctatggagctgctgtccaggctgccatcttgagtggagagggcaacgagaaggtccaggacctgctgctgttggatgtcactcctctttctcttggtctggagacggccgggggtgtgatgacggtcttgatcccaaggaacaccaccatccccaccaagaaggagcaggtcttctccacctactcggacaaccagcctggtgtgctcatccaggtgtacgagggtgagaggaccaggacccgtgacaacaacctccttggcaagttcgagctgtccggcatccctcctgcacccaggggagttccccagatcactgtctgctttgacattgatgccaatggtatcctgaacgtgtctgccgaggacaagacgactgggcagaagaacaagatcaccatcaccaacgacaagggcaggctgagcaaggaggagattgagaagatggtccaggaggctgagaagtacaagtctgaggatgaggagcacaagaagaaggtggagtcaaagaatgccctggagaactactcctacaacatgcgcaacaccatcaaggatgagaagattgcctccaagctgccagcggacgacaagaagaagattgaggacgccatcgacgctgccatccagtggctggacacgaaccagctcgctgaggcggacgagttcgaggacaagatgaaggagctggaggccctgtgcaaccccatcatcgccaagatgtaccagggcgctggtgccgacatggagggcggcatggacgacgacaccccggctgcttccggcggtgctggccccaagatcgaggaggtcgactaaatgagtcgatgttctgttgcagaggcggtgaagcctgcttcttagttattatgtgtgtcctatgttatctgagactgggttgcggtgtgttttggtacctcggccgaggtttttttttttttttttttttttttagtgaaagctggcattgacatgttcggacaaactgcaactcacttcattcctgaagaaccccacaaaccaaaccattcaagaattgtcccctaaatgcctcgcagagttgcagaagcttaaaactcaggctatacagtagcaaaatagtgcacaccatactaaagatgcaaacccctacatagtagcctgataaaaaagacccagactcctcaagtttgacgattatactcctcttacaaacgctgcgatattgatacccaggaccagttgcttccttgaaaatcttcagcttattggacccaccacaaccatgaccttaccccacacaccgactagaccaaatggtgacaactgcagcgacaagggaattaccaccattggtcaaatctgtattcagcccaagttcagatcagggttgccaccttggccaaagtcaaaggcaacacctgtgggagcttccatagttgcccccatcgcatcatcttcctcctccatccagtaagcctcgagaatcttcacagccttctcatagatctcattgttatcatggctctgcaggttctcaatcttttccaggccctctgcttcatcaatcatctgcgcatagacattcccctccccagaagcacccaaattcttatcagtttctccaactttgagaatgttctcaagaccctccaagcaaacagtaacaatccttggatctgggcaaagcaggaggtcacacagtggcttgatgcagccctcgctaaccaaatacttgatttggtcgtgggaaccaccggaggtagcattcgagatggccacaagcagcctccttcttgatatcgaattcaaccgtttcagcagatgcaccagag

SEQ ID NO: 25821 - DNA, 2005 bp, Triticum aestivum
  Clone ID: PAT_TA_25821
gatgcgtgagattgcagaagctttcctttgcagcactgtgaagaatgctgttgtcactgtacctgcatacttcaatgactcgcagaggcaggctaccaaggatgctggtgtcattgctggcatcaatgtccttcgtatcatcaacgagccaacagctgctgccattgcttatggtcttgacaagaaggcttccagtgttggtgagaagaatgtcctcatctttgatcttggaggtggtacctttgatgtctctcttctcaccattgaggagggcatctttgaggttaaagccacagctggtgacactcatcttggtggtgaggactttgataacaggatggtcaaccacttcgtccaggagttcaagaggaagaacaagaaggacatcagtggcaacccgagagctcttcggaggctgaggacatcctgtgagagggcaaagaggactctctcctccactgcacagaccaccattgagattgactcgctgtttgagggcattgacttctactccaccatcacccgggccaggtttgaggagatgaacatggatctgttcaggaagtgtatggagcctgtggagaagtgtctcagggatgcaaagatggacaagagcaccgtgcacgatgttgtccttgttggtggttccactaggattcccaaagtgcagcagcttctccaggacttcttcaacggcaaggagctgtgcaagagcatcaaccctgatgaggctgttgcgtacggggctgctgtccaggctgccatcttgagcggagagggcaacgagaaggtccaggacctgctgttattggatgtcactcctctttctcttggtctggagacagctgggggtgtgatgacagttttgattccaaggaacaccaccatccccaccaagaaggagcaggtcttctccacctactcggacaaccagcctggtgtgctcatccaggtgtacgagggtgagaggacaaggacccgtgacaacaacctccttggcaagttcgagctgtctggcatccctcccgcacccaggggagttccccagatcacggtctgctttgacatcgatgccaatggtatcctgaacgtgtctgctgaggacaagacgactgggcagaagaacaagatcaccatcaccaatgacaagggcaggctgagcaaggaggagatcgagaagatggtccaggaggctgagaagtacaagtcggaggacgaggagcacaagaagaaggcggagtccaagaatgccctggagaactactcgtacaacatgcgcaataccatcaaggacgagaagatcgcctccaagctgccggccgacgacaagaagaagatcgaggatgccatcgatgctgccatccaatggctggacacgaaccagctcgctgaggcggatgagttcgaggacaagatgaaggagctggaggccctgtgcaaccccatcatcgccaagatgtaccagggtgctggtgccgacatggagggcggcatggacgacgacaccccagctgcatccggcggccctggccccaagatcgaggaggtcgactaaacagtcagttgttctgttgcagaggcggcgaagcctgctgcttattataccgtgtctgtgttatctgagacttgaggttgtggtggttattgttttgcttccgagtggtcggagttattccgtgcgagttgcaacattcgtggtagtggatcaagggttatgatgtctcacgtctaagtatattattagtttgttggtatttctactgtacctttatattactttgattctgtgtttgtgcttttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaagggaccaaattttactaccccgggcttgcaaggaaaaagtttttttttggggcccccaaatttaa

SEQ ID NO: 25822 - DNA, 2327 bp, Triticum aestivum
  Clone ID: PAT_TA_25822
gaggaattcggcacgaggccgccgccagcagctgcgcaaaggctccacaaaccctaaccctagctccaagcttagcttccatcttctcgatctagctagagccatggcgccgaccaagggcgaggggccggccatcggcatcgacctcggcaccacctactcgtgcgtcggcgtgtggcagcacgaccgggtcgagatcatcgccaacgaccagggcaaccgcaccacgccctcgtacgtcgccttcaccgactcggagcgcctcatcggcgatgccgccaagaaccaggtcgccatgaaccccatcaacaccgtcttcgatgcgaagcgtcttatcggcagaaggtttgctgatgctcctgtccagagtgatattaagatgtggccgtacaaggttattcctggcccagcagacaagcctatgattgtagtgcagtacaagggtgaggacaagcagttttcagctgaagaaatttcttccatggtcctcatcaagatgcgtgagatcgccgaggcttacctaggagtaactattaagaatgctgttgtcaccgtgcctgcttacttcaatgattcccagaggcaggcaaccaaggatgccggtgttattgctggtcttaatgtgatgcgtatcatcaacgagccaacagcagctgcaattgcctatggtcttgacaagaaggctaccagtgtcggtgagaagaatgtgcttatctttgaccttggtggtggcacttttgatgtctccctccttaccattgaggagggtatttttgaggtgaaggccacggctggtgacactcatcttggtggggaggactttgacaaccgtatggtgaaccactttgtccaagagttcaagaggaagcacaagaaggatatcagtggaaaccccaggtctttgagaaggctcaggacttcttgtgagagggcgaagaggaccctttcttccactgcccaaaccaccattgagatcgattcactctttgagggagttgatttctattccaccatcaccagggccaggtttgaggagctcaacatggacctcttcaggaagtgcatggagccagtggagaagtgcctgagggatgccaagatggacaagagcactatccatgatgtcgtgcttgttggtggttccaccaggatccccagagttcagcagctgctgcaggacttcttcaacgggaaggagctctgcaagagcatcaaccctgatgaagctgttgcctacggtgctgccgtgcaggctgcaatcctcagcggtgaggggaacgagaaggtgcaggaccttctcctcctcgatgtgaccccactgtctcttggtcttgagactgctggaggagtcatgactgtgctcatcaccaggaacaccaccatccccaccaagaaggagcaggtcttctccacctactccgacaaccagcctggtgtgctcatccaggtgtttgagggtgagaggacaaggaccagggacaacaacctgctcggcaagtttgagctctccggcatcccgcctgcacccaggggtgttccccagatcactgtctgcttcgacattgatgccaacggtatcctgaatgtctctgctgaggacaagaccactggccagaagaacaagatcaccatcaccaacgacaagggcaggctgagcaaggacgacattgagaagatggtccaggacgcagagaagtacaagtctgaggacgaggagcacaagaagaaggttgacgccaagaactccctggagaactacgcctacaacatgaggaacaccatccaggacgagaagatcgcctccaagctgcccgctgacgacaagaagaagatcgaggacgctgtcgacgctgcgatccagtggcttgacgccaaccagcttggtgaggttgacgagttcgaggacaagatgaaggagctggagggcctctgcaaccccatcatcgccaagatgtaccagggcgctggtgctgacatgccgggaggcatggacgaggacgcgccggctgccagcggcggtgctggccccaagatcgaggaggtcgactaagttagtcgctttcatatacgccatttgattcagtcctgggtgccaatcatatcacctgggctggaagttttgttgtacttttggtctgtagcatcagtgtcgtaaacaatgcaatgatgcatgttttggctcattgttgatttcagcttaatgcttattgtttgtactacctacacctgtgatttcattctgaattcttagagcttaaatttggctgttgtctctgtattcgagttcagagttaagttgcagcatgccattcacgttagggtaaaac

SEQ ID NO: 25823 - DNA, 2416 bp, Triticum aestivum
  unsure (1)..(2416): unsure at all n locations
  Clone ID: PAT_TA_25823
caagctcgaaattaaccctactaaagggaacaaaagctggagctccaccgcggtggcggccgctctagaactagtggatcccccgggctgcaggaattcggcacgagggcagccgccgccagcagctgcgcaaaggctcctcaaaccctaaccctagtccatagctagcttagcttccttcctctcgatctagctagagccatggcgccgaccaagggcgaggggccggccatcggcatcgacctcggcaccacctactcgtgcgtcggcgtgtggcagcacgaccgcgtcgagatcatcgccaacgaccagggcaaccgcaccacgccctcgtacgtcgccttcaccgactcggagcgcctcatcggcgatgccgccaagaaccaggtcgccatgaaccccatcaacaccgtcttcgatgcgaagcgtcttatcggcagaaggtttgctgatgcccctgtccagagtgatattaagatgtggccgtacaaggttattcctggccctgcagacaagcctatgattgtagtgcagtacaagggtgaggacaagcagttctcagctgaagaaatttcttccatggtcctcatcaagatgcgtgagatcgctgaggcttacctaggagtaactattaagaatgctgttgtcaccgtgcctgcttacttcaatgattcccagaggcaggcaaccaaggatgccggtgttattgctggtcttaatgtgatgcgtatcatcaacgagccaacagcagctgcaattgcttatggtcttgacaagaaggctaccagtgtcggtgagaagaatgtgcttatctttgaccttggtggtggcacttttgatgtctctctccttaccattgaggagggtatttttgaggtgaaggccacggctggtgacactcaccttggtggggaggactttgacaaccgtatggtgaaccactttgtccaagagttcaagaggaagcacaagaaggatatcagtggaaaccccaggtctttgagaaggctcaggacttcttgtgagagggcgaagaggaccctttcttccactgcccaaaccaccattgagatcgattcactcttcgagggagttgatttctattccaccatcaccagggccaggtttgaggagctcaacatggacctcttcaggaagtgcatggagccagtggagaagtgcctgagggatgccaagatggacaagagcactatccatgatgttgtgcttgttggtggttccaccagaatccccagagttcagcagctgttgcaggacttcttcaacgggaaggagctctgcaagagcatcaaccctgatgaagctgttgcctacggtgctgccgtccaggctgcaatcctcagcggtgaggggaacgagaaggtgcaggaccttctcctcctggatgtcaccccactgtctcttggtcttgagactgctggaggagtcatgactgtgctcatcacccggaacaccaccatccccaccaagaaggagcaggtcttctccacctactccgacaaccagcctggtgtgctcatccaggtgtttgagggtgagaggacaaggaccagggacaacaacctgctcggcaagtttgagctctccggcatcccgcctgcgcccaggggtgttccccagatcactgtctgcttcgacattgatgccaacggtatcctgaatgtctctgctgaggacaagaccactggccagaagaacaagatcactatcaccaacgacaagggcaggctgagcaaggacgacattgagaagatggtccaggatgcagagaagtacaagtctgaggatgaggagcacaagaagaaggttgacgccaagaactccctggagaactacgcctacaacatgaggaacaccatccaggacgagaagattgcctccaagctgcctgctgatgacaagaagaagatcgaggacgccgttgacgccgcgatccagtggcttgacgccaaccagcttggtgaggttgacgagtttgaggacaagatgaaggagctggagggcctctgcaaccccatcatcgccaagatgtaccagggcgccggtgctgacatgcccggaggcatggacgaggacgcgccggctgcgagcggcggtgctggccccaagatcgaggaggtcgactaagttagtcgcttttatatagtgagaaaatacactatacgccattttattcagtcctgggtgccaatcatatcacctgggctggaagttttgttgtactttttggtctgtagcatcacgagacttgtgtgtgtcgtgaacaatgcaatgatgcatgttttggctcattgttgatttcagcttaatgcttattatttggactaccctacccgtgtgatttcattctgaattcttagcttaaatttggttgttgccattcaccanaaaaaga

SEQ ID NO: 25824 - DNA, 332 bp, Triticum aestivum
  Clone ID: PAT_TA_25824
gcggccgcccgggcaggtaccactgcagatactcgtcataagatgacaaatcaaactgctcagtctcccgaaatatgcgctgtcgccgtgcttcccattcctgaatatactcatgatgtgtctcttcccaattttcacgctctctaccacgtcggctaatacgatgtaatgtctgtagggtaggtcgaaaaggtggcggaatgcattgacgaagcccgaattgccgcatcactcgctcaggcaagatacatctcaacaataggaaaatttattaatggtgcttgagtaatccacaggtcagcatcttttgtacctcggccgcgaccacgcta

SEQ ID NO: 25825 - DNA, 603 bp, Triticum aestivum
  unsure (1)..(603): unsure at all n locations
  Clone ID: PAT_TA_25825
acaacttactggagtaacattcagaacaacttggggcagtttagaagggacaaaattagaatggtaaccttcgtgtataaaggaggaaagataagtagaaaaactgttgtcctaattccaaataaggagaaggaaggcattcagatttactcttcaggataatcagaaaatgatatttttgtgatgcttgaaaatcaaccatggtcatgagaattggtgatgcaaatgaaagcatgtaaattggcctcaactaaagattatcacaagaaacctaagtttcatccctgaattctccaataagcaactgctccaaggaaattcttccttngacaaacacctggcgaaaaaacaaaagcacatgttgttaaatttaatttgccgggattttacgttgttttcaaaatggggacacccgattttttancaatccaataaatgagcctaactacacctatagggcaattattaagttacctccggccgcgaaacaacgctaatncaaaattcccccccggccgccaatggggggccggggaaacaatgccaacgtccngggcccaanttccccctanaagtgggggtcgttattacaaattccccggg

SEQ ID NO: 25826 - DNA, 325 bp, Triticum aestivum
  unsure (1)..(325): unsure at all n locations
  Clone ID: PAT_TA_25826
tagcgtggtccggccgaggtacatatgagtgtagaattggaatgtatacacatgtgtatgcatctcctcacatcacgacttacccacgcctatggcattatctctgccacaattttcttttctaatccctcacacaattcatgtcttcatctgaacacacaagcaccaagctccactcctgcccgggcgggcatctaaagaagcgccattccggactcccaaagaacctaattttgtgccatcccccacctgcccgggcnggccgcctccaaatccaattccccccgggncggcaatggggggcnggancaatgngaagtccggg

SEQ ID NO: 25827 - DNA, 396 bp, Triticum aestivum
  Clone ID: PAT_TA_25827
tagcgtggtcgcggccgaggtacagtttcgaacaagatccactcttgttctcctttttttgtctatattctcagctgtagcagagattccaaataaaaaacatggcctttatatattcatgcatattcagactcactcatctcactccttccattcattcgttaggaggggacatgcttgtctgtttgaatctacagtgcagcagaaagtcgcagctcctctttgaaaccaactcaagaacatcgatctgaaagcatacgatgctttatgctactaccaccgaccgatgcccactacacaacgcgctgatgaacccctacacgtatttttccatctcaaaaaatatatgcataggatgctctgtttgtcttgtacctgcccgggcggacgctcgaa

SEQ ID NO: 25828 - DNA, 478 bp, Triticum aestivum
  unsure (1)..(478): unsure at all n locations
  Clone ID: PAT_TA_25828
gcggccgcccgggcaggtacttgtccgagtagcacgcgaggagcttcttgatcaccgagttcacatacgagctcagcgggtaaggcttgaagcccgccatgctcagccttgatttccacttgccaagcagctcatgcctctccactctgtccttcccctcgcaggcgatgatgttcacgatgtccttggccaggcagtgttgctccacacttatcctctctttgctgtctcgaggcaagttggcgtcgatagactcgaacatggcggagtagtaatccatggtctccaaaaacctcatcaagaaaggcgtcgtgttggtgtgcgactcctgttccaccaacgtggtcaccttcggggacagccctttcaccatccggagcaacccgtcccgtgggttgttgacatccacactctcgtctggggtatggtgcanntggagggtgaagttgacagcaacacctcggccgcgaccacgcta

SEQ ID NO: 25829 - DNA, 450 bp, Triticum aestivum
  Clone ID: PAT_TA_25829
tcgagcggccgcccgggcaggtacacgtccgaggaagaatagaatgaggggcaaggtatcaaggatgtcacgaggaacagttgaaagtagctaaaactgcatccaccgaccagcaccattcgtgtgtggctattgcagtggaagaagactgcctcagtcaaccacacctttccctcaacccaatctgttgcttccgaggagattgatcatcactagataggcaggtttcacatgtaaatagttgggggcagggcaccaagtaaattcccggcattaatcgacatcctgattcactggttgccttgactccgctcctgctccgctgctgcccacggtcctgtccgcctcttcctttcctttgccaactgctccttggcccccctcgcccgcgacctccctggcataccttcagtcttcatgagttttggacaaaatgtaaacataagtgct

SEQ ID NO: 25830 - DNA, 680 bp, Triticum aestivum
  unsure (1)..(680): unsure at all n locations
  Clone ID: PAT_TA_25830
gcaagcacttgccaagcaggggttttcagatttaacaggaactgattacagtgaaggagccattgaacttgcaagaaaccttgctgctcgtgatgggttcactactataaggcggccgcccgggcaggtacttgagacaaagttagacaggaaattcaaagttattacagataaagggacattggatgccattggattgcatccagatggccgtgcaaaaagagtgatgtattgggaatctatatcaaacttggttgaaccaggtggccttgtggtcataacatcatgtaatcacacaaaggatgagcttctgcaagaagtagaagagttcggtatgcggaaatttggtaaggaggacgcagacagaggtgcaggtgattcgcaccagatcttccgatacttggatcatgtccaaacgtatcctaccatcatgtttggcggagttgaggggtctcaagtgtgcaccgtggctttccaacgggcgtgaaaggccagcttaagagtgcttttctctctatgttgtagctcaattttatcctcaggtntgttgttgtagcctatactggcagtccttcccagtttgcaaggacagagagtaagagaacacttatgaagcaatttttgtgttgtgtaaacgaacaggtgcctcggccgcgactgtattaaaaaaaggcacgagc

SEQ ID NO: 25831 - DNA, 361 bp, Triticum aestivum
  Clone ID: PAT_TA_25831
tagcgtggtcgcggccgaggtacaaataccgcgataatatttaatcgcttacttcataacttacaaacaaacaccattgataagtttgacccagagaaatgaagttgttcaaaacataacccgttaactttgatctcgagaattgaagttattataaaaccatatctcgataacttcttcataaatagcattgtatttttatgcaccacggacctgatcataggcacacgcctaaacgggtctggccccacacaaaccgaaaagttttatttataagcaggcccttctgagcttgcacgtggacctcacctggtggcactgctactgctgcctcccgtacctgcccgggcggccgctcgaa

SEQ ID NO: 25832 - DNA, 409 bp, Triticum aestivum
  unsure (1)..(409): unsure at all n locations
  Clone ID: PAT_TA_25832
tagcgtggtcgcggccgaggtggggatcaatggagtgacctgataggattgccaatggcaacgaggtcctttaagcttccaaatccaatgtacatggttctagttttacagtatcagtagctctaggtcaagctttttttttttttttttttttttttttggttttttttttttttttttttttttttttttgcagctcccaaaagaaacatttatttctggcacaaaaattttactccccccaccccaatatttactggactggactttttctcccccctgnagcagtaactnncacaacaantaattttaacacaactccctgacttggttctacacaaaaaacatttcccttttttttattatcatttccacaatatgactactcctaccaccccataatatgacc

SEQ ID NO: 25833 - DNA, 255 bp, Triticum aestivum
  unsure (1)..(255): unsure at all n locations
  Clone ID: PAT_TA_25833
tancgtggtcgcggccgaggtactaagagcaagcctctgaaacaaggcacagaactaagcatactatgatgaaccaatgatgaatatcttacaaagttagacatttacaataactgtagcaccaaatagttcgatgccagccaataaagctactaagtaaatcatggctccaatccaacgccttgtcacctacacattaaattagtgtaactatataagaaaatgcagtagtacctgcccgggcggccgctcgaa

SEQ ID NO: 25834 - DNA, 217 bp, Triticum aestivum
  Clone ID: PAT_TA_25834
tagcgtggtcgcggccgaggtactgcaggcgttacagtcacacaacaagcaggaaagcaagagtcaacaacaacccccaaagagcggcagctggtaagcccggacgtgataatgcaccacttccttcccgtggagtagtagtagtctccttgtcaacgattcgacacagaaccgaaggtccgctcgagccttgcacctgcccgggcggccgctcgaa

SEQ ID NO: 25835 - DNA, 488 bp, Triticum aestivum
  Clone ID: PAT_TA_25835
tcgagcggccgcccgggcaggtacatcacagcagctctccgatgcagaaaggatggctcttctcaagtcagcagctaaccaaactggcaacttcggggtagctcagtcaatataggagttgtgcagtaaacagcttcagtcgagaaatcagcaagttctagtgcatagtgtcttccaggcaccagtttgttgtttcctaatcaccctaattccaaaagtattctactcaacttcagcgccatgctcagtccaaccacatggcttcagggtgcccgagttcgtcgccaccatcagttcggagactctgccactgcgtgtgtcgcgaccatggccacctgcgtcactgcgtgctccgtcaacagcctcccgcgcaaggaaaagcaacaggagtagagccgtctgagatgctctgttctagcgaggcggcttattatgtttgtcagtttgtagtacctcggccgcgacctccctcggccgcgaccacgcta

SEQ ID NO: 25836 - DNA, 381 bp, Triticum aestivum
  unsure (1)..(381): unsure at all n locations
  Clone ID: PAT_TA_25836
tagcgtggtcgcggccgaggtacttccattcggttcttcatgacnntccttggttccattgcttgtattgactaaagtgctgctaggagaagttaatagttctccattcccctctggctgatcatctgttccttcagtgctcacatcagtgtgcgtcaaagttttgctcttcttttcccttggaaaaacatgaacagatggtggaagatagttttcttgaattgcctgccaaccatctgggcctctcagcccccctttgattgcatatgcctctttgaaaccattgttgaacagcagctcagccactttcattgaattaccatcaaagttgtcaaggacgcagacgacggtgttggccacctgcccgggcggccgctcgaa

SEQ ID NO: 25837 - DNA, 324 bp, Triticum aestivum
  Clone ID: PAT_TA_25837
tagcgtggtcgcggccgaggtacaccctccaaatacggtcgacatgtctccatcttgacatgttaatcttagttcttcttgacggaacggcgagccttgacggtcatgtcgtagagcgcatccttgaacgcgaacaagaaagcagcggtgatgaccgactgcgtgacctttggtccaatgcctccgtagagtccaccaacaccctcctccctgtaaatcttcttcaacgtcgccgtcatgcccaacttggggccatccttcgcagccacatgcgccctcgacttgacggtaatgtacgggtacctgcccgggcggccgctcgaa

SEQ ID NO: 25838 - DNA, 220 bp, Triticum aestivum
  Clone ID: PAT_TA_25838
tagcgtggtcgcggccgaggtactatgggcgattagtagaaacaaagatcagagaaaaggttagcagcccgactgaagaggtagttgagcgaggaggtgcggaccttctggatagggacatcgacgagtagggcgtcaatcagggaccagagaggggacgtgggcattgagcttgagcgccgccgtcccagtgaggtacctgcccgggcggccgctcgaa

SEQ ID NO: 25839 - DNA, 552 bp, Triticum aestivum
  Clone ID: PAT_TA_25839
atgaagaaatgttaaacgccatgtttccttctaccatggatacatcatcggataattccttgggtaaatattcatactacccatgtttgtaggccaccttcataaccttgcgctcttcgtcgagcgccactgcaaaatccaacatgtatacatcgttcgtgcccctcaggggtaaatactcagactacacaagtttgtaggcctccttgcgagcttgtcgctcttgcgacagcatgcggacaaaacgggccagttcctgcttcttcgagcccctctctagatcgggctcgttctcgcctgtctcgacgtcatgcttgcacacctgtttcttcagcaagcactttgccgtctgaaagagcacggatgcttggatatcgacgaggtcggcgctagcctcactgaagctatcgatgatcggcgtggcacccctcttgtaggcccacccagcagtcccccacttgccgcactcagccgcctcaaacttctcttcaatcttggcggtgccggtgcccaatgacaggatcatgaacttgccgtaatcagcatgcttga

SEQ ID NO: 25840 - DNA, 307 bp, Triticum aestivum
  Clone ID: PAT_TA_25840
ttcggccggccccccgcccaggtacctcaagcgcgccgcaccaatgaagcagttcctcgagatggagattggtatcactggaggtgaggaggacggtgtcaacaacgaggatgtggacaacaactccctctacacccagcccgaggacatccacaacatctacaagaccctcgccccaatctccccatacttctccatcgccgctggcttcggcaacgtgcacggagtctacaagcccggcaacgttaagctccgcccagagctcctccagaagcaccagaagtacctcccccgccgcccgctcgaa

SEQ ID NO: 25841 - DNA, 321 bp, Triticum aestivum
  Clone ID: PAT_TA_25841
tagcgtggtcgcggccgaggtacatcctcgacaggtccgttacacgatttgcttccataagcactgtaaatcccttctcaataattgcggatgtgtgtcgctgtagcaattgtttttctgtagttgctataagtggcttcctcgtgttagcttccaaatacagaatgcacctatcatgttcttcttgcaaccttgactccgcatgccttagataatctggaatatcagactgctgcaaatatttgacaccttcagtagcataaaactcagaggtgcattcaagaaaaggcttttcgaaacctgcccgggcggccgctcgaa

SEQ ID NO: 25842 - DNA, 607 bp, Triticum aestivum
  unsure (1)..(607): unsure at all n locations
  Clone ID: PAT_TA_25842
tcgagcggccgcccgggcaggtacattgccgggccgccgcccaggtacaatccaatgctgttaaccacatctcaatgtagtatgcaccaacatcaaaactacaatgcagctccttaaaagaaaggcccatatatttcagctcacaagcagtttgtctcccagctctttgcggtagaagtgaatgaggccagcgctgtcgattgtctgcagcttatccttcagtatcttcgtgtagtggtcatccctatcctccaagctcctcatcaattcaacctgtctctggaacgactcgaattcatcgaagctcagggaaccatcgctgtttgcatcaaggagatgcatgagcgccatcgcatcctcgccctcggcaccaagatcttccatcacctccgtgagctcctcgatgctgatcctcccatcaccatttttgtctataaggcagaaagcctggttcttgcattcacctcctcgatgatcactggctgggaggtctcgnnnncgatgagctgccagttctgccgcggccaacataatagccttgagtcttttagcctctccgggatccgtangnnnacccttgtnnnnnnngtgnnnnnnttctcnanca

SEQ ID NO: 25843 - DNA, 566 bp, Triticum aestivum
  unsure (1)..(566): unsure at all n locations
  Clone ID: PAT_TA_25843
tagcgtggtcgcggccgaggtactggtagctcctgaagcagcagcggccgatgccgtgggtggtggacgggggactcttggggccctcttctcaatttgggcaagcttcaactgggcgacagccagggggttgttcgggatatcactagattgctcaccaggttcagaattaactgcaggggccttcttctcctttatttgagcgagttttggggggagtgcagctctcggggagggaaccagaactgaactatagccaccaccaaacctttgtgccctggcttgctcggccttctctttgatcgccttctcccgttccgtcgcaagcttatgccggtctttgtaagcgggatacttctcatcagcaaagccttccacattcttcgacatcaactggaatgaagatgcaacatttgcatcatctgcgtcaccggattcttggtccctttttccaaatgttgtaatggacataccatctcctgcatttctgatcatgagagactccaggggcccctttgtttctggctcctctacctgcccgggcggccgctcgaccgcgacnncnn

SEQ ID NO: 25844 - DNA, 689 bp, Triticum aestivum
  unsure (1)..(689): unsure at all n locations
  Clone ID: PAT_TA_25844
aatcacgtttccaaaagcatatatgcggcattcaagattaccagcccgtctagctctgggttgctagatgaatttctccctaatgtttgcttagccatatggaccactactccatggacaattcctgctaatgctgccgttgctgtgaaccctgagcttagttatgcagtagttgagctccagtctgtactggaaagtgagtcaacatctggaggaaagcaacaaaaacttgggagtattttgagctctgggatcgagaaaccatttatcatcgtggcttctgatcttgtctcagttctagagtccaaatggggtgtgaagcttgtaatccggaaatcatttcctggttcagtcttggagcactgtagatacctccatcctgtgaatggcaatgaatgttctgttgttattggaggagattacataacaactgaatctggaactggccttgttcacactgcccctggccatggccaggaagactacctgacaggtttgaaatatggtcttcctattgtttctcccgtggatgatgaagggaacttcactgccgaagctggacaatttagtggcttatctgtcctnnnagctggtaatgctgcagttgtgaagtatctggacgaacatgtttcactcatcttnnnngagccttacaaacacaagtaccnnnnnncgggcnnnnngctcga

SEQ ID NO: 25845 - DNA, 340 bp, Triticum aestivum
  Clone ID: PAT_TA_25845
gcggccgcccgggcaggtacatctcgggaaatgactccgatgcagagcataagtgatcccacagctccccttcgctcaacagcttcttgctctctgacactgagatgcacttcaaaccatggtaaagatagaagacctcctcagcccccagctggaaccactgtttctctgcttcggcattatccagcgcccggccaaaggccgcacggttaagaagtgcagcttgctgcagattcacaccgagggtcgcatccctgccccgacaagataaagttgccacaagtttcgagcctttcagcgaggactggagctcagcaacacctcggccgcgaccacgcta

SEQ ID NO: 25846 - DNA, 934 bp, Triticum aestivum
  Clone ID: PAT_TA_25846
ggctccccacccgaccacacgcggcagagagagagagagagagagagagagagagagatcggaggggatcgccgagccgagcggaggccggagagggagaaggaagatgatactcgccgtgctcttcgccaactccgagggcaacatcctcatcgagaggttccatggcgtccccgcggaggagcggctgcactggcgctccttcctcgtcaagctcggcgccgagaacctcaagggcgccaagtccgaggagctcctcgtcgcctcccacaagtcggtctccattgtgtataccatgatcggggacgtctgcctgtacattgttggcaaggatgaatatgatgagcttgctttgtcggaggtgatcttcgctgttacgtcggcggttaaggatgtgtgtgcgaaaccacctaccgagcgcctcttcctcgacaagtatgggaggatctgcttgtgccttgatgagatcgtttggcaggggttgctggagaacacggagaaggacagggttcggaggctgatcaggctgaagccccccgtggagccatgatttttgcagttgagagatggatccttgctgtgtatgtatcgctttgttagagccttgatgataactcaccaacactgggcacttgtgtgattcttctgtcctgcctgtactgtgtactaacaatttctttgatgcaaatatgatttgtgcacaacaagttcatgttaatgaaaaaaagaaaaggaatacaaagtggttaacctatcgctgtcggagcgataacagtatctgtccactccactcccatgcaaaatcgatggggaattttccaatgggcacttcatttcgttgctactagtacacacaaatgctccacaccaaacccaactgcattctcatgtcaatttaggactgcactaagtagccagcattatgagcatcact

SEQ ID NO: 25847 - DNA, 692 bp, Triticum aestivum
  Clone ID: PAT_TA_25847
gccaaccagtggcacccagtgagcactgagcagagcagctagcaagggcccggctcgtcgacccaccgtcaccttggacccggccgggcggaaggtggaggcagcggcggcgacgatgctctcgggacggcgagcgctacccattctgctggccgtgttcgcgctgctcgcggcggccgtgagtgtgagcgcgcgcgggggcgcggagagggcgccgacgctggtgttcatcctggcggggcagtccaacatgggcggccggggcggggccacggtggggaaccgctgggacggcgtggtgccgccggagtgcgcgccgtccccgcgcacgctgcgcctctccccgtcgctccgctgggaggaggcccgcgagccgctgcacgccggcgtggacgccggcaacgtggtgggcgtgggccccgggatgccgttcgcgcacgcgctgctccgctccccggcctgcccgcgcggcgccgtcgtggggctcgtcccctgcgcgcagggcggcacgcccatcgccaactggtcccgcggcaccgagatgtacgagcgcatggtgacccgcgcccgcgtcgccggcgccgggacggggagggtcgccgcgctgctgtggttccagggggaggccgacaccctccggcgcgaggacgcgcctgcgtacgccggcaggatggaggcgtttgtacgggacg

SEQ ID NO: 25848 - DNA, 692 bp, Triticum aestivum
  Clone ID: PAT_TA_25848
gcctgtgacagtaagggggaggatcatggcgagttctccttcttccttgctacacggagttgcgatccttgctctcatatgctgctccttgtcatgctcggcggcggccggagatgtagttgctctcgacggacgtcgtaatcagtggaaacctccgccgactccgttgccagggaagcagcatactccggtgagtccagtcccaactccggcgactccggtgccagggagaccggtgactccaaatcctccagtctctgttcctcctccaccgtcaacgcccgtgcgcagatacccggtgaccccaagtccttcaacccctatttgtgtgccgcggcctcccccggtgcagcgggaggtgtcggctctttcgccgcaccgcaagaccctacagaaggctgttaagaacgtgctttaattaagaaagcaccaaatgctaccgctcagacatattttctatgttatagtacaagaggattgtgttgctaattaattaaggtaatagataatatgatatcagtgtagtactccctccgttccatagtataagatgttttgacactagtatagtgtaaaaaacgttcttatattagggaccaagggattagtatttacatacagattttgtttggtgtactggtcatgagtcatctgaagcttcatttcgccagcccatgcagcgctgtgcatgc

SEQ ID NO: 25849 - DNA, 345 bp, Triticum aestivum
  Clone ID: PAT_TA_25849
tcgagcggccgcccgggcaggtacaacgccaatcaatcttttcgttctttccatcttacacctccaatgcccaaaaataaagcgaccaatcatagtgtgtccatctcaccccttccatacacaacaacaaaccaattttcaaaacgtttctaagcgggacaggcgaggcctgtttctccatgcttccaggtctcggtttgggatccgaccagtttgccattggagcggctgggcgaggcctgtttctttcaaagtttgccatcggagcaggaggcaccagtgccgccgctgctttgtttctgagtgccacaactgttcttatgtacctcggccgcgaccacgcta

SEQ ID NO: 25850 - DNA, 1090 bp, Triticum aestivum
  Clone ID: PAT_TA_25850
tttatactaccaattatcatagaaatagctgcatccacgtcccacgccaggccgcgggggggcggcgctggtgttcgggtcggcgatgtgcccccgcagcgcgccccgcgccttcggcttgaccgccgccttcgccgcggtcgtctgcgcgcgcttggcttttcccgcggcgccctgggcgccggggtcccgccgtcgctggcgcgaggcggggggagccgtggccgcgagggggctgcgcgcatggtcgcgtcggggatgaacctcctcatcgcggcgctcggcttcggcatgaccgccgccttcgtcgcgttcgtctgcgcacggttcatctgctgccgcgcccgggacgcggacgatggcgccccatccccggtggactttgacgttgacttcccagcacatctcgaacgcccggtagaggatgctaattgtgggttggaacctttggttattgctgcaattcctattatgaagtactctgaggctttatattcaaaggatgatgcccagtgcgccctacgtctaggtgaataccctggagacagagcttctaagaatcattccgacatgtcaacataactttcaccgtacctgcttagacttatggttgcagaagcagactacttgcccaatatgccgggtctcgttgaaagagttgcctagcggcaaagctgccatagcaccttcatgtagcaatcctcaagtgcgcccccgcactgagaactctgttaatccagcacctgactggctcctccctgttcatcattctcacagaggtcaacagaatagttcagacacacaagcatcagtagaagtggttattgagatacgccaataagcacatcatgagattgctatgaaagagaacaaagcgggaatatgtaataggtttcctgcctcgctgcattgttgcagcatcctaattggatcgacattgtatgcaatctcgtcgcaggtaatgtgtcaacatttgttgtacatttcgcattgtaggtaagcatattgtgttatggcacataaacactttcaatgttcttttctagtgctctgtatatcataaaaatggtaaagaaatattggatgttag

SEQ ID NO: 25851 - DNA, 485 bp, Triticum aestivum
  Clone ID: PAT_TA_25851
gcggccgcccgggcaggtactttagaagagcacgactccttgaagattgaactggagaacaaggacgctcagaacagagctcgagaagatgaattgctttcgctgcaaaaagagctcagggcaatggcatcaaaatgtatttattgcactgaacagattcaaattatttttgatggcttgcttgatttaggttacgcagtagacttggcaacaggcaactccagcattgtatcaaaagtaggacaaactttgtctgttttgaagaacgaggagtctggtgattatataaaggtggtggacactttagtatcttccgtgaacaaactgaagtcagagtctcagaagttatctgatattaaggggttagtgataactttgatagaagagttgaaaatgagactgaaacaagccgagtcagctgctgaaactgcttcaaatgaccaccagctgtatttggaaagagtacctcggccgcgaccacgcta

SEQ ID NO: 25852 - DNA, 436 bp, Triticum aestivum
  Clone ID: PAT_TA_25852
gcggccgcccgggcaggtcgcggccccccggcccggtacgcacataaagctttgggactgggaccagaactggaagtgcagacaaacattcgaggcacagtccacggtaaatcaagtcgcatttaacccgaaggacgccaacagttttgcaagtgcttcggacgatcacacagtaaagatttggagtattgattcttcagaacctaagtatactctctctggtcatttgggtggagtgaactgcctcaatttcttcacaagcaacgatcaacagtatttgattactggttcggatgataagactgctaaggtctgggacttcctggaaaggttctgcgccgcggccccgaccgcgcttatgtctccagttatttcttccatttcccatccctgtcttccatttttaattacaggtacctcggccgcgaccacgcta

SEQ ID NO: 25853 - DNA, 572 bp, Triticum aestivum
  Clone ID: PAT_TA_25853
actgcacgaggggagcttgggttctgctcagataacggagatacaacccctcacgcagaatgtacagctgaagaaccagtctctgaggctgagcctgctaccaccgaggcacttgaactcaaagattctgctgctgaggaaacaggtgtgtcagaagaatctgatgatgatgaaacgccctcacctgagacatccactgatgaggaagtgccgaggggtcctgcttaattgaagagtactttgtttcagtttggttagaatgtttgaattgagctcattctcaacattgaagaattgttactgctgctttggggagaggtagacgctaaggtgttgccgttttcgataagggctcgtgggatactaacgtgaataagttataggattatgtcacttcggaattaagagtcggctgttactgtgagcagtgtgcgcgatgttaggcgatattgttccggtgatgcttgtcttcaattaaaatcattgggcattgccatttttattgttattatggttttgtgtatccaagtttactttgtatcaatagtagtatggatgtctgaattattatt

SEQ ID NO: 25854 - DNA, 627 bp, Triticum aestivum
  Clone ID: PAT_TA_25854
taacgtggtcgcggccgaggtacacgtcaaagcgatgctcacaaaatagtttccacagggcatatacacttcagtttcccagaaaaaaacagggcacatacactgccggagcagattctcctttccaaagctctgcgtacacaactgacagttccctcaggcttaaaaaaataagacagttcctcagcagcatgtgatatgcctctgtcgacaacttgttggcatttgacatacacaaaatcagttaaatacaaaggccaatgactgtcatgattctcacaaagactgaaagtttcagagaagttactattgcagacgcaagcgggctcattgccaattcagaaatatgggcaacgggtaaatcatggaggagaagccattagctgtagccccgatctgaagcagtgcaatcattcgtcttggagcacgatcatcagttctccgccttgactgagaacgctgtccaggaatgcaattagtttttctttgcactgaaactgcttggccgacggaagatcgctgtccaaattaaaccagatgccatcaatgcttcgaattgctacccaatgcctgccggtccacagaccccttaacctcctcacgggtacctcggccgcgaccacgcta

SEQ ID NO: 25855 - DNA, 1235 bp, Triticum aestivum
  Clone ID: PAT_TA_25855
gccctggcccggccggtgaacgcgccgggcgtgcggcagccgctgccggtttctcttcctgtgctcgtcgcagccgcgcgagggcggtgaccccgcccggcgggggtggccccggtccaggtgcagttagtgttgatgccctggatgctggaggcggcaggtcctgccccggcgctgatgggtctgccgagccgggtgccccgtcttgtcgctcgaactgggagtctgcgggtcttcttgctgctcgggtggcgttgccggaccgtgggccccgtggtggccttcggactccccgtgccgcggacttcctgcatgtgcgctagcacaggatgccctgtgaggaagcatgttgagagagcatcgcatgatcctaaatcagtgataacaacgtatgaaggaaaacataaccatgaagtccctgctgcgaggaatgcaatccatgagatgtccgcgcctcccatgaagaatgtcgtgcatcagattaacagcaatatgcccagcagcattggcggcatgatgcgagcatgtgaagtcaggaacttcagcaaccaatattctcaagccgctgaaaccgacaatgtcagtcttgaccttggtgttgggatcagcccgaaccacagcgacgccacaaaccaaatgcagtctacaggtcctgatcagatgcagtatcagatgcaatcgatggcttcgatgtatagcaacatgagacatccatcaatggcagtgccaacggtacaagggaactctgctggccgcatgtatggttccagagaagataaaggtagcgaagggtttactttcagagccacaccgatggaccattcagctaacctatgctatagcggtgctgggaacttggtcatgggtccatgagtggaatgatgagagtgtctgcaaatgcttatagctccatgaatcatatattacaaacaatgcttttgtaacgacaatctcttcagcaagattcttaattgtgtatcggttacaagtcagttccagccggaggcaagtaagctataagctatacctgggggactgcagcaaatgcgcatgtgtctttttaagtgcggaaaaggcccctgctgtatgtagcgctgcagccctacattcgttgtacagcgaacctaatatgattagttaattagattatgagaatttggttttgtgaactgtcttatcttctgtactggaatattgacagaaatatagatccatcgtaattttcttttaaaatt

SEQ ID NO: 25856 - DNA, 954 bp, Triticum aestivum
  unsure (1)..(954): unsure at all n locations
  Clone ID: PAT_TA_25856
gttcgccacccctccctgcatctctcttccacacctcgccgcaagcatgacggcgaaagtgtccggctgccggaagcgcggggcggaggccttcatggaggaccccttcgcggcgctcccgccgctgaacgcgaangggggcgatgctcgccgtccgccgccgccgacgtggcggagctcggggtcagcatggacttcgaccccgtcgacgcgctccagctcatcttccccggcgccgacccgcagcttcttcgaggctatttcgaagcgtcgggaaatgtcttggatgctgcaatcagaggcttcaaggattatttggcgtcgggttcagcaccgaccaatgctcatgcggcctcatctggcgtggcatctgatgtcccggtgatgaagatgaataatctgagaaacggcactgaatgggcggagctaattgtcaaggagatgtcagctgcttcagatttgatcgacgccaagaatcgagccttcaggatacttgaattgttcgacaaatctgccgcagactgcaatactcctgatgaaaagcagaaaatgcgtgaggagcacaagatactgaagcagatgctgggaggcctgctacaccagaacggcgtcctgaagagggcctttcttatccagcacaaccggctcaaggactaccaggacatggtgcaggagcggtcccagttcaaggagatcgtcgacaagtaccagcagcagatcaaggcgctagaggataggaactatgtgctgtcgttgcatctcgcgcagtcggatcatcggagtggcatatctgggcaccgcaaccccgacatcttctaggcgtctactgcatcctgctggattcggatgcgagaccctgaagctgtgattgttgaagaaatcatgaatacaagaaaacatctttgtgtagttatgttgacacaatatatatgtgtggtgcgatcgtttcgaatt

SEQ ID NO: 25857 - DNA, 510 bp, Triticum aestivum
  Clone ID: PAT_TA_25857
ttcgagcggccgcccgggcaggtctttttggtgaaacctttaaagcttttgaatgtcttgaaacactgagcatctggagctgcccaaagattaattgggaaaggcttgttgggttgccgccttcattgcaatatctgaacatgattgattttggtcaattgtctgatcactttctgagctgcctagaacatctagcgtcgctactgaaactgaatttatcttctgaatctttgacttcaattcccatacaacaatggtcatctctactgcgcctggatgtttggaactgtagcaaattaacaacagttgacttcactcctccttccttaccagcagtaaaagtaatcacaattccaaattgtgaagctttattggctctacctggcaaaacgtttgtggagttctgttgtctagaggaattgatgatacgtgaatgtccaaatattgactggagaggcttgacatttcctatatcgcttcgggagctgtacctcggccgcgaccacgcta

SEQ ID NO: 25858 - DNA, 7246 bp, Triticum aestivum
  unsure (1)..(7246): unsure at all n locations
  Clone ID: PAT_TA_25858
gaacactgcatctgcgctgtttgtccaaagggaggacgatgggatccacacatttgcccattgtcggccttaatgcctcgacaacaccatcgctatccactattcgcccggtaaattcagccggtgctgcattccaaccatctgccccttctagaacctccaagaagaaaagtcgtcgtgttcagtcattaagggatggaggcgatggaggcgtgtcagaccctaaccagtctattcgccaaggtcttgccggcatcattgacctcccaaaggagggcagatcagctcggaaatttggctcgtcttgtgagacggtgcatccagggtactgccaacaccagtatcctaactgggattactgacttgatggagcttcttggccgggaagtgtactgctcccatatgcagttgggtggccccaaaataatcgccacaaacgttgatgaccatctaacaatttcataggagcttgtaggtgtatctgatatattggggtaggtcatctatgtacctgcgaacattggaggacctctcagtattaaactatgtttggtcccgcctgccagaccagatgtgtagatccctgagaatatgcgggtcactcgtgcagacatcagtgggattgatgctagccaagggaaataaatgtgcgactcgtagggcagatagcagtgtgaagcgacgtttctagtgtttgccatggttggggtcatgcgtctaggaatactgaacttccagatgcactaaatgcaaacggaattgtttttcttgggccaccatcatcatcaatgaacgcactaggtgacaaggttggttcagctctcattgctcaagcagcaggggttccgactcttccttggagtggatgacaggtggcaagtacagtagaagttcgtttgtgatcgatacctgcggagatgtctaggtaagtttgtggtagtactacgtgggaagcgctatcttgttgaaagatgattggggattgagccaagattaaagcatcatggggtggtagaggtaaagggatccgttgggttaataatgacgattatgtaagaacactgtttgggcaagtgccatgagaagttcctggctccccaataattatcatgagacttgcgcatagaagcccggaagaaacagttgttgcctttgtatactcaaattgcggtgcggtttgctgaattgcatgacactgcagtgtgcaacggcgacaccaaaagattattgaggatggaccagttactgttgctcctcgcgagacagtgaaagagctagagcaagcagcaaggaggcttgctaaggctgtgggttatgttggtgctgctactgttgaatatctctacagcatggagactggtgaatactattttctggaacttaatccacggttgcaggttgagcatccagtcaccgagtggatagctgaagtaaacttgcctgcagctcaagttgcagttggaatgggtatacccctttggcaggttccagagatcagacgtttctctcagttgctctcaggatgttgcagactccagtccaggatctagacgcctcgccacagggtctttctatgcgacgagagaagatggatccctcaaggagagcacagtttgttgaggaagtcaagaaagtccttaaatgatcaagatgataccaacgcatccagaacagaatgtgcaagatgtctgttactcttgcagaacatttgtagaaggatatcattctggctgtgaccggccatagctgatttgactgatcctttatttggtaaatctttttcgcagtgttctctttgattagaaggcaaaacttgtttttcggtcgcctcagaatagttgctaattcgagttggaattgttagtaccgctgcttagaaggttggacatgtatgcgcgtcgggcttcagggctaacatgatcaagactggttggcttcaaaacttattgtcaagtcgtgttcaggcttctacactatggtggtatgtttcagtggttggaggagctatatacaatcggatgacgaggaacaccgactctgtgtaggcatatgttatctatctcgttaagggtcagattccaccaaagcatatatcccttgtccattcaactgtttctttgaatatagaggaaagcaaatatacaattgaaactataaggagcggacagggtagctacagattgcgaatgaatggatcagttattgaagcaaatgtccaaacattatgtgatggtggacttttaatgcagttggatggaaacagccatgtaatttatgctgaagaagaggccggtggtacacggcttctaattgatggaaagacatgcttgttacagaatgatcacgatccttcaaggttattagctgagacaccctgcaaacttcttcgtttcttggttgccgatggtgctcatgttgaagctgatgtaccatatgcggaagttgaggttatgaagatgtgcatgcccctcttgtcacctgctgctggtgtcattaatgttttgttgtctgagggccagcctatgcaggctggtgatcttatagcaagacttgatcttgatgacccttctgctgtgaagagagctgagccatttaacggatctttcccagaaatgagccttcctattgctgcttctggccaagttcacaaaagatgtgccacaagcttgaatgctgctcggatggtccttgcaggatatgatcacccgatcaacaaagttgtacaagatctggtatcctgtctagatgctcctgagcttcctttcctacaatgggaagagcttatgtctgttttagcaactagacttccaaggcttcttaagagcgagttggagggtaaatacagtgaatataagttaaatgttggccatgggaagagcaaggatttcccttccaagatgctaagagagataatcgaggaaaatcttgcacatggttctgagaaggaaattgctacaaatgagaggcttgttgagcctcttatgagcctactgaagtcatatgagggtggcagagaaagccatgcacactttattgtgaagtcccttttcgaggactatctctcggttgaggaactattcagtgatggcattcagtctgatgtgattgaacgcctgcgccaacaacatagtaaagatctccagaaggttgtagacattgtgttgtctcaccagggtgtgagaaacaaaactaagctgatactaacactcatggagaaactggtctatccaaaccctgctgtctacaaggatcagttgactcgcttttcctccctcaatcacaaaagatattataagttggcccttaaagctagcgagcttcttgaacaaaccaagcttagtgagctccgcacaagcattgcaaggagcctttcagaacttgagatgtttactgaagaaaggacggccattagtgagatcatgggagatttagtgactgccccactgccagttgaagatgcactggtttctttgtttgattgtagtgatcaaactcttcagcagagggtgatcgagacgtacatatctcgattataccagcctcatcttgtcaaggatagtatccagctgaaatatcaggaatctggtgttattgctttatgggaattcgctgaagcgcattcagagaagagattgggtgctatggttattgtgaagtcgttagaatctgtatcagcagcaattggagctgcactaaagggtacatcacgctatgcaagctctgagggtaacataatgcatattgctttattgggtgctgataatcaaatgcatggaactgaagacagtggtgataacgatcaagctcaagtcaggatagacaaactttctgcgacactggaacaaaatactgtcacagctgatctccgtgctgctggtgtgaaggttattagttgcattgttcaaagggatggagcactcatgcctatgcgccataccttcctcttgtcggatgaaaagctttgttatgaggaagagccggttctccggcatgtggagcctcctctttctgctcttcttgagttgggtaagttgaaagtgaaaggatacaatgaggtgaagtatacaccgtcacgtgatcgtcagtggaacatatacacacttagaaatacagagaaccccaaaatgttgcacagggtgtttttccgaactcttgtcaggcaacccggtgcttccaacaaattcacatcaggcaacatcagtgatgttgaagtgggaggagctgaggaatctctttcatttacatcgagcagcatattaagatcgctgatgactgctatagaagagttggagcttcacgcgattaggacaggtcactctcatatgtttttgtgcatattgaaagagcaaaagcttcttgatcttgttcccgtttcagggaacaaagttgtggatattggccaagatgaagctactgcatgcttgcttctgaaagaaatggctctacagatacatgaacttgtgggtgcaaggatgcatcatctttctgtatgccaatgggaggtgaaacttaagttggacagcgatgggcctgccagtggtacctggagagttgtaacaaccaatgttactagtcacacctgcactgtggatatctaccgtgaggtcgaagatacagaatcacagaaactagtgtaccactctgctccatcgtcatctggtcctttgcatggcgttgcactgaatactccatatcagcctttgagtgttattgatctgaaacgttgctccgctagaaataacagaactacatactgctatgattttccgttggcatttgaaactgcagtgcagaagtcatggtctaacatttctagtgacactaaccgatgttatgttaaagcgacggagctggtgtttgctcacaagaacgggtcatggggcactcctgtaattcctatggagcgtcctgctgggctcaatgacattggtatggtagcttggatcttggacatgtccactcctgaatatcccaatggcaggcagattgttgtcatcgcaaatgatattacttttagagctggatcgtttggtccaagggaagatgcattttttgaaactgttaccaacctagcttgtgagaggaagcttcctctcatctacttggcagcaaactctggtgctcggatcggcatagcagatgaagtaaaatcttgcttccgtgttggatggtctgatgatggcagccctgaacgtgggtttcaatatatttatctgactgaagaagaccatgctcgtattagcgcttctgttatagcgcacaagatgcagcttgataatggtgaaattaggtgggttattgattctgttgtagggaaggaggatgggctaggtgtggagaacatacatggaagtgctgctattgccagtgcctattctagggcctatgaggagacatttacgcttacatttgtgactggacggactgttggaataggagcatatcttgctcgacttggcatacggtgcatacagcgtactgaccagcccattatcctaactgggttctctgccttgaacaagcttcttggccgggaagtttacagctcccacatgcagttgggtggccccaaaattatggcgacaaacggtgttgtccatctgacagtttcagatgaccttgaaggtgtatctaatatattgaggtggctcagctatgttcctgccaacattggtggacctcttcctattacaaaatctttggacccacctgacagacccgttgcttacatccctgagaatacatgtgatcctcgtgcagccatcagtggcattgatgatagccaagggaaatggttggggggcatgttcgacaaagacagttttgtggagacatttgaaggatgggcgaagtcagtagttactggcagagcgaaactcggagggattccggtgggtgttatagctgtggagacacagactatgatgcagctcatccctgctgatccaggccagcttgattcccatgagcggtctgttcctcgtgctgggcaagtctggtttccagattcagctactaagacagcgcaggcaatgctggacttcaaccgtgaaggattacctctgttcatccttgctaactggagaggcttctctggtgggcaaagagatctttttgaaggaatccttcaggctgggtcaacaattgttgagaaccttaggacatacaatcagcctgcctttgtatatatccccaaggctgcagagctacgtggaggggcttgggtcgtgattgatagcaagataaatccagatcgcattgagttctatgctgagaggactgcaaagggcaatgttcttgaacctcaagggttgatcgagatcaagttcaggtcagaggaactccaagagtgcatgggcaggcttgacccagaattgataaatctgaaggcaaaactcctgggagcaaagcatgaaaatggaagtctatctgagtcagaatcccttcagaagagcatagaagcccggaagaaacagttgttgcctttgtatactcaaattgcggtgcggttcgctgaattgcatgacacttcccttagaatggctgctaagggtgtgattaagaaggttgtagactggaaagattctaggtctttcttctacaagagattacggaggaggatatccgaggatgttcttgcaaaggaaattagaggtgtaagtggcaagcagttttctcaccaatcggcaatcgagctgatccagaaatggtacttggcttctaagggagctgaaacaggaagcactgaatgggatgatgacgatgcttttgttgcctggagggaaaaccctgaaaactaccaggagtatatcaaagaactcagggctcaaagggtatctcagttgctctcagatgttgcagactccagtccagatctagaagccttgccacagggtctttctatgctactagagaagatggatccctcaaggagagcacagtttgttgaggaagtcaagaaagtccttaaatgatcagatgataccaacgcatccaattcagaatgtgcatgatatcggtttctcttgaagtacatatatagaaggatactattcggctgtaaccgaccatagctgatctgagtcaaccattattttgtaaaacttttttgcggtcttctctgttattcgaggcaaaacttgttttcggacggctccgaatggttgatgagtgtagttggaaaaaaatgtgttagttccgcttccnnnnnnnttgnnntgaatgccggtggtgcgtnnnngctgcc

SEQ ID NO: 25859 - DNA, 871 bp, Triticum aestivum
  Clone ID: PAT_TA_25859
ccttcacgctgacgttcctgctcacctccacccggagacgctgccgacgttcgtcacggagcggcctatcgtgctcgctgagacggcggctggtctgtaccggctgtcctcccacgccaccgcggccacgatggtgttcctcccgtatctcctggcggtggcgctgctctactcctcgtgcgtctacttcctcgtcggcctctgcgcgtcgccggcggcattcgcagtgtttgtgctggtggtgtgggcggtggtgctcacggccaactccttcgtgctcttcatcagttccttcgcgccggactacatcgcgggaatgtcgctggtgtcggtgtcgctggccgggttcttcctcttctctggctacttcctgtcccgggagagcacgccggtgtactgggtgttcatgcactacgcctctccctacaagtacgcgctggacgccatgctcgccaacgagtactcgtgcgcggcgaaccggtgctttggggtggccggcgccggagaggagtgctccgagacggggcgcgacgtgctggcggcgagaggcctcacggcggaggagcggtggacgggagtgcaggtgctgtttggattcttcctcctctaccgggtgctctactgggtcgtgctcagccggagagcgtccagagccaagaggtgaccattgatcgatccatgaatctcgtctcctccattactacactacgtagtgcgtatacgagtgtgtgtgaacgcatgcatggagaagaaggagcttcgtgcatgcgacagtaaaggtacgccaatgtcaaagttcatcgacagagtggttaaccggtaattaagctgctatactgatgtatattgtgaacataaaatgaccttctac

SEQ ID NO: 25860 - DNA, 364 bp, Triticum aestivum
  Clone ID: PAT_TA_25860
ctcgtgccgcctaaagataatacaatcaatccaactgttaattttggcgtgctttttggatggactaatatgaagacgctggctagctcgcattgccatcatatattctagaagcaagagcaaggattatagcgaaaataatggtatatgttgataacaaaggggttggagtggtgccctgtggtgacagccgacagtggagaaagatgtgagcgcccacctcttcgaactacggttatatttatatacgcaggttcctgttgtagcacttgaactgagctacttctagcaattttttggtctatttggcgatttttgtactcatgaatcgttaatggcattacaaagatggatcttttcgaat

SEQ ID NO: 25861 - DNA, 726 bp, Triticum aestivum
  unsure (1)..(726): unsure at all n locations
  Clone ID: PAT_TA_25861
agccaacccggccgccccaagccgttcaccatcgcagctactaggccgattgtgttgagcctcctgccactgccggtggggctccattgccgcaccgcccatatcgttcaccgctgccacaccggggtgttgacaaccccgcggctcaggaggcacacacttcgcccctccatcccaggagagagtacatctccttgtgcgcgagcagtccattgccgatgtacactgctgctctaagctccttggccactgctccaatatgtccagcgccgtccccagtccagtctcgtggcatctggacggtcgagttcatgccgagcagcagtccacggccgtcagctcctatttccactatagtggctgggttgccgttttcctcatccttcctggtgcatgacaacccagcccacatgctgctgccgtccgccaccccaaaatagctttggctcttccttaagcaaccatttggagaaccttttggtgttttttctgctggtgattgattttagcaatttggagctatcttgcattggaacctgaaagttcaagattgctgtagattcaattcttgtagtataaatgtcctagagttcagtgacatctctaatattgtgctcagcatcctcccaatccgctcgatctcgtcctgctccggagcatgcttcagttcaacaaaaagctccggaaaagttcagagttcatagtacctcggccgcgnccacgcta

SEQ ID NO: 25862 - DNA, 1701 bp, Triticum aestivum
  Clone ID: PAT_TA_25862
cacactgcggccgcgccactcgtacacggccaccaccacctgctaggcggcgagcggcgagcggcgagatcggcggcgggcggaggaatggtggcgcccgcgggaggagggtcgccgtcgcggtggccgtcggaggaggagcttgacattgtgcggaagaatgtggtcgagattagtggaagagatgcgagagaggttagggtggttgcttgcccctacaggatttgtcctttgggggcccacattgatcatcagggcggaatagtgactgctatgacaatcaattatggagtacttcttggctttgtgccctctgatgatgctgaggttgtactccagtctggtcaatttaaaggcgttactcgattcagagttgatgacttgcaaaagcctattgagaaccgaggaaacataacttgggaaagctatgcaagaggtgcagtttatgccctgcaaaatagtggatatgatctcagaaagggtataataggttatatttctggagtgaatggacttgacagttcagggcttagttcgtctgcagctgttggcattgcctatttgctggctttagaaaatgtaaatgatctggtcttatcaccagttgataacattcagttggacaagtccattgaaaataaatatttgggtcttgaaaatggcattctagatccatcagccattttattgtctcgatatggctacctcaccttcatggattgcaagactgcctcaccttcctacgtctacttctcggaactaagtaaaagccagcaacctcaaggtcggccgccattcaagattttgttggcattttcaggtttgcaacataacctacccaagtcgcgtgggtataatatgcgagtcttcgagtgcaaagaggctgcacgtgctcttttatgtgcgtcaggctctgaagatgcaccaatactccgtaaagttgatccaggtgtatatgaggcccaaaagtgtatattagatgaaaatcttgccaagagagctgagcactatttctctgaaatgaagcgagttgttaagggaagagaggcatgggctcgtggagacctacaagaattgggacagctgatctctgcatctggccgcagctccatagtcaactacgaatgcgggagcaaagagatgatacagctgtacgagatcctcctgaaggcgccaggggtcctcggcgcgcggttcagcggcgctggcttcagaggctgctgcctcgccatcgtcgaaagcgaccgtgccgaggaggcggcggcgtacgttggcgccgagtacgagaggtcccagccagagctggtgagcaagatccccgcggatcgtcgcgtgctggtctgcgagcccggggactccgcgcaggtcatcttgcagtcatgagcgtcctgttagtcgggactttgtgaaggtgagaacacgtgcaaaattcgtacgtcctcgtccatctggaactccaccccctaaattctactccctccgtcccataatataggacgttttttgacactagtgtagcgtcaaaaaacatcttacattatgggatgaagggagtagacatttagtccaagataagactagcgttgttgtgtatgaactgtactcagtcgagctcccagatagctcatctgtgtatgtgtggaaccatttgattcattcatttccacgtaagcaataatcagtaatgcaaaggttctctct

SEQ ID NO: 25863 - DNA, 1033 bp, Triticum aestivum
  Clone ID: PAT_TA_25863
ccccgacgctgcacatagacaaccatggctaagtatctatatggttcttttgccatatcagtctgcttaaccctgtcttttgttgctgcaacaacaagagaaccttttcgcccagaaccatctcggaagaccagtgagccttctgtgtcatacagcccacagccgcaacatttcccaaacgagcggctataccaagcctacctcgttatccagcgcttcaagagcagcatttctagtgacccgaaaaacatcaccacgacctgggtctggccatgatatctgcgggaggaaaacctaccttgggttccattgcgggaggacacctgaactggctaagaacctcacgatcatggcggttgctttcaatgattttgggctgagtgcgccgatgctgcgaggcttcatcgaccagctccccgaccttgtgccttttcatggcttcctccaacaagtttggcggtggcatcccgcccctcggcagccttcagtaccagtacaagctaagtatccatgacgatcgccatgattcattttctgagagcaacgtatctcctcgggcacaaatctcggactgggtcctgttaatattggtgtaaagctagctgttgtcaaaaccccccgaaagggcacaaatcttaatagtggtagggcgcttctcctgaacagcaacagtttatccgggacactacctgcaaacttgggcttctccaagttgagctacctcgccctcgccaacaacaagctcaccggggcaatcccgccatcaatcgcgcacatgcaagactccctcctcgagatgctcctcctcaacaaccagctctcaggctgcctccccgacgagctcggcatgctcaccaaaaccgccgtcatcgacgccgggatgaaccagctgaccggcccgatcccgtcatccttctcctgcctcagcagcgtccagcagctcaacctcgcccggaaccgcctctacgggcaggtccccgacgcgctctgcaagctggccgggccggccggccgcctctccaacctcacgctg

SEQ ID NO: 25864 - DNA, 715 bp, Triticum aestivum
  Clone ID: PAT_TA_25864
ataattatgaatgccgaacatgaagctacttcttaaacaacaacaaagggtcttacttgggaaatctgatgtttctggctggggagcatttctcaagaatactgttagcaagcatgagtatcttggcgagtacactggggagcttatctctcacaaggaagcagataagcgtggaaagatatatgatcgtgagaattcgtccttccttttcaacctgaataatgagtttgttctggatgccttcagaatgggagacaagcttaagtttgccaaccactcccctgacccgaattgctatgccaaggtcatcatggtagcaggcgatcacagggtgggcatatttgccaaagagcggatcggttcaggcgaggagatcttctatgattaccgctatgagcctgaccgagcccctgtgtgggctcgaaagcccgacgctcccggagcgaaagaccccgggcagccatccagcgggcgggccaagaagctcgcccactgaagagacacgagtcattggttgattcttttgttcagggccagaactgggtagttgttagcatgctgttgtaccttaacctgacattcattccttggcccatgactgttgttgtagtgtcaaaagttgagaaccccatttgtgtcggaacctgtggatgaaacatggccggtttttttaaccgctatggttgcttcatgcccaatgcagctgggatgcctt

SEQ ID NO: 25865 - DNA, 970 bp, Triticum aestivum
  unsure (1)..(970): unsure at all n locations
  Clone ID: PAT_TA_25865
ggcacgaggaagttggttaattttcaaaacagagatatcgaattggaggctgcacagttgatggactgggttgggcttggtaatattcttcatactatttcaactgcagcaaagttcagggataatactgcctcgtgctccataattgaccatctggcatcaaaattgatggcattaacaagcactaactgtcttccgagtataaaaaaggataccctggatgatatgtttttctgggacacccgaaggcggacaatgttctatattcatgagatccctaaagcgctgaacgataatgactttgttacaagggtgaagaaccacgcgtggccactaccatgggacagtaagcattttggactcgtaaaggccatgaacgactaccgtgaagaagttgcggtaagagataaacacaagggagttaatccaggtccagaagttctaaaacagtatcattgcaatggacagcggccgccccgccaggtacagtgtatgagcggagcttacactcaccaggacaaaatagagaaggacattaaagatgataaagacaagcgaatgtcggtggatgtggctgtccagaaggagcagccagagttgtgtcttgccctacgtaggttgctcgcaggggaagccttctagaagaaggcaatgaagaatgttttcacctttgtgggtgtgaaagccgaggcgttttgcaaggagtatagacagggttgctcctcctgttagtctaangtcganggtggcctttttggatgggagagaatggcttggccaagtagacccaccaaggggccccaaaatgaccctttggtaaattttggtggcgttacttgtatcagtcagagagagtttggttgttgttgctgctgtttttttcatggatattgaatgtctgatgctatgttccatgaaattgagatcgcgttgnnnnnnnnnnnnnnnnnnnnnnnnnnnnnnnnnnnnn

SEQ ID NO: 25866 - DNA, 1544 bp, Triticum aestivum
  Clone ID: PAT_TA_25866
gcgttcgcggtaactacgcggctgctggcacagagttagccgatgcttattccagcttcgccgccagggccggctcgtatccaggcaacgtgggcgtcccgaagcaatggtacaacctcatcgccgacctgccggtgaagccgccgccgatgctgcacccggggacgcaccagccgctcaaccccagcgacctggcccctctcttccccgacgagctcatcaggcaggagctcacggaggagcgcttcatcgacatacccgacgaggtccgggatgtctacgagctctggcgcccgacgccgctgatcagggccaagaggctggagaagctgctcggcacgccggcgaagatctactacaagtacgaaggcactagcccggcggggtcgcacaagggcaacaccgccgtgccgcaggcgtggtacaacgccgcggcgggggtcaagaacgtggtcaccgagaccggcgccggccagtggggcagcgcgctctccttcgccagcaccctcttcggcctcaactgcgaggtgtggcaggtgcgcgcgtcctacgaccagaagccgtaccggaggctgatgatggagacgtggggcgccaaggtgcacccgtcgccgtccgacgtgacggaggccggcaggaggctcctggcggcggacccgagcagcccggggagcctcgggatggccatctccgaggcggtggaggtcgcggccaccaacgccgacaccaagtactgcctcggcagcgtgctcaaccacgtcctgctgcaccagaccgtcatcggcgaggagtgcctggagcagctggcggccatcggcgacaccccggacgtcgtcatcggctgcaccggcggcggctccaacttcggcgggctcgccttccccttcatgcgcgagaagctggccggcaggatgaacccgcagttcagggccgtggagcccgccgcgtgccccacgctcaccaagggcgtctacgcctacgactacggcgacacggccgggctgacgccgctgatgaagatgcacaccctcggccacgacttcgtccctgatcccatccatgcaggtgggcttcgctaccatggaatggcgcctcttatctcccatgtgtatgagctcgggttcatggaggccatgtccatacagcaaactgagtgcttcgaagctgcattacaatttgcacggacggagggcatcatcccggcgccggagccgacgcacgcgatcgcggcggcgatcagggaagcgctggagtgcaagaggaccggggaggagaaggtcatcctcatcgccatgtgcggccacggccacttcgacctcgccgcctacgaccggtacctgagaggcgacatgattgatctctcacactcctctgagaagctcaaggagtctctgggtgccattcccaaagtttgatgttagaggttcagagattgatagaagaacagtggtgggaagttgggatacaataagatgaacaatgtgacgctttcttggtgcatggcacaaataaatttgatcaataacagatgttaccttttggcc

SEQ ID NO: 25867 - DNA, 1072 bp, Triticum aestivum
  Clone ID: PAT_TA_25867
ccccccgctcacagcccgggtggttgactacccactgagcagagcagctttcggggcgcgatccaggaagccaggaacggcaaagcaggccccgcggcggcggctccatcgtgacgacaagaaatggccaccgccctccgccctccccggctcccagcagtcccggagcaagcctcctcacttcatcgcctaccaaagcacagagttgctgtcactgggcgtaggagcttcgccgccagggccggctcgtatccaggcaacgtgggcgtcccgaagcaatggtacaacctcatcgccgacctgccggtgaagccgccgccgatgctgcacccggggacgcaccagccgctgaaccccagcgacctggcccctctcttccccgacgagctgatccggcaggagctcacggaggagcgcttcatcgacatacccgacgaggtccgggatgtctacgagctctggcgccccacccactgatcaggggcaagaggctggagaagctgctcggcacccgggaagatctactacaagtacgaaggactagccggcgggtcgcacaagggaacaccccgggtgcgaccgcggcttcgaagctgcattgcaatttgcacggacggagggcatcatcccagcgccggagccgacgcacgcgatcgcggcggcgatcagggaagcgctggagtgcaagaggaccggggaggagaaggtcatcctcattgccatgtgcggccacggccacttcgacctcgccgcctacgaccggtacctgagaggcgacatgattgatctctcacactccgctgagaagctcaaggagtctctgggtgccattcccaaagtttgatgttagaggttcagagatttatagaagaacagtgtgggaagtgggaatacaataagatgaacaatgtggcgctttcttggtgcatggcacaaataaatttgatcaataaatggccgaagcataagaatgtttctagaaacttttggaaacgagccgaaagtaaaaagtcgtgtgtaccaaaagccttatcccaaacactttgatgcagttttgtatccttaaggttat

SEQ ID NO: 25868 - DNA, 2147 bp, Triticum aestivum
  Clone ID: PAT_TA_25868
ccgcgtacccgcgtgcgccccggatcccgccctaagcttaccaaaatgccccccaaactcctcactcacctcctcctggccctcgtcgccgtccccctcgacgtctccggcgcggcggcggcccggcgccacccggccccggcgaaacttcacacgcctcggggaaccccgtttacatctggccgctgccgaagaacttcacctccggcacgcagaccctcgccgttgaccccgacctcgcgctcgacccccagggcgccggcgccggcgccgcggccggtcgcggaggcgttcgagaggtacaggcacctcatcttctccccgtgggcgcacgcggcccgccccgcgtcggcggggtacgacgtcgccaggctcaccgtcgtcgtcgcctccgccgatgagacgctcgagctcgggagtggacgagagctacacgatctacattgcacggcggcgggcggcgccaaattccattgtcggcggagcaaccatagaggctaatacaatatatggagctattcgcggactagagacattcagtcagttatgtgtttttaactacgacacaaaaaatgtcgaagtgcgctatgcaccatggtacattcaggatgaaccacgctttgccttccgtggcttgatgctagacacctcaaggcattacctcccagttgatgtgataaagcaagtcattgactccatgtcattttctaagctgaacgttcttcattggcatatcatcgacgaacaatctacagtggaagagataccatcatatccaaattatgctaagaagttcatattcaaaatcagagcggtacacagtgtacaagatgcacgctatattgtcagttatgctaagaaaagacgtattcatgtcatggcagagattgacgtacctggtcatgcagaatcatggggaaatggatatccaaagctttggccttctcttagctgtacagagccattagatgtttctagtaatttcacattcgaagtaataactggaatcttgtctgatatgagaaaaatctttccgtttgggctgtttcacctgggtggcgatgaagtatatacaggctgctggaatttaacaccccatgtgaagcagtggcttgatgaacgcaacatgactacaaaggatgcttacaaatacttcgtgctgaaagctcaggagatagcaattgatcttaactggattcctgtaaattgggaggaaaccttcaactcattcggaggaagcctaaatccccggactgttgtgcataactggttgggtcctggggtctgccctaaagttgttgcaaagggtttgagatgtataatgagtaaccaaggtgtatggtaccttgatcatcttgatgttccgtgggaacaagtctacactgccgagccacttgcaggaatagacgacgcagcgcagcaaaagctggtactgggtggagaggtttgcatgtggggtgagacggcagacacctccgatgtccaacagaccatatggccacgagcagctgcggcagcagagcgtatgtggagtcagttggaggccatatcggcccaagacctggaaacaaccgtcctggctcggctacactacttcagatgcctgctgaatcaccgcggtatcgctgcagccccagtcacaaacttctatgctcggcggcctccaatcggccctggctcgtgttttatccagtaacacagatcatgcaacgcgtaagatacacatgagggggtatggccgcgcctcgatacacacacccccacactgtaccaaaatggtgtcgtcacctctactgtatcacttctgtaagttcacttgcatccatattagcccatacagctgtggacaataaaagcccttgatcctcccccgtgtatttcacccccgaaactccaataaaaccaccccagccttgctccatccgaccggagaaaaggcggttgccgatgtaacagtaccattcgggcgccttttcaacagtcgtgtttgttgaacacgagtttccggatcaacatttgcaactggccaatagggccaagcagggctccctttgaactggtaaaagagaggtgatgtgaatctctcagtgtgtgtggatatttcaactatctctgcttaccctacttgcatttggatattttggacc

SEQ ID NO: 25869 - DNA, 1763 bp, Triticum aestivum
  Clone ID: PAT_TA_25869
ggagataccgcagaccagagccgttcgcaccgccattgcagcttgcccaggcaggtgctcgtgcgctcctgctcgcccgcggtccctgcccctccccctccccagcagcgatggcgacggcgttctcaaccaagcagcccctgcgggtcgctacgcctgcaagcaaatggcgtccaaggttgccactggtgaaagtgcaatattcatccaacaaacaagctagtgcttccatttcattgacgtccagtgcggaggatgcggagagaaacgagcccatagtcaaaatgtgcggcatcacatctgccagagatgcagaattcgccgcaaaggctggagctaaacttatcgggatgattctttggcctaagtccaaacgatctgtccaactgtcagaagcgaaggaaatatccacagtagcaaagtcatatggggctgaagctgttggggtgtttgtcgatgatgatgaagagaccatcttaagagtgtctgattcatgcgaccttgaacttatccagcttcatggagatagttctcgagcactagctcctgctcttgccaagaacaaccggattgtatatgttcttaatgctgacgcggatggaaaacttatcaattctcctcctagcgagcagaccagagccgttcgcaccgccattgcagcttgcccagccaggtgctcgagcgttcctgctcgcccgcggctcctggccctcctcagcgatggcgacagcgttctcaacgaagcagccgctgcgggtcgctacgcctacaaacaaatggcgtccaaggttgccgctaattaaaatgcaatattcgtccaacaaacgagccagtgcttccatttcattgccatccagtgccgagggtgtggagagaaacgagcccatagtcaaaatgtgtggcatcacatctgctagagatgcagaattcgctgcaaaggctggagctaaacttatcgggatgattctttggcccaagtccaaacgatctgtccaacggtcagaagcgaaggaaatatccagagtagcaaagtcatatggggctgaagctgttggtgtgtttgtcgatgatgacgaagagaccatcttaagagtagccgattcatgcaaccttcaacttattcagcttcatggagatagttctcgggcactagttcctgctcttgccaagaacaaccgaattgtgtatgttcttaatgctgacgcggacggaaaacttatcaattccccccccagtgaagaatacgacattgactggtttttggtggacagtgcagagggtggaagcggcaaaggattcaactgggacaattttcgaatgccatcggtgaaaagcaagaacggctggctgctagcaggaggccttcatgcggacaatgtttgccaagctgcttccgctctaaaaccaaatggtgtggatgttagcagtggaatatgctctcctgacggtataagcaaggacccgaagaggatatcgtccttcatgagaagcgtgcaatccttaagttcccgacgaggtctctatttagacgccccaggcttattgtagcttcttgcttcagtttgtgaagacatttgcaaataagctgtcctgaatgatagcagtaaataaacaactttgaagcggagttccaactatgcttgtctaatggtagcattagaccagtttctgccattttacctgttaagatagtaagatggtctaaatgtaagtcttttcctgttcgtcgccatgcattttgcttgcagcggcattgtcgcctg

SEQ ID NO: 25870 - DNA, 1050 bp, Triticum aestivum
  Clone ID: PAT_TA_25870
gccggccccggccggcggttggtcggtctcctgggtctccctccctccctccctatcgtctgtttccttcggccgaaaagctccccgttccctgcccctgctccgcccctcgtccccttccccccctccctatcggctgtttccttcggccgaacagcccccctgttccctgcgcctcctccgcctctcctcgtccccggcctccgctccgtctgctctcggtaattggatggcctcgcctaagacgccgacgacagtccaccggcgcccaggaggaggccgcggcccgccagtcgctcatcgggatctcccaggtccaccccggcggcgggagaagccctggagcgtcaagtcaccgaacggacgcatggaaacacgggcaggacgacagcggggcggccgacaagtccaaggtcgatgctcatgtccatcctccaacccagtcgcctggaggcgcgccaaggccaacgccgtgcccgcacagcaacgccgcttagagccttgagtcttagccctgtaatagtactgattagccttgcagctgcagctgtcgatatgttgcggacccttgtgtggcgcccataataatcgccatgttgctgggttttcggtgatgaaatgatatgcagtgtggaatactactaaaaaaaaaaaaaataagacattgactggtttttggtggacagtgcagagggtggaagcggcaaaggattcaactgggacaattttcgaatgccatcggtgaaaagcaagaacggctggctgctagcaggaggccttcatgcggacaatgtttgccaagctgcttccgctctaaaaccaaatggtgtggatgttagcagtggaatatgctctcctgacggtataagcaaggacccgaagaggatatcatccttcatgagaagcgtgcaatccttaagttcccgacgaggtctctatttagacgccccaggcttattatagcttcttgcttcagtttgtgaagacatttgcaaataagctgcctgcaaaaaaaaaaaaaaagaaaaaaaaaaaaaaaaaaggccccta

SEQ ID NO: 25871 - DNA, 477 bp, Triticum aestivum
  unsure (1)..(477): unsure at all n locations
  Clone ID: PAT_TA_25871
tagcgtggtcgcggccgaggtaccaggtttcacaaagtcaaaacaaaaactaaagaccagcactccatatctgaaattcccggccgcgtcctcgtcctcccttagtcaaaactatcttattactaagatcttctctggatcttcttcttttcttccaacctgcataacaaaaacactggtggccgatgggcttggctggcgctactccggcgaggggcgtcactctggcaaggaggaagcccgtgcagcgagtaggaggcccgtccggcccgggcggcccctcgcccaagactcccatgcatgtcgtcgtcaagatttaccgggggtgggccgatggccancancatcccgtgctccaccggcagcagcggcggccacgacgacgcaaggagcaggggagcgggagcagcctccacacggcagcgaccatgacgagaagcattcattcaacgccagattctgcatcatgtgcattgg

SEQ ID NO: 25872 - DNA, 1013 bp, Triticum aestivum
  Clone ID: PAT_TA_25872
acctgatgctaactgtttcctgcattggcgtttcaaagatcgaatgcttgaagttatgattaaggcggggcatgccatcaaaaaaggagatgagatgacaatcgattatatgagtgcggtgaacagcacgttgatgcaaagatatggcttctcatcaccaacgaacccctgggaacatataaacttctcgagccctgccaagattcacctggattccttcttatcggtcttcaacatagctggcttgcatgacgagctgtaccacaatgttgcattgacctcaggggaaagcacctttgtcgacggaggagtggtggcggcagcgaggactctgccgacatggtcggacggcgaccttcctgccataccgagcgtggagagaaaatccgctcaggcgttgcatgaggagtgccggaagatggcggagtctttctcgaccacgatccaacaggacgaggagattctagattccgacgagcctatgaggaaaacacgcgaaatcgcgatcaagtaccggctgcaccggaagctgctcttgcagaagatcatcgactcgctggagatctaccaggatcggattctgttctagctagatgtattctagcgcgagcaggtgcggttgtgtcccgagtgttctgaagggcgtttgcagcaccaccacaccacccttagatgattttgaagggcttgagaagcctaggttcataggactacatagtaggttactactaggtgacagtaggaggatcccagcagaaagataatgacaagtgccaagtggcgcccaaggcatgtcggagctggcaccatggtttggggaagacgggggccggcccgccggcactcatctgcccatcctggccccgcctggcaggcctcgtaaacgcatctcgatttctcagaggaatgtcttacctgttccatttaaatgtgattcatgctgatgcttccatgaaagatatcatcatcggtgcaaaaaaaaaaaaaaaaaaaaaaaaaaaaaaaaaaaaaaa

SEQ ID NO: 25873 - DNA, 1083 bp, Triticum aestivum
  unsure (1)..(1083): unsure at all n locations
  Clone ID: PAT_TA_25873
agtgaatgtatttacaaactatggcattcatccatattgacatttcatgatcaagacaatattgaactttgtggacttgccatttatcatctgttctaactccaataagagcttgatttccccagggttaagttttatacacaagaaatagtgtttttccggcaagatctcctttacaggatgcggcggtatgcttgattccaccaacaacggaagaaacaagtgacccatttgaacatctagtagcaactatcacccatcagagtcatctgtgtccattgcctcttacagtgcaacctattatatggaactacgatcattgcctacggctatatccaactcctgacatgatagtattggctgacaagagtgagcagaaggccttcaaatatacaggaatcacttgcttcaatcctggttcttttgcgaacgacagcacttttgcagcataccgtccttgcactaaggaggttgagctttctgcattagaaagctaatattgaaggtgggacaaactgaagctgtaatcagtaacaaaccgaaccttcgatgagctgcctatcactcctgtacatcagccatcaggactggtgtttatgactttagccatataaactaatgagtccgtttcatggaagcgaatttgcaagcatgacaaagcaacgacatccatagaattggtgctgtttctccagcaaatctgatgctgacatctcaactttgtatcacacattcatagcttcagatagttgtggaccatagtgtttgttacttgttagggtgttttccccacctggccatctgtcctttgtgcagtgtttgtgtaacatgatctcagggtgctttccctaaagtcacaaaatggtgctcagtcctgtaatatgtactgtttatgtttgccattgttgtaaaccatgctaacaaagctgtgatttttagtccagacctattgctttctaaaagattggattttccaattttgtaaaatttagtccgatcagttatatcaaatgcacaggaaattggtttcgnaaaaaaaaaaaagaaccactgttatgttgagctatctagaaagggcggccg

SEQ ID NO: 25874 - DNA, 421 bp, Triticum aestivum
  Clone ID: PAT_TA_25874
tcgagcggccgcccgggcaggtactgatacacagcatcctcacaatcctcttttctccctcaaccccacagtccctcacgcaagaccttcactccttgcccatcctcaccctctcccgtccatccaactctggactccccctctcctttcttgactcctcatcccaagaatcctgccttccctgtccagctatgccacccatttcatgctccttctccgccccaaatcctcccgaagaggtctgcggtctagcagcgaaaagcccgtaaaccgccattccaagcagggacaattggaagatgaaagaggggatggtggcgtagaatgcgaagcgagtctgttgacacatcgtcccgaattgctcgggaacgctttgattcgggacgtctttccacaggcaacctcggccgcgaccacgcta

SEQ ID NO: 25875 - DNA, 702 bp, Triticum aestivum
  unsure (1)..(702): unsure at all n locations
  Clone ID: PAT_TA_25875
nnaganttaaangacgccatggcggntatanatnatntaggngaattgntacggccccccntgngtttgccgttgaaacaggcttcttttcactttcatcaggtagataaacatcactatggtcatggtttttccctccgcaaaacggcaatgtctgtcgtactggtgatgaaactgttacacttgttcctacaatgccaataacaactaatggcagcaatgatctgagctcgttggagcctgaccaaagcttatttattcatttcttgtcaacaactaatcaccaccaaatcaactcttccgaggaatcaatcaatgatagtattctagcgaactttagtactactaatcaggcaggcaggcacacacaccgactgattgcgtactggatcaactatcagagcgtggcgatgtatgcgtcggcgagcatcttgccgagccggacctgggcctgcgtggtgaggtgcgtgatgtcgttggcaagggggagccccatggcgtccacgtacttgaggttcggcacccgcaccgccctctgctgcttccgcaccagatccagccacttcccctgcttattcccctgccactgcgccgtcgcgatcccaacctggatgacgaggaggttgggcaatgcgaggtcgcggcggacgtcccgtacaaacgcctccatcctgccggcgtaggccagcgcgtcctcgcgcc

SEQ ID NO: 25876 - DNA, 365 bp, Triticum aestivum
  Clone ID: PAT_TA_25876
gtggtcgcggccgaggtaccagcaggtaaaactgaggctttgacacccagatgaatggatagaaatgatggcgctttaacatagttcttctgaaagtttttctcctcttctggaagctcttcagccttcacgagttttccaaatgtgtcccatcttgtggcatttgatattactgttctagcgacctgccccggcccccgcgccaacctcactccaacagctttcccattttcaagaataacattggtcacattcgccttgtaacgtattgcgcttcccttttcaacaaggccatttgccaaagacaccgcaataccaccaacaccaccaactggatagttaattcctccaaagtaactatcaca

SEQ ID NO: 25877 - DNA, 365 bp, Triticum aestivum
  Clone ID: PAT_TA_25877
cgtccgcggacgcgtggggcagcaacgcaccgtcccagacagaccccgagcccgagcccaaaagccaggaaggaaggaaggaagcacaaagactctccacccacctactcgaaaccaaaatcccctctccgactcccagaaatccagcgcggcgattctgatctgcatacagatcccctcgagctccctcgctcgctcttgctccggccggtcgtcgtgatttggagtgcctggaacgttcatgggtgtggagtgagatcgagagcggggaccgtgaattcctacgagggcctgcattcggcttgcgcgtctgcatgaactgtttcgtcaatctgggactcaactccaactccaaccactacgtc

SEQ ID NO: 25878 - DNA, 488 bp, Triticum aestivum
  unsure (1)..(488): unsure at all n locations
  Clone ID: PAT_TA_25878
gcgacgcgtccggtcgcctgcctcctcatcttcctgctgcatttctccccgcagccgctgctgatagatcagggcaattcaaatcccaattccaattcaagtagaagtaatcgtcaagaaggagaatccaatctcagtagtagtaatcgttaaggggaaaaacagagctcaacaaatggcgaacaacaacagctcatacggggaaaatgtcagtagaaaatcccacacgccttctgctattgttattggtggggggtttgcaggcattgctgctgcaaatgcgctcaggaatgcgtccttcgaggttgtgcttctggaatcccgtgaccggataggtggccgagttcacactgactactcttttgggtttcctgttgatcttggggcatcttggcttcatggggtttgtgaagaaaatnccctggcaccgatcattgggagacgggggcttccactgtgccgcacaaggggagatgaatccgtccttt

SEQ ID NO: 25879 - DNA, 2335 bp, Triticum aestivum
  Clone ID: PAT_TA_25879
gcgcgacgcaccccccacagaacccgagcccgaaccggaaaccagctgcgcccgaaccagaacgccaggaaggaccaaggccctcacactccccacccacacacgctaaaagcctctcccccaccccgcccgaaaccaaattccgctctccgactctcacacacccaccgccccgcttctgctcgacatacagatccccttgtgctccctcgctcgctcgatccggccggtcgtcgagattgggggtgcctgagacgttcatgggtgtggagtgagatcgagagcggggaccgtgaattccgacgagcgccgccattcggcttgcccgtctgcatgaactgtttcgccactctgggacccaactccaaccccaaccactacgtcgcctgcctctcccccctcctgctgcatttctccccgcacccgctgcagataagtaaccccaatcccaattaaaattcaagtagaagtaatcgtcaagaaggagaatccgataccagtactagtaatcattaaggggggaaaacagagctcaacaaatagcgaacagcaacagcacatacggtgaaaatgccagtagtatttgccgcacgtcttctgctatcgttattggtggtgggtttgcaggcattgccgctggaaatgcgcttaggaatgcgtccttcgaggtcgttcttctggaatcccgtgaccggatcttttgggtttcctgttgatcttggggcatcttggcttcatggtgtttgtgaagaaaatcccctggcaccaatcattggaagacttgggcttccactgtaccgcacaagtggagatgactctgtgctatttgacttcatgatcttgagagttatgcactttatgatactgtggaatggcaatcaagttccacaagagtttgtagaaaagatagggaaagtgtttgaggctatattggaagagactggcaaattaagggaagaaatgaaggaagatatttctatagctaaggccattgcaattgttttggagagaaatccacacttgaggcaagaagggattgcacatgatgttctccagtggtatttgtgccgcatggagggttggtttgctactgatgcggatgccatctcgcttcagtgttgggagcccagagttcttcttcctggcaaaagtggtctcatggttcgtggatatcgtccagttataaatactttggcaaaaggtctagatatacgccttggtcacagggttgttgaaattgttcggcactggaatagagtagaggttactgtaagcaatggtaaaacatttgttgcggatgctgcagtcatcaccgttcccttgggtgttcttaaatcaaacaccattaagtttgagccgaggctcccggaatggaaggaggaagcaataagagaactgtcagttggagtcgagaacaaaatagttctccacttcagtgaggttttctggcctaacgtggagttcctcggagtagtttcatccaccacatatggctgcagctatttcctcaaccttcacaaggcaacagggcatgctgttcttgtttacatgcctgcaggccggcttgcttgtgacattgaaaagatgtcggatgaggctgctgctcaatttgccttttcccagttgaagaagatcctccctaatgcagctgagccgcttaactacctggtgtcacactggggctcagacgagaacacgcttggttcctacacctttgacggggtaggcaagccgcgcgacctgtacgagaagctccgcatccccgtcgacaacctattctttgccggggaggccacaagcgtccagtacacgggcacggtgcacggcgccttctccacgggggagatggcggccgaggagtgccggatgagggtcctggagaagttcagggagctggacatgctggagatgtgccacccgatggccgagcaaacggccaccgtctccgtcccgctgctcatctcccggctgtaaacagtcgcgcccctaaactatctatctattgtcacggcgggtttgccggccattcattccagtgattgctcggggaaggcagcgtgggagcaatctatccttgctcttcctcgtggcatgaggcgtgtggtcgtgtgaccctatggtttgctgaataaacttactgttgggttaataaaagattgtgggcgtctggtatgtagactgtcagcgtgactttgggggttcgtgttggtggtgtagtatgagcgatggcctacttgaatatctttgtagggcagagttggtggtgtagtatgtgtgatgaaacactgtaattttactacattgacattcttaatattggtgatgatggcagatt

SEQ ID NO: 25880 - DNA, 724 bp, Triticum aestivum
  unsure (1)..(724): unsure at all n locations
  Clone ID: PAT_TA_25880
tagccggccccccgcccaggtacggtatagcccatccctcacatcaccttcgattcggaggtcctcctgctcttctctgcttttctcaatttgcctcaagagctcttgttctgaagataactgaagagatatgtctttgctggcttcagagagctgagatgataactccttaacatccttcatattatctgcaagcaaacctctaagatgctgattatcatagtataaggaatcaattttgcttgccagtctgcacctctcatcgagttcatcgtgagtcgtgtgaagtgtgggtgcctttatattcttggacatgatttggtccattctagcaatgatctgtggaattttctttcttaaaggttcaaactccacatcattctgaagagcaagagaccccttctctcgtttcaatttgaagagctcctctgtcttttcttgcagggccagttcatgagccctcttcaatttgcttatttcagacttaaagtagcttatcgtttcttccctggtcatagcattcaaatggcggaagtcagatttttccgagataaccatggatttctgtttcctgaaactcttgctttcctcggtgcggggtgaggcatgatcctcctttgttttctttccaaataaatacttccacttattgctcttgctacctgaactttcttgcttagtgtgagaaatgtgtnttctggtacctgcccgggcggccgctcga

SEQ ID NO: 25881 - DNA, 425 bp, Triticum aestivum
  Clone ID: PAT_TA_25881
tgagcggccgcccgggcaggtgcatgccatcatcgtcgtcgtggctctccacaaagtatgagtcgcagtatccgaaggccgggaaagtcctgggcgcctgtatcggctgtggttgttgatgttggtaagccatgttgagagtgggtccagatccaggatcgatgaattgcttcggttcgggtggattgatgtgaggtagtgagcgaatgcttcgaactggcggagagtattaaaatagcgtggttccgggtgggatgttgtttgtcgtaatgatcgtgattagttggttgcttgaccgaaaggagtggacagtcttgaacagtagccttgaccaattctggttcagggagggtgttatagacaaatcgccgaaaggcgccttgagaattaaattacagtgatgtacctcggccgcgaccacgcta

SEQ ID NO: 25882 - DNA, 413 bp, Triticum aestivum
  Clone ID: PAT_TA_25882
tcgagcggccgcccgggcaggtacgtgcgaccagagatctcttccagcgcgaccctgatggacctagcctggccgcggccgagggctgccattgagatccaagtctatcattcctctttgttgaacgaaggtcttagtgtggaagaatggctgattgaaattcaacatgttagtatcaaggatcagctcaccgacatgttcgagtcattttgtttcggtattaaattcttgtaaacagttcatgtcgggcatgtcgccgtgtcatattcttatttaaatcatatttacctccgtcccaaaaaacatgtcttatatttatctagatacaaacgtatctaaccctagaactttttgggactaagggagtatatacataaataaagagaaaagtacctgcccgggcggccgctcga

SEQ ID NO: 25883 - DNA, 2280 bp, Triticum aestivum
  Clone ID: PAT_TA_25883
gcggatctacagtctccagagctcccgggaaggaaaatatccgtgaaagaaagagactgatgagccaaagcgtgacgactgcacgcctccgctcacctaaccaaacccctccttaaacaaagcctcttcgtctctcacatcaccccctctcccttcttatcgcctcctacctcactccctctcctctcctctctccccccacatctgccgccatggcccaagcttgggccttcctcctcccggtcctcgtcctcggctcctacgtaaccagcctcttcttccccagctatatatccaaccccctctgcggcggcgatgggggcagatccttgttcctctgcgcgcaggctcccaaggaccaggacccgtctcctgctgtcagcaccatgtacaagaccgccttccacttccagcccgccaagaactggatgaacgatccatctggaccaatgtacttcaatggcatctaccatgaattctaccagtataatctcaacggtcccatttttggtgacatagtttggggccattcggtttcaacagaccttgtcaactggatcgggcttgaacccgcgttagtacgggataccccaagtgacatagacggttgctggaccggctcagtcaccattctgcctggtggtaaaccgatcatcatatacactggtggcgacatagatcaacatcaggcacaaaacatcgcgtttcccaaaaaccggtctgacccgtacctgagggaatggatcaaagcacccaataacccggtgctccgaccggacgaaccagggatgaactccatcgagttcagggatccgacaaccggttggatcggaccggacggactgtggaggatggcagttggtggtgagctgaacggctacagtgctgcgcttttgtacaagagtgaagactttctgaattggacaaaagttgatcacccactgtattcacataatggatccaatatgtgggagtgtccggatttctttgcggtattgccgggcaataggtggactggacttgtccgcagcgatcccacaaggcgccaagcatgtcctcaaaatgagcatgaattgcactgttgacgtgtacatgattggggtgtatgatctcaaacgtgatgcttttgtgcccgatactgtcctaaatgacagtcggctctggccgaggattgattatgggaatttctatgcttcaaaatccttctttgactcaaaacatggccggaggatcatatgggcttggactagcgagacagatagttcttcagatgatgttgcaaaaggctgggcaggaatccatacaatccccaggaccatttggttagccggcgatggcaagcagttgttacaatggccagttgaggagattgagtcccttcgaacaaatgaaatcagccatcaaggaatagagctcaacaagggagatctatttgagatcaaggaagttgacgcttttcaggctgatgtagagatagattttgagctggcgtccatcgatgacgccgatccttttgatccttcctggcttttggaccccgagaagcattgtggagaagcgggtgcatcagttcctggtggtataggtccatttggacttgtcattctggcctccgacaacatggacgagcacactgaggtgtatttcagagtctacaagtcacaggaaaagtacatggtactcatgtgctctgatctaagaaggtcttccctgagaccagatctggagaaaccagcctatggaggcttctttgaatttgatcttgaaaaggaaaggaagatatcactcagaactctgattgaccggtcggcggtggagagcttcggtggcggtggcagggtttgcatcacatccagagtttatccggcggtgctcgccgacgtcggcagggcccacatttacgctttcaacaatggaagtgccacggtcagggtgccacagctcagcgcatggaccatgaggaaggcacaagtgaatgtggagaagggttggagtgctatttaaaacagaggagcaatttgattttctcgattcttttactatcattcatgagcattgcctggcagaaataaggacattcagcaggaaaaaaatagcctatcatttctttgatctctagtattcatatattgtagttactacttagtaagcccttcccatctcagttacttgtatcaatttttatggaaacgcacactagtgatgaaattcacgggatgagtactttagtcccccataagaatctctggaaatgttttaaagtggttacaagactttgtg

SEQ ID NO: 25884 - DNA, 2350 bp, Triticum aestivum
  Clone ID: PAT_TA_25884
gccatggcacaagcttgggccttcctccccgcccgccggtcccgtcgaccgcgcctttgcaagactggcttgctggccttgcgtgtctgttctccaccggcattgttttccacaccctcgtgcgaccttggagcaatggagggcgagtcctcttctgcccacaatctccaaaggcctgctccaccctccgccagcggtacaggactgactaccacttccaacccgcgaagaactggatcaatgatccatgtggatcaatgtactacaatggaagtttaccatgaattctaccagtacaaccccaatggctcttataatcccaatatctcctacaacattgtttggggccattcggtttcaatggacctcatcaactgggatcaatccttgaacccgcaatagaaccggcatgcaccaagtgacataaactggttgctggcactggctcagtcaccattctgccagggtgaacaagtcattcaatgtttctactctggattagtcacaattctatctgcatatacaccggtgatcatatacatcagtcacagctgctttgagacgaaaccggtccggaatatcgcgttgcccaaaaaccggtctgcatccgaccggacggaccaggcatgaactcgagcgagttcagggatccgacaaccggtgggaacttcgaggttggcatatggtaggaagctgaaagggttcaggtgagcactgatctaagtagatcttccctgagagcatgactgtatacacaagtggatgggggcttctttgaatttgactttgaaaaggaaagaaagatatcgctcagaactctgatcgatcggtctgcggtggagagcttcggcggcggtggcaggctctgcatcatggctagagtttacccggtcgcgattgtcgatgacgttggcccggctgcccacaggtaggccttcaacaagggaagtaccacggccaagagtgccgcagcttagggaatggagcatgttaagaggacaagtgcgtgatcaatgtggatgatctcctatattaggcctttgttccagataccgtcgtagatgaacctcggctgtggctgagaatagattatggcactttcaagattttgaaatcggtttttgacgcgaacaataactggatgataacattgggtttgactagggagacatatagttgatcagatgaccatgaaaaaggtttggaaggattccattcaatccccaggaccatttagtaagccaacaatggaagggagttgttacaatggccagttgaggagactgagtcccttcgaacaaatgaaatcagccatcaaggaatagagctcaacaagggagatctatttgagatcaaggaagttgacgcttttcaggctgatgtagagataggttttgagctggcatccatcgatgacgccgatccttttgatccttcctggcttttggaccccgagaagcattgtggggaagcgggtgcatcagttcctggtggtataggtcaatttgcattcgtcattgacgcctacccttataaggactactagattttggtctctttcaagaatctacgagaaacgggtgcatcacatggtacttaggagctgtcctctttggacgtcttcattcatggccctaccaggacaaggaagcctatcgcggctgctttgatcttgagtttaaaaaggcaaaggagaaatcactcaggaactctgtgcgacgggctagcggtggcgtactttgacggcggtgcgcagagtatccatcccaatccaggagtctttcaatttgatgttcacaggcagaggaagatatcactcagaactctcattaaccggtcggcagtggacagcttccgtggcggtggcagggtttgcatcacatccagagttgttccggcggagctcgccgacgtcggcagggcccacatttacgcattcaacaatggaagtgccacggtcagggtgccacagctcagcgcatggaccatgaggaaggcacaagtgaatgtggagaagggttggagtgctatttaaaagagaggatcaaattgattttctcgattcttttactgtcattcatgagcattgcctggcagaaataaggacattcagcaggaaaaaatagcctatcatttctttgatctctagtattcatatattgtagttactacttagtatgcccttcccatctcagttacttgtatcaatttttatagaaacgcacactagtcatgaaattcacgggatgagtacttcagcggccggccgctagtcacacatatgaatctcttgaaacgttttaaagtagttaaaagactcggtgagcaaacaaaaaaaaaaaaaaaaaaa

SEQ ID NO: 25885 - DNA, 347 bp, Triticum aestivum
  Clone ID: PAT_TA_25885
ttttttttttttgatgtgttgaatgatgcattgcctcacttgtcagctatatgtctgctcgcatcgctctcccgccgccccggccgggtccccggcgcctcgggcggccgcccgggcaggtacatcagctggctccactgcagagtagcggtctgaacaaaatcagtctgccctggctcactgtgctaacgtgaccatctccctccctggcccccatctacttcgtcaccggcctagcacaccctaaattcgcgaactccttactcacagtgccaaacacaccgctcaaagtctcaaccaccggcgtcacgactccattcaacgtacctcggccgcgaccacgctaa

SEQ ID NO: 25886 - DNA, 469 bp, Triticum aestivum
  unsure (1)..(469): unsure at all n locations
  Clone ID: PAT_TA_25886
tctcgagcggccgcccgggcaggtacgccgcaactcaaaaaacagcagcagtaaactagcagcagcagcaaaaagcagcagcagcagtagcagtaaaaaggcaaggtagttcagtgcatccgtcctttcttttcgctcgtgggtagtcgtgaaatgacaagaaaaagaacgcaaaatcaaaagcaaagggtagtagtgtaagctttgaatctcttctcactctcgttctccgttttgtcgtatcgtggttcaaaaaggggatcttcttcggtctcctttttgattgttttcacgccccaactcccgctaaagcgcatttcacttcatgcataaggacgaaaaagtcgtttacttcatcggagcgaagttgccgtaagggtgctgaggtggcatgcccatggacgggtagaccggtggaggaggagcaggacggtaaggagacctcggccgcgaccacgctaatcnnnnn

SEQ ID NO: 25887 - DNA, 641 bp, Triticum aestivum
  Clone ID: PAT_TA_25887
ttagcgtggtcgcggccgaggtacagaaagctgcaactggtggtggcgactgaatctcaagtcgggtggaaacagcaaacgagcgagactgccttcgagagcgaagagtgcggtctgcccagcgaaaaatgcgcaaaaacaacgtcgctcatcatcgaggtctgacacccacctttccgtgtgaagagagaaaggagacacacacatgcgggatgttgtaggttctgaatttgactctggttggtttggatgcacgaaaaaaggtggatgtcaggtctcgaagttttcgcagaaaggagaacgccgtgtgaattgcacaattgccctgagtagccgctccacactctcgaatcgtggaaaaggagctcgtgatataagcaaaagggagaagatgggcgttcatggcgtggttgttccgccggtggtcgtctcagacgttcatcgtctagtagccggagattgatggggggcctttaggaggcagaacgttctcagcgaactggccggcgaagttgcctggtcccttgtagttgcagacggtgaaccatgccgacacgcccgctccagtgttggcgagaccgttagggcagtgctgggtggcgcaggcgacgtgggtggtacctgcccgggcggccgctcga

SEQ ID NO: 25888 - DNA, 490 bp, Triticum aestivum
  Clone ID: PAT_TA_25888
tagccggccccccgcccaggtacctcgtcgtcaagttcacgctaaggaaaaaggtcaaccagaagttccgtaaaaaccgccaatgccgtaagctcattcgcgccgccgccgccgcagctgccgccgccgcctttggtgtgccttctgatgaggatgaggatgctataggcgaggacctatttgtcttggcttttggtcagaatgcttttgcattttttgatgatgctgtggaagaggaggctggagttggtgcagaggaagtcgctgatttgttccaggacttgctcgaagagaagacatacagtgaggctgaagatggtaagtccgacaagtagacgaatggccacctgtgaagttttgctatatcctctagatgaagtccttcccagtagacctccaatgtgtcaactcttgccttagccagtcggctgtttattgaacagttggtgatactgttatgtagtgtgtacctcccccgccgcccccccga

SEQ ID NO: 25889 - DNA, 662 bp, Triticum aestivum
  Clone ID: PAT_TA_25889
cagcaggcgtgccaagaagagaacgcagagtgttttcatcatttggtagttgcctcccactctgagaatctccggcatcgccgcaatgggtggctttatctggttggtcagccagagaagcatgctgttgcttggctggggtgtttgctccatcaaggttttccgtctcttcactaacaagtccaagggtctcatactggattgatgaatctggagtgcacgacttcagatcctcatcttgcgttttctgactgctagctttggtcttttcatgcaaaacaaatttatctttcacccatacacactccaggatagtactgggatcattgctcgaggggcgggccgccccccgggccggtactttatcaatactgatcttaacagcctgctttttatccgtaagatcggtaaccttgctgtatactgatacaacatcaagtaacatctgttgggtcaggaccctcactcttgcaagcaaagcaagcactgcagtgcaaagttctacaaaaaaagatctggcaagtaaaaagctgatctgaccggcgcccggctgaacgggctctggataggtagcaatcaactccgaatgaaagttactacgagatttgtttccttttcagtggcaagctaagtgtgggtgtacctcggccgcgaccacgcta

SEQ ID NO: 25890 - DNA, 305 bp, Triticum aestivum
  Clone ID: PAT_TA_25890
tcgagcggccgcccgggcaggtacacacacccaatcattccaacattcctctacgagaagcttgagatgaagctggtgatgctgctcttgagcttgccctcgaggtccttgctcaaagcaccctccttgtcaatggtggacaaaagctcggactcgttgctgcggaggtggctgaggtagtcggactcccacttgaggatcttgttgacggggatcttgtcgaggtgaccgttgacaccggcgtagatgagcggcaccaccccgctgccggccaggggctggtacctcggccgcgaccacgctaa

SEQ ID NO: 25891 - DNA, 253 bp, Triticum aestivum
  unsure (1)..(253): unsure at all n locations
  Clone ID: PAT_TA_25891
tagcgtggtcgcggccgaggttccacatagaaccgggtggcattttcctcacatttcatggtgattttaatttgagcattcagcttgaataccctttaaactttccgtcgttgtgctcttattgttttggtgtagcacttcatgtcacaattgaatgttgaattcttaccactgtagaaacttcaacatatacttattcattagataatgagtatgtctgaaaaaaaaaaaaaaaaaaaaaaaanaanaaaaa

SEQ ID NO: 25892 - DNA, 264 bp, Triticum aestivum
  Clone ID: PAT_TA_25892
tagcgtggtcgcggccgaggttacaaacatgtgtgacaaagctaatccataaacatggatgttgtttttcttttgctactacaggcgatacattcatttcatatgcatacctaagatataaattgtaatatttcatatacatactccataaatatggatgttcttgtccacaggattatgacggcagatgttgtgtacaaacatgtttctgctgcagaacgccatcatgttcaacaaacgtacctgcccgggcggccgctcgaa

SEQ ID NO: 25893 - DNA, 320 bp, Triticum aestivum
  Clone ID: PAT_TA_25893
tcggccggccccccgccgaggtactcttttttgttgaaactatgaccgttgctgtatacttgtcctcctttatcggtgctctcttcgcctcttgagtatctaagacgctgttcatatttcttctcgtccacttgaattaatcagcccgtggccaccacctccccgtcccgcgctcgagtggctgttgtatctccgtgaggttgggacacccggttataccaacattcattatttcagcaatagctgcttcaccaccgatggacctgaggcttggacagcccgtaatgctaagtacctgcccgggcggcccgcccgaaatc

SEQ ID NO: 25894 - DNA, 460 bp, Triticum aestivum
  unsure (1)..(460): unsure at all n locations
  Clone ID: PAT_TA_25894
ttcgagcggccgcccgggcaggtacaacagtaggctctgatttggatctgttgcgaagctatggctgtttaattagaaacatggtttggcaaatgtgggaacatctgcggtgacgtgggatatctggatattggttcgatttacatatcttgtggcagaagttgttccgcttgctacagcaccggcgatggctatgcccggcgacggcgttaactttcccaggcctgaaccagctccttccttgctcggataccaggatcatggaggctgaagaatctatcatctacctgataacccctgaagcttggatcaagttgccagtgcactaaaccgtttctcagtctgatttgaaggccattatgtacctcggccgcgaccacgctatnaatccnaattcccccccggccgcccaatggggggccggggaacaattncaaactccggggcccaanttcccccc

SEQ ID NO: 25895 - DNA, 254 bp, Triticum aestivum
  Clone ID: PAT_TA_25895
tcgagcggccgcccgggcaggtacgatgtctacaagttcctggtggctgagattgaggaatgcatgtgtttatcacttactacattccaaacaatatattgttctcctggtcctgcttgacatcatatatctatcctaattagctatatcctatgtagtgaactggttaattattattggcagtgaactgattacttgttcttgttggacattatgtatcttgaacattttgtacctcggccgcgaccacgcta

SEQ ID NO: 25896 - DNA, 3287 bp, Triticum aestivum
  unsure (1)..(3287): unsure at all n locations
  Clone ID: PAT_TA_25896
cgccgcaggattcgctgcgccatgacgagcctgatatcccagaacgcgctccagaagcgccgcctggagaaggacgacgacagcagcagcgatgaagagaccatggattcccccgtcgcttcggatgcagaggccgggaagaagcccaggccggaggatcgcaggaaggaccggaagaggaagaagaaggcgctgcaggccaggcagggccaggaggccgatgagatgaggcggctggagagctctctgtttggcaacatctacacaccgctggagttcggcaccgaggccggggctgccgtgccggctcgtgaccaggatgatgatgctcccttgttcttcccggccccgtgggccggcgccgaccttctcccaccctgcctcgtcgcggaacagtgctcccaccgccggcgccatgagtaagttgcagagcgacgccctgagggaggcaatcacaaacattatcaatgactgccgtgagaagcaccgcaacgttcgttgaaaccattgaggctgcagattggtcttgaagagctatgacccgcaaaaggacaagcgttgccgtgggacgaacaggctgcctctcgtacctcgcccacagatgagggtttgcatgcatggtgacgcacaaaacgttgaagaggcaagtgaaatgggcatggaccgtaagaacctgcaatccatgaagaaggttaacaaaaataataatctggtcaagaatcttgcaaagaaggtataatgctttccttgcatctgatgtggtatttaagaagaagccgagccttcatcaacgtggttttaacaaggaagcgaacaaagacatattatgctgtccttgcagctgagcgttatcactacaagcagattccccagacttcttggacctggtcttaacaaggcaggaaagtttccaactttggtgtctcaccaggaatccctcgagtccaaggttaatgagaccaaggccacagtcaagttccagctgaaaaaggtgctttgcatgggtgttgccgttggccacctgggtatggaggagaagcagatcttccagaacgtgcagatgagcgtcaacttcctcgtctctctgttgaagaagaattggcaaaacgtgagatgcttgtacctgaagagcacgatgggaaaggtgtaccggttgttctaggctctagtcttctaggatttccaggagattgacaacttggaacttttgttgctttctcaattatcaaattttcgtgcgcgacgagtgacaattattgtcttgtaccgagatggtttgttctattgtctggaacttgatgacatttaattcttctactcatttgatctggtgaaagctgctgttagtaagattggacccttgactgggcgtgaggagaaaagcctggagagctttgagatatcacctgattcgagaaccattgcgtttatcggtaacgaggggtacattctcctgatatcttccaaaacaaagcagctcattggaaccctcaagatgaatggtaacgtgcgttcgctggcctttgccgatggtgggaaccagctactgagcagcggtggggacggccatgtttaccactgggatctcagaacaaggaagtgtatgcacaaggctgttgacgagggctccctatcaggcctttccctctgcacctcccaggacagctcttactttgccacaggctccagcagcggcatcgtgaatgtgtacaagagggacgagttcctcggggggaagaggaagccgctgaagacgatcgagaacctcacgaccgagacgggccagatgaagttcaaccatgacgcccagatcctggcgataagctcgggcaaggataggaatgggatgaggctcgtacacgtcccatccttcaccgtgtaccaaaactggccagggccacggttcagccttcagtacccgaggtgcctggacttcagccctgggagcgggttcctctccgtcgggcacgccggcggaaaagttttgctctacaagctgcaccactatcagaacgcttagggctcccacagtccagttttgacactgtatttttctgcttccagagaaaacccttgatgttatctgtaacgtgattcttcttaaaccctcttgccttgtgagtgccgttgtcacagatattttaatccgccgcgccctcctcccaccctgcctcgtcgcggaacagtgctcccaccgccggcgccatgagtaagttgcagagtgacgccctgagggaggcaatcacaaacattatcaatgactgccgtgagaagaaccgcaagttcgttgaaaccattgagctgcagattggtctgaagaactatgacccgcaaaaggacaagcgtttcagtggttctgttaagcttcctcacatccctcgcccaaagatgagggtttgcatgcttggtgatgcccagcatgttgaagaggcagggaaaatgggcctagactgcatggatgtggaatctcttaagaagatgaacaaaaacaagaagctagtcaagaagcttgcaaagaagtatcatgctttccttgcatctgaggctatcattaagcagattccccgtcttcttggacctggtcttaacaaggcaggaaagtttccaactttggtgtctcaccaggaatcccttgagtccaaggttaatgagaccaaggccacagtcaagttccagttgaaaaaggtgctttgcatgggtgttgccgttggccacctgggtatggaggagaagcagatcttccagaacgtgcagatgagcgtgaacttcctcgtctctctgttgaagaagaattggcaaaacgtgagatgcttgtacctgaagagcacgatgggaaaggtgtaccggttgttctagactctagtcttctaggatttccaggagattgacaacttgggaacttttgttgctttctcaattatcaaattttcgtgcgggacgagtgacaattattgtcttgtactgagatggtttgttctattgtctggaacttgatgacattttatccgttgccccctgtgccttcctactgaactgcctgctgtcacagccatcagtttaacgctagattcagcattggtccaaaaaaaaaaaaaaaaaaaaaaaaanaaaaaaaaaaaaaaaaaaaaaaaaaaaaaaaaaaanaaaaaaaaaaaaaaaaaaaaaaaaaaaaaaggggggggccggttgaaaaacccggggcgcgagcccgggcggagcggccgtnggtgcaaattttggggggggtccaaatattcaaatgaaaacttttaaggcccaaaaggaaa

SEQ ID NO: 25897 - DNA, 729 bp, Triticum aestivum
  Clone ID: PAT_TA_25897
ggcctggtgggtttcgtgcaggctttgttcgacgcaataccgttgctcacggctgctcaagcagctgctagggccgcgtgtggcgtcagggcttcgagagcggcgatatctcacgagaagtctacttcgacgtctgacatgctctctcaatccaggacgcgaatggcatcaagagctacagctactccggtgcgtctagggaggcgcagggcctcgaggtggcgattaccgtcgggccgcgtgacctccggctacacctccaccccttcttcgacaccaacgtctgtggcaagaaaaatcctcgcagttactaccagatctggcagactctaggcgtcgacagcccgtcccagatactcttcttgcccgatgtctaccaagattccaccgccgcaagggatgcaggtcttgaggtgctaatatcgatcaggcctggaaacgcgccgcttcctgaggatcacggcttccagaccatcacgtcgtttgctcaaatcgccacctgaatgccacagagagctcacccctgccatatgtgcacaagagtatcatttataaagggaaaccatctgatctcaaagcattggcttttttatcgtttccactagagcagttgcaactcattaagttgcaaccacaagagtcggtacaattgtctcaagcccttgtgtaaaaccatgactcgtcaattgcaggtttgcctaaaagcagaacacatgtgggtattttatc

SEQ ID NO: 25898 - DNA, 712 bp, Triticum aestivum
  Clone ID: PAT_TA_25898
tccaaacggcccaaccgacggccactcacttcggctagctcaggccagcagcacaaaaccaacaagcgagcgcgagcgcaggccatcgcatccatctcatggcgctcctctccatcctacgctcgtctccgctggccgtccccgcggcctcttctcgccgcccacccaatcatggtgtctacctactacgcgtcagcaccagggccgcgccgtcgtctctgtccgtgaggtgcgagcagagcagcaagccgggcggcggcagcgtcgtcgacgtgtgggcgagccgcctggccatgatgagcttcgccgcggcggtcgtcgccgaggtgtccaccggcaagggcttcgtcgagaatttcggcgtggcaacgccggcgccggcgttggcgctggtggtgacggcgctcgtcatcggcctggccgtcctcttcatcgtcaggtcgggagcgcaagattgatggatccatcgcacgaaataattgaagacccttttctagaatacaatacaaagtaagcggagacctatttctgaagaacgagcgtgcagatcttctttgcatctggtttgcaaagattcctggagattataattagcattacttctgactgtaaatgatctgatgtatcatggtactactgctgtgagcatattcatatggaaaattctggttcaaataaaaatgagccaaaggcttccgatgttactaccaaa

SEQ ID NO: 25899 - DNA, 261 bp, Triticum aestivum
  Clone ID: PAT_TA_25899
gcggccgcccgggcaggtgttggttagaaacttccagtttgcctgtttattccacctaacattacacatctgttgacctcaacatcacccgtttaaacccgcatctattgcaagaccttggaaatggccacatttgtatcatgtagtagcggattttcttctaatacatccaaatcgacgtatcttcgagcaccgaaactctaggtgttgttgccttggaagcatcctgctccttatggtacctcggccgcgaccacgcta

SEQ ID NO: 25900 - DNA, 270 bp, Triticum aestivum
  unsure (1)..(270): unsure at all n locations
  Clone ID: PAT_TA_25900
ccgaggncnttttttttttttttttttttttttttttttgcattggaacaaagcctcatcctttttcccagtaaccccttacatgacaccttttttggtataccaccagcacgacacggcagcctaccaaaactgtaaccatcagatgtgcactacaaactctacatcaagctcattggtgcaagcgaccaactgaaactaagtgtctcagcagttctctctaaaagcatggcatgaggcgcctgccacctgcccgggcggccgctcgaa

SEQ ID NO: 25901 - DNA, 497 bp, Triticum aestivum
  unsure (1)..(497): unsure at all n locations
  Clone ID: PAT_TA_25901
ttcgagcggccgcccgggcaggtacagttggaagcataccaactctggttgaattcaagctttactctggatgcttagggcctatcatcataagttcaggatttgaagagttagagaggctcgagttgaagttcagtttttcgcagctgacgtttgaagtgggcgctatgcctaacctgaagaaacttgatctccatgtttatttatctaagttcaaatctgttggtgctggttttgattttggcatccagcatctctccagccttgcttcggtttctatcgtcatattttgcgagggcgtcagtgctgcctatgtggaggcagcggagggagctttcaagagcatggtcaatggacacccgaaccccaaccgacccatattggaaatgactagagaatctgcggacttcatgtcacaggatgagtgacaaaatggcgctggtcggtgtttcggtgaataatcatgtacctcggccgcgaccacgctaatcnntnnn

SEQ ID NO: 25902 - DNA, 357 bp, Triticum aestivum
  Clone ID: PAT_TA_25902
tagcgtggtcgcggccgaggtgccacttccgcccatttccagcatagggtttgatctggttgacttgccagacagcgtgcaattccactttgatcaagcaagggcaaaaccgaagaagatagctatcgctgatgcaccatccaagaaggccggctatagcaacgcggtgttcgacatctcaattgccatcgccaggggtggtttcacctcggacgggtggaaactattaaggtcggacctcatgttcccttttgtgtatgaagatgctgttcttcatggcggacggatctttgcactgacaaacggggggtctgttttcgtttggcagctctcgtacctgcccgggcggccgctcga

SEQ ID NO: 25903 - DNA, 310 bp, Triticum aestivum
  unsure (1)..(310): unsure at all n locations
  Clone ID: PAT_TA_25903
ccgaggtacccgcgtgtgctctaccgaccgccatgacgggcgttcgccgttttgccgccttcttccacccccgcctcttcccacctcttctttgttgggtgtagttgaaatccgtgacaacaagctagctagctagcaaccatttttcttgccgtgtccatatatatacatccttctccattgtagatccattgtatttgtatgctgctatattatgtcaagttgagtgaagcaaacaaaanaaaaaaaaaaaaaaaaaaaaaaaaaaaaaaaaaaaaaaaaaaaaaaaaaaaaaaaaactaaaacccca

SEQ ID NO: 25904 - DNA, 806 bp, Triticum aestivum
  Clone ID: PAT_TA_25904
tcggcacgagggtgttgagtaccatccagatgctggtatagatattaatatgccttcatctagtgggcacaggaatattgaaatgaacgatgcctttgatctcaacgatagcaaccaagcacagcaaagtgcttgtgcacaacctgctgctggaagtgacggaagggagataggaggaagcagtactaatgaaggggaggaagtccttaatgcaggcacaactcctgcttttgcaagggatcagcttagcttaggaattagtggtggaagtgttggcatgggtgctagtgacgaggctgaaattcatggcattgatgtatctgtgcaaagaaccgagagtggtgtaggtgatgcagaacctattactgaccttactgagacaatgggccataccggtgaatcagttccagggcctggattgatggatgagtttgtacctgaagaagttgatcgggaagaacctcatggagacagccaagatattgtgttccgttcagcaggccgtgctgacagtggatcaaaatattttggttctaataaagctgattctggtgagagtggaaaaaagataggacatgccattggtcatgaaagcagcatgcatccttctctctcttgcaatgctggggtgtatgccggcttcgatgcatctaaagaggaagtgacacaggctggcaaagcagtgactactgatgatcaagggttgcaatatgatctgcagaatggattacgagcaacacatggagaaaatgactatgaaccaggtcttccaagatttgatccttgtaagcatcacaacagttact

SEQ ID NO: 25905 - DNA, 625 bp, Triticum aestivum
  unsure (1)..(625): unsure at all n locations
  Clone ID: PAT_TA_25905
tagcgtggtcgcggccgaggtactattttaacgcaaggctttgccacatcgggtcttttaactgaaatgcatcaatccacgatactagtacctgctctacaatctcagtggttaatgatgcatgtcagtatgatgttattaagctatgcaactcttttgtgcggatccttattatctgccgctattctaatcattagatttcgaaataatttccatttcttttctaaaaagaaaaaaaatgttttaaataaaacatttctctttagtgatattaaatatttttatgcaaaaagaagtgctttaaaaagaacctctgtcccttcatttccaaattattacaaatatcaattaacggagcgtttggattcttggagttatcgtgtcattagcctaggatttacccttttaaccgtaggtattctttgtggagcagtatgggctaatgaggcctggggatcctattggaattgggatcctaaggaaacttgggcatttattacttggaccatattcgcaatttatttacatagtagaacaaatccaaattggaagggtacctgcccgggcggccgctcgatccccaattttttttaattnttaaaaannaattccaaattggganggg

SEQ ID NO: 25906 - DNA, 232 bp, Triticum aestivum
  unsure (1)..(232): unsure at all n locations
  Clone ID: PAT_TA_25906
tagcgtggtcgcggccgaggtcttgaatctggctactgttctgtgaggaattttgagatggatttcgaaccttgtttgttcctagacgctttggaaagcttggggcatgcatgactagcacatgaattttatgaatcttgaatgtgactactgttcaaacttgtcagtgaggaatgggcaataaaaaaaaanaaaacntnaaatgnatctttnccaaatgggcctnaaaaaa

SEQ ID NO: 25907 - DNA, 234 bp, Triticum aestivum
  Clone ID: PAT_TA_25907
tagcgtggtcgcggccgaggtacatcatcaacattgaggctgggcccgcagccgtggagcagcagcaaaacgcatgatcgatgacagtgaatccgtgatacattgatctgaccatatatacatgaagatgcgaagggagcatctagagaagtctaagacaaactttttgggacagaggaagtatatgtgtctttagcatgtcttgatgttgtacctgcccgggcggccgctcga

SEQ ID NO: 25908 - DNA, 272 bp, Triticum aestivum
  Clone ID: PAT_TA_25908
gatttcgagcggccgcccgggcaggtaccataacatcagtaagaaaatgaaaatttctcatatttgcagaaatccatgagaacaaaattcacatacttcagtgctcaaagtcagcaaacgaggattattctttgtcttgtcagcaatccaaagtcagcactcgacagttgttgaattgttataggttggaacacaaaattttgagatagattcttttgcttgcttcatgaactcatgcatcatagtatcgtacctcggccgcgaccacgcta

SEQ ID NO: 25909 - DNA, 272 bp, Triticum aestivum
  Clone ID: PAT_TA_25909
ctggaaaaaggaacgcctatcaaaatattgatgaataagctcttatctgaatttgcagcatcttaacctatatatgtttctcttttcaaaacaaagattatatgtatgtttcaagtacaagcttttttttttttttttttttttttttttggataccccccataaactcatcatgcccaaccaaaacagaaatacccaaagttcaccattttttttggcaacgaagttacagttgttaaactaaaacctgcccgggcgggcgctcaaaatta

SEQ ID NO: 25910 - DNA, 336 bp, Triticum aestivum
  unsure (1)..(336): unsure at all n locations
  Clone ID: PAT_TA_25910
ggcagcaagttcagactttcaccaattcatttatgtgaaaagagtcgagacactaagaaatagtagcacatgagaagtatccaatgtgaagagagccctcggttacaggctggaaaccatggaacataagggttgctacatcctgggccgatggcccatgtgagttcggagtatcgccagccgtcaaacaaacgagcaacataacagcaatcttcacagcctgcctcgcgangtttggtctgctgcattagattggcttatacaccttgcttttctgcattcacatatatatcacgaaaatacctgccncgggcggccgctcgaaatcaannncnn

SEQ ID NO: 25911 - DNA, 338 bp, Triticum aestivum
  Clone ID: PAT_TA_25911
tagcgtggtcgcggccgaggtgtctggcaagccattcgtctcgaatgctatgcttaaaagctgctaaggcttcagcgtccgggcagtcgactatttggttctttttagtgaggaacctattccaaagctttcgggctgactctccgggatgctgagttatatgactcaaatcgtctacatccggtggtcggacataggtcccttgaaaatttgcccgaaaagcgtcttcgagctcttcccagcttccaatggagttttcggggaggcttttaagccagtgccgagctggccctttgagcttgaggggtaagtacctgcccgggcggccgctcgaaatc

SEQ ID NO: 25912 - DNA, 334 bp, Triticum aestivum
  Clone ID: PAT_TA_25912
tagcgtggtcgcggccgaggtacttactctgtgctgggtagactctggtggtatactcgtggtttatgccggttgactctggtgaagatttgctttatttgttgcattccgctgtggcccttgtgcattcaatttggttgcaatgttctgtttgatctatggtcattgcttcgaagttctgatgttcacctgttaattagatgtgctcacaggggtctggactgtgaaagaacatatttctgttgattagatttttgcttcagccactctgtagcactgaacttgtaaggccgacttcagagcaaagagttgtcaaacagataaaaaaaaaaaa

SEQ ID NO: 25913 - DNA, 1170 bp, Triticum aestivum
  Clone ID: PAT_TA_25913
ctcgttcccccctcgcgcgcggaaaccccgcctcgcctccacccaccgccggggtccagccttccgcttccgccgccgtggtgctcgaggcttgtcttctggtgaattcggcgattcaagcaaaagaaaaccatgagctacttccaagctacaacttgcaagcctcatactgggctcattgcggacagacccataacgggtcttgggaagacctgcagattactacctgtcccccagtattccctacggccacgtcctctcggatttcgcaagcttgataagcatatctacccacgccttgttcttgttgctgctagccacccaaggcttactcctgtatgcgcctcaagtggaaaagggaaccccgagattgacaatgatccctttatggatcatttgaagaaggccatggctgatgcaaaaaagccacgacccttacaagatgcgctgaaagagaaattcgccaagctgagagaacaagcatctggtggaggtggagggaatggaaacaggcgtggaggtaatggtggttccggtggcccagaagatgaatcattcaaggaatcattggatgaagtagtccaagttatcttagcaactgttgcttttatacttgtgtacatccatattatcagaggggaggagctgtaccgtcttgcgagggactacactagatatctggttactggcaagcgaactgcccggctgaagcgctccatgcaacaatggcgcagtttctcggagaaattcatgcaaaacgagggctctcaagaagagcggtacgaaaggccagctgctacggaacccatgtggtggcagcagcctcaaaagtttgttcatcttatggaggagctttgcagagggaactggcgtccacatgcccagaagtcttagttctggcgttccaccgtccttttttgacacttgaaagaatatgttgggtgttgtgtgggtgagatgggtactggctgcgttgcttggctggcgcaaaggttttacatggatggagtttcctgatggggcagagatggtgttgttctttgttcgttagcctgtatttctgtctctggtttgtcaagtatttgaatgtgggtataagttgttggaaattttgtagttgaagagaccgattattccttatttatgatggttagcttgctctaaaaaaaa

SEQ ID NO: 25914 - DNA, 996 bp, Triticum aestivum
  Clone ID: PAT_TA_25914
ttcagcggccgcccgggcaggtcagaaatgaagcctaaatcgaatgtccactgtgtaacatgtggtgaggatgggcacagggccaagagctgtccaacacgggtgtttatatgctacaaatgcaatgaagaaggccacatatccaggaagtgccctcagaaccaatcatcagaaatgaagcctaaatcgaatgtccactgtgtaaggtgtggtgaggaagggcacagggtcaagagctgtccaacatgggtgtttacatgctataaatgcaatgaagaaggccacacatcccagaattgccctcagaaccaatcatcagaaatgaagcctaaatcgaatgtccactgtgttagttgtggtcaggaagggcacatggccaagagctgtccaacacgagtgtttacatgcttcaaatgcaatgaagaaggccacatagccaagaattgccctcagaagcgttaagaccgccacaccgagagctgtcggtaaagcaaacagtgccacacactatacatgtcgttacatattcaatcacgccgagaagcagctggtgaagagattttgacactgagatacaaccaaggaagctcgcaaagttactcactgagctgagccagacctccacctttgaccaagaagttcttgcagaattactcacgccgagaagcagctggtgaagagctttttcttgtgatattctagctgttgaaagttttcaaggatctgtctatttatgatatgtgttttagaatgtccttttctatgaagttggtggtgccaattgaagatctgatgaaaagacattcccaagactgcgttcacaactgccggactgtgcaagttactggcatgttccttggtttaataaatgcttatccatactaaatgaactggatgaagtgtaaggaatacatctgggtaagttgcggcaatattctgtaatatctgaagaatgcatagaacatctgagttagtacctcggccgcgaccacgcta

SEQ ID NO: 25915 - DNA, 361 bp, Triticum aestivum
  Clone ID: PAT_TA_25915
ttcgagcggccgcccgggcaggtgcgatattcaaacgaaactcgtcactaaagatcaaactgtggcccagttcatcgcagagttctatgggttcgaccgtgacttgttgtgggttgttgcagtagttcatgttgctttcaccgtggctttcgctttcatgttcagttttgccattatgaggttcaacttccagaggagatgaaggagaggagatgtcatttttctgtatccggttgtatttgcactgggtgcactgctgatgcatagcacccgttgttaatggagatcactgtaaccatttgaggtttttgttccattctgcaataaagatccttcacaaggtcttattaaaaaaaaaaaa

SEQ ID NO: 25916 - DNA, 228 bp, Triticum aestivum
  Clone ID: PAT_TA_25916
tcgagcggccgcccgggcaggtacactaaaagcctcgcatacaaaatgcatactacgcgctaacccttaaaagacgagctgaaatgcatagctgtgattccacatggagtaagccaagtggggtcacctcaatctaccatctgatctgtttagtgtctcccaactaatgttctggccacattcgtcacagcttgtcgtgcatccagcacctcggccgcgaccacgcta

SEQ ID NO: 25917 - DNA, 783 bp, Triticum aestivum
  unsure (1)..(783): unsure at all n locations
  Clone ID: PAT_TA_25917
tagcgtggtcgcggccgaggtaccgctggtggcgctggcgatttcgttgccatgcaagttcaacgcggcgtggtcgccgccgagggcaagcgtgtcgtcgtcacggagactggctggccataccagggtgacgccaacggtaacgccgtcgcaagcattgagaaccaggcaatcgccctcgcctcgatcaagagcaagttcaccgaggactgcatcctcttctcttccctcagtgatcactggaaggtgaacactcctgcaaccttcatgtgcgagcagtattggggaatctacgaccacggcaactagatgggtggttttccatcgatccatgggaaacggcgttatgagacttcctactccacgtcaatgctggttctgtgcgatgtcctctgcgtgtacaaaatgcgctcgacgcatgacggcagttgcagggagagaggactatgcatgggtggcgttcttcttccttccttctcttttaccccattttggtgccttttcgggtggagcatgaggaggactggcttttcttctcaacagtccgcttcttggacatgagggaaggaaacgacagcagatggtgcgatctgttttgaagatcgtgcacgctgcgggtcagtggtccgccaggaatggaggagtatgagactttcgtcgaaatagcttctttacctctttcgctgtgattgaacgagttgtcgcatcagttgatcgcctccgcgtggaggaggtacctgccccggcgcccccttgatttttttttttttttttnnnnnntnn

SEQ ID NO: 25918 - DNA, 295 bp, Triticum aestivum
  Clone ID: PAT_TA_25918
ttcgagcggccgcccgggcaggtcgaagatacggtttactgtttccggtctggttcctactcgcctcaactataatttaaaaaaccggaccggagatcgaaccgatgagcccgtcagttcagcttctcattggttttcattgattcatctgtaaactgtagaaatacgtttagatatatcaatttcagcaataaataatatgtatcgaagggagtaataaaattaatatgtattgatgggagtaataaaatattaagtagcatgttaatatagtacctcggccgcgaccacgcta

SEQ ID NO: 25919 - DNA, 846 bp, Triticum aestivum
  Clone ID: PAT_TA_25919
tagcgtggtcgcggccgaggtacacacacataatatgattcatggacattattatttttctttgtgtggttgtcgcagttttggtgtctataattaagtcctgaaatctgcacaagattttcttgttagttgtcacatctgtgcgcactgattgcagagcagtttggttgacattgacagctctcagagaaaaaatgattgactgtcctgatttgaaagttcagttaatcagtaatttacctgacagccttgtaacgagtgacatcaacatcattgtagtaatgtgacctattatcccgtcatgagtgttatcatatatttgaggtgtcatgtattatgtgttaatcttttgataaccttgttattaatattgctcctacattttgaccatttatctcatgttcatcatgacatgaatttactgtttgtcgagagctggcaatggttaatccacggtgcatttctaagttcccttcaatggcaaccggttggcattatattatttagttaatccctgagtctttcacataggcctcaattagtctagtatttggttgttttctacataggactcaccaaatacaagtttttcagatttccattgccagaaaatagagaccaaaagttgttgcagttgttttacttgtaataaatgcattattatctgtaggaagctgtgctaatactcatgcaacctctgttactcgtagcttgttatgatcgtccagctgaaacctgtgttgcttctaatgtattatcattggcctcatcctttattgacatcaaattaatttggtggtttgtcacaggaataaaaaggagtacctgcccgggcggccgctcgaa

SEQ ID NO: 25920 - DNA, 1107 bp, Triticum aestivum
  Clone ID: PAT_TA_25920
atcgccctttttttcgggggaaaagtgggcttgcagtcgccacttgtggtcctgcactcctgctctgccccagcccgcaggataagaaacatgctccccgtgctcatcgccggtgcctctgcgccgccgcgtcccttctcccccaggcgccgccgcgagctacccatccggctgtcctcgtccaaacctccccgtgccctgcagaacagcgagggcggcagtaggcccctggggcgcgcctggccggccgtctccgctgccctcttcggctcggggttcctcctagggccgctcctggacggcatccactcccgcgtcggcctccaggtgtacggaaacggcgccctcgacctgggccccctccacacccacatcctggtgccgcccctgctcggagcgttctactgcaccgtggggctgctccggctgttcctggacgagagggcggcccccaggtccaaggccaccgggagcccgcgcgacacggcgacgtcgctcatagtcctcgccctgttcatcgagctgagcgcggagatgtacagagcgggggtgccgagcaacgtggaggcgtacgtgctgttggccgtggcggagttcgtgtggctcttcctcgacagctcctggctcggcttcgccctggcctgcctcgtcggcgtcgcctgccctctcgccgaggtcccgctcgtcagattgctcgagtgctggagctatcccaatgccgacgtccagctgtttggcaccgggctgatgagctggacgacgacgtgctacttcgtgtacacgcctttcctggcgaatctggcgagattgctcaagtcgcggctggcggacgataacacggaggggaaggaagaatgaagcggctcgcccgtgagttttgggggagccctcctatgaagccagcgcatggtcaaacgggtagcgcaaggaaagctggaggctcaagagccatttgggatcgattcagattttagggtcggatcaagatcgtctgagctgagtattattgtcttatgtaccgaaaatgagctgatcttgagccaatacgatactatattttagctccaatgctcgccaaagcataaatatgcactaaaaaaggggggg

SEQ ID NO: 25921 - DNA, 651 bp, Triticum aestivum
  unsure (1)..(651): unsure at all n locations
  Clone ID: PAT_TA_25921
ngagatcctaagctctacgcaaataatgtcagaaaactaatagcaatggaggtaggctaaacccaaaactgagcttgtctaaaacaaccatgcaaaggtcaaacaacttcttcgtaatatatgtatccaccgagggctgggtaacaaaaaggcaaagggcaaaacagttctttttttcaaaaaataaaaatcataaaaaaggttcttagggcctttacttagtgtttttcttcttggacttcgttcaagcttggggtctttcctccaataataagctctacaatcaccgatcaccttttttaaaatataaattaatatggtcttaatcccaccatataaataacgttctctttctgcagggcaatttagttctttctaatattgggctggcagagaagcgcgtgtaccatgcagcactgactggtagtagtctacctggcgctagacatgagaaagatgattgaaagacgttgcgtcgctttttctgtaacagacagccgaggaacacttaaaaatgtaactgtgtgcgtgtttttatacctgtaatgtggcagtttatttgtttgaggaggctgttgagtacccttctcatactacattgtacaaaaacaatgtccaatgtccattatagtttgatgaggttcgtgctcc

SEQ ID NO: 25922 - DNA, 519 bp, Triticum aestivum
  unsure (1)..(519): unsure at all n locations
  Clone ID: PAT_TA_25922
tagcgtggtcgcggccgaggtacaaatagcctctctttttggtggtgacacggtgtcccttccaggttcagcagcaggcaatgctcaagacagagttgggtgcacatcatatttatacatatgttgtcgcatcttaataaacagagatgagcagaagcagagatgagacatctatccgactgtcatccttcccagacttgggtctgtcatctctgtcagcatccgcttccgcttccttagttggttgtcgcttctttgtaacaccatttgaataaataataaataagcctgagtttggattaatcttgcgtagcccattggattgattggatatcagaagatacgtgtatacttagccaagacattatatgctgactgagttccctaagcagggattttcagtcacactttctatagccacgttcatgagttgattcagtatagctcatgagttgattcagtattattattgatttgcaatacagttgattcagtacctgncccgggcggccgctcgaa

SEQ ID NO: 25923 - DNA, 498 bp, Triticum aestivum
  Clone ID: PAT_TA_25923
aggagcaaatgtgcaacatagggcatctatgcctcctgcaacctacaacagacaatcaacaaatataaatcatgtctgtcgtaggatgaaacgctaagcccccaccagattgtagtactgtgctaaactttgtgaagtaggtgggattttacaactacacacatcagccacgaaagcacatagacgcagacccttgtacccctgaaaagcggccgcccgggcaggtaccttacaccaaggccattgcatgtaagtattaaacccttgtgtcggttcaggtaatccgctgcattctgatcctgaacgtataaaacacctttcttgtcatactcctgccgttttactggattgctaagaacttggtaggcctcattaatgtcctgaaatctggatgttgccttttcttcaccttgtttcttgtcagggtgccatttcagcgccagacggatgtagctcgacctgattgtctcctccgacacctcggccgcgaccacgcta

SEQ ID NO: 25924 - DNA, 1585 bp, Triticum aestivum
  Clone ID: PAT_TA_25924
cgattagcaccagatcctgccgatgccgacggagatggccgcctccaaccaccacggcccggatccctggctctctccatcgttctctgactctcgccgacgtccaccgggatcgacctcctgacttagccgtgcggttaagtagcaaagggaggttcgctggcttccgtcgagcagttcgttgcacctccccaccgctagtcacgcatcctccgccgtcgcagtggagcagcgccaccaccgtggccgtgtccatgcgccgggacgccgaggctagtgcggccagggcctggaggtcgccacttctaccgcgcggggctccttgtcccgctcctcccctgcccaccttctcccaatgcggcccgccccatcgcgccgccacgtcgcccccagatccgagcgacctctcctgctccggtccagcggccaccgccatgtccgccgcgccctgggaacggatctggccgcccgtgcagcagatctggccagccccgggcaaatccctccttcccacactccagcagcacgtggccctaccacgcccgccgttgaccgtcgagatggagcaggccgagcgtcgcgggcatggccacatggcctccttcacttccagccatcccttagccacctacaaccgtgcgcgtggggttgccatgcatttcagtgcagctcagcgaccgtggaagtgcagctcgaaggcgcgcgtgatgaggttcagtgcacctcaaacaccattgacctcctctcctacatctgtgtgggcatgcggtttgccggcgcggtgcagtgtgctgcactggttctggtgatgcaattcaccggcgtagtccccctatccagcaccgagcagcagtttcatttaaacaatgttgtcatcaggttcgtcaacgcaaacaagcagctcagtgccagcgggcatgcagtttggtgcaggcgtccagttgcggtttagttgttgcgccatgcagttttgctcggattcgaggtggcccttcgttgtgcactgcaaaatttatgttataaaaaatcgtggcttcgatgcctctgttccgctcgagcagcgatgcagtttggttgggtcacgtgcgctgaaattgttgttacgtatctaatttgttgttatttatctcagaaaatgttgtttacttacggtaatgtggattagtttcaagtgtgttgtggttcagttttgagtgtgttgtggtttactaatgcccgatgtgaagcacacttcacttgcttgtttgggaaaaaaatttgtatgagaaaagaaactatggagttcacttaaaaaaaaaaaaaaaaaaaaaaaaaaaaaaaaaaaaaaggaaaaaaaaaaaaaaaaaaaaaaaaaaaaaaaaaaaaaaaaaaaaaaaaaaaaaaaaaaaaaaaaaaaaaaaaaaaaaagggggcggcgggttttaaaaagatccaagtttacttcccgggtgcttgcgaaggtaatagctttttttttgagggccccctaaaattaaattcactgggccggggtttaacaacgtcgggaactgggaaaaaccttggggttccccaatttaatcgctttgaagaaaatccccttttc

SEQ ID NO: 25925 - DNA, 551 bp, Triticum aestivum
  unsure (1)..(551): unsure at all n locations
  Clone ID: PAT_TA_25925
ggatagtcattcaaccctccattcaggtatccagaatgttacttggctaactatctgaccctcttgatgcagaaactcgctactataagaaatgcatcgcacaaaagtatattatgggaaacacataattctgaacaaaagatgacaagccaggttcctttgtgacatcttctttcaacgcttcatttatccattgattcgaaaaacttatcctacatatccaatagctaacaaaactccagctcaaaatcactctttaaacaatcgggtcatatttcacgttgtcaaggtaaagcccgtaagcaggtgccataggaggtgcagcagtcattgtctttgcatccagaattctctccacatcagcagttgttagatctcctattccaacagctttcaaaagaccgaccatcaatcttacctggtggtaaaggaaagactgtgcccttgcagtaacaacaaagcagcggtgccttaatctctttccaaactcttgtccattctcgcatactaatttcctactnntagtacctgcccgggcgnnngctcgaatc

SEQ ID NO: 25926 - DNA, 339 bp, Triticum aestivum
  Clone ID: PAT_TA_25926
ttcgagcggccgcccgggcaggtacaggggatataagaaggagcggtaaatctactgaagaagcaaaagagcaagagaaacgaaaaaggatgatgccatggaaggatcgatcgtcagtcagtcagtagttgttgctgttgtagccgatgtagttgttgcggtagcgcatcccatactgctcatagaaggtgtcgccgtagttcaccgccttgatctccaccatgcgccgcttgctgtccacctcctggaccgcgccgaacaccacctcgttcgtcgtctcgcagctctgctcgtagaaggtctgcggcccggaggagtacctcggccgcgaccacgcta

SEQ ID NO: 25927 - DNA, 449 bp, Triticum aestivum
  unsure (1)..(449): unsure at all n locations
  Clone ID: PAT_TA_25927
tcgagcggccgcccgggcaggtactgtttggatatattaattgctgcagttatcttcacatttaaatccggtgtgcctaatatactggtatgaaatgggcaatgttgacttcctggatgaacggtaactgaatagcttgtttgctttgtacaacctttccaaggaaagaagcaattctctgttgcagtagtttgttgcagtggttctaaggctggacatgataatatgtattttagatcacaggctgtgctagaaattttggaggtctggtgtgggggcagttgtcgcatcttttacaatttcacaattcggagttatcagttgtgacgctcgcacgacttgcagttgacgaagccaatgttggaaggatgttgacgcatggaacatcatttgacatactccctccgttccgaattatttgtcttggattntnnnnnnnnnnnnnngnn

SEQ ID NO: 25928 - DNA, 180 bp, Triticum aestivum
  Clone ID: PAT_TA_25928
tagcgtggtcgcggccgaggtactctgggtcgaagcggagagccaaatcagaagtcaacatggttggcttgtgcttcttggtcgagtcgtaggcatcagggatgatctcgtcgtcggtcttggccatccactggtgtgcgccagcgggggacttggtacctgcccgggcggccgctcgaa

SEQ ID NO: 25929 - DNA, 703 bp, Triticum aestivum
  Clone ID: PAT_TA_25929
tttttttttttttttttttcctattcagcaatacactgatcggttttgtaaaattttctgacctgcagatacagtgtctccctgaacacaactggtgtaaactgagaataatcactttttcagacattcaaacatcactagctttttcttctccacgaacacgtatggtccaagcttagctaggaacgcacacgcactctgaaattttcagaccaagacaactaattttatatgaaatcctgcgcgtttgacatccacttaaaaaagcttttgctcatgattttgtcctttgcacaatctgtagccgcatgtcgtttttgctgcctccggtggagatggagtgggatgcccccaataaacagtcgccaatttggttaggccatcaaggccgccgcccacggatcgacgtcaacaacacaccggaccagatagggcgggcatgcgttgagccaggtgtccatccatctctggcctgaatcagtggcttcagcctgaaatggcggccggctgcgtgatcgaccagggggtcctttccgcctacctgcaacaagcacccgcacgccgacgcgcgcagggcggcactccggcgtagctctccagagtgattaggccacccacaccaagacgtcccgcatcagcttgtggcgttcgtggcacaggcgcaggcgctgcgagtctctcgatcagggaagaaaccagcctc

SEQ ID NO: 25930 - DNA, 255 bp, Triticum aestivum
  Clone ID: PAT_TA_25930
agataagaacttactagatataatacattttttttcgaaaaggaggttgaaacccttggcctctgcatcatcgggatgcacacagccaactacatataatacataaaacttaagcactatacgacatcaaagtgaaaaataacatttatacgaagataagctatctaggagttatcgtagatatagtcacatcattaaaactacaagacttagtaccagcggatgcttctttacctgcccgggcggccgctcgaa

SEQ ID NO: 25931 - DNA, 381 bp, Triticum aestivum
  Clone ID: PAT_TA_25931
tcgagcggccgcccgggcaggtcttaattacgcccatctggatccttgctctgttttctctgaaacaggaatgcagcgtgaagaacaaggatataaggatgcttttggacggcctgtgacaagttcgccatcaacgaagagcacagtgctgcacttccactgaagcagttctaactgtgttcattttatcgccatcaatgaagagcacagtgctgcatttcctcgtagctgttcctactgtgttcattacctgcatcgcctggtctgtttgtgttgttggtgtcttctgcggttccactgcttgctgctcgtggcatttggggaggtgtcttcttttgtttgttgagcagctgttccagtacctcggccgcgaccacgcta

SEQ ID NO: 25932 - DNA, 946 bp, Triticum aestivum
  unsure (1)..(946): unsure at all n locations
  Clone ID: PAT_TA_25932
ttttttttttttcatcactgaaagtgaagtatgtcctctgtggattccaactaaattctttattctcaaggtcaagggtgactcacactaaatatatatgttccttcgaactaggtgtcaggccttccccaagaatataaacagtgtcttacaagtttaaactgggggcgaacaacaatcaattcacttgcaaaattctgcaaatgttccttttggaacaagggacagcgatttgaatcgactcttccgatataaaatcactggaacaacatatatcgaattgccagagaccataggcgacaacaatctacagactagctcaaatggattattaactggtttcttcctccgatgccagacctaattttgaaagggtacagcaggcagcagcactgcacgtaaacaagcacccggatgcgccaatctggaacttggccgaatgctatgcatgtttgagaagcaggtggacgaaacgagctggctgggtaggaagaagcttcgctcaacatttcccatggcttttgttcactgaagtccttctcgccagcttgcggttagaagctgcttgatcatccatgtttagcgaggccgcagattcagaccgcatagtttgattttgagattgaccaagagactggaatgcatcaagtgcatcaacagccagcccccggccgccgcgcgctggactgcctgagctggaactagtatcataacagcaagctgctgcaacaatcccattgacccatggacagcaactgttgtgatgcttaacaggatcaaaatctggaagacctggttcatagtcgttttctccatttgttgctcctaacccattctgcagatcataatgcaacccttgatcatcagtagtcagtacttggagaagatctggcggacgtgcgacacctgcccgggcggccgctcgaatcgaattcccgcggnnnnn

SEQ ID NO: 25933 - DNA, 807 bp, Triticum aestivum
  Clone ID: PAT_TA_25933
ttttttttttttgacccccgacgaaaaccggccttcttttttccgccatttgaattggttgataaacgaatgtactgatcacaattatgaaattaatgaatagactatggtgctaaaaaagtatacaaagtgttgaaacattgctctctacatgatagaactataggtcgaggtagaacttcagcaaccaagtggaggtcaggtcaggtcggcgatttcccaggttcaacagatccgatcctggttcgcaaacccgcgctccaaacacctgccaggggcttaatgtttactggctcacaggctaactcttctcttgtgtttgtcacccaatccggtggtcttcaacagatccatataccccaagtgctttattcatatctccagggcccaactgataaaacttctgattctatttcgaaaaacaaaactactgatacagtgggtgtgtgcctagcattaagtattcagtgcctcaatttgatcaaaatctagatctacaaagctctccttgccaaaaagtgtcatctggacagtaaccttcttatttttgcgatttacttccagaagagaggccagtgaagcctgcaaaaggcccggagagaacatgaacactggcaccgagcgtaaaagtgtcgttgctggaggcaccttttgtagttgatttcttgacctgtttcttgatcttattaattaacataagttcagagtcttcaacgggtttaccaaaagaccccttatcccagttttccaagtcttcaaattctttgtcagctttctcttgttcctccttttcctttttaataatcg

SEQ ID NO: 25934 - DNA, 598 bp, Triticum aestivum
  Clone ID: PAT_TA_25934
tcgcggccgcgtcgacctcgtctcctcccttcaagctcctcgatggtagttggaaactgcacatgctcaagtggcctgtcctcacccactgtatcataaaagcctggagggggtctcttttcaaaagggatctcagcattatagtcaattccctttctcttccttttcttgtgccggttgtcaataccagctgccttcagttctctccttttttgcagtgatgcaagccgcctcgcctcttcaagctgtttctctcttgccttccgttttgcctttttacccctggtgttagctaagcgagcccttgcctcaaaaagcatttccttttcatcttcatccatgtcaacaggatccggacgtgcaggttttgactcgacctgcccgggcggccgctcgagtcgcaactttcttgggtcatcattaggctcataattctcatcctttgcacaggcagcatcgagcaatttttcataacgctcgaggcactgggatggtgttcgacccacgataggtgcaatagtcctccattgagtaggcatgagcttagcaagatggagcagcttctcatcctcttcccttgtccactcagtcttcttga

SEQ ID NO: 25935 - DNA, 283 bp, Triticum aestivum
  Clone ID: PAT_TA_25935
tcgagcggccgcccgggcaggtggcagttcgaagggacgagattacgggagtattgaggagaggacgacaggttcacgatagcgaaatcggggttgtggtggcatgtttgggtattcttactgcggcattgatacggctggtgacgatgttacggcgggcgtgtgtttggcatgagatattcgggcattatatgaactgctttcgagcgttcagttcgtgatatctgttgatcttgcgagagaaagtatttaacgattaccattggcatctaaaaaaaaaaaa

SEQ ID NO: 25936 - DNA, 250 bp, Triticum aestivum
  Clone ID: PAT_TA_25936
tagcgtggtcgcggccgaggtacagtctatcctgacaaaattattctttgcctgtgaaaagcctctggtcgtgacgctgcagtgggctcggtgatgacctccgtcccgccatcctggcggtcttggtctcgttgcaccagaatggaaacctttggctgattcctcgggactccgcttctatggcttgcctcccttgaaacaaagaggaaacctgcactctgcgcccgacctgcccgggcggccgctcgaa

SEQ ID NO: 25937 - DNA, 435 bp, Triticum aestivum
  unsure (1)..(435): unsure at all n locations
  Clone ID: PAT_TA_25937
tttttttttttttttctccggagaagtgtttcattgaggtaaagagcgtgttcgtcggatcgtcaaaaggcacccttcaactttctcctccaccgacaagtcccatatcctccacccgggccagatcgcccatcatccaccctctcctctcatttgctcgcaaccatggtcgacgtggaatgaagcggacattgacatggcatcccttcgttgtccgttggttggtcgcacgtggcgttgcatttagcagttgcagttgccgggagcgcaagcgcagttgtcgttcttgcaggatccgcagccacccatgatgatgattggtttgtttggttggtgattggtggagtgtgttgtgtagtgtgttgaccttgatggttttgcgacctgcccgggcggccgctcgaatttttttttacctcggccnnnaccacgcta

SEQ ID NO: 25938 - DNA, 184 bp, Triticum aestivum
  Clone ID: PAT_TA_25938
tagcgtggtcgcggccgaggtacaataggtgtaagaatgcatgcatagtctggatcgttaattagctaccagatagctagtcatccagcggcacgacataggcaccgaagccgacgaggccgtcggcgctggagcggccgaagaagccgacgatggccccggacctgcccgggcggccgctcga

SEQ ID NO: 25939 - DNA, 716 bp, Triticum aestivum
  Clone ID: PAT_TA_25939
tagcgtggtcgcggccgaggtatgattcgagagcaagatggggggtgcactctgcacacataaggatgtgacatggacatggacacggtcacggaggagcagttcaagcagacccacacagaactcttgacccggagaagcacgcaggataagctctagcagaggctctgcatgttttctgaatcatctgttccctgaaccttacgaaaccgctgaagaaaacaggagcaatatccgtcggtatggagggcaagtccttggtgcttttggcagtctgcatgagcttgtggaacaagaaatggagaattgctatggaggaggctacctgacttgatgctggaactggtgaccggtattggcggagcaattttccaaacagatgtttctcccgatgaacaagattcttccttgaacacaccaaaagggtagctgtgaagattactgccgggatccgagtgtcggattcttcgttgcagttacccgcaccgtgtttgctgagttggcctctttgagaaacaagtcagggcaagcttattgatatgatgtgcaaaactacaagcacgacggacaaggttggtatgtcttacaaaaacaggcttcagttccttcgactgatgagactcaagttaccactgcttttgtagtgacttccgttcctgcggttgattgggtttaagttaccgccgcttttgcagtgtacctgcccgggcggccgc

SEQ ID NO: 25940 - DNA, 483 bp, Triticum aestivum
  Clone ID: PAT_TA_25940
ttcaaggtgcctactgttaaccaagagaacggaatgcttggcaccgaaccaacagaaactatgctgacattccggtccggtgaagtgctccgtccgagccacgagaataaacacaaggtctactttgggcaaaatctggtctgcaaggagtcggtgtcagcaaagggcaaagggagggtcgtgaaagtcggcgacccggtttacgttctgcagacatacccttcttgcgacgaagttccagcctgagcaagggcgtggcagcacgtaccatacatgttttatgtgtgtgtcgaagagacgactgttcggttgattttgtgcgcgcattacgtaaattgaacttagcaataaaggctcgaggagcgtgatcatcatgtcaaacaatatcgtatcatctggttctttagtctgtcgatcggtcaaatagttctcggtgaaaaaaaaaaaaggcgccgttaagatccagttagtacgcggcagcga

SEQ ID NO: 25941 - DNA, 955 bp, Triticum aestivum
  unsure (1)..(955): unsure at all n locations
  Clone ID: PAT_TA_25941
atcaatcctgcagggcgtctccgtgccgcaggcccccgtcacctccaccgggttcaggtgggaccggcagtgggtggtggtgaacgccaagggcagggccctcacgcagcgggtggagcccaagatggcgctggtggagacggagttgccgccggcggccttcgacgaggactggcagcccacccccgactcctacttggttataagagcacccgggatggacacactgaaggtccctcttgctgcggaacacgtcacgcttgacgacgtctccgtctgggagtggtctggttctgcctatgatgaaggagctgaagcagctgaatggcttctcctcctatttcgggaagccaagtcgcctcgtgcggtttaaggaagagtccgaaatcaggccgactaatcctgagtatgctcaaggctacaagctcaccttcacggatgtcttcccgttcctgatagcatcccagggctcactggatgcactgaatgagcttcttaaggaacctgtaccaatcaatcgcttcagaccaaatattttagtggatggatgccacccgtactcggaggatctgtggaaaaccataaagataaacaagctgacatttgacggcgtgaagttatgcgaccgttgcaaggtgccaaccgttaatcaagagaacggaatacttggcaccgaaccagcagaaactatgctgacattccggtccggtgaagtgatccgtccgagccacaagaataaacacaaggtgtactttgggcaatatctggtctgcaaggaagcggtgtcagcaaagggaaaagggaggatcgtcaaggtcggcgacccggttcacgttctgcagacatacccttcttcggacgaagttccagcctgagcaagggcatggtagcacctaccatatactccctccgtgccaaaacaagngnctcaactttagtactaatgttactaaag

SEQ ID NO: 25942 - DNA, 796 bp, Triticum aestivum
  unsure (1)..(796): unsure at all n locations
  Clone ID: PAT_TA_25942
tataccttggntacctgtcaaaagttttagaaaatgttttctcaatgagatcgtctctggtacttatggagaaagtctcctttccatgcttttcatagagtccgaaattaggccgactaatcctgagtatgctcaaggctgctcaccttcacggattgcttcccgttcctgatagcatcccagggctcattgaatgcactaaatgaggttcttaaagaacctgtaccaatcaatcgctccagaccaaatattttagttgatggatgccacccgcatggataggatatgtggaaacccataaagataaacaagctatcatttgacagggtgaagttatgcgaccgttgcaagttagccgcaatggaaaaagtcaggatctcaacaaagaaccttctggacgatatgatgcagcagcttggccttccaaacgcagcgtactcaacatagaaggcaaggacggttggtcaaccattcactatccatcaaagcaccaactggacaaccgacttccaaggatatcaatatccatttacgtgtacggtaaactcaaagaagcttaagatcgaccggcaactaaagctctcaagtagtccaagtgaagtgaaggaactttatcgcataataaatacaaactccacagcaagatcaacacccaaagccaacaatctgaaacatatttcgtcacagataagatatgttgctgatcgtcttaacgatataagtttacaatcagaaaccgttatatagaaaacaaacaagtattattgaagcatgaatgatgatattgaaggaattg

SEQ ID NO: 25943 - DNA, 3161 bp, Triticum aestivum
  unsure (1)..(3161): unsure at all n locations
  Clone ID: PAT_TA_25943
cttctttcctctcccgccgtccggcctcccctgctccacgaccctccgcctcagggcctcccgcgccgccgccttctcttccgggcctcttctccgacgctcgaggtgcagccggggcgacctcctcctcctcttcctctcctcctttcctggaggggagccgacctacaggtaaagggcgacggcggcggcgctcgagcagatgagagggagagagaggtaggtgcagcgaggcgacggacgggagaggggcgagggcgagctccagcgcgagcgcgcggacccgtcacccacgccggcaaggtcctcggccccaagctgcgcctctaccaccgcgaaggcgactgctgcgaccacgctcggttttgttcagtgcgcacacacactgtgccgtctccaggtgccagttgaagttactatcgggctttattgccctcctctgatttggtgttgtaggagaaagaagaagaccaggcatgttctttgtctctacatccaacgtccacacggctagatcgacgggtctaaactcttgatctgagacagaatagaagagaaaaaaattcctatggaagagtttgacgagaacaagaattttgcaatggggaatttatccacanagcttgtcttgtcatgtgtaggctacgcgactatacaccagcatggcccccggcaccctcacccaccccccccccgcttcgttgcgcgcgacgcagcggccatggcgtaggcggcgtccttcctctcgtctctcctcggcggcgccggcgcgggcgcggaggcgcccggacggccggcggcgcaagggggcgtccgtcctcccatcccccgtccggcgccgcggcgccgccgccgcgccggcggcccccgcggcggcggcagcgtgcccgtgcgaacgccggagcccggtcggcaggggcaaggccacgccgtcaacccccgcaggcgcagccccgtgccgcgggcgccggggacgggtggcgggctacggccggcgccgcgctgtgacgccgcggccgccgcccacgacgtggatatcggagacggagcggcccgcgcacgcagtcgaagagacctggtagcccacgcccgactcctgcatgagttctccgcagcaccatggccggccactgccaacgatcatcatgctgcggaacacgccacacgtcacgtcgtctccggccggaagcagtctggttttgcttatgatgaagggcccttgaagcagctcaattgctttcggagctctagttacgggaaagctcaagttcgtcctcgtggcggtttaaaggagagtccgtaaatcagaacaactaatcctgagtaagttctacgctacaagctcgcctttcacggattgcctcccgttcctgattgcatcccagggctccctggatgcgctaaatgagcttcttaaggaacctgtaccaatcaatcgcttcagaccaatgattttagtggatggttgccacccgtacgcagaggatctgtggaaaaccatgaagataaacaagctaacatttgacggcgtgaagttatgcgaccgttgcaaggtgcctacccttaatcaagagcacggaatacctggcggcaccgcaccaacagaaaccatgctgacactcgctgacgttccggtgcggcgtccaggccagaacgagccacaagaattaaccgaaggtatactttgggcaaaacctggtctgcaaggagtcggtgtcagcaaagggcaaagggaggatcgtcaaggtcggcgacccggtttacgttctgcagacacacccttgttccgacgaagttccagcctgagcaaggccatggtcgctcctaccatatcggtttgatgtgtgtgcgtcgcggagattaccgggcaagcgattttgtgcacgcactacgtaaattgaacttagcaataaaagctcgaggagcatgatcgtcatgccctccatgtcaaacaatatcataccatctggttctttagtctgtcgaaccggcaactaaagctctcaagtagtccaagtgaagtgaaggaactttatcgcataataaatacaaactccacagcaagatcaacacccaaagccaacaatctgaaacatatttcgtcacagataagatatgttgctgatcgtcttaacgatataagtttacaatcagaaaccgttatatagaaaacaaacaagtattattgaagcatgaatgatgatattgaaggaatttctgctctgagcaatgcaggccatgaagaacaacatctatgaagacttgcctcaaagaaattgttctaaacatccaacgatacatctgccaaatgtagcttagctctgcctatctacatgccttgctcataacattgtaaatattgtttgtaagcttcttagaaaacatgatcatcagcaaccatcatcatcatcaattcgtacttaaaaaaaaaaaaaaaaaagacaacccgatctacaacagcgacaatccagtcagccgcaattgaaaaagtcaggatcccaacaaaggaccttctagacactatgatgcagcagcttggccttccaaacgcagtgtactcaacacagaaggcaaggacggttggtcttgacgcaaccattcactatccatcagagcaccaattggacaaccgacttccaaggaaatcaatatccatctacgtgtacggtaaactcaaagaagctgaagttcgaccggcaactgaagctctcaagtagtctaagtgaagtgaaagaacttactgcataatagatacaaacttcacagcaagatcagcacccaaagccaacaatctgaaacatattttgtcacagataagatatgttgctgattgtcttaatgatataagtttacaatcagaagccgttatacagaaaacaaacaagtattattggagcctggatgatgacatcgaaggaatttctgctttgagcaatgcaggccatgaagaacaacaactataaagacttgccacaaagaaattgttctaaacatccaacgatacatgtgtctaacatagctctttctatctacatgccttgctcataatattgtaaatgatcgttcgtaagcttattagaaaacatgtatcatcagcaaccatctatctatcatcaattcatacttatttccaagtgtttcaaaaaaaaaaaaaaaaaaaa

SEQ ID NO: 25944 - DNA, 590 bp, Triticum aestivum
  unsure (1)..(590): unsure at all n locations
  Clone ID: PAT_TA_25944
ncgagcggccgnncgggcaggtcaactggaaatcaacatgaagaagatgaagcgtgatttgggcatggaggactatgatgaagaggacgaggatggatcaggttcagaaagtgaagacgatacagcgggctatgatgagggtatggaggactacgatagagaggaagaggatgaatcggattcagaagatgaagacaactaggtggaatcgcacgcttggccacgccggcgattttttcgagatgttcagatagtctttcctgttcatagcgtggtcgcggccgaggtgtccccaacaatagagcaatatagagtaaatggtgtgtggtttcatcttcacatatcagcctcagcaatatacaaacggatcaactataactaccggtcgcgtagtcatgtccttctctggatcactatatcaggaggcctgatctgaagcctgtgtaggtttaatttgaagcaacattcagggaagagggaagtgctagcctccataggtgggtgctagtcatcagacggatcgcttctcacttgtggaccctcacgattagcctttgtaggatctgtacctgcccgggcggccgctcgaa

SEQ ID NO: 25945 - DNA, 270 bp, Triticum aestivum
  Clone ID: PAT_TA_25945
tcgagcggccgcccgggcaggtactttctctgaataattccagagaaatagcctacacctggtgctgtccaatgaatgggtggatatacaacaatggtggggaatggatgcatgcggtggatccaattatacacagggaaacaactacaaatctgcacacatacatactccctctgtaaattaatataagagcgtttagattactattttagtattctaaacactcttatattagtttacggagggagtacctcggccgcgaccacgcta

SEQ ID NO: 25946 - DNA, 648 bp, Triticum aestivum
  Clone ID: PAT_TA_25946
tatgattcaagggactgtaattatttacatatttagtgctctcacttgctggtacaagaggggttcactgcaatttattgtcgactggtgagtcactgctgggacatcctcagttcttgcaattgatcccaaacatctcagactgaaaatgagatgaggcgcatttttggatcaaaggtagttgattctacctgaaaaccagcggaatatgcctggcacttcaaggcaagtgcgtggtgttaggcgtgctggccttaatcctagaagaaccctacttgtatctccacctggcttctggccagcatgggataagtcaatgtcaatggatcttgttgagacaaagggaagtttgaattatttcaggtacgtatatgatccttctgtcagccatgtgcaggaattgtttgaagctgccaagtcagccaatgacctcaatgccattgctgctatattagcaaaatacccctaccatccagactcgctattgacatttgctgatctgttcaaatattctggagaacatcaatcatcagcagacgctgttgagaagtgtctatttgcactagagtgtgcttggcatccactatttaatccactgcagggcaactatcagttgaaatacagccatgacttaaacaagccattttt

SEQ ID NO: 25947 - DNA, 404 bp, Triticum aestivum
  Clone ID: PAT_TA_25947
cagagacaaagcctcctcgctccaatcttgtctgcatcgagagcgcgagatccagagttccaaaccaaaccagccagcagcagagctagacgaaccggagcggcatggcaggcggcgacgagggctccctggtgccgcgggaggtgccgggcagctacggcatgccgttcgtctcggccatccgcgaccgcctcgacttctactacttccagggccaggacaagtacttcgagtcccgcgtcgacaagtacggctccaccgtcgtccgcatcaacgtcccgccgggcccgttcatggcgcgcgacccgcgcgtggtcgccgtgctcgacgccaagagcttccccgtgctcttcgacgtcgacaaggtcgagaagaagaaccttttcaccggcacctacatgccc

SEQ ID NO: 25948 - DNA, 745 bp, Triticum aestivum
  unsure (1)..(745): unsure at all n locations
  Clone ID: PAT_TA_25948
cgtccgggagaagatggagctgaccaagtcggcggtgtgggaggcgctgcggctggacccgcccgtcaagttccagtacgggcgcgccaaggcggacatgaacatcgagagccacgacgcggtgttcgccgtgaagaagggggagatgctgttcgggtaccagccgtgcgccaccagggacccccgcgtgttcggccccacggcgagggagttcgtcggcgaccggttcgtcggggaggagcccacgcgtccgcccacgcgtccgtactggtccaacgggcgggagaccgagagccccagcgtggacaacaagcagtgccccggcaagaacctggtggtgctcgtcggcaggctcctggtggtggagctgttcctccggtacgacaccttcaccgccgacgtcggggtcgacctgctcggcaccaaggttgagttcaccggcgtcaccaaggccacgtccggtcctgatagcgctgtttgaaaattaaaacctgcaccggtcatcggattaacgtacggcggcagcagctctcgtagcagccatcgatcgacccagtcagcacgtagtagtacgagtcagtcatgcatgcatcttgttcggctgcttcgctgcattgtgccctcaatattgctcttgtgcccttgtgtgtgtgtatgtgtatgtgtgtgtgtttacttttcgcaatcttgcccagtgtaataagacggactttcctgtaataagattctcactcttgncgtnnaa

SEQ ID NO: 25949 - DNA, 1891 bp, Triticum aestivum
  unsure (1)..(1891): unsure at all n locations
  Clone ID: PAT_TA_25949
ccccgcgggaccgctagatcctcctgatccaccaatgcgaaccagcgagcccgagatccaccccgatccaaaccagcccagccagccgcaggagctagacgagccgcgagcggcatggcgggcggcgacgagggctccctggtgccgcgggaggtgccgggcagctacggcatgccgttcggcctcggccatccgcgaccgcctcgacttctactacttccagggccaggaccagtacttcgagtcccgcgtcgagaggcacggctccaccgtcgtccgcaccaacgtcccgccgggccccttcatcgcgcgcgacccgcgcgtggtcgccgtgctcgccgccaccgagcttccccgtgctcttcgacgtcgacaaggtcgagaagaagaacctcttcaccggcacctacctgccctccccctccctcaccggcggccttccgcgtctgctcctacctcgtacccctccgagcccacccacgccaaggtcaagcagccgctcttctccctcctcgcctcccgcaacggacgccttcatcccggccttccgctcccacttctcctcgccgcccgccactgtcgagtcgccgccggcgcttggcggcaagtcctcctccaacacgctcacctccgcaccctcctcgccaccacatcggcgacgcctactttcggcgtggcccccctgctgctcacttacgtacgcaccatcggccccggcgaaccgcgccaagtcgcccagattctcccgcccctccttctccgcggtgagtcccacgcgctctccaagaacttcgacgcgccgctcacccacgccctcgacctgccgcacatcctcgtgctcaacggcgacgaggcactgcacaagctcctctacgccgccgcggccaaacgccgcggcggccccaaggtgatggtgccggggagcctcgggcgaattgctgagccccgagaggagttccacctaagaggctgggccggggaggtacgcacggccccgggggaccccggcggcaacgtgagggtagaggcgctggagaacatggagctggccaagtcggcggtcggggcggcggcgggcgtcggcggcagggtgtcgagttcgagtatggcggcgctaaggccgacatggtcgtcgggaggcgcggcgctgcggctggaccggccagtcaagttacagtacggccgcgccaagcctgacatgcacatggcgcgccgcggtgcggtgctcgccgtagggaggggggcggtgctggtcgggtccgagcggtacgccagcagcgaccgccgcgggttcggctccacggcgggggagttcgtcggcgaccggttcgtcggaggggaggggaggaagctgctgcagtacgtgtactggtccaacgggcgggagaccgagaagccccagcgtggacaacaagcagtgccccggcaagaacctggtggtgctcgtgggcaggctcctggtggtggagctgttcctccggtacgacaccttcaccgccgacgtcggggtcgacctgctgggcaccaaggttgagttcaccggcgtcaccaaggccacgtccggtcccgagagcgctgtttaaaaattaaaacctgcaccggtcatcggcgacaacggattaacgtacggcagcagctctctcatagcagccgtcaatcgtccccgtcagcacgcacgtacgtacgtgcctcgctatatagtactcctagaacgagtcagtcatgcatgcaccttgttcggttgcttcgctgcatggtgcccttgtgtatgtgtgtgcgtgttttacttttcgcaatcttgcccagtgtaataagccgtactttcctgtaataagattcaagattcctactctaaaaaaaaaaaaaataaanaaanaanaaaaaaaaaaaa

SEQ ID NO: 25950 - DNA, 434 bp, Triticum aestivum
  Clone ID: PAT_TA_25950
aaacaaacggagtgtggaggtgctataataagcaaacttaccaattcccgttggccaaagggctctttcatagaatcttccgacctatggcaacgggagtggttttacatcactgaacctcgcggcaaaaagtgggtagctacacctgcattccattatgtccctccattacaacttgcatcctggattaataaggggccagactgggtatccgttgataaagtgcagacgctgcaaagccgcattcggagcctcattgaaaaggacaccggtctcatcaatataatccaagtaatgctagtccgtcgggtcctaccgtgccagcgacgtcctctctgcatgtgggaattcaatccggaaggaccgtgaacccttcagcacttctccggcacgacgctccgaggagtgtggaaattattcttcggcgcatgaaa

SEQ ID NO: 25951 - DNA, 390 bp, Triticum aestivum
  Clone ID: PAT_TA_25951
gcctttttccttgtcaaatccattgtgtccactgcattatttgttctggcaatgatgggcctcatatatctcagcttcctggctatgaacccaaaggaggcatccggctctaggctggatgaagcaatgggcaacccatcggaggaccctgttgaagaggcccgtaggataatggagaaatacaagtaattaacctgtgcaaaggtgctgtactctcagaggtatgatttgtctgtagagcttccttgcgtgacgtgaggggtgatggatgggtggatctgattttagcatactacactacactcagtgttttgatatatgtaaatatagttgcacggttggtgaccaaatgaattccgcaaatcaacaagaggttaccattttccggtc

SEQ ID NO: 25952 - DNA, 456 bp, Triticum aestivum
  Clone ID: PAT_TA_25952
ccattatattcacatcaacatcagagtcccaacggagctgacaccacggcaacgggagctgatggaggagtttgatatagaggagagcaacgacgtggcgagagttgcggctgcatctggatgagatttttatgctcctcatcgattgattgattattggcacacataataagtcagatagccctgaagggcttggtgtaccctatatgtccctatccttgtttgtaggcgttagatggtgagttttgccctgtataatatacacgtcaccataactgataagcctaaattatactgtattgtataagcatctgatttatattcaccacttccttgtggtaccattgtaacaagagattaaagttggaaccgatggagcaacgtttttggatgagaatgtatcagcaattttgttataaacatgaaacaaatggaacggatgccatttgctgacgg

SEQ ID NO: 25953 - DNA, 1101 bp, Triticum aestivum
  Clone ID: PAT_TA_25953
aatatacaaaaaaaaaaaaaaaactccaacgtgatcgcgaacacaaagcacccctccacacgcccgcccgcccgccccgccgacacgccggacgccccccccgcccgcaccaatggccgccctcgccgcctccatggccacccccaccgcctccgccgccaagcgcgcctcgtccgcccccccgccgcgcctctccgcctcccccgcccgcccctgcgccccctcctccgcgtccaccggcgacgccaccaccccctccctctccgcctccatggcgctctcctccgtcctcccctcctccgccgcgcccaccccgcccgccggccgccgcgtccccggcccaaggcgctccccaagcgggagaagcagtcggtgaagaagctgaactcgtcgctcaagaagtacgcccccgactcggcccccgcgctcgccatccaggccaccagcgagaaggccaagcgccggttcgaggaactacggcaagttcggcctgcgctagcggctccgacggcctgccccacctcatcgtcagcggcgacccagcggctactgggcgggcgagttcatcacccctcggcgtgctctttcctctacatcgccaggcctggatctgggtgggtcggccgcagctacctcatcgccgtcagcggcgagaagaagcccgccatgcgggagatcatcatcgacgtcgagctcgccgccaggatcatccccaggggcttcatctggcccgtcgccgcctaccgcgagctcatcaacggcgacctcgtcgtcgacgacgccgacatcggctactaagtagctgccatgcgtgcgtggttggctagtcagtcccaactcagatgggcagcggaggattgagggcttgtggtgtcgatctgcgtgggcttggtgtaggagctgataggatcatggagaaatggaagctcgatctcttgtatttaagaaactgaacccaatcttgtataactattgtcttctctcttctacttatgttttctttacaaatttgtgaattttaccattgttcaaattgtagagaacaaatacaagaagaaaaaaaaagccaacatacataggaaactcaagtttgaaaaaaaa

SEQ ID NO: 25954 - DNA, 876 bp, Triticum aestivum
  Clone ID: PAT_TA_25954
gcacgcaaaacttttttcgtcaacacaattacacaagcaaatgcataacgcagtgttactagggtacaagtacatagctaaaatagcagttatttgatccataaccatgaccccaaggatgctactctgacagtttgacaacacaagcaaatgcataacgcagtcgaactagcatacaagtacatagctcaaatagcagtaaaatcatcgataaccatctccttgtcatgtttattcagtggaacaaacgttttgtttggtgaagaaattcaggcaggtgtctcttggctttgctctaaccccgcctcggaaggagaatacatctattgtaagctcctagatgttcacattagcatcattcaaagctgaggtgaaactcccatcggtgccatgggttttcattaccatgaaattttgtgccttcctttagcaattctccgagcaatcaccttacgcccacccgtggttgatttacgtgcacgaaatccatgggttcgtttccgcttgatggtgctgggttggtaagtccttttgggaagtaactcaaggggttcattagcaacaggatcaattccatcgtcaatgaggaaccggagagaggggaggccgcaggggaaggagatctccccggggagcgaagttagtctcgcgaccacctccgcgtcgtgtgcgtccaccgacgccggcggcggcgggacgtgcggctggatcctatggagcagcgacggaagaggaggtccggtccgcagaagagacggaggcggggaggcgaggaggcggccgaggagggaggagccagcccgcgctaggattttcgccgacgccatcgccgtgatccacttcgtcctggaccggacgcgtgggcggacgcgtggg

SEQ ID NO: 25955 - DNA, 768 bp, Triticum aestivum
  Clone ID: PAT_TA_25955
cggacgcgtccgggctcatccaaaacccggaactcaaagagagcgcagcaaccgtcagagccgactagtcgaaggccacagccatggccgcccctaccggcacttccatgctaagggccctgctccagcttcccctggctccgttctcggggaagagctccgcgccttcggcggtccacatgaccgcccgccgcgcgccgacgcccgtgctggccgccaagggctacaacgtgcagatcgtggtggacgagaacgagggggaggactccatcttccggcgcttccggcgggaggtgatgaaggccggcctgctccaggagatcaagcgccgccggcggcacgagaacaccaaggacaagaagatccgcaaggcccgcgaggccggccgccgcaaccgccgcaggcgtatgatggatgatcgtaggttccccgaagatgagggagactcagaggctgtgagaacccgccgcgacgaggacaacgacaactgggaggttagcggtattctgtgaatggaatgatgacggaattcataacaactttagatgcacaactctggcaattcgagatcttttcttttgcctgcatggcacaaactatatgagtcaccagccgccctttccagttcaattgtactatttaattgtaccaaatgttagctaatgcaatctccattccgtatacttctgtactacttttttttttacttcaagattcggcacatgttgcgaatgcaaagcatatactatttatcagatcgttcaagtt

SEQ ID NO: 25956 - DNA, 869 bp, Triticum aestivum
  Clone ID: PAT_TA_25956
cctccgcctcatccaaaacccggaactcaaagagagcgcaccaaccgtccgaccccaactagtcgatcgccacccccaggcatgcccgccccgactggcacttccatgctggccgcccctaccggcccttccctgctgaccgccctgcgccagctgcccctggccccgttctcctgaccagcccccccgcgccgtcggcggtcccgtgctccgcccgcagcgcgccgacgtgcgtgctgggcgggacaaggacgacgaggtgcacatcatggtggaccacaacgggggggaggacgacatctgccggccttcccggggggaggtgacgaaggccggcccgcccaaggagatcaagcgcagccggcggcgtgaggacacgcaggaccagacgatccgcaaggccggcggaggccggccgccgcaacggccgcaggcgtatgatggatgctcgtggggtcccagaagatgagggagacccagaggctgtgagaacccgcggcaaccgaggacaacgacagctttggaggttagcggtattatgtgaatggaatgataacggagattaataacaactgtagctgctcagctctcggcaattcgagatcttttcttttatccgcatggcacaaactatatgagtcaccagccgctctttcaacttcaattgtactattttgttgtaccaaatgttagctaatgcaatctccattccggatacaaaattaagaaaatttacagaatttaaagcatatactatttatgagaacgaaaaagttatcgagtaagagccctttttttctcaaaggatttttgtaactgcagttcatatgttttttttcttctatggaggcccttgggatcaaagcaat

SEQ ID NO: 25957 - DNA, 587 bp, Triticum aestivum
  Clone ID: PAT_TA_25957
ttttttttttttttttttgatcttggggtgtattagtatattggatccatccatattgtaaatgtcttacattatgggacagaggaagtaatatatattgcaagtgctaacaaatgttctcatcttcttcttcttcttcttcttcttcttcttcttcttcttcttctgcggccgcccgcgcaggtacatttcatcatcaatcgcatcagcatcagctacttcgaaaggaagattcaacttagttccatgtggagatctgtgagtgaaatgaatttgactctgcatatatacaccacaccacatctaggtttgatcttgacaagagcggagggctcagaggtaacggcgctttagaggccgattttgctgacgaataactttagatattttccttttcaacttcacctgctcgcgggccatgctaattgaaacatggtcgtgagggtttgggcagtccttgagagcatgactagatgaagcacagttgagacaccgccaaccatccttctcatcttctttcttgctctcagcatttgatgaatcacccaatgtaaattctcgatcgtacctcggccgcgaccacgcta

SEQ ID NO: 25958 - DNA, 825 bp, Triticum aestivum
  Clone ID: PAT_TA_25958
cttcctcctcgcctctccccctccgcctcccccacctggcccccggtgccctagcccgcctcatcatcggccgccgcgcagcgtccccgctcctggcgcgccccttcgccgcgaaggcccgcgcgccgcagcgggcgccggagccggagcccctgtcggaggaggacgacgacttcaccagcggcggggaggccgcccccatccccaccgagggcatcagcaagccgctcgccggcatcctcaaggagctcgggaagagggttcccgagtccctcctgaagatccgcctcgaggacaatggcttcgccctcaagtacatcccatggcaccttgctaacaaaattctgaatatgcacgctccagaatggtctggggaggttcgcaacattgtctactcatctgatgggaaatctgtatctgttgtctatcgtgtgactctctatggaactgatgcagagatctatagagaggctactggaactgcttctgttgaggaaaaaggctttggagatcctgttcagaaggctgaaggaatggcttttcgccgagcttgtgcccgccttggtcttggacttcatctctatcatgaagatatgtcatagatgcttactgatcattgtttgtggtctggacttctgcttcatgtctcttagtgcgcggacacttgtcgttcagtaggctacccttttgtgctgaacatgatatggatgtgccggcatataaaactaagtattctagaatgtcgtttagttgtctaatgtaagctacaaggtgggtgatgttctgaatggtgtgcttataatgagccagcttggttcatcttct

SEQ ID NO: 25959 - DNA, 481 bp, Triticum aestivum
  Clone ID: PAT_TA_25959
ctcaggaagctggaaccgtcgacaagcgtgctgcaaccggcggcgaagaagagctgcaaggaggggagcaactgctggtggtggagatgacgccctcaggtgctgcaacccatggctatttttgctggaatcggggcagcaaaaaagctacatccaacactgccggcgatgaagacgacgacctgcggtgctgcatccagcgagttgtttgctggaaccggccgacgaaaaagttgcatccacaccgacccgtgctggaattcgacgaccaggcaagtcgttttgctggaaccggccttttgttttgctacaaccggcaaattttttgctgcttcggcaaggtgtttcattgtgacagtctgcggcgaagtattttggcaggaaccggtgatgtgttttgttggaactgtattccctttttgctactaccggtgacagtgcctttttgttgctgaattttgttttgtcttttgctggaaca

SEQ ID NO: 25960 - DNA, 437 bp, Triticum aestivum
  unsure (1)..(437): unsure at all n locations
  Clone ID: PAT_TA_25960
atcgggcgctacctcaagnaggccgctacgcccagcgcgtcggctccggcgcccccgtctacctcgccgtcgtcctcgagtacgcctcggccgaggtactactactattatttgttggtctgaccaagccaagccaattatagattgcaatctctgtatcattagttttatggaagccaaatgcatgtagtggtctgttgtccttggaagttggaaactaccatcctccatttgccaacagctggtcaccactaaatgttgttatgatcctgtccatgttattgcaagtccgaccgccgccgccgcctcctcctctcggttccctctccttccttcgagtttgcttcagccatgggtaaggagaagactcacatcaacatcgtggtcattggccacgtcgactctggcaagtcgacgaccactggccacctgatcta

SEQ ID NO: 25961 - DNA, 563 bp, Triticum aestivum
  unsure (1)..(563): unsure at all n locations
  Clone ID: PAT_TA_25961
aggtcggtagagggcgctggttgtaggggcccaagtgggctacggggatggacggcctagctggatctctccctccgttttctattactcataagaagaaaaaaacatatgagataaaagaaaagaacggaggagtagcaaaggagtttgacagggagaaaagtctttccagactcacaaaaatatgcttaatcccagaaaatagaagttagcacgaatgcaaggtttaaactcaaactcatttgaattaaattcaaatgatttgaataggaagtgagggttgggaaggtccaaaaatgtttggatttttggtggagctccggaaaatggagaaagggtaaatagcaaggttagagcccaagagtcgtgataacaaaggcattgggtttttgcaagtgtgttatggtaattccacaagaatggaaatatttataatagctccctaatatcaggaggatatgttataaagagaagtcaccctgtgaattccctcgatttaaaaggaccgaagatccatgcaatttatttagtgagttttaaaaaaaaaaaannnnnnnnnnnnn

SEQ ID NO: 25962 - DNA, 1792 bp, Triticum aestivum
  Clone ID: PAT_TA_25962
ccacgcgtccggcgaaagaaccaccctgagagaaaggcaaagcgccgcccggcgaaagcggcgtcggcggcgatgttgcggcagatgcggtggctgacggacagggaagggaggtgggagctggacgtggagtccccggcgacgatggagggcacggcgcgcccggtcccgggcgacccgctgcccctgggcctctcgcgggggccccgcgtcacccgcaccaagcagctcgacttcttccaccgcttcatggcctccccgctcgtcccatccttctccgcctcccgcgccggtctctccctccatcacgcgcacctcctccatctcgcccacaactggtcgtttactatcttggagcagcttcatgtacagcagcttgtggcagtcgtgaaagagaagttgtcaaatcggcaagaaggggtcccctggtccaatgatctcaagaggcatttgcgcgatgtcatttctctaggtgttggcacggaactcttgatcacaccagacacggcattgctgctggagttgtacaatatcaacaagggggaccgaggcaaagcgattattcaccacaagcttcctcaacaaaatattacattagcagcatcttggcctggattatttgttgataaacagggggtgtactgggatgtgcctttatcattgtcgccggctctggcttcggcccgccccagttctggattgagttatcatctattgttacaacagaatagtggggagccaaaatgttttggtgggtgatgaaaccaatgatgttcctctcgctctgtgggctggtttgtgtgctaaagcagctatttccatcaagagaagtattgatgcttggaggaagaaagaagacaagctaaaaatggttcagccttatgatgcatttctctcagaccctcatgtttcattcactggaattgttggtgcagtagccagtggttctttgggggattgttcaaaaagaattacagtgccggacgaaatgcgaaaaagcaatgccttcagagtattccacgagaggaataagtttgctgcatgtgcagacctctttgcttctgttacttttacagctcaacatggaaatttccagaggcttttcctggatttgacaagggtcagtgcccgattagatatatcctcaggatctttgttcttacgtggtgcttctcgtctagcgcaagattttttcttctctagacggcctgatttagagacattctgtgatgtttgtccagatgtgattgtttctcttcaacaacagatagttgggccattcagctttcgtgttgaatcttctgttgccattgacccaagaagtcaagaccattttgtccgagtggacgactcggtcttcgccattgattgggctctgaaggtcctgggttcagcaaaggccacagcttggtattcgcccaagcatcaggaagcaatggtggagcttcgtttctttgaggtctgatgaagcacataaaggttccatctcacgtcgaaggtcacaagcacataaggttccatctcatgtcgaaggtcacgttgaaggtcacaagcataattgtatgaatggtcgatgctgggttttatcaagcctatgcatacaacaccattggatttatttgggttatactactttgacatgttggatcatcggtcctgccatgctgctcttcgggtaaaatagtttctgctatagagtaatccacggaggaaatggttatttcagttctaggacagttgttatgtattcacattgtccgtcaattgaaaatacattctaattgtatttcgt

SEQ ID NO: 25963 - DNA, 254 bp, Triticum aestivum
  unsure (1)..(254): unsure at all n locations
  Clone ID: PAT_TA_25963
cccggccgggggggattaccaagnntcagagggagccattggggaagattgtggcagcactggcaactcagctcgaggcaaacaaccaagacttgcaggatctggagacaaagaagaatgcaacagaattctccattgcaaggcttgaggaggacaataggaggctgcatgaggcatataatgaagaaatgcgcaagctgcatcgcaaggctcgtgacaatgctctgaggattttccaggacaatgaaaatttg

SEQ ID NO: 25964 - DNA, 234 bp, Triticum aestivum
  Clone ID: PAT_TA_25964
ttactatgctgctgcagtaccagcatatcagtatggtttgtctaagatgttgccgactaaataaaaatctgtatcgtttggctaaaaaaaaaaaaaaaaaaaaaaaaaaaaaaaaaacctttggcaatgtacattctgaatctgatctgatctgagccgtgtgtgggcgtgggcacgctgacacgtacggttgtttgcttgtacgatggaggaataagactttgcttccagtcc

SEQ ID NO: 25965 - DNA, 538 bp, Triticum aestivum
  Clone ID: PAT_TA_25965
catgattctaataagtaatagcttgaacatgacccaaatagactcagcaccggacagtctccggacatgggacacacagcaaggcacacaggttgctccttgttgtttattcgcatacgattgtaataacatcttatatcatgagacgcatggagtaacatacaaatacaatcgtgcatttcggtatctttatatcggcagcgaacgctcagtgctcagtgacaaataactaaattactcttgagcggcatacttgtattcccgttcttggcatagattgcttccatcctacttcggaggatagcgcgggagcggccccggccgcacctggtaggaaggggacgcccaggttcccctcacaccgtctcgcttcacgttgcttaaatcacctctggcggcaagcacggcctgtgcgacgaacgcaagcgaggcgagcaccacgcacaggagcgcagccaagttcctgacgagagccatagttgaagcctgaaggaaggaagggtgcgtgtgttacttctgtcttggagaagctaagtgc

SEQ ID NO: 25966 - DNA, 614 bp, Triticum aestivum
  Clone ID: PAT_TA_25966
gcaaaaaggctaatattctgcatcagaactttcaggagtacatgccaaaattcttgttctcttgaaaagagttttgacagtgctatttctttgtcggtccaccacaaccttcagaaaaatcttctatacaaggtacaaacagccaaataagaagatgagagaacatggtggagacaaactgggggaaagccaagtgtatgctaccagtgaaagcagtacattcccctgatcctgatccttctgaagctaattgttgctatataagcgatctttatgcagcctttgcctttggttttgccttcttgaatctagagtacaggaaaacaccgagcagagccagaccagttccaagggcatttataggtgaaattggagttctgaagaagataacggatgacacgatgacaacaacccgtttgacagagtttgcaacagaatgggtcacaggtgatattctggccaataaactatatgaaacctgttgataaaaatggaaacaagtgccagcaatggctgctttcacgcaaagttcttgaagatttacgccagtgctctgtaggtatgatgggctaaacttgatgccctctaaatatagcattaatgggaccgacaac

SEQ ID NO: 25967 - DNA, 820 bp, Triticum aestivum
  Clone ID: PAT_TA_25967
atgatgtaaatccttgcatggtacataatctggtttccgataccaggcttcaagaagccaaagcactagtattgtaaacaagcagagcaccacccagcagaattccagcaagagtagccacccagagcaacaaccatgtctttcctcccgcatagtagtcaccacttggagaccattcttctgggttatatattgggctacattaaagacatcgcaaatatcatatatgcaatgaaaactgagggcagtagatgaattctgaatgctattattttcactggcatcttcttgaacatttttatcatctaaacagtacagcctgcttatatatatattatatatatatttatttatttttatattggggtgaatgttctacctgccccatcaacatttgctccatacttgctggcaaactggtagacgcccttccccttggctagccttccagatgcatcaacaccatctttcagttccaatcctcccccgggccctagatgttaagaaagcacaatttcatagcttttgtaggatatactgagctacattgataaacaaaaaaaatgctatccaataggccagtaatagttcctttttattcctagaaattccgtatgacagaaggtggattttatagcatgtactgaccgaaaggctgagaagtctgaactttctttgcctttttggacattactctgaaagatgatgatcgtgctgaaggctggatgcgctggagctgcgactgcccagaaaatggcgatggagatgatttcagagccatagaagccatgatcgaggtcgccatgcgaatgacagtaag

SEQ ID NO: 25968 - DNA, 344 bp, Triticum aestivum
  Clone ID: PAT_TA_25968
tcgagcggccgcccgggcaggtacaagtgtacaagtgcaaccataacatgcacgcagaaccacctatccttctctcatctctcacagtagaaacgagagaaaaaggtcgcaaaaaccaccaacccaaaaccatttctcatggtgagctaacaagctcagaaaacctttgtgttcccgacccttctccactgccgcggaatcaccgaggaaagaaacgaaaaaggacaaaatcattcccggcgaataaaacagacactaattaaagcagcttcgacaagttttgtgtgtgggtgtgtgtaatttcatgcgatgcacgtgactcagacgagcacgacgcaatctgt

SEQ ID NO: 25969 - DNA, 640 bp, Triticum aestivum
  Clone ID: PAT_TA_25969
gggggcctggtggaagcacggctcgatggacatggcacggccgcacggcggctccggcacgacgtggttctcgggcctgtacatgatccacggcgtgaggcaggcgaggccatgcgcgacgtagccgaaggtggagaagccgctggtgatgagcacatcgctcatgctcagcaggtagatctccgcgagcgccttcatgttgtgcttcctgttcttcttcttctggtactcctcgtggctcggctggtaaactttcaccgtggtgccgtagacggtgtggtgctcgctgtacctttccctaatctgatcactgtaccaagagctcaaagaggtcgcgagaacggcgattgtccggttattcccagcggccgctccatcggtcacgccgatttgtggcagcagcttttcaccctggacacaggaaaggatctgctctaaaacatgtggaaacggcccatttctttgcaggatgcccttcttctcaaatatcctgatctgtattcccactactttatcagctttagcaaggtaggccctgtagtgagcatcggatatgtcacggccaaatgacttgtctgatcctacggcgcagtagtatggaccctgggggccagggtacctgcccgggcggccgctcgaa

SEQ ID NO: 25970 - DNA, 566 bp, Triticum aestivum
  Clone ID: PAT_TA_25970
cgacccacgcgtccgcattcccgccctcctctcctcctgtcgcctccagagcaacagcagctccggctcgagcaagaaacaagtactagtttgatctgtcaagatgttggccatcttccagaagcaggtggcgcacgcgccgcaggagctcaacagcccccgcggcagcaccgccaagcccaagaaccccgacgagatcctccgcgacttccacgccgcccacccctccgacgccttctccacctccttcggcggcggcgccgccctcgcctgcgtcgccgcgcagccccgcaacctcgccgccgccggctaccagaggatgttctgcgggctggacgacatctactgcgtcttcatgggcacgctggacaacctgagcagcctgatgcggcagtacggcctcaccggccgctccaccaacgaggcgctgctggtgatcgaggcctaccgcaccctgcgcgaccggggcccctacccggcggaccaggtggtgaaggacctgtccggctccttcgccttcgtcgtcttcgacaaccgcggccggtcggggtcgggggcggcggtgt

SEQ ID NO: 25971 - DNA, 507 bp, Triticum aestivum
  unsure (1)..(507): unsure at all n locations
  Clone ID: PAT_TA_25971
gccctggtttgttacccaccttcgttttacatggttcacaaccagctacaagccgggatgggatgtagggacgcccagccatggacgagcagcaacggcgggatggatgtggtttcccttgctgcaggatgtccggtgttggagaaccaagtggcgttgcacgagctccgaccctggcgctcctccctaagggctatgagttgatggccacgctgctgttttgccctgcttgataattcttttactgtccggtctgctctgcatagtttccagttgcttataaaacgataaaccagtggngatgtgaggtccgacaatggtttgtaattttggttacatccccagcctnctccaagctagcttcttcttcacatcatatcatatttgcacctgctgctacatcatgggatttggattggtcacctactanctnagttagattagcttgtattgccatccaaattanntccaatangtgntttccanntttgcangttttcctngtac

SEQ ID NO: 25972 - DNA, 612 bp, Triticum aestivum
  unsure (1)..(612): unsure at all n locations
  Clone ID: PAT_TA_25972
ataaatctgttctgagctgaaacatcaaacgcacagcactagtaacactattttaggggtcaaaattatagtccactccactctgcgcagtaagctgtgacactgcaaagcgttgtttcttctcatcacaaaccggctaattgagatgcacatatgtacagtacagcggccacgcacgtagtcaaggcgtttcatcaagacttcagacccagttgttgggcagcgagaagttgtggaacctgaaggaggcgtcccctgcggtgtccctcccctgcaccatccccggctcgccgtcgggctgcggcggctggtcgacccacgagaaggagttctgccgcagcagctcggcaaacgccggggacggctgcggcgtcgggcagggcgccccctgcggccggttcggcgcgtcggtgccgaagtcccacatgaggacgtggagcaggatggggcgcagggcgtgccggtgcagggacagcttctggctgagcgacacggtgtcgaagcaccggatggcccggaggtggacaccatccaacggcagcancttgcggnacgacaccgggaagatgaccaacaacttggacgcgcgcttcgcctccggtaaaagtccgc

SEQ ID NO: 25973 - DNA, 305 bp, Triticum aestivum
  Clone ID: PAT_TA_25973
gcggccgcccgggcaggtctttgctgaagcacccaatgctcatagttatccacctatatgcgccggggagtatgtggaacaagagctctcagcaattaatctgaaagggaaggttgcactttaggtgcacacagaccgccgattaatctggtgacttggtgactcgttggtctgccttctatggtcagaatgcgaattgcgataatccaagccgatacttgtatcttcattcaactttgttgacataacgaggttgcgccggtctattttcgacacaaccctatacctcggccgcgaccacgcta

SEQ ID NO: 25974 - DNA, 453 bp, Triticum aestivum
  Clone ID: PAT_TA_25974
tagcgtggtcgcggccgaggtacaatacacatcgtttggtgcatattttggtttgccgcacaggcttcaagaagccaatgcactagtattgtagacaagaagagcaccgcccagcagaattccagcaagagtcactgcccagagaaacagccctgtctttcctgtatatataagtcatcaagaaaatagaaggtcaaatttattgaatttgggatacagtaaacattttatgacacgcttaaagaaacgtcacctccaacataaacgtcaccacttggagaccattcttctggtgtatatatcgggctgcaacgtagtaagaaccgaataagatgccatgagagctgaactccatggacgatctctgaattttgtagatatttgtttttactgacagaaactgcaggtttgggtttgcgtgtttttacctgtacctcggccgcgaccacgcta

SEQ ID NO: 25975 - DNA, 649 bp, Triticum aestivum
  Clone ID: PAT_TA_25975
cccgagaaaagaatcccggcctccccgtcgcggaatccgccggctcgcccccgcccgcggctgcgcatcttctgcttcctcttcttcttcccccgagtttcccgtgcgctattcttttcttccctccctccccagcccccggacctggggaagaagaagcagcggcggagacggggcaggaggagccggcgggggaagacaaggaggagcttcgttgttcgtctccccgccgattcgtttccggattagccgcctcccgccggagccagccattgatttgacccaaagctcgcgtatttccccggaatccctctctgtgacggaagagcagcaggcggcggcgggatggggtaccaagtggtggcggcgcagctggcgcggctgagcggcgcgctgggcacctcggaccacgcctccgtggtctccatcaccctcttcgtcgcgctgctctgcgcctgcatcgtcctcggccacctgctcgaggagaaccgctggctcaacgagtccatcaccgccctcatcatcgggctgtgcaccggcgtggtgatcctgatgaccaccaaggggaagagctcgcacgtgctcgtcttcagcgaggacctcttcttcatctacctcctgcctcccatcatcttcaacgccggtttcc

SEQ ID NO: 25976 - DNA, 700 bp, Triticum aestivum
  unsure (1)..(700): unsure at all n locations
  Clone ID: PAT_TA_25976
actgaaccacaggatcaacaagagtgggacggccaacggtccgccgccgccgatttattttcttttcgccggaagaattcgttgttttgaggtgcttcataccttcagcgccagcttcttggcggcgagggcctccgcctcaagggtcggctcccacaggatcgtggtctcggccagcagcgctgtcacggtgtatgggtccatgttcgaggccgggcgacggtcctccagatatcctttgccctttgcctcggtttctcgccccacacgaatagagcagccacggttcgcgacaccccatgagaagtctgatatgctagctgtctcgtgtagccctgtcagcctccgctcgtttccttcaccatatgcggctatgtgcaagtcatggcgaagtgaaaggttcaggattgccttcttgatcacgtcgaaacctccatcttcacgcatgctcaatgtgctgtaatttgtgtggcagccagctccattccagtcaccctggattggttttgggtcaagggtgagcaccacaccagcttgctccgtgattctctcgagaatgtatcttgaagcccatatgtggtctcctgcatcaataccaacactaggcccaacctggtactcccactgaccaggcatgacctccccgtttgttcncactgatttcaattnncccgcgtaaaggcaggccttgtagtgagca

SEQ ID NO: 25977 - DNA, 467 bp, Triticum aestivum
  Clone ID: PAT_TA_25977
cgtctttcccgttctcctctccccctgtcgccggcatagcatcagcagctccagctcgagcaagaaagaactagtttgatctgtgaaaatgttggccatcttccagaagcaggtggcgcacgcgccgcaggagctcaacagcccgcgcggcagcaccgccaagcccaagaaccccgacgagatcctccgcgacttccacgccgcccacccctccgacgccttctccacctccttcggcgggcggcgccgccctcgcctgcgtcgccgcgcagccccgcaacctcgccgccggcgggtaccagaggtaacgccaccatctctcatgacccaaatcgctcccagcaaccgcaacgatgtccggacgaataagaagaaccgatctctctgtgtgcgcaggatgttctgcgggctggacgacatctactgcgtcttcatggggacgctggacaacctgagcgcgctgatgc

SEQ ID NO: 25978 - DNA, 792 bp, Triticum aestivum
  unsure (1)..(792): unsure at all n locations
  Clone ID: PAT_TA_25978
ataccaggtgaataagaagctgctagatttgagtggtatcgtcactgtattcttctgtggtattgtgatgtcacattacacctggcataacatgacagagagagttacaacaaagtaaccttagttcttagtctgtgttatttcaatataagcaatcttatgttcagtcaaaaactgttgcaggtgctactacgagtagtgcttgtaatttagttttgctctaccaatcgtcaattaattccctggttactactatgtaggggatgttactgttcagtgaaaaacctgcattgcaagatatactacagtgcaggtccttgtggtactatgggatttattagctgtttggagatgtactcatattgtgccatgtattttattagctatatgattacacatgtcagttttattatcaaaatctgaactgtagtagctatgtattttattagctattggttctttctttcttcagggctatgagttgatgggcacgctgctgtttttgctctgcttgataattcttttactgtccggtctgctctgctctgcatagtttccagttgcttataaaacgataaaacagtggtgatgtgagatgctggcatttgttcatgtcgcaagctccaggatgaaaagtgaagaagcatttagttctagctcattggagctagttatacttttatagatagttatattttgatatttggctgtgttncttggtggttgtaaacctgatgtgaagtatgttcgattataaacgtggtgtgaactatgtttgnattgtaatgtacc

SEQ ID NO: 25979 - DNA, 641 bp, Triticum aestivum
  Clone ID: PAT_TA_25979
agggacatcggccgagaaggtcacggaaggatgcctcgcgcggggttgtcggcggggtcgagcaaggtggacgtggccatcgacctcgggaacccgctcctcaaccgcaccgtcgacggcttcctcaagatcggcgccgtcggcgcctgcagggttgccgccgaggacgccttcgactgcctccaaagtgggagtgtctcgaagcgcaagcttgagaagacactggaaaaaatgtgcaaggagggcgcatattggggtgctgttgctggagtgtatgtaggcatggagtatggagtggaaagggtccgcggagagtatgactggaaaaatgcgttgattggaggcattgcaagcggcgccctgatctctgctgctagcaacaacaaagggaacaagatcgccaaggatgccatcaccggaggtgccatcgcgaccgccgtcgagttcatcaactacctcacctagctgtgaggccatccatattcgcggcgacgtttttatcggacaagactgaataagaacttcttgactgaagccaagccatccaccctctgtgttaataattggagccgtttcctccaacgttttcccattttctgttgcctgcgttctcatgtccatgttctgaacaatttgttttc

SEQ ID NO: 25980 - DNA, 824 bp, Triticum aestivum
  unsure (1)..(824): unsure at all n locations
  Clone ID: PAT_TA_25980
gcacgaggcgttctcctctccccctgtcgcctccatagcagcagcagctccagctcgagcaagaaagaactagtttgatctgtgaaaatgttggccatcttccagaagcaggtggcgcacgcgccgcaggagctcaacagcccgcgcggcagcaccgccaagcccaagaaccccgatgagtaggagggcgcggcggccgctgcaaaacccggggcgcgagcccgggcggagcggccgtcggtgcagatcttggtgatctgcgacgaccgcgccgtggccaaggccgggtgcgggcggtcctacgcgccgttcccgcccgggtgcatgttccacagcgagggcgggctcaagagcttcgagcacccccgggtgcatgttccacagcgagggcgggctcaagagcttcgagcaccccatgaaccggctcagggcgttcccgcgcgtggacagcgagggcgtcatgtgcggcgccaacttcaaggtcgacgccttcaccaagatcaactccatgccccgcgtcggcagcgccaccaactgggccgccacctgggacgacgccgccatctgatctccggcgccggcgacgcgcgcctcgtggcctcgtcggacttctgaatttaggcttactgcattttacttatattttttctttggcaatgtacattctgatctgatctgatctgagccgtgtgtgggcgtgggcacgctgacacgtacggttgtttgcttgtacgatggaggaataagactttgcttcccgtcccaaaaaaaaaaaaaaaaaaaaaaaaaagaaaaaaaaaaaantaactcgagggggggccgta

SEQ ID NO: 25981 - DNA, 1431 bp, Triticum aestivum
  Clone ID: PAT_TA_25981
ggtggaaagagaccatggattcctggggttcaaaaatgatttctgcaattgaggttgttgctgagatggcggcgattggatttggcttgtcaaaggatgcatttacctctttgatgaaggtccctgttggctgtcttctcattcagtcagggaaacagttggaatggcttacaggtggtgaatgtttagctggaatgcatgaggtagtggtgaccaagagaacattagaggcaatagaactagctaaagagcagaaccgaagtttgtggaggatctcatcaacactattctcgcacattgcttccgatgcgacactcaagccattgggccactttgctgaagcacccaatgctcatagttatccacctatatgcgccggggagtatgtggaacaagagctctcagcaattaatctgaaagggaaggttgcactctaggcgcacacagaccgccgattaatctggtgactcgttaatctgccttctgtggtcagaacgcgaattgcgataatccaagctgatacttgtatcttcattcaactttgttgacataccgaggttgcgccggtctatttccgacacaactctatctatgtccatgctaagtatatgtccatttgacccccctgttaagttatagtggatgctcatgctctggtgtactgaactgatagcacctgtgaaaattaaataatagcagtgctgttattctcgaaccgaagtgtactgaactgatatcagcgttgctgtctacgaaaatcatccttgcaatccgttttgcaaccgataaacctgttctgagctgaaacatcagacgcacagcactagtaacactattttaggggtcaaaattatagtccactccactctgcgcagtacgctgtgacactgcaaagcgttctttcttctcatcacaaaccggctaatcgagatgtacatatgtacagcacagcggccacgcacgtagtcaaggcgtttcatcagacttcagacccagttgttgggcagcgagaagttgtggaacctgaaggaggcgtccccggcggtgtccctcccctggaccatcccgggctcgtcgtccgcctgcggcggctggtcgacccacgagaaggagttctgccgcagcagctcggcgaacgccggggacggctgcggcgtcgggcacggcgccccctgcggccggttcggcgcgtcggtgcccaagtcccacatgaggacgtggagcaggatggggcgcagggcgtgccggtgcagggacagcttctggctcagcgacacggtgtcgaagcaccggatggccccggaggtggacaccatccacggcagcaccttgcggcacgacacccgggagatgaccagcagcttggacgcgcgcttcgcctcccggtagaggtcgcgcagccccgaccgcgtcgacggcgccggccggctg

SEQ ID NO: 25982 - DNA, 308 bp, Triticum aestivum
  Clone ID: PAT_TA_25982
tcgagcggccgcccgggcaggtacacatcgtttgattcatattttggtttgccgcacaggcttcaagaagccaaggcactagtattgtagacaagcagagcaccgcccagcagaattccagcaagagtgattgcccagagaaacagccctgtctttcctgtataagtcaccaggaaactaaaatgtcaaatttactgaatttgggatacagtaaacattttatgatacgtttaaagaaacgtcgtgcagtgtaaacttatttgtttcgagatgccagtcggtctgcgcgtacctcggccgcgaccacg

SEQ ID NO: 25983 - DNA, 976 bp, Triticum aestivum
  Clone ID: PAT_TA_25983
cgggagtggagagggcaaaacagaaccgcgatggagtacgtcaaccctctcaccggcttccgcgtcgacggccgccgccccaacgagatgcggcagctcaagggcgaggtcggcgtcgtctccagggccgacggctcggcgctcttcgagatgggcaacaccagggtcatcgccgcggtctacggacctcgagagatccaaaacaggagtcagcaacaaaatcgtaaagaggctttggtgcgttgtgagtatagaatggcagaatttagcactggggatcgaaggagaaagccaaaaggtgacaggcgatcaacagaaatttctcttgttattcgacaaacaatggaggcaagcatattaacacatttaatgccacactcacagattgacatatttgtccaagttcttcaagctgatggtggaaccaggtccgcatgcatcaatgctgcaacactagcacttgcagatgctgggattccaatgcgagacatagtcacttcttgcagtgctgggtatctgtgttctactcctttgcttgatctgaattatatagaagacagcgctggaggcgcggatgtaaccgttggcattcttgcaaagatggacaaagtgactcttctgcagatggacgcgaaactaccaatggacacatttgagactgtgatggaccttgcaactgaagggtgcaaagcgatcgcgacctacatccgagaggtgctattggagaacacgaagcagctggagtgtcagcgaggctagttaaacctagcaggcggatgccattaaacgagagcctgtagcacttgaaggcgggtctgttgtgtaacgctgattgatggcttatctgcctagcagagctagcattgagagaaaaaaatggcactgaacctgtcaaagatagccggaccatcattttccctcctaacgtaaatgctgtagcgcacaggagatacatctggttatgtaaactttgatg

SEQ ID NO: 25984 - DNA, 698 bp, Triticum aestivum
  Clone ID: PAT_TA_25984
tcttgctctgtatctctctctgcgccgagtgctagacgagaagggagcagggaaggatgcctagcgcggggctggaggcggggtcgaacaaggtggacgtggccatcgacctcgggaacccgctgctcaaccgcaccgtcgacggcttcctcaagatcggcgccgtcggcgcctgcagggtggtcgccgaggacgccttcgactgcatccacaggggggatatctcgaagcgccagcttgaagagacactgaagaaaatgtgcaaggagggagcatattggggtgctgttgctggggtgtatgtaggcatggagtatggagtggaaagggcccgtggtgaccgtgactggaaaaatgcgttgataggaggcattgcaaccggtgccctggtctctgctgctaccaacaacaaagggagcaagatcgcccaggacgccatcaccggaggcgccatcgcgaccgccgtcgaattcatcaactacctcacctagccgtgaggccatcgatattcgaagcgatgtttttatcggacaagactgaataagaacttcttgactgaagccaagccatccaccctctgtgttaataattggagccgtttcctccaatgttcttccactttttgttgcctgcgttctgtgtccatgttctgaacaattttattttatctcctgcgtggttgaatccttcaaaaaaaa

SEQ ID NO: 25985 - DNA, 1638 bp, Triticum aestivum
  Clone ID: PAT_TA_25985
ggaaaaaaagaatcctttgggcgattcattatccttttaataacgtagttctccgaatagactcaggtacagggtttggccagacccaacagatcaaatggactcagtccaagcgaaaaaaacatgcggagtggttctacaaactgtgaggatttttgtacagacagtgccccaacggaaccacaggatcaacaagaatggacggccaacggtctcgccgccgccgccgatttattttcttttccccggaagaattcggccctttcaggtccttcataccttcagcgccagcttcttggcagcgagggcctccgcctcgagggtcggctcccacaggatcgtggtctcggccagcagcgccgtcacggtgtatgggtccatgttcgaggccgggcgacggtcctccaggtatcctttgccctttgcctcagtctctcgccccacacgaatagagcagccacggttcgcgacaccccatgagaagtctgatatgctagctgtctcatgtagccctgtcaacctccgttcgtttccttcaccatatgcggctatgtgcaagtcatggcggagtgaaaggttcaggattgccttcttgatcacgtcgaaacctccatcctcacgcatgctcaatgtgctgtaatttgtgtggcagccagctccattccagtcaccctggattggttttgggtcaagggtgagcacgacaccagcttgctccgtgattctctcgagaatgtatcttgaagcccatatgtgatctcctgcatcaataccaacgctgggtccaacctggtactcccactgaccaggcatgacctccccgtttgttccactgatttcaattccggcgtaaaggcatgccttgtagtgagcatctgaaatgtcacggccaaatgacttgtctgatcctacggcgcagtagtatggaccctgggggccagggtaccctccaacaggccagccaagaggccagttcacatccctctgcatcagagtgtactcctgttcgattccaaaccatggcacttgtgaagtgaccttggggtcactgaagatttgtgcagccatgtgtcgtttgttagtagggatgggttccccttgtggtgtgtaggtgtcacagataaccagtatgttgttgcctcctcggaatgggtccttgaatatggcctgtgggtataggatgacttcactgtcttctccaggagcttgccctgtgctcgatccgtcgtagttccatttcggtagctctgaggggtcctccactggcttcgaaatcgtccttgatttgcttctgaggtcaattccagatcctccaacccagatgtactcggcgatgatcttgtcggtgaagggcgtggtgtccatgtcgagcagctgctgcatcctctggatgacgccggtggtctccgggccgagggccagcaccttgaacccggaggcggcgcgggcggtcctcctgacgccccacaccctgcccgccggctgcctcgccgggacggccgacctgccccgcgcgcccacctggcactgcatcgccggcaccaccgcctgcgccatcgccgctgcttgcttacttacttactccgccgccttccccttcagcgctagctgacaacgacgcgggcgagacaagggagg

SEQ ID NO: 25986 - DNA, 655 bp, Triticum aestivum
  Clone ID: PAT_TA_25986
aagcaaggaagatgcctagcgcgggggtgtcggcggggtcgaacaaggtggacgtggccatcgacctgggcaacccgctgctcaaccgcaccgtcgacggcttcctcaagatcggcgccgtcggcgcctgcagggtggtcgccgaggacgccttcgactgcatccacaggggggatatctcgaagcgccagcttgaagagacgctgaagaaaatgtgcaaggagggtgcatattggggtgctgttgctggggtgtatgtaggcatggagtatggagtggaaagggcccgtggtgaccgtgactggaaaaatgcgttgctaggaggaattgcaaccgggtgccctggtctctgctgctaccaacaacaaagggaacaagatcgcccaggacgccatcaccggaggcgccatcgcgaccgcggtcgagttcatcaactacctccacctaggtgtgaggccatccatattcgcggcgacgtttttatcgggcaagactgaataagaacttcttgactgaagccaagccatccaccctctgtgttaataattggggccgtttcctccaatgttcttccattttctgttgccctgcctcctcatgtccatgttatgaacaatttattttccttcgtggtttgaatccttcagttatggaa

SEQ ID NO: 25987 - DNA, 696 bp, Triticum aestivum
  unsure (1)..(696): unsure at all n locations
  Clone ID: PAT_TA_25987
attccccgctccaacaacctccatctctcctctcctctcctctcctctcgtctccacagcagcagcagctccggttcgagctcgagcgaggaagaagtataccatttggcccgtgaagatgttggccatcttccagaagcaggtggcgcacgcgccgcaggagctcaacagcccgcgcggcagcaccgccaagcccaggaaccccgacgagatcctccgcgacttccacgccgcccaccccgccgacgccttctccacctccttcggcggcggcgccgccctcgcctgcgtcgccgcgcagccccgctccctcgccgccggcgggtaccagcggatgttctgcgggctggacgacatctactgcgtgttcatgggcacgctggacaacctgagcagtctgatgcggcagtacggcctcaccggccgctccaccaacgaggcgctgctggtgatcgaggcctaccgcacgctgcgcgaccggggcccctacccggcggaccaggtggtgaaggacctctccggctccttcgccttcgtcgtcttcgacaaccgcggccggtccgggtcgggggcggcggtgttcgcggcgcanagcacggacggcggggtgccgctgcactgnggcgtggcggcggacgggtcggtggtgatctgcgacgaccgcggcgtggccaaggccgggtgcgggcggtcgta

SEQ ID NO: 25988 - DNA, 687 bp, Triticum aestivum
  Clone ID: PAT_TA_25988
ttatatttcttgctctgtatctgtgtgccgagtgctagacttgagagagcgagagagggagggaggtcggccgagaaggttcaggaaggatgcctcgcgcggggttgtcggcggggtcgaacaagttggacatcgccatcgacctcgggaacccgctcctcaaccgcaccgtcgacggcttgctcaagatcggcgccgtcggcgcctgcagggtggccgccgaggacgccttcgactgcctccaaagtgggagtgtctcgaagcgcaagcttgagcagacactgaagaaaatgtgcaaggagggcgcatattggggtgctgttgctggagtgtatgtaggcatggagtatggagtggaaagggtccgtggtcagtatgactggaaaaatgcgttgattggaggcatcacaagcggcgccctgatctctgctgtgagcaacaacaaagggaacaagattgcccaggatgccatcaccggaggtgcgattgcgaccgccgtcgagttcatcaactacctcacctagctgtgtgaccatatgcatggcaatgttttttttatcagcaagacgaataagaacttcttgactgaagccatccgccctctgtttaataattggagccgttccctccaatgttcttcccttttccttcatgtccatgttctgaacaatttatttaaaaaaaaaa

SEQ ID NO: 25989 - DNA, 1299 bp, Triticum aestivum
  Clone ID: PAT_TA_25989
acgcgtccgctccctcacgtaaccctcaacgccgccgccagtgacgccgccgccgcctgctacccctcgtcgccggtcggatcctctcctccgcctccagatccggccacccctgcctctttccctccggatccccaactcagcagcgctaatcctgccaacagcaaggagcagcgacctccatggcaatggcgacctgactcggacgccattgacgcccgagacaacagccggagcaaggagcagcaaccccaaggcctagcccctcgcccaaacatcaagcaaagccctcgccgccgccgccgcccgctcggagctagaagaaggagtggagagggcaaaacagtcccgcgatggagtacgtcaaccctctcaccggcttccgcgtcgacggccgtcgccccaacgagatgcggcagctcaagggcgaggttggcgtcgtctccagggccgacggctcggcgctcttcgagatgggcaacaccagggtcatcgccgccgtctacgggccccgagagatccaaaacaggagtcagcaacaaaacagtaaagaggctttggtgcgttgtgagtatagaatggccgaatttagcactggggatcgaaggagaaagccaaaaggtgacaggcgatcaacagaaatttcgcttgttattcgtcaaacaatggaggcaagcatattaacacatttaatgccacactcacagattgacatatttgtccaagttcttcaagctgatggtggaaccagcgtctgcatgcatcaatgctgcaacgctagcacttgcagatgctgggattccaatgcgagacatagtcacttcttgcagtgctgggtatctgtgttctactcctttgcttgatctgaattatatagaagacagcgctggaggcgcggatgtcaccgttggcattcttgcaaagatggacaaagtgactcttctgcagatggacgcgaaactaccaatggacacatttgagactgtgatggaccttgcaagtgaagggtgcaaagcgatcgcaacctacatccgagaggtgctattggagaacacgaagcagctggagtgtcagcgaggctagtcaaacctagcaggtggaggccattgaacgagagcgtgtagcacttgaaggcggatcttttgtgtaacacagattgatggcttatctgcctaccacagacactgaacctgtcaaagatagctggaccatcattttccctcctaacgtaaatgctgtagcgcacaggagatgacatcttgattatgtgaaactttgatgttgaacttggtatccatg

SEQ ID NO: 25990 - DNA, 629 bp, Triticum aestivum
  Clone ID: PAT_TA_25990
tttttttttttttttttttttaatcctttgtgtgattcattatccttttaataacgtagttctccgaatggactcaggtacagtgtacagacccaacagatcaaatggactcagttcaagcgaaaaaacatgcgaagtggttctacaaactgtgaggattttgtacagacagtgccccgacggaaccacaggatcaacaagaatggacggccaacggtctcgccgatttattttcttttccccggaagaattcggccttttcaggtccttcataccttcagcgccagcttcttggcagcgagggcctctgcctcgagggtcggctcccacaggatcgtggtctcggccagcagcgccgtcacggtgtatgggtccatgttcgaggccgggcgacggtcctccaggtatcctttgccctttgcctcagtctctcgccccacacgaatagagcagccacgattcgcgacaccccatgagaagtctgatatgctagctgtctcgtgtagccctgtcaacctccgctcgtttccttcaccatatgcggctatktkcaagtcatggcgaagtgaaaggttcaggattkccttcttgatcacgtcgaaacctccatcttcgcgcattctcagtgt

SEQ ID NO: 25991 - DNA, 584 bp, Triticum aestivum
  unsure (1)..(584): unsure at all n locations
  Clone ID: PAT_TA_25991
cgtccggtcctcctctcctcctgtcgcctccagagcaacagtcctccagctcgagcaagaaacaagtgtagtactagtttgatctgtgaacatgttggccatcttccagaagcaggtggcgcacgcgccgcaggagctcaacagcccgcgcggcagcaccgccaagcccaagaaccccgacgagatcctccgcgacttccacgccgcccacccctccgacgccttctccacctccttcggcggcgggcgccgccctcgcctgcgtcgccgcgcagccccgcaacctcgccgccgccggctaccagaggatgttctgcgggctggacgacatctactgcgtcttcatgggcacgctggacaacctgagcgcgctgatgcggcagtacggcctcaccggccgctccacaacgaagcgctgctggtgatcgaggctaccgcacctgcgcgacggggccctacccggcggacaagtggtgaaggactgtcggtcctcgcctcgtcgtctcgaaacgcgcaagtcggtcggggcgcgtgtccgcgcaagacgacgngggtgccctcacgggctgcgcgacgtcgtgtat

SEQ ID NO: 25992 - DNA, 1425 bp, Triticum aestivum
  Clone ID: PAT_TA_25992
ttaactctcgcctctcccgccgccgcccaccgcgcagcccaatggacctccccgtggtggatctcgcgcccttcctgcaggccgccgccggcgacgcggccgcggcgccggccgaggcggaggaggcgctgcgcgcgctctgcgccacggtgagcgccagcctgcgggacacgggggcgctgctggtcaaggacccccgctgcaccgccgccgacaacgaccgcttcctcgacgtcgtcgagcgctacttcgcccgatccgacgactccaagcgcctccaggagcgcccccacctccactaccaggtcggcgtgacacctgaaggcgtggaggtgcctcgcagcctcgtcgacaaggtagatgcaagacacgatcaagagtatgccagaggagtttcaaccagccacccctaaggggccagacccgaagtggcggtacatgtggagagtgggccctcgcccgtcgaatacccgctttaaggagctgaacgcagaacctgttattcctgatggattaccggagtggaaagagaccatggattcctggggttcaaaaatgatttctgcaattgaggttgttgctgagatggcggcgattggatttggcttgtcaaaggatgcatttacctctttgatgaaggagggaccgcacctcctagcaccaaccggaagtaatctgatgcgtcatggttttgagggcacctgtgtttgctgggttccattatgatcttaatttcttgaccatccatggccgtagtagatttccaggcctgaacatttggttaagtaatggtaaaaagatggaggtgaaggtccctgttggctgtcttctcattcagtcagggaaacagttggaatggcttacaggtggtgaatgtttagctggaatgcatgaggtagtggtgaccaagagaacattagaggcaatagaactagctaaagagcagaaccgaagtttgtggaggatctcatcaacactattctcgcacattgcttccgatgcgacactcaagccattgggccactttggctgaaacacccaatgctcatagttatccacctatatgcgccggggagtatgtggaacaagagctctcagcaattaatctgaaagggaaggttgcactctaggcgcacacagaccgccgattaatctggtgactcgttaatctgccttctgtggtcagaacgcgaattgcgataatccaagctgatacttgtatcttcattcaactttgttgacataccgaggttgcgccggtctatttccgacacaactctatctatgtccatgctaagtatatgtccatttgacccccctgttaagttatagtggatgctcatgctctggtgtactgaactgatagcacctgtgaaaattaaataatagcagtactgttattctcgaaaaaaaaaaaaaaaaaaa

SEQ ID NO: 25993 - DNA, 1369 bp, Triticum aestivum
  Clone ID: PAT_TA_25993
aaacgaaattgcaaacgttatttatttgccacttacatccctatataagacttataaacgaaaaaaggaggcagtacattgcaactggcgagaagacacaaactaataacaaaggggacacattacacaatgaacaaccggaaaaaagaagaccacaacgaattcatgtgggctggctatcgtgaatgtgtgggctgccgcattcaaatccaaagtttggttttccctggggtttttttttccgacggtacatggtttttttttcgacggtatcacacatcagagctctcccatcctcttggcgcattccacgctgcagtccagcgtctcctccacaccatacttgaacctgaatcccagatccacaagcttggtcgaatcacccttcaccctcacgccctctcctgccaccttcttgagcaatatcttgtgctccgggtacttggcggcgaaacgggcgacgtagtcctccatgttggggtacccgacggcgcagaggaagcggccggccatggacggctggtccatgcagaagaggtgcgcctcgcagacatcgtcgatgtgcaccagcggcacggacccgcagagcgcctgcatgaacttgagggagttgtggtggatctcgttgccggtgagcggcgccaccaccacggggatgctgctccagaggatgggctggatggtgtcgccgccgacgagcccgcacgcgagggtgaccacctcgaacgccctgccctccgactcgttgtacctcagcagctcctcctccgacagccgcttggacgacacgtacgcgtcgaggtggacgttgctgtagccgtaggagaggtggagcggcgaccagcaggactcgttcatggcgtccttgtacccgtcgccgtcctccttgagcggcgaggcggccgtgacggaggccgtgtggatgacgcgccgcaccgtcttggaccgctcgcactgctgcaggatgatgcgcgtcgcgtccacgatcgctttccgttatgttcttgtacttggtgctgctggcgtcgtgcagcagcggggtggcgacgaggaagacgaagtcgcagccctggatggccggctcgaaggtggcggcgtcgtagatgtccgcctcgaacagcaccagccgctccgccgcgccggggagtgacctcagcagcccagtcttcttctcatcccggagggatctcaaggtggcgtggacgacgcagcctcgctgcagaagcttccggacgagccaggccgcgaaggaagcggccgggccccggtgacgcacaccctgctcatcttcctcacaacaagcttctcggactcccggtctcccgtgttctcttctcctctccggtcggtcaagcctcgtgccgaattc

SEQ ID NO: 25994 - DNA, 738 bp, Triticum aestivum
  Clone ID: PAT_TA_25994
gtctcactgtactccgctccatcttcttgctctgcactgctcccagctggtcagtcaagagaaggaaagatgcctagcgcggggctggaggcggggtcgaacaaggtggacgtggccgtcgacctcgggaaccctctcctcaaccgcaccgtcgacggcttcctcaagatcggcgccgtcggcgcctgcagggtggtcgccgaggacgccttcgattgcatccacaggggggatatctcgaagcgccagcttgaagagacactgaagaaaatgtgcaaggagggtgcatattggggtgccgttgctggggtgtatgtaggcatggagtatggagtggaaagggcccgtggtgaccgtgactggaaaaatgcgttgataggaggcattgcaaccggcgccctggtctctgctgctaccaacaacaaagggaacaagatcgcccaggacgccatcaccgggaggcgccatcgcgaccgccgtcgagttcatcaactacctcacctagccgtgaggccatcgatattcgcagcgatgtttttatcggacaagactgaataagaacttcttgactgaagccatccaccctctgtgttaataattgggagccgtttcctccaatgttcttcccttttttttttttgttgccagcgttctcatgtccatccatgttctgaacaatttatttattttcctgcgtggtccgaatccctcaattaatgatatctgtgtgctgggcct

SEQ ID NO: 25995 - DNA, 2748 bp, Triticum aestivum
  Clone ID: PAT_TA_25995
gatcccgacctccccgtcgcggatccgccggctcgccccagcccgcggctgcgcatcttcttcttcttcttcttctcccgagtttcccgtgcgctattctcttctttcttccctgcccacccccggacctggggaagaagaagcagcggcggagacggggcaggaggagccggcgggggaagataaggagaagcttcgttgttcgtctccccgtcgattcgtttccggattagccaagggcggctcgagctgggttgatttgatccaaagctcgcgtatttccccggaatctttctctctctgacggaggagcaggcggcggcgggatggggtaccaagtggtggcggcgcagctggcgcggctgagcggcgcgctgggcacctcggaccacgcctccgtggtctccatcaccctcttcgtcgcgctgctctgcgcctgcatcgtcctcggccacctgctcgaggagaaccgctggctcaacgagtccatcaccgccctcatcatcgggctgtgcaccggcgtggtgatcctgatgaccaccaaggggaagagctcgcacgtgctcgtcttcagcgaggacctcttcttcatctacctcctgcctcccatcatcttcaacgccggtttccaggtgaagaagaagcagttcttccggaatttcatggcaatcacactatttggtgccgttgggacgatgatgtcgtttttcacaatatctcttgctgccattgcgatattcagcaggatgaacattgggacactggatgtatcagattttcttgcaattggagctatcttttccgcgacagattctgtctgcactctacaggttctcaatcaggacgagacgccctttttgtacagtctagtgttcggggaaggtgttgtgaacgatgccacatcggtcgtgcttttcaacgcgctccagaacttcgatcctaaccagatcgacgcgatcgtcattcttaagttcttggggaacttctgctacttattcgtgtcaagcaccttccttggagtgtttactggattgcttagtgcatacgtcatcaagaagttatacataggaaggcattctactgaccgtgaggtcgcacttgtgatgctcatggcctacctctcatatatgctagctgagctgctagatttgagtggtatcctcactgtattcttctgtggtattgtgatgtcacattacacctggcacaacgtgacagagagctcaagagttacaacaaagcatgcatttgcaaccttgtccttcatcgctgagacttttctcttcctttatgttgggatggatgcactggatattgagaagtggaaatttgctagtgacagccccggcaaatccattggaataagctcaattttgctcgggttggttctggttggaagagctgctttcgtcttcccgctctcgttcttatccaacctgacaaagaagacggagctcgaaaaaataagctggaggcagcaaatcgtaatatggtgggctgggctgatgagaggagctgtgtcgatcgctcttgcttacaataagtttacaagatctggtcacacacagctgcacggcaacgcgataatgatcaccagcaccatcactgtcgttctgtttagcactatgttgtttggcattttgacaaagcctctgatccggttcctactgcccgcgtcgagcaatggcgccgcctcagatcccgcgtcaccgaagtccctgcactctcctctcctcacaagccagctaggctcggacctggaggcgcctctccccatcgtgaggccctccagcctccggatgctcatcaccaagccgacccacaccatccactactactggcgcaagtttgacgacgcgctgatgcgcccgatgttcggagggcgcgggttcgtgccctactccccaggatcacccaccgatccgaacgtactcgtggaatgaacgtcgcgaagaagcaacggagaagccattacagcttcaggagacactctgaactgtaacaggaagggaaggaagtgtcacagcttcagaagaacgcgaagtctccggtaatattatagcgtttggcagactcggaaggctgaagaaggcggccctccgatgatggttcagatgaacggttggttgcggcaccgacaggaagatgaaccctagtaacggtgatgcgagtatcatcatcgccttatcggttacgacaaagcctgtacagttttgtatgtagattaacaagccaattgtatcctatgagatctccgttggcaggcaggcgtctgacctcctgcatctgcgacgaccgcggcgtggccaaggccgggtgcgggcggtcgtacgcgccgttcccgcccgggtgcatgttccacagcgagggcgggctcaagagcttcgagcaccccatgaaccgccttaaggcgctccccagggtggacagcgagggcgtcatgtgcggcgccaacttcaaggtcgacgccttcaccaagatcaactccatgccccgcgtcggcagcgccaccaactgggccgccgcctgggacgacgccgccatctgatcctcgccggcgccggcgttgctctccgtcgtggcctcgtcgggcttgggcttattgcattttacttgtttttctttccttggcaatgtacattctgatctgatctgatctgagccgtgtgtgggcgtgggcgcgctggcacgtacggctgtttgcttgtacgatggaggaataagactttgcttccagtccaaaaaaaa

SEQ ID NO: 25996 - DNA, 1033 bp, Triticum aestivum
  Clone ID: PAT_TA_25996
gccggccggttcggggtgctctactctactctatcttcttgctctgcactgcgccactacctggtcagtcaagagaaggaaagatgcctagcgcggggctggaggcggggtcgaacaaggtggacgtggccatcgacctcgggaacccgctcctcaaccgcaccgtcgacggcttcctcaagatcggcgccgtcggcgcctgcagggtggtcgccgaggacgccttcgactgcatccacaggggggatatctcgaagcgccagcttgaagagacgctgaagaaaatgtgcaaggagggtgcatattggggtgctgttgctggggtgtatgtgggcatggagtatggagtggaaagggcccgtggtgaccgtgactggaaaaatgcgttgatcggaggcattgcaaccggtgccctggtctctgctgtgagcaacaacaaagggaacaagatcgcccaggacgccatcaccggaggtgccatcgcgaccgccgtcgagttcatcaactacctcacctagccgtgaggccatccatattggcagcgacgtttttatcggacaagactcaataagaacttcttgactgaagccaagccatccaccctctgtgttaataattggagccgtttcctccaatgttcttccattttttgttgcctgcctcctcatgtccatgttctgaacaatttatttttcttcgtggtttgcatccttcagttaaaaaaaaccagctatgaggaggaaaagcttggtgcatgtaagcccatgcgtatgtgatactttgggccgccaagttcagttaaacggtcatatttttcatgcgcgaacacgcgtttgaaagagtcgtccccggacacaattctgtcctgtcgtgtttggtcttcatgtgcttatcgtcgggttcacgcctgcttaattttcagctactagctagcttggctgagacaacagaacgttagaaacagcgcatatttgcaagattcgaatgattgatttaaatatgcaagatatgaatgattagacgcttgcatggg

SEQ ID NO: 25997 - DNA, 1140 bp, Triticum aestivum
  unsure (1)..(1140): unsure at all n locations
  Clone ID: PAT_TA_25997
tgcttccgcccacgcgtccgtctcctcctgtcgcctccagagcaacagtcctcctctcctcctgtcgcctccagagcaacagcagctccagctcgagcaagaaacaagtgtagtactagtttgatctgtgaacatgttggccatcttccagaagcaggtggcgcacgcgccgcaggagctcaacagcccgcgcggcagcaccgccaagcccaagaaccccgacgagatcctccgcgacttccacgccgcccacccctccgacgccttctccacctccttcggcggcggcgccgccctcgcctgcgtcgccgcgcagccccgcaacctcgccgccgccggctaccagaggatgttctgcgggctggacgacatctactgcgtcttcatgggcacgctggacaacctgagcgcgctgatgcggcagtacggcctcaccggccgctccaccaacgaggcgctgctggtgatcgaggcctaccgcaccctgcgcgaccggggcccctacccggcggaccaggtggtgaaggacctgtccggctccttcgccttcgtcgtcttcgacaaccgcggcaggtcggggtcgggggcggcggtgttcgcggcgcagagcacggacggcggggtgccgctgcactggggcgtggcggcggacgggtcggtggtgatctgcgacgaccgcggcgtggccaagnccgggtgcgggcggtcgtacgcgccgttcccgcccgggtgcatgttccacagcgagggcgggctcaagagcttcgagcaccccatgaaccgcctcaaggcgctccccagggtggacagcgagggcgtcatgtgcggcgccaacttcaaggtcgacgccttcaccaagatcaactccatgccccgcgtcggcagcgccaccaactgggccgccgcctgggacgacgccgccatctgatcctcgccggcgccggcgttgctctccgtcgtggcctcgtcgggcttgggcttattgcattttacttgtttttctttccttggcaatgtacattctgatctgatctgatctgagccgtgtgtgggcgtgggcgcgctgggcacgtacggctgtttgcttgtacgatggaggaataagactttgcttccagctcgtgccgaattcggcacgag

SEQ ID NO: 25998 - DNA, 314 bp, Triticum aestivum
  Clone ID: PAT_TA_25998
tcgagcggccgcccgggcaggtaccgctgcttcgtcggcggcctcgcctgggccaccgacgaccagtccctccagaacgccttctccaagtacaatacacatcgctggtgcatattttggtatgccgcacaggcttcaagaagccaaggcactagtattgtagacaagaagagcaccacccaacagaattccagaaagagtgactgcccagagaaacagccctgtctttcctccaacataaacgtcaccacttggagaccattcttctggtgtatatatcgggctgtacccaacctgcccgggcggccgctcga

SEQ ID NO: 25999 - DNA, 1051 bp, Triticum aestivum
  Clone ID: PAT_TA_25999
acaaagcaagtaactgcaggtagatgaatccttcaactgttcttcagaaacagagcaactactctctcaaaaagaaaaaagaaaactcaaaagatatactggcatacagcttgctcgtacatgcatctatgtttgtttcgtttacaataacaatttctagtgcctcacttcaaacttcgaacttcaagagagtgaaagaagagagacaaaaaaggaagaggagaacacataactgaaagggcagtgatattaatctaggtaccatcaccaggaccccaagctgagataacgaaataaaaagatggtatacccaactaggcactcagagcaggctccagcggctctgcaataccacccccgctgttgagaactaccaccttaccatccgaatccacatcaacaatagcagaatcaccttccttgacctcgccagccagcatcttttccgccagactgtcttccaaaagcctcataatggcgcgtcgcagaggcctggcaccgtagctcgggttgtaaccttcatccacaaccctatcccggaacttctccgttacctggaggtcgatttcctttgccttgagcctgtcaaacacctccttgagcataatatcagcaatctctttcacctccagttttgtcagctgccggaacacaatcatctcatccaatctgttcaagaactcaggccggaaatactgcttcaactcctcggtcaccaagctcttgatcctgttataactggtatctttctcatcagagtcaaggtcaaacccaatcttccggcctcccttctcgatgacactgcttccgacattcgatgtcatgatcaacagtgtgttcttgaaatcaactgtccgtcccttgctatctgtcagcctcccatcttctaagatctgaagcatcatgttgaagacatctggatgtgccttttcaatctcatcaaagagaacaactgtgtatggacggcggcggactgcttctgttagttgacctccttcagtgtagccaacataacctggaggtgatccgatgagtttggacactgtatgtc

SEQ ID NO: 26000 - DNA, 2067 bp, Triticum aestivum
  Clone ID: PAT_TA_26000
aagggagaaatatcacacagctatacatatctatgctttctacatattgtatcattaaaaccttaagatacaaccaagataaccgtaaataaggtacaacaacctcaacaactttcaagaataaacacaagagtccaaaaatgacatatatacatatattttgactgtcaaatgtatgctagcacacgagcaacgtatgcatgtgcatattacaacaatcctaacctcttcccgcaatccacgcttccatcaagcacctcctctgctccatacttatacttgaatcccagctccacaagtttgtttgtgttagcctgcactctcaatccctctcccaccatctttgatccgctcgagttcggggtgcatgcgggcgtagtgctccaagatgtcatgcatgttggtgtgcgcggtggtgcaaaggtatcggccaccaacaacatcagacgacttctccatgcagaagacgtgtgcctcgcagacgtcatcgacatgcaccagtggtacggagccgaggagggcctgtaggaacttgagggagttgtgatagatctcgatgccggttagaggcgacaacatgacatggaggctatcactgatgtacggcaggatggtgtctcctcctacgaggccgcataccaagacaacaacgtcgaacgctctaccctcgaagaagtcatcgttgtacttgagtaattcctcctcagagatggtcttcgaggatacataagcgtccatgtattcgttgctgtggtcgcaggacaggccgagtggggtccagcaggattcgttcacgaactctttgtacccgtcgccgtcctcccggagcggcgaggctgtgacaacggagcccgtgtggatgacacgcttcaccgtcttggaccgctcgcactgctgcaggatggtgcgcgtcgcgtccaatgtcgcttcggtggtgtccttgtacttggagctgccggagttgtgctgcagcggggtggcgacgaggaagacgaactcgcagccttggatggccggctcgaatgaggcagcgtcatagatgtccgcctcgaacagcaccagccgctccgccgcgccggggagccccctcagcagctccgtcttcttctcatccccgaggtttcgtacggtcccatggacggtgcagcctctgtcgaggagcttcttgacgagccaggacgcgatgtagcctgcagctccggtgacgcacaccctgctcatcttctccggccggactctctttcctatcccctgacgcccagtgatcctgtgtctatatatatatagtacgtgtgccgtgctgcaccctaagcctcagtgctattacaacagatcaaatggactcagttcaagcgaaaaaacatgcggagcggttctacaaaccgtgaggattttgtacagacagtgccccgacggaaccacaggatcaacaagaatggacgacggacgaacggtctcgccgccgccgatttattttcttttccccggaagaattcggccttttcaggtccttcataccttcagcgccagcttcttggcagcgagggcctccgcctcgagggtcggctcccacaggatcgtggtctcggccagcagcgccgtcacggtgtacgggtccatgttcgacgccgggcgacggtcctccaggtatcctttgccctttgcctcggtttctcgccccacacgaatagagcagccacggttcgcgacgccccatgagaagtctgatatgctagctgtctcatgtagccctgtcagcctccgttcgtttccttcaccatatgcggctatgtgcaagtcatggcgaagtgaaaggttcaggattgccttcttgatcacgtcgaaacctccatcctcgcgcatgctcaatgtgctgtaatttgtgtggcagccagctccattccagtcaccctggattggttttgggtcaagggtgagcaccacaccagcttgctccgtgattctctcgagaatgtatcttgaagcccatatgtggtctcccgcatcaataccaacgctaggtccaacctggtactcccactgaccaggcatgaccggacgcgtggg

SEQ ID NO: 26001 - DNA, 568 bp, Triticum aestivum
  Clone ID: PAT_TA_26001
gttttttttttaacattaataattaattgtcggtattattgactgcggcctgcggggtactgatatttacatccaattacatatgtcgttgcggttgtaacccgtacaagtacacatcgtttgattcatattttggtttgccgcacaggcttcaagaagccaaggcactagtattgtagacaagcagagcaccgcccagcagaattccagcaagagtgattgcccagagaaacagccctgtctttcctccaacataaacgtcaccacttggggaccattcttctggtgtatatattgggctgtaccctgacgcctatgtccgcatcatcggattcgacaacatgcgtcaggtgcagtgcgtcagcttcatcgccttcaagccaccgggctgcgaggagtccggcaaggcctaaacagctcactcacgacaggccaaatataaagtgccattgcagttttgtcaactctgacattgctttgggttttccttctccatttatctttcttatttgttcctaagaatatgtgtatgtccatgttcatgtacctgcccgggcggccgctcgaa

SEQ ID NO: 26002 - DNA, 1255 bp, Triticum aestivum
  Clone ID: PAT_TA_26002
ttttttttttttagtttctaaaatatatatatttttatcacatataatacataattaaataattaaatcgccgacctagacttattcaccgagacggagatagtacaaagcaagtaactgcaggtagatgaagccttcgactgttcttcagaaacagagcaactactctctcaaaaagaaaagaaaaaactcaaaagatatactggcatacagcttgctcgtacatgcatctatgtttgtttcgtttacataacaatttctagtgcctcgcttcaaacttcgaacttcaagagagtgaaagaagagagagacaaaaaaagaagaggagaacacataactgaaagggcagtgatattaatctaggtaccatcaccaggacaccaagctgagataacgaaataagaagatggtgtacccaactaggcactcagagcaggctccagcggctctgcaataccacccccgctgttgagaactaccaccttaccatccgaatccacatcaacaatagcagaatcaccttccttgacctcgccagccagcatcttttccgccaggctgtcttccaaaagcctcataatggcacgtcgcagaggcctggcaccgtagctcgggttgtaaccttcatcgacaaccctatcccggaacttctctgttacctggaggtcgatttcctttgccttgagcctgtcaaacacctccttgagcataatatcagcgatttctttcacctccagctttgtcagctgccggaacacaatcatctcatccaatctgttcaagaactctggccggaaatactgcttcaactcctcggtcaccaagctcttgatcctgttatagctggtatctttctcgtcagagtcaaggtcaaacccaatcttccggcctcccttctcgatgacactgcttccgacattcgatgtcatgatcagcagagtgttcttgaagtcaactgtccgtcccttgctatctgtcagcctcccatcttctaagatctgaagcatcatgttgaagacatctggatgtgccttttcaatctcatcaaagagaacaactgtgtatggacggcggcggactgcttctgttagttgacctccctcggtgtagccaacataacctggaggtgatccgatgagtttggacaccgtatgtctctccataaactcactcatatctaatctgatcatggcttcctctgagccaaagtagtaggatgccagagcctttgctaattctgatttaccaacaccag

SEQ ID NO: 26003 - DNA, 1590 bp, Triticum aestivum
  Clone ID: PAT_TA_26003
acgcaacatttttctctcgcccggtcgccccacccgctgttccaccagttactactactgacagacgcagccagcgcgggttccacaatccgatccccctcacaaccgcattttttttagcggcagcggaatttaactcgcctctcccgccgccgcccgtccgcagcccaatggacctccccgtggtggatctcgcgcccttcctgcaggccgccgccggcgacgccgcgccggccgaggcggaggaagcgctgcgcgcgctctgcgccacggtgagcgccagcctgcgggacacgggggcgctgctggtcaaggacccccgctgcaccgccgccgacaacgaccgcttcctcgacgtcgtcgagcgctacttcgcccgatccgacgactccaagcgcctccaggagcgcccccacctccactaccaggtcggcgtgacacctgaaggcgtggaggtgcctcgcagcctcgtcgacaaggagatgcaagacaggatcaagagtatgccagaggagtttcaaccagccacccctaagggaccagacccgaaatggcgctacatgtggagagtgggtcctcgcccgtcgaatacccgctttaaggagctgaacgcagaacctgttattcctgatggattaccggagtggaaagagacaatggattcctggggtgcaaaaatgatttctgcaattgaggttgttgctgagatggcagcaattggatttggcttgtcaaaggatgcatttacctctttgatgaaggagggaccgcacctcctagcaccaaccggaagtaatctgatgcgtcacggttctgagggcactgtgtttgctgggttccattatgatcttaatttcttgaccattcatggtcgtagtagatttccaggcctgaacatttggttaagtaatggtaaaaagatggaggtgaaggtccctgttggctgtcttctcattcagtcagggaaacagttggaatggcttactggtggcgaatgtttagctggaatgcatgaggtagtggtgaccaagagaacattagaggcaatagaactagctaaagagcagaaccgaagcttgtggaggatctcatcgacgctattctcgcacattgcttccgatgcgacactcaagccattgggccactttgctgaagcacccaatgctcatagttatccgcctatatgtgccggggagtatgttgagcaagagctctcggcgatcaatctgaaagggaaggttgcactctaggcgtacacagaccgccgattaatctggtgactcgttaatccgccttctgtggtcagaacgcgaattgcgataatccaagctgatacttgtatcttcattcaactttgttgacataccgaggttgcgccggtctatttccgacacaaccctatctatgtccatgctaagtatatgtccatttgatccccctgttaagttatagtggatgctcatgctctggtgtactgaactgatagcacctgtgaaaattaaataatagtggtactgttattctcgaaccgaagttgtacttgaactgatatcagggttgctgtctacgaaaatcatccttgcaaaaaaa

SEQ ID NO: 26004 - DNA, 584 bp, Triticum aestivum
  Clone ID: PAT_TA_26004
ctcgtgccgcgttcccgttctcctctccccctgtcgcctccatagcagcagcagctccagctcgagcaagaaagaactagtttgatctgtgaaaatgttggccatcttccagaagcaggtggcgcacgcgccgcaggagctcaacagcccgcgcggcagcaccgccaagcccaagaaccccgacgagatcctccgcgacttccacgccgcccacccctccgacgccttctccacctccttcggcgggcgggcgccgccctcgcctgcggtcgccgcgcagccccgcaacctccgccgccggcggggtaccaagaggatgttctgcgggctggacgacatctactgcgtcttcatgggggacgctggacaaccttgagcgcgctgatgcggcagtacgggctcaacgggccgctccaacaaacgaagcgctgctggtgatcaaggcctaacgcaacctgcgcgaacgggggccctaacctgctgacaagttggtgaaggacctgtcgggctccttcgcctcgtctctcacaacgcggcggtcggtccgggcggcgtttccgggcaaacacgacgcgcgtgcgctg

SEQ ID NO: 26005 - DNA, 1061 bp, Triticum aestivum
  Clone ID: PAT_TA_26005
cggacgcgtgggcccgtcctcctctcctcctgtcgcctccagagcaacagtcctccagctcgagcaagaaacaagtgtagtactagtttgatctgtgaacatgttggccatcttccagaagcaggtggcgcacgcgccgcaggagctcaacagcccgcgcggcagcaccgccaagcccaagaaccccgacgagatcctccgcgacttccacgccgcccacccctccgacgccttctccgccggctaccagaggatgttctgcgggctggacgacatctactgcgtcttcatgggcacgctggacaacctgagcgcgctgatgcggcagtacggcctcaccggccgctccaccaacgaggcgctgctggtgatcgaggcctaccgcaccctgcgcgaccggggcccctacccggcggaccaggtggtgaaggacctgtccggctccttcgccttcgtcgtcttcgacaaccgcggcaggtcggggtcgggggcggcggtgttcgcggcgcagagcacggacggcggggtgccgctgcactggggcgtggcggcggacgggtcggtggtgatctgcgacgaccgcggcgtggccaaggccgggtgcgggcggtcgtacgcgccgttcccgcccgggtgcatgttccacagcgagggcgggctcaagagcttcgagcaccccatgaaccggctcaaggcgttcccgcgcgtggacagcgagggcgtcatgtgcggcgccaacttcaaggtcgacgcattcaccaagatcaactccatgccccgcgtcggcagcgccaccaactgggccgccacctgggacgacgccgccatctagctgggctgggtgtgcatcacctcgccggcgccgctcgcctagctcgtcggacttctgaatttggggcttaccgcattttacttactttttttctttggcaatgtacattctgatctgatctgatctgatctgatctgagccgtgtgtgggcgtgggcgcgctgacacgtacggttgtttgcttgtacgatggaggaataagactttgcttccaagtccaaaaaaaaaaa

SEQ ID NO: 26006 - DNA, 620 bp, Triticum aestivum
  Clone ID: PAT_TA_26006
tcgagcggccgcccgggcaggtacaggaaaacaccgagcagagccagaccagttcctgcaggcaaggtaagaatatatttcagagaaacaaatcggaaagtgaattgttagaacttgctggctaaataggattggttagtcatgaagttaccaagggcatttataggtgaaattggagttctgaagaagataacggatgacacgatgacaacaacccgtttgacagagtttgcaacagaatgggtcacaggtgatattctggccaataaactatatgaaacctgcctcggaaacaaacagacccatcaacatttgctccatacttgtcggcaaactggtagacacccttccccttggctacccttccagacgcatcgacgccttccttgaactccactccaccaccaggcccgtagggttgggcagtctggaccttcttcgccttcttgctggctactatgagcagcgatggcctcgccgatggtcgcaaacctcggagtttcgctcgttctaacagtggagagggagatggcttcgtcagaaccatagacgccatgacagaggcagacatgtttgtgctcactggatcaccctcttttacctcggccgcgaccacgcta

SEQ ID NO: 26007 - DNA, 741 bp, Triticum aestivum
  Clone ID: PAT_TA_26007
ccccgcgtccgctgtatctgtgtgccagcgtgctagacgagagagagagagagacggagagacatcggccgagcaaggttccggaaggatgcctcgcgcggggttgtcggcggggtcgagcaaggtggacgtggccatcgacctcgggaacccgctcctcaaccgcaccgtcgacggcttcctcaagatcggcgccgtcggcgccttcagggtggccgccgaggacgccttcgactgcctccaaagtgggagtgtctccgaagcgcaagcttgagaagacactggaaaaaatgtgcaaggagggcgcatattggggtgctgttgctggagtgtatgtaggcatggagtatggagtggaaagggtccgcggagagtatgactggaaaaatgcattgattggaggcattgcaagtggcgccctgatctctgctgctagcaacaacaaagggaacaagatcgccaaggatgccatcaccggaggtgccatcgcgaccgccatcgagttcatcaactacctcacctagctgtgtgaccatatgcatgtcaatgttttttttatcagcaagacgaataagaacttcttgactgaagccatccttcccctctgtgctaataattggagccgtttcctccaatgttcttccctttttggttgccccattctcatgtccatgttgtgaacaatttattttcctgtgaagatatcctttgtgctggcctaaaaaaaaaaaaaaaaaaaaa

SEQ ID NO: 26008 - DNA, 847 bp, Triticum aestivum
  unsure (1)..(847): unsure at all n locations
  Clone ID: PAT_TA_26008
atgtgctgcaaggcgattaagttgggtaacgcagggttttcccagtcacgacgttgtaaaacgcggccagtgaattgtaatacgactcactatagggcgaattgggtaccgggccccccctcgagttttttttttttttttttagtaattaattgtcggtattattgactgcggcctgcgggtactgatatttacatccagttacatatgtcgttgcggttgtaacccgtacagtacacatcgtttgattcatattttggtttgccgcacaggcttcaagaagccaaggcactagtattgtagacaagcagagcaccgcccagcaagaattccaagcaagagtgattgcccagagaaacaagccctgtctttcctccaacataaacgtcaccacttggggaccattcttctgggtgtatatattggggctgtacccatcaacatttgctccaatacttgtcgggaaaactgggtagacacccttccccttgggctaccccttccaagacgcatcgacgcccttcctttgaactccactccaacaacaaggcccgtaggggttgggcagtctggaccttcttcgccttcttgctggctactatgaacagcgatggctcgccgatggcccaaactcggagttcgctcgtctaacatggagaaggagatggctcgcagaacatagacgcatgacagaggaagcatgttgtgctcacggggggccggtaccaattcgccaaagtgagtcnataccgcgctcatggcgtctttaaantctncngaaaacctgcgtaccacttanccctgaganancccttccactggatacaaaggccgacgttncttcaat

SEQ ID NO: 26009 - DNA, 657 bp, Triticum aestivum
  Clone ID: PAT_TA_26009
taaccctactaaagggaacaaaagctggagctccaccgcggtggcggccgctctagaactagtggatcccccgggctgcaggaattcggcaccaggggacatcggccgagaaggttccggaaggatgcctcgcgcggggttgtcggcggggtcgagcaaggtggacgtggccatcgacctcgggaacccgctcctcaaccgcaccgtcgacggcttcctcaagatcggcgccgtcggcgcctgcagggtggccgccgaggacgccttcgactgcctccaaagtgggagtgtctcgaagcacaagcttgagaagacactggaaaaaatgtgcaaggagggcgcatattggggtgctgttgctggagtgtatgtaggcatggagtatggagtggaaagggtccgcggagagtatgactggaaaaatgcgttgattggaggcatcgcaagcggcgccctgatctctgctgctagcaacaacaaagggaacaagatcgccaaggatgccatcaccggaggtgccatcgcaaccgccatcgagttcatcaactacctcacctagctgtgtgaccatatgcatggcaatgtttttttttttatcagcaagacgaataagaacttcttgactgaagccgaccccccccccccccacttgatctc

SEQ ID NO: 26010 - DNA, 2146 bp, Triticum aestivum
  unsure (1)..(2146): unsure at all n locations
  Clone ID: PAT_TA_26010
aaaaaaaaaaacagaactcaaaaaatatactggcatacagcttgctcgtacatgcatctatgtttgtttcgtttacataacaatttctagtgcctcgcttcaaacttcgaacttcaagagagtgaaagaggagagacaaaaaaggaagagaacacataactgaaagggcagtgatattaatctaggtaccatcaccaggaccccatgctgagataacgaaataaaaagatggtgtacccaactaggcactcagagcaggctccagcggctctgcaataccacccccgctgttgagaactaccaccttaccatccgaatccacatcaacaatagcagaatcaccttccttgacctcgccagccagcatcttttcagccagactgtcttccaaaagcctcataatggcgcgtcgcagaggcctggcaccgtagctcgggttgtaaccttcatcaacaaccctatcccggaacttctctgttacctggaggtcgatttcctttgccttgagcctatcaaacacctccttgagcataatatcagcgatctctttcacctccaactttgtcaactgccggaacacaatcatctcatccaatctgttcaagaactcaggccggaaatactgcttcaactcctcggtcaccaagctcttgatcctgttatagctggtatctttctcgtcagagtcaaggtcaaacccaatcttccggcctcccttctcgatgacactgcttccgacattcgatgtcatgatcaacagtgtgttcttgaaatcaactgtccgtcccttgctatctgtcagcctcccatcttctaagatctgaagcatcatgttgaagacatctggatgtgccttttcaatctcatcaaagagaacaactgtgtatggacggcggcggactgcttctgttagttgacctccctcagtgtagccaacataacctggaggtgatccgatgagtttggagaccgtatgtctctccataaactcactcatatctaatctgatcatggcttcctctgagccaaagtagtaggatgccagagcctttgctaattctgatttaccaacaccagttggtccagagaatatgaagctagcaatgggccgatttggattcttgaggccaacacgagcacggcggatagcacggctaatagctttgacagcttcatcctgcccaatgatacgtgtatggagagtctcttccatcttaaggaggcggtcagattcatcagatgagactttctccacaggtataccagtccatgatgagacgatgtgttgaatatctgcctctgtgacaagaggaccaacttcaccggattcagtctctgctttaaccatttccttgctcttgtcaataatggctgtaatttgggccttcaactccatttcctcgtctcttaattccccagccttctcaaaatcttggccacgcacagcctcattcttgtcctttgttatttggcgaagttttttgtccagctccttggcctcatcaggtagctgtgcatgcctgagcctaacacgggaccccgcttcatcaatcaagtcaatagccttgtcaggcaggaagcggtcactgatatactgatatgataactgcgccgcggcaacaagagcatcatctgtatattgcagcttatgatgaagttcatatctctcacgaagtcctcttaagatttgtattgattcttcaacagtcggttctggtaccttgactggttgaaaccttcgctccaaagcaggatctttctcgatatgtttcctgtactcatcgagtgttgtggcaccaatgcactgcaattcacctcttgcaagagcaggtttcaagatgttagcagcatcgattgcaccttcagctgcaccagctccgatcaacgtgtgcacttcatcaatgaagagtataatatcatcactttgcttaatttcctccataagcttcttcagcctttcttcaaactctccacggtacttggtaccagcaacaaggagccccatgtcaagggtaataaccttctttccttcaattgtttccggaacatcaccattacaaatacgttgtgcaagcccctctgcaatagcagtcttgccaacaccaggctctccaattaagcacggggttgttactttgtnccgcct

SEQ ID NO: 26011 - DNA, 1098 bp, Triticum aestivum
  Clone ID: PAT_TA_26011
gttcccgttctcctctccccctgtcgcctccatagcagcagcagctccagctcgagcaagaaagaactagtttgatctgtgaaaatgttggccatcttccagaagcaggtggcgcacgcgccgcaggagctcaacagcccgcgcggcagcaccgccaagcccaagaaccccgacgagatcctccgcgacttccacgccgcccacccctccgacgccttctccacctccttcggcggcggcgccgccctcgcctgcgtcgccgcgcagccccgcaacctcgccgccggcgggtaccagaggatgttctgcgggctggacgacatctactgcgtcttcatggggacgctggacaacctgagcgcgctgatgcggcagtacggcctcacgggccgctccaccaacgaggcgctgctggtgatcgaggcctaccgcaccctgcgcgaccggggcccctaccctgctgaccaggtggtgaaggacctgtcgggctccttcgccttcgtcgtcttcgacaaccgcggccggtccggctccggggcggccgtgttcgcggcgcagagcacggacggcggcgtgccgctgcactggggcgtggcggcggacgggtcggtggtgatctgcgacgaccgcgccgtggccaaggccgggtgcgggcggtcctacgcgccgttcccgcccgggtgcatgttccacagcgagggcgggctcaagagcttcgagcaccccatgaaccggctcaaggcgctcccgcgggtggacagcgagggcgtcatgtgcggcgccaacttcaaggtcgacgccttcaccaagatcaactccatgccccgcgtcggtagcgccaccaactgggccgccacctgggacgaagccgccatctgatatagccatcgtcgctccccggcgccggcgacgctcgcctagctcgtcggacttctggatttgggcttactgcattttacttatttttttctttggcaatgtacattctgaatctgatctgatctgagccgtgtgtgggcgtgggcacgctgacacgtacggttgtttgcttgtacgatggaggaataagactttgcttccagtccaaaaaaaaaaaaa

SEQ ID NO: 26012 - DNA, 1779 bp, Triticum aestivum
  Clone ID: PAT_TA_26012
tttttttttttttttttttgaaagcagcacaaagaaaaatcctttgtgtgattcattatccttataataacgtagttctccgaatggactcaggtacagggattgtacagacccaacagatcaaatggactcagttcaagcgaaaaaacatgcggagcggttctacaaaccgtgaagattttgtacagacagtgccccgacggaaccacaggatcaacaagaatggacgacggacgaacagcctcgccaccgccgatttattttcttttccccagaagaattcggccttttcaggtccttcataccttcagcgccagcttcttggcagcgagggcctccgcctcgagggtcggctcccacaggatcgtggtctcggccagcagcgccgtcacggtgtacgggtccatgttcgacgccgggcgacggtcctccaggtatcctttgccctttgcctcggtctctcggcccacacgaatagagcagccacggttcgcaacaccccatgagaagtctgaaatgctagctgtctcgtgtagccctgtcaacctccgctcgtttccttcaccatatgcggctatgtgcaagtcatggcgaagtgaaaggttcaggattgccttcttgatcacgtcgaaacctccatcttcgcgcatgctcagtgtactgtaattttgtgtggcagccagctccattccagtcaccctggattggttttgggtcaagggtgagcaccacaccagcttgctccgtgattctctcgagaatgtatcttgaagcccatatgtggtctcccgcatcaataccaacgctaggtccaacctggtactcccactgaccaggcatgacctccccgtttgttccactgatttcaattcccgcgtaaaggcatgcccttgtagtgagcatcggatatgtcacggccaaatgacttgtctgatcctacggcgcagtagtatggacccctgggggccagggtaccctccaacaggccagccaagaggccagttcacatccctctgcatcagagtgtactcctgttcgattccaaaccatggcacttgtgaagtgaccttggggtcactgaagatttgtgcagccatgtgtcgtttgttagtagggatgggttccccttgtggtgtgtaggtgtcacagataaccagtatgttgttgcctcctcggaatgggtccttgaatatggcctgtgggtataggatgacttcactgtcttctccaggagcttgccctgtgctcgatccgtcgtagttccatttcggtagctctgaggggtcctccactggcttcgaaatcgtccttgatttgcttctgaggtcaattccagatcctccaacccagatgtactcggcgatgatcttgtcggtgaagggcgtggtgtccatgtcgagcagctgctgcatcctctggatgacgccggtggtctccgggccgagggccagcaccttgaacccggaggtggcgcgggcggtcctcctcacgccccacaccctgcccgcgggctgcctcgccgggacggcagacctgccccgcacgcccacctggcactgcatcgccggcaccaccgcctgcgccatcgccgctacttacttacttactccgccgccgccttccccttcagcgctagcagagagacggacaagcacgcggacgagacgagggaggagaggagggagggaaggggggcggaacgaccttgcgagatcgcgctggaaatattatttatggaagcggaggccggtggtataagtaatttagattgcgggggag

SEQ ID NO: 26013 - DNA, 623 bp, Triticum aestivum
  Clone ID: PAT_TA_26013
ctcgagtttttttttttttttttttagtaattaattatcggtattattgactgcgggtactgatatttacatccagttacatatgtcgttacttttgtaacccgtacaatacacatcgtttggtgcatattttggtttgccgcacaggcttcaagaagccaatgcactagtattgtagacaagaagagcaccgcccagcagaattccagcaagagtcactgcccagagaaacagccctgtctttcctccaacataaacgtcaccacttggagaccattcttctggtgtatatatcgggctgtacccatcaacgtttgctccatacttgtcggcaaactggtaaacacccttccccttggctacccttccggacgcatcaacgccttccttgaacaccactccaccaccaggcccatagggctgggcagtctggacctttttcgccttcttgctggctactatgagcagcgatggcctcgccgatggtcgcgcgcctcgaagcttcgctcgttctaacagtggagagggagatggtttcagaaccaaagacgccatgacagaggcagacatgttaaacgcttgctcactggctcactctcacacctgcccgggcggccgctcga

SEQ ID NO: 26014 - DNA, 1523 bp, Triticum aestivum
  unsure (1)..(1523): unsure at all n locations
  Clone ID: PAT_TA_26014
ctcgagtttttttttttttttttttttttttttttttttttttttttttggaaaaaactgtatttttttgtcaaccaagacactcaaatacgttatgtccgggcaaatttacttgtattgggacatctaaggagcccgtggnaaaaataaataaataaacaaaatcggtccaaacaatgcctgaacaatgaactttctcacaaacccccatttttttctgccgagacctactcaaaggtccatacaccaccgaatttgacaccgacatcacgcactcgatcatgttccatgccaaaaaaattgatatttttttgaattgactgttaattcttgggagaagatgagctcaggagccgaatcgctgcgtagagatgccctagtaacttaggtgatagcaccatgttctttatcttcatctttacttgcagaattaaactctgtgaacattcaagtgccattgtagaacttgatgacatttgcgagagagctcatgcgcttgcactgaaaacttaatcatgcttgcaccatgctgcttacaggagaacattagtaattaattgtcggtattattgactgcgggtactggtatttacattcagttacatatgtcgttacggttgtaacccgtacaatacacatcgctggtgcatattttggtatgccgcacaggcttcaagaagccaaggcactagtattgtagacaagaagagcaccacccaacagaattccagaaagagtgactgcccagagaaacagccctgtctttcctccaacataaacgtcaccacttggagaccattcttctggtgtatatatcgggctgtacccatcaacgtttgctccatacttgtcggcaaactggtaaacacccttccccttggccgcccttccggacgcatcgacgccttccttgaacaccactccaccaccaggcccgtagggttgggcagtctggaccttcttcgccttcttgctggctactatgagcagcgatggcctcgccgatggtcgcacaccccggagcttcgctcgtcctaacagtggagagggagatggtttcagcagaaccaaagacgccatgacagaggcagacatgtttgtgctcactcactaggctcactctcgtgccgaattcggcacgagcttctccttgaaatctttttgggttcacagatttggaggatgtcttgcaactgtggatccggttgcagctgcggctcaaactgcaagtgcgggaagatgtaccctgatctgacggagcaaggcaagngccgncgcccaagtcggccgacgngggacgtcctcggcgtggcgccttgaaaacaaaggcggggcaagttcganggtggggccgccgggccaattccggccgaaggggcttggaantttggngggggaacaaactgggnaaggnggccaaacccccntggcaaaactgggttnaaagcttggcattgccccctttggtaacccnaaaccnttnttnntttnggnnnnttnaaanaaaattnttaacccggggg

SEQ ID NO: 26015 - DNA, 1537 bp, Triticum aestivum
  Clone ID: PAT_TA_26015
ggcagttactactactgacagacgcagccagcgcgggttccacaatccgatccccctcacagccgcattttttttagcggcagcggaatttaactcgcctctcccgccgccgcccgccgcgcagcccaatggacctccccgtggtggatctcgcgcccttcctgcaggccgccgccggcgacgcggcgccggccgaggcggaggaagcgctgcgcgcgctctgcgccacggtgagcgccagcctgcgggacacgggggcgctgctggtcaaggacccccgctgcaccgccgccgacaacgaccgcttcctcgacgtcgtcgagcgctacttcgcccgatccgacgactccaagcgcctccaggagcgcccccacctccactaccaggtcggcgtgacgcctgaaggggtggaggtacctcgcagcctcgtcgacaaggagatgcaagacaggatcaagagtatgccagaggagtttcaaccagccacccctaagggaccagaccctaagtggcgctacatgtggagagtgggccctcgcccgtcgaatacccgctttaaggagctgaacgcagaacctgttattcctgatggcttacctgagtggaaagagaccatggattcctggggtgcaaaaatgatttctgcaattgaggttgttgctgagatggcggcgattggatttggcttgtcaaaggatgcatttacctctttgatgaaggagggaccgcacctcctagcaccaacgggaagtaatctgctgcgtcatggttctgagggcactgtgtttgctgggttccattatgatcttaatttcttgaccatacatggccgtagtagatttccaggcctgaacatttggttaagaaatggtaaaaagatggaggtgaaggttcctgttggctgtcttctcattcagtcagggaaacagttggaatggcttactggtggtgaatgtttagctggaatgcatgaggtagtggtgaccaagagaacattagaggcaatagaactagctaaagagcagaaccgaagcttgtggaggatctcatcaacgctattctcgcacattgcttccgatgcgacgcttaagccattgggccactttgctgaagcacccaatgctcatagttatccgcctatatgtgccggggagtatgtggaacaagagctctcggcgatcaatctgaaagggaaggttgcactttaggcgtacccatcaacatttgctccatacttgtcggcaaactggtagacacccttccccttggctacccttccagacgcatcgacgccttccttgaactccactccaccaccaggcccgtagggttgggcagtctggaccttcttcgccttcttgctggctactatgagcagcgatggcctcgccgatggtcgcaaacctcggagtttcgctcgttctaacagtggagagggagatggcttcgtcagaaccatagacgccatgacagaggcagacatgtttgtgctcactggatcaccctcttttagttcgattttcccgacccggccggc

SEQ ID NO: 26016 - DNA, 387 bp, Triticum aestivum
  Clone ID: PAT_TA_26016
gggggaccgcaacgccgcgaggacggcggagcaggcagagcacatcaggagaaccgggaggatgccgccctcgctgggctgctggaactggtgctcgtagtcgtagacctggaaaaaccagcatgcgttgctcctgtcaactagggaatggaatggatctggcaccgtagaatcttctttcttctcttttgattggttcagtagatatgtggcacgagaacagaccgcctgtaagttgtaactatgtgtatgtaagttgcgagctttcttgcctagtctcatgtttcttgcattcttcagtgatgctgagatttctgttcagatccgtatgtacattacagacagtgatttgcttccaaaaaataataaatgatgtatgttttcaaa

SEQ ID NO: 26017 - DNA, 402 bp, Triticum aestivum
  Clone ID: PAT_TA_26017
atgcagagtacagtagatgagaatttcattattgaagaaacatggccttgatttttgtcaaaattccagatttgtatgcaaagcagatgaaaattacaaaccatgcgcgtatacttgcatcagaaatgatgacaagaatgagcgagcgtccggcgagttctttgtgtcgcgtatacttacaccacaaatgtatgtgctttcctcgtccatcatcttggcagtggcacggcgacgttccagtcgtacaccgtgacgtcaaggccggccgcggagtcccgaagcgcgcgccggaggtcgacggcgtggcctgggctcctggcgagcaggagggcgaacccgccgccgccggcacccacgagcttgtagccgcagcagggggggtcgggcgggcgcgaacagctc

SEQ ID NO: 26018 - DNA, 219 bp, Triticum aestivum
  unsure (1)..(219): unsure at all n locations
  Clone ID: PAT_TA_26018
nnnttgcatgtattaatgaagtagtccacgttaggtggattggctcaaaatggagaagcatgattgtattaagcatttaagctctaagcaatttagaatgtcaatgtcttggggctcccttgcaatatttcagagaactatattttttcagacattttatattgcctcacgatgtttgggggatctgattaggtattgtttctctataaaaaaaaaaaa

SEQ ID NO: 26019 - DNA, 1750 bp, Triticum aestivum
  unsure (1)..(1750): unsure at all n locations
  Clone ID: PAT_TA_26019
gtttctctctgtcaagctctctctcttctctcccccangggcattcagatngccgtgactcagccgccatgggcgccacaaagcctgctcccgccgcgagactcctgtgatccctatccccccccccccccccccccgccccccccccccgcccccccccgcgggccgacggggacatgcctcccacgccgccgccggagacggacgccgagccggagttcgccgaggtcgaccccaccggccgctacggacggtacacggaggttctcggcaagggcgcgttcaagacggtctacaaggcttttgatcaactggaagggctagaagttgcctggaaccaaatcaaagtgggtgatatattacggaacaatgatgatttggagaggctgagatcagaagtgcggttgcttaagacgctcaagcacaagaacataatcaagttctacaattcatggctcgacaaggaaaaaacaacaacataaacttcatcacagaagtcttcacatcaaggaacattgcgccagtaccgtattaagcacaagaaggtagacattagagctttgaagaaatggtcaaggcaaatcttgagtggtctagtgtacctccacggccatgatccaccaataatccatagagatttgaaatgtgataacatatttgtgaatggaaaccagggtgaagtaaagattggagacctgggattagcaaccatcctagacaatgcacgctcagctcatagcatcattggtaaccgattcagcacaccggaattcatggcgccagaactctatgatgaagaatacaatgagcttgtagacatttatgcatttgggatgtgtttactggagcttgttacatttgagtacccatattgtgaatgctccaatgcagcacagatatacaaggtgaaaggcctggttcactggctaagattgaggatcctgaagttaaattctttatagagaaatgcatagcccaagcttcccaaaggctctcagcagaagaactattagtggatccttttctcctagatgttgatgatgaaagaatcttctatccagtacagtcaaatacgaatgcatcagatgctggtggcagttcgaacccaagtgcgaattacagaacagcatcatctgttggctcccggggacgaacaggtagcacgggtgaatcacatccaagtgatagctacatacatggcaataggaatcgacaagctgcgactagtcgaatgattacagttgagagtcagcggaaggacctaaatacaatatttctgaaactgcggattgccgattcaacaggtcatgcccaaaacatccattttccatttgacattgaagctgacacttcaattagtgttgctactgaaatggttgtacaacttgatcttacggaccaagatgttactgcgattgcagaaatgatagatgctgaaatacaggcacatatccctgaatgggcgtttgatgaatcagttgacaaccaaggggatgaaggagctcattctgagactgatgattcagaatccgataacgatgagacttctgggcttcgtaatgaggttgacgcaacaaacaatggttttacacaggagcagcttccttctggccggaaatactggtcagactcacccagaagagatattgagatctctcagtcggtggaggaccaacagatctatgataatatgccaaatgggattttgaaaaatgataatgtaggaggtatttgtgagcgaatatcatca

SEQ ID NO: 26020 - DNA, 718 bp, Triticum aestivum
  Clone ID: PAT_TA_26020
tgtacaagcatatccactcgaagcatcacactctggtggtcccatacgcgtttggcgctctttacaaccatcccctcgagggcctcattttggacacgattggtggcgccctctcgttcctcgtcgccggaatgactcctaggacgtccatattcttcttctcattcgcaaccatcaagaccgtcgacgatcactgcggcctgtggcttcctgggaatatcctccacatgctgttcagcaacaacagcgcttaccatgacatccaccaccagctctacggcaacaagtacaacttctcgcagccgttcttcgtcatgtgggacaagatccttgggacctacatgccatacactctggaggaacgcaagggaggaggtttggaggcgcgccctgttaatcttggcctcgcagcgcagagcaagtctgactaagcagttcgctttctcccggtcaacacttgcccggtgaagaatgctctacctgatcttttctaactacatttgtgttgtagaattcttttcctgtccatatagataaagcatcctgctggaatgccgttgtgtaccaaggtatagcaaataaaacactgtgtaaagatgatccactctgatttgctcatgtgggttgtgtgtgagcctcatgctgatgatggccaaagtgagctggtattattattagcatcacatacattatgcatcagtgtgttgcgttggccctc

SEQ ID NO: 26021 - DNA, 552 bp, Triticum aestivum
  Clone ID: PAT_TA_26021
accctgatgtaaccacgactcctttagttcctgatatgtctgaccccgagcatttcgcgcggaattatttacctctagaggtcagaagggcccttgcaaagggaaagaaagtaggaggtcgtctttgtctcaaagtgtggaccttgcccaagggtgtacggataccagtctccttgaacacttcgggcctgccaatcggagaaaatgcaatcatgttgattaactttctaggcgcactggcacgagatgcagtgttggcacctctcacatatgtaagttggaaaacatttccaaaggagaacaaggatgttatgccgcgcagggtcccgctgggcgccgctgttgatccacctcgcgagttgtcggtcctgagctccataagaaacaagtggaagttttggaaatgtcacctaaaactgaaacaccacgatcctcatataactgaagaggaacgccttgctgatcgagatcctcgtgtcccaaaggaacaatggcgagcccttattgcatattggaatacggaaaaggcaaaggccagaagtgctgcaggta

SEQ ID NO: 26022 - DNA, 497 bp, Triticum aestivum
  Clone ID: PAT_TA_26022
ggcaatgatagaacataacgattatgataaattcaggtgagcaaaagctcaaacaccgtcatatagctaagaatgtccacaatacataacgggacaaaaaaaaaggaagtatgcactactaatgaacaatttctttgcaatgatggtgtttgcatggtttgactcgctgatggaatccgaggatttgactttgccgagagaaaaaaactttccgttgacttcaaaaacctccactgatcttgcactaggagcatcatgtcatgtttcgggcttggctgactaacccagatgtacctgcagcagtctttccattgaaaaaaatgcctaaacgcggaggccaattttggttaactatgattgtaaaaaactccttggggctgccatcacctacaggtcagcctggcgttttcttcgataagcactgagctactctttctgattggcctacaaatgtgccctggttaaagtttcctcgcgatgctgtgcgggcaccccat

SEQ ID NO: 26023 - DNA, 758 bp, Triticum aestivum
  Clone ID: PAT_TA_26023
gccggccggtccgggagcagaacctgcctgccactgcaaaaatctcgggagagagaaaagatcccgcgagcaggcgagcgaggagggaggaggatgtcgtggcagacgtacgttgacgagcagctgctctgcgacatcgacggccagcgcctcaccgccgccgccatcctcggccacgacggcgccgtctgggcgcagtccgagcccttccctgaggtcaaacctgaagaaattactgcagtactaaatgacttcgatgaaccaggctctttagcaccaactggattattccttggtggtacaaagtacatggttattcaaggtgaacctggggctgtcattcggggcaaaaaggggtcaggaggggttacaatcaagaagacgagtctagccattatcattggaatctacgaggaaccaatgactcctggacagtgcaacatggtggttgagaggctcggcgattaccttcttgagcagggcttctgaactcagagtcctagtctgggccaactgggcttatgcctatcgaaatgtactaccgcataccccatgaataattagcacacatccggatatgtttgaacaagtggtggttactcgttatgttggagttgcttcctatatgtcatgggacttatatgtactctttaaacgttgtcatatttttgccgagcatctagtatgtgtctaattctgatcgttaaaagttgtccatattaaaaaaaaaaatgaaaaaaaaaaaaaaaaaggcccct

SEQ ID NO: 26024 - DNA, 610 bp, Triticum aestivum
  Clone ID: PAT_TA_26024
gccggccgggttcccagatttcttctctagcctttcatcgcacgaaaggcatcaatggcggcggcgggcccagccaagacggagcggcatccatggcggcggcgggcccagccaagacggaggtgctgtccctcttccgcgccttcctccgcacggcgaggcagttctccgactacaacatccgcgagtacacgcggcgccgcgcggcggacgccttccgcgagaaccgcgccctcgccgacgcgccggccgcggcggcggccttcgcggacgggaagcagcagctggaggtggccaagaggcaggtgctggtctactctctgtacgcgcccaaggccaagagcgttgtggagatgaagattcagtgagcgacaccagagagaggtttcacgcactcctttttcccctttagggtctgtgctcttttatgtactgttagtagggttatggcgatctgatgctaatagaatttctgccattactatgtttgctggataattgccctgatacggtggttgctattgttcaataagttcgcaaattaatgatcatgatactatgtgtttcgtaaaaaaaaaaaaaaaaaaaactcctagctcgtgccgaattc

SEQ ID NO: 26025 - DNA, 587 bp, Triticum aestivum
  unsure (1)..(587): unsure at all n locations
  Clone ID: PAT_TA_26025
gtgcaagcgactaatggnacaggcacttgatcctcccgttctgttaacgatgacccctgacgaactaaaggctgggttgacaccagcagagatagcgtctgaatcagaagaatcaaggcagctgcagatgactgaggcccggtgtagaagatgcacggaaaagaaagtaggcatacttgatatcattcatgccagccgtggagatcgctatcaggtcgaatgtatttcctgcggatacacatcatttgcgtccagagatgacatcttaagaaatggctagcgagatcaggcgatcagccagacaagaagcctgctactgatgagagcacggagacttacatggagaggcagaccatagtctaacatgcgaagcgggatgaaccctccctgcgcctgcaactaatcatgggtcgtgatatgtagaatgaccattcacaaaaaaaaaaggatatgtaggatgacatcagtgttaggcgcctaggatgttctggaaaatctagtgcgcatctttcgacgtgtcaaactcttccaactgcatattcatgatgaaaaacgttttccaccgctttatattataaagcaaccgc

SEQ ID NO: 26026 - DNA, 623 bp, Triticum aestivum
  Clone ID: PAT_TA_26026
aagaagcatgcctgatacccgggtcgctgtcgatttctccgggggaccaggggcaagcagtgaaaaccaagtggctacaccagcaactacaacaactgaagttgttattccttgcaagtacataggttttgtttgtggagccaatgacagtgacctcgctgagataaagaagatatccggcgctgaaattacagtacatgatccaaagcccggagatacaaattcaacagttattatatgtggagaccccgaacaaacgaagagggcgcagagcctgattcatgctttcatcttttgtggtctctaccagaaatgaccctgcaacagtggtgatatttgccatcatagaaccatggatcctcctcggaggtcttccacctggagagttttttgttttgtttcctttccctgagaggttgtgtgtacatgtacaatagtgattgggttgtatgtagataggattgaattggtggctggctggacacacagacagcgccgttgtaagtttcttgagtggatagctggacgcatggcgccattgtaagttgttgaatttgatgtatgaacacaaagtcagcaccattgtgggttgttgtgtttggtcgagggaaaaaaaaaaaaaa

SEQ ID NO: 26027 - DNA, 446 bp, Triticum aestivum
  unsure (1)..(446): unsure at all n locations
  Clone ID: PAT_TA_26027
aacaagagacaagaagcatgcagtaagcagaggtgacactgtttacagatggttagagcttacaatcgcctactagatgataacgaaagcactacggtgctgattacaagcgcagattctgacaactaatcgcacgatgattatacagtaagagaaaggaactagtctactaccccaacaagaaactcaaaagtagagcaccatgaggnagaggagcgaccaacggcaccgccctagcctgaagcagggtgcccatccccacgtcctgccgttgctcttgtccaggggtgggcatgggcaggacggtggcggtgtcggtcgacgccggcggggagcggcaccgcggggttgctgctnntgaatgcggtgctcgccccatcgcccgacgcggcaggcgccggcgngcccgcattgccgctggccggcgccccagggctcagcctctc

SEQ ID NO: 26028 - DNA, 1508 bp, Triticum aestivum
  unsure (1)..(1508): unsure at all n locations
  Clone ID: PAT_TA_26028
gaagaaaagcttgaagctgagcgtctccttctagaggaagaaaggaggaagtttgaggaggaaaagaggaactttgagttagagaaaaagctgtttcctcagaaaaagtagctgtggatgatgaaaagaaggagacaaagcagtctttatttgagagcacaattgatacagctgacaagcatgtcacactttttgagaagatcatcagtatcccccaaaaaggagagacattcgggaagaccataactgaaaatgcagaagttattcttaagaaactcaaggtacttaaggagaagaggataccaaggagcattacttcctcaggagtggccgggatttacttcttcaaggaagaaatgaaggagtggactgggatgagggttggggaatcaaatggggaatcaaatgctgtcctgaacgtaggaaatggaaaggttactgcaaatgggttccacaacagggaatggaccctgtttcctcaaccggggtngaccctgtttcctcaacggggtngaccctgcttcctcaaccgccgtcgcccctgcttcctcaaccgccgtcgaccctgcttcctcaaccggcgtcgcccctgcttcctcaaccggcgtcgaccctgcttcctcaaccgccgtcgcccctgcttcctcaaccgccgtcgcccctgcttcctcaaccgccgtcgcccctgcttccccaaccggcgtcgcccctggtgtgactggagctcaggttggaggtgaacccaaggttgagtgatttagccgatggaagtttcttaaacatcactttttgttgcccctggtgtgactggagctcaggttggaggtgaaccaaggttgagtgatttagccgatggaagtttcttaaacatcactttttgtcgcccctgttgtgactggagctcaggttggaggtgaacccaaaggttgagtgattcagtcgatggaagtttcttaaacagcaacctttggcatttgaccctaagctatgattttttgtcattcggcttgtgatgtatttcttattacctcgttgatatagtttttgatctgcgttgatggttgacgcttcagatttacttgttcaaactatgtttcgtcctgatggcacccaaagctgtgccactactagatcacagtccagctagccacctaagtcagttgcaggtcacaggacacacagactgccgtttgcctggtaatcttcgtttgtgttttccattggatttaacaccccttccatttgaccacgtacgcacagcatgaacaggggacagcaggaagagcatgtacaaagtaacagttttgaaaagtagattagtagctggatgatgattttttggtatcaaattagtgtaatttcacacatagcatagtgctcactgtcaccacataaaagccgcaattaaaatagttcttggctacgcacaggaatgcaagccaattctggttttcttgaagttgttaaattttctcgtttcctgaaatgttagtctacgttttttttgc

SEQ ID NO: 26029 - DNA, 1294 bp, Triticum aestivum
  unsure (1)..(1294): unsure at all n locations
  Clone ID: PAT_TA_26029
tcgagattaaccgctcgttatcgtttcccccgtgaaaccacccgacccccttggccgtctccccgccgccggccgggtacatccaatccaagcgccgcctgcgcgcccctgctccgacccgatggcgtggggcgcgcccgcgcgggcgcagtcgtcgcgggtgcaggccctctacgacctctgcaggcgcaccttcccctccccctccccctcctccgccgccgccccggccgcccctccgccggccagcgccgtccgcgccatatcctccctcatggatactatcagccccgcggacgtcgggctcagggacgacagcctcggggacggcggcggcgggcacgggttcttcgactccaccttcgtcaagggcgcggccagggcggccaggtgggcgcagcccatcacctacctgcacgtctacgagtgcgacgccttctctattggaatattctgcttgccaacttcagccgttattcctcttcatgatcatccaggaatgactgtactgagcaaaatcctatatggttcgatgcatgtgaaatcatatgactgggtagagcctactgttgtagcgagtaatcgacaagtgagactggccaagttacatgcagatgatgttcttactgctccatgtccaactaccgttttgtatccccaaagtggcgggaacctacactccttcacttcagttgcctcttgtgctgttcttgatgtgcttgccccaccatacgctgaggatgctggtcgaatttgcacctattttaatgattatccgttttccagcttctcaagtggacgcgcaaagacagtcgatagcccagataattatgcctggattgaagccataaactcacctgtgtacattaacatgcgccctggcatgtatactggcccgactgtacaggactgcctatcataaccgacggaccaaggagcatcaagtgtgtatccgggcagcgaggcaccaatacagttcttccaatgttgtagtgttgtaaatgtaccgtaacctgttacttttctatttagattttgtgctagatggatggctacagtgaatatacagttagaactttctcatgctccatttagtggaggaatccacattgtgtggcctgagcttgtcgtgatactgtttttgcgcccccatagtatatctgtgttggtctggtctaagtttgggactagggtagtgaatgctgatatattcaaaattccatgcaaaaatcagctgaaaaggcattcagccactgttatcaaagtacnataaatatgcanaacaatacattca

SEQ ID NO: 26030 - DNA, 976 bp, Triticum aestivum
  Clone ID: PAT_TA_26030
atctctcgtcggggcagggcacggagcggggaagaaacagggcggcagccgggctgggcaggaggaggaaggaagcaaccccacccaccacccgctccttcttcctcccccctccacgcctcccagggcccgagctgctgccatggcggatagcaacccggacagcatcaagagatacacgcctcccgtgcacaggaatcgtgcaaacaatcgccgcaaggctggagatagggctgagaaagccaactattcatacaacaatgatggagagaagagccatgttccttcactaaagaaccttcctccaattatccatcatgatgcgtttgtcagcaatgctcaaaatgattacagtcatgcaagattaataccattggaaggatgttctgccagtgaggcttcacagcttctcagtgaacgttgggctgctgcaatgaacatgtataatgacccaaatgattcccctgataaaccagtgatgtacgctggatctggcggatcgtcatggggtcaaggtcacatgaaacttcctcatcagatgaacttcctcgaagatctgcgtcgtgcggtagatgctcaaacgggcctggcagcggcgctcagcacctggaactaattaaagtcaagctgcatcggtggagtgtcacagatttatcagaagcaagctattttgccagctcaatgtgtgttcagtttcgtttgaaaactatatgtatgatgagaagtccaaattttagtctaacctgcggctgcttggtttctctaaaatgggagcagcagtcaatctcttgtagccttacagatggaagggcattgctgtgtcgtgaacctgagtcaccgggtaggtactcgattactctgccttaacaatgtcctggtaaaagttgtatttggttgaaagaaaagattgtatggatatactctgtacaagtgctctcacaccgcccccgcccccgcgcttctctctggggattcc

SEQ ID NO: 26031 - DNA, 522 bp, Triticum aestivum
  unsure (1)..(522): unsure at all n locations
  Clone ID: PAT_TA_26031
gcacgaggatttacactgcccactccactttctgtccgctccgctccgccccaccctcctctccggtcatctctggcatggctaggaacagatctgaatccggtcgatctagatccgtcgacttggagctcggcgcctgctcggacgaggagatagccgtccagctcgtgctctgccaacccctggaggatacctgagctctgtcgttggagccgcccctccgcggatccaccagccgggcgccttcaccgccactccagctgggatccaagcgttgggcgccgcgtgtccgctccatcaccggatcaggcacgcgccggtccttgtccccgcgacgttggcctcnggagtctgaggccaatgtcaagcaatgcgcaaaggcatggaattttgccagatgcccgggcgccggcggcgggtctgccatcgagtgatggtgtgcccgctgtgagagggagaagntgcgacgcggcgcatagggcaataggaggcccgtgcccggatcctgacgaagtggcaagc

SEQ ID NO: 26032 - DNA, 1707 bp, Triticum aestivum
  unsure (1)..(1707): unsure at all n locations
  Clone ID: PAT_TA_26032
tcgacccacgcgtccgatgagagttgcttggcatctcatccagaatggaaggaggattaggggtgaagatgagggccttccagaaaccgaagcatagcctcgtctaaatgaaaggaggattaggggtgaggatgaggcccttccagaaaccgaagcagagcctcaaaagcagcgaagtaatcctgaaccggatgacaaacttgctactgagaatgagatgagcaaaggaactcatgataatgaatcaagcagggatcatactggcattcaccagaatgatgataccaatcattctaatctgcctactaatgtggataccgccgacaaatctcaacaagtcgctgaaacgaaaacagtggaaaacagtggaactgatgcttccgtttcatctcgactagaggatctgcttgataagagtcttggtctgggccctgccaagggttcagggaaaagctctttgctcgccagcagtctttcaagtttaggagaagacactgatgatcttgatgtgaaaaaatcaatagtaagagagaaaccctatgtatcaaaagcagagagaagaaaactgaagaagggtgagaatgcctgtgaatctactagtagatcctcagnaaagttgtcaaaaagccagataacccacagcaagaaaagggcaaggataatacaaaggccgctaatcctaaaacaagtcgtggacagaagggcaagcttaagaagatcaaagagaagtatgcagagcaggatgaagaggaaagagaaatccgtatggctttgcttgcgtcttctggaaaggcttcacaaaaggacaatccttcacaggatggagaagataccactgcaaaacaatcaaaaccatcaactggcgaagacgactcattaaaggtttgttataaatgcaaaaagtctggacatctatctcgtgattgccctgacagtacatcagctgtggatccgactgatgtcaacgttggtagaagcagagatggtatggatagaagtgctactcctgttgatggcagcattgtcatggatgaagatgatataaatgaacttggtgatgaagagaaagaaaagttgattgatttggactacttaactggaattccagtggcaagtgacattttgctatacgcagtacctgtatgtgcaccttataacgcgctacagacatacaaatatcgtgtaaagatcaccccaggcactgcaaagaaaggaaaagccgccaaaactgctatgagcttattcatgcacattcctgatgccacgaaccgcgagaaggaactaatgaaggcatgcactgatcctgaattggttgctgcgattgttggaaatgccaaaatcaccgcacctggcctcactcaactgaagcagaagcagaagcagaaagggaaaaaggctgcgaaaagtaactagattgaaaccaccatgacaatgcactgacgttttgatccactgctgtctgcagaacgcatgtaaatcctgtggtatgatctgtctgcgctctgtagaaatcatgtaaatcccgtgatatgatcagttgaggcataggcaacaaatacactttagtgcatataaggtgttttacaccttggcatttgagaggccaggggccggtgcaacagagacggcggcctaaaagagcaaatatacactttgtggtgttaccttgagaaatctctgcctcagtaaactctcaaatttcatctc

SEQ ID NO: 26033 - DNA, 1054 bp, Triticum aestivum
  unsure (1)..(1054): unsure at all n locations
  Clone ID: PAT_TA_26033
gttatttttgaagtttaagtctggacctgtgcccattgtgctaggctgcatgactgggtggggtcctcgtctcccgcccccttgcccattgcacccgctctttcccgtgttgcctcaggttgccctgcagtccaagtcccgtggtggtgcttcagagcacagagacagaaggagctcttcagagcgccaagacaggaggagttcttcagagcgcagagacaggaggagttcagaacgtaaagacagaaggtccatggagcgcaaagatagaagttcttcagacctccgagacagtggccacgacaaggaagtaactaaaagcaagggacggggaagtgctagcggggactcaagcacttctgatagaacctccgcggaaccatcacagaagcagctttctgacaaacaaggggaggggaagttccagttggtcactggtggtgccaagaaggaacttcctcggacggtcactgcagatgaagctgctgctattgttatggcggctactcgtggactggggcctgccaatcctcaacctaacacgctaaaagacacggttgacattcgccatatacagggctcaggtgcagtgtccaaacctgcttcaaatagtgagcctggcatatcagtcacaagtagtgatcagctaaagaaggaaggtattggaattatcgatgatgattggatcacaaatacaatcgcaaaagcagttgctgttgccgcctctaaagaggcagattcttctgaagcttccatgacaaatgagcagaagctgaaggctgagaggcttcggcgtgcaaagatgttcacttcaattattaagggtggtggcaacaagaatgatctggtgacacaggagataagtaatgaatctgcaagggccgctcctgctaattcgaacctccccgtgcctccagaacctttggctagtgaacgggaaggtagctctgtgcattttgaacgggaaggtagctctctgcgttttgaccggaaggtagctctgtgcgtttcgaacgggaaggttcgaatatgatcaagcangagaaagactctg

SEQ ID NO: 26034 - DNA, 644 bp, Triticum aestivum
  unsure (1)..(644): unsure at all n locations
  Clone ID: PAT_TA_26034
gcacgaggtttttcatcacattctttgatgtcaatcattgcaaagttgtaacgtactaaatcctaatatgccaatgcagcaaaaaaagtcttatttttcagattgcaccaangaaaaaactgcttccatggcttcctcggcctccctgtcgtgctcgagatggagatgcctccctgcttcaccactactaggtacctcttcttcctcagcttcgtcctcctcctagcagtggatgctgcaggcccatctccccaagcaccccaccctcgccatggattgagtgggaggtcagtttgctctgaatccctgagagttttggtcctgcatctcttgctcaatcagcgggctgatctttgccggcgccggggtgacatcaccagaactgctgcatcttcatctggtttgctttagataacgagagcaaggcaagcagcttgccaaaaacaaaggtggatgcagaaggaacatcacttgttggctcccttgacagaaatgcggagttttacatgatttacgaggacatgtcttcttggatggatgtggattatttggttcctttgtgggaactgataacattttgtttacatatttactgctcgaccgtatgcccatannnannnnntgatctctttttctacgcannn

SEQ ID NO: 26035 - DNA, 198 bp, Triticum aestivum
  Clone ID: PAT_TA_26035
gcacgaggctgtgggcgaccctttctgtatgcatgcatgcatgctcgaaccgaagcagccccacccgtcgttcagctgagccaccctccattgcattggcttggccttcccttaaacaacaccaccaagaaagattgacgatgaatgtgggtgtacatgtatatatcgaccgaccagcttaattctaaaaaaaaaaaa

SEQ ID NO: 26036 - DNA, 509 bp, Triticum aestivum
  unsure (1)..(509): unsure at all n locations
  Clone ID: PAT_TA_26036
gcacgagggccacgcgcgcttcgcccaagcccccctcctcccccccctccccgccccccccccgccgttcatagcgtagcacgtagcacgtacgcgcgcgcgcagcgcgggcgagagagacaaagctcgtcggccggctgtctctcgcctgccatgggaacggaggtgctccgcccgcacgactgcctgtcccgcgtccgccaccacgcccacgcccacgcccacgccggctccaggcgctcgccgcgcccggccgcgaggacgcgccgcggcaccgctcgccgcgcccaggcggcgtcgcccctgccgcaagaggtgcgggtcaaggtgtcagtgtcacccgccaccgcggacgccgcgtacgccgggccagcgttcggcgtcatgtcgccgtcgccgcgggcgctgccgctgccgcgcttcagcancnnnaagacggcagcccnnnnnnacgtggaggactcggccacgcgggagctccggcggctgctgggcctcgagcgggcgnn

SEQ ID NO: 26037 - DNA, 817 bp, Triticum aestivum
  Clone ID: PAT_TA_26037
ccgcacgtccggttgctattacaacataggaaccttttctagctagcgcttcagaaaaccgaccaccatggcggtgccagccaagtgcctccttctgttctccctctccgcggcgctcctctctctgcttggcaccggcgcctccgccatgggcctgccccagcctcatgtgccggtgaacttcaccatcggcgtgcagggcatggtctggtgcaagacctgcaggtacatcggctacaacgcaaacatggacgcctccccgctcaaaggcgtggaggtgtacctgcagtgccggcacggcccgcggcggctgaagaagttaccagggacatcggggcagggcggctacttcgtcatccagtcggcgcacatggcgtccttcaccaacgacgagtgcaaggtgtacgtggagagctcggcctccaccgcgtgcggcctcgtcgacgaacccgccgccggcgaggggctgccactcaagttcgactcattcgtcaagcacggcgacggcctgcaggcgctctactccgtcggcaacatcttcttccgccccagcaaccccaacaagtgctactgacgcatccatccgtcatgtacgtacttgtgggacttgaataaatgggtcaggaactcaggatgaactagctgttggagtagctggggatatgtatatccggtgctgtaatgttgatttaagttttttctattgttgcagtagttttgtaagcttcttttaattagcaaccgcatgatcgaaataactcttaatatgattagggcagtgtatgtcatgtcatgtgatgactaaccgatgttctac

SEQ ID NO: 26038 - DNA, 659 bp, Triticum aestivum
  unsure (1)..(659): unsure at all n locations
  Clone ID: PAT_TA_26038
cagcagcgcggcctacctcggcactgccgctaccgacaccgacccgctgagctatctgccggacgggttcgtcgagaggatgaacggtacagggctccttgtgccactgtgggcgccacaggtggagatccttaaccacgtcgccatgggagggttcatgtctcatggcggatggaactccacgctggagaccgtggcggcgggcgtgccgatggtggcgtggccgctctacgctgagcagaggatgaacgcggtgatgctgtcgtcggatcgggtgggcctggctttgtgggagaggcctcccctcggtaaggacggagcggttgtcccgcgggaggaggtggcggcgctggtcagagagcttatggaaggggagaagggcgccgcggcgcggaaaaaggccggtcacctccgggatgaggccgagattgcttcggcgccgggcgggccgcaggatcgagctctcgcggtagtggctggcatggtttccttgcatcggaggagccacggcgagtaaagaggaggctccctaaaagaactgagtaagaggcatggtggctcaagtttttccttcattcatgtttgtatcgattgctatatctgtattttacatttaaatatagaataatacttcgtctnnnnnaaaaaaaaaaaaaaaa

SEQ ID NO: 26039 - DNA, 697 bp, Triticum aestivum
  unsure (1)..(697): unsure at all n locations
  Clone ID: PAT_TA_26039
atcagatcgagcatccaatccagaaaaaccagagcaatccgcacgtgaggccgtgagcaattgatggaggcggcgaaggagaggcgggagcagcaggagcggaaggccgccggcgccggcgagggagccgactcggtgcagctgccgacggagacgagcccgtacgtgcagtacaataaggacgacggcctggaggactacaagatgcgggcctacggcgcgcagggccacctccccgtctccgacgtcccccacggctccggcaccgacgcgcccaccatccctggcaccgcgctcccgaccgagcacctgaatctgcacgggcgccagcagccgcagcggggtgcccagggaggaggcgctggcgttcgccgcaccgacgacgacgaggctggcaccgacgccatcaaccgccacggcgtgccgtagttcatggatggctaggctgtctagctagctcgaggaggttatccacgtagtgctcagtgccgcgtggggaaaaatgaataaagttggtaatgtaaaatcgctggcaaagcttgtctacagcataatgtaacactgtaacagtttttgtccaaaaaaaaacatcttccaagagctnttgaggttatccacgtagtgctcagtgcgcgtgggggaaaatgaataaagttgngtatgtnnnnnnnnnnnnnnnnnnnnnnnnnnnnnnnnn

SEQ ID NO: 26040 - DNA, 629 bp, Triticum aestivum
  unsure (1)..(629): unsure at all n locations
  Clone ID: PAT_TA_26040
cacactcactcgttgtcatcactcatcagatcgagcatccaatccagaaaaaccagaggaatccgcatgtgagcaatggaggcggcgaaggagaggcgggagcggaaggccgccggcgccggcgagggcggcgactcggtgcagctgccgacggagacgagcccgtacgtgcagtacaaaaaggacgacggcctggaggactacaagatgcgggcctacggcgcgcagggccacctccccgtctccgacgtcccccacggctccggcaccgacgcgcccaccatccccggcaccgcgttcccgactgagcacctgaacctgcacgggcgccagcagccgcagcggggtgcccagggaggaggcgctggcgttcgccgcaccgacgacgacgaggctgccaccgacaccatcaaccgccacggcgtgccgtagttcatggctaggctgtcttgctagctcgaggaggttatccacgtagtgctcagtgcgcgtgtggaaaaatgaataaagttggtactctaaaagcgccatggcaaagcatctcttcaacataatgtaatagttttcgtccaaaaaaatagagtcaaatacatcatggaaaaaaaaaaaaaaaaaannnnnnnnnnnnn

SEQ ID NO: 26041 - DNA, 577 bp, Triticum aestivum
  unsure (1)..(577): unsure at all n locations
  Clone ID: PAT_TA_26041
gccgcccgccgccggtttcttcatcataggcaagattctttcgtccagagcgtagattgtagcgagtccggcagcggcaatggcggcggcggtgcagaacgaggtggtggcgcggcaggggcgcgaggacgaggtccacggcgtcgacgaggagcggccactcctggcgaggccgccggccgtccgcgacgacccagctggcgacgggctgagcccgatgcagagggccatcagccagacgtaccagagcacggcgcacctggccacgctgctgcccacgggcaccgtcatggcgttccagctgctgtccccgatcgtcacggaccagnggccactgcgtccgcgccaaccgcgccatggccgccgcgctcgtcgcgctctgcgccctctcctgcttcgcgctcagcttcaccgacagcttccgggacgccaagggcgccgtgcgctacggcttcgccacgcgccgcgggctctgggtcatcgacggcggcgcgccgctcgacccgcaggccgcggcagcctacaggctgcgcttcctcgacctcgtgcacgccgtcgtcaccgtcatggtcttcgt

SEQ ID NO: 26042 - DNA, 433 bp, Triticum aestivum
  Clone ID: PAT_TA_26042
ggagagaaagagagagagagagagagagtccactgcccgtcttcccctgagctccttcgccggcgaacgcccaaagccccgcatggagatcctccaacaaggcactatgttgatgttcccggggatggatcttacgaaaatggatcctccaactcttacccttcttggagcagcttgttgtgtaatgttgtctatgcatttcacagtacagctggtatcacagcatcttttctattggaaaaatcccaaagagcagaaggctatactcattatagtgctgatgcctccgttatatgctataacttcctttgctggtcttctggatattaagggaagcaaaacgttttttacatgtttggagtctgttaaagaatgctatgaagcactggttattgctaagcttctggcattgatgtacagctacttaaatata

SEQ ID NO: 26043 - DNA, 487 bp, Triticum aestivum
  Clone ID: PAT_TA_26043
cccacgcgtccgactcgtcagacagacagacagacagcgcccaaatttgcagatctctcggcggctccgcagcgagcaaccccccttccctcccgcgtgccgacggaagctgcagcctgcaggcaccatgtcgatgttcccagggatggatcttactaaaatggatgctccaacgcttaccctccttggagcagcttgttgtgttatgttatctatgcatttcacagtacagttggtatcacaacatcttttctactggaaaaatgccaaagagcagaaggccatactcattattgtgctaatgcctccactgtatgccataacttcctttgttggtcttctggatattaagggaagcaaagcgttttttacatgcttggagtctgttaaagaatgctatgaggcactggttattgctaaatttctggcattgatgtacagctacttaaatatatctattagcaaaaacattgtacctgatgaaatc

SEQ ID NO: 26044 - DNA, 656 bp, Triticum aestivum
  Clone ID: PAT_TA_26044
cccacgcgtccgcccacgcggcgagcgatctgcactagtcacggcaagaaccaccaccacaagtgagtgaccgtcggagcaaggaaaggcagggagagatggcaatgaggccgctcgtcgtcctggccctggccgtggcgctggccggcgtggcgctgggagggggcgcggcggagggggccggcgagtgcgggaggtcctcccccgaccggatggccctgcgcatggccccgtgcatctcggcggcggacgagccggactcggcgccctccagcagctgctgctcggcggtgcacaccatcggcaagagccccagctgcctgtgcgccgtcatgctgtccggcaccgccaagatggccgggatcaagcccgaggtcgccatcaccatccccaagcgctgcaacatggccgaccgccccgtcggctacaagtgcggagattacacgctgccttgatggcccggcaatgctgccgatgaagatgaatgctgtggaaggtgtcgtcgtgtgggaataagcgagtggtgcatgtaccacttatgtggggcactagtgactgcatggtgcctacatgtgatgtgtgcttgtgggaatatttctataagcatgtaatgtttcgtctgtgttaacgtgaacacacgtcttccgtggtggatt

SEQ ID NO: 26045 - DNA, 802 bp, Triticum aestivum
  unsure (1)..(802): unsure at all n locations
  Clone ID: PAT_TA_26045
tagaaagcctactgattctgcaccanagnactatatgtgtgaaacaaacccatgccccagtacaaaatatagcacgatgcctggaagccgctccatttcggaggaacgacagagttacttaaaaagattaggttatccggagttgcattcttcaaattttctcgatcttgatttgttatcgtcttcaggaaattcttgtgatgaagaagcttttgagaggtcatcgatcatacattcacctttggatggtatcagtgttggatctactactacttacagtgagccaggacacaatgatgagggaagggatgacaccgacctgtcgcgctcaagcagccagctctcagactcacgcgactattctgaccgctttgctcagtgggtggctaatggaggcatgctttgctactaagtgctaaagaatttgtcctggtggcatctccatataattttcgccgcagcacgaaagctccacagctagaacaaaggtaaaaaagctcaagaagaagctgcagcctgtgtgcacggtgctggcatttcgtcgaggctgaaccaacagaagaagaatcggcgcgattcgctcggtggatcgaagctctaacgcggtgactcagttgaggaatgaatgcagatgatgatggcgtgtggtttggtttggtttggacaggactggagagctatggtgaagaattgaccgtagtgaagggaaggcaatgaatgataggcaaaggcaaacatatctatctgtttcttttcaagggttagcttagctagacagctatgttttttgttcgccttagag

SEQ ID NO: 26046 - DNA, 771 bp, Triticum aestivum
  unsure (1)..(771): unsure at all n locations
  Clone ID: PAT_TA_26046
aggggccttttttttttttttttgacgggtacatggcaatttactactcaatatcagtcccacggtacatgataataactgtaactcagagcccatcccgatgancaaagtaaactcagattacaacaccgcacaacacagagtcacaaggtctgtgcaacataacacgtgaggcagaaatgtcgaccctcagacgtaatagaaggcgagcagcgaagtcgccacggttgcgaggataatggttgcggggccgccgggagacctcgccggcgcattcgccttcggtggtgaagcggtcgcgccgccactggatgctgaaggcgccggtgcttcagcaggagccgcagcgtggcacttgctcaagacagaggcggattggccgcaggcggtggggagggcgagcacgcgtgtcatgttgatcggtatcggagttgtcttggcgtccatggcagcgcagaggcacttcacggtggcgggggtgccgacggcggtcttcacctccgtgcagcaggccttggtaggccgggccgacttgctgtcgggcaacacatagtcgaggcagtctgcgaggctagtcaacgcctccgtgcagtcctgcgccggcgcgggcgccggcgcccgggtggccgcccccgcggcgtcggcgagcgcgaggaggacgaggatgcacgctgcggtggtggcgacgcggccggtgagagccatggctgcgctggttggtgcggtgtgcgcttgagcgtgaggagtgggttcgagcctgggcgagccggc

SEQ ID NO: 26047 - DNA, 1295 bp, Triticum aestivum
  Clone ID: PAT_TA_26047
gccggccgggtccgaccggagcaggaaccgagagagagagagtccactgcccgtctgcgccaaagccccgcatggagatcctccaacaaggcactatgtcgatgttcccggggatggatcttacgaaaatggatcctccaactcttaccctccttggagcagcttgttgtgtaatgttgtctatgcatttcacagtacagctggtatcacagcatcttttctattggaaaaatcccaaagagcagaaggctatactcattattgtgctgatgcctccattgtatgctataacttcctttgctggtcttctggatattaagggaagcaaaacattttttacatgcttggagtctgttaaagaatgctatgaagcactggttattgctaagtttctggcattgatgtacagctacttaaatatatctatcagtaaaaacattgtacctgatgaaatcaaagggagggtgcttcatcattctttccctgtttctcttttcctgccccgcaatgttcggctggagcacaagacacttaagcttctgaagtactggacctggcaatttgttgttgttaggcctgtatgctccattctgattattgcacttcagcttcttgggctgtaccccagctgggtcagctggacgttcacaattatactgaacttttcagtctccatggcattatatgccttggtcatattctatcacttgtttgctaaggagttggcacctcacaagcctcttgcgaagttcttgtgcatcaaagggattgtcttcttctctttctggcagggctgtgcactggatattttggctgctgtaggggtgattcagtctcaccatttctggctggacgtggagcacatccaggaggcaatccagaatatcttgattatcctggaaatggtcatcttctcagtcctccagcaatatgcgtaccacgtcgctccgtacagtggcgctgacaaggcgaaatccgtgaagaagaacgaatgatgcagggctttgtgccaagcaacatccgcggctagttcatgtatggttttgtgtgtatgtgctgggagtattgattcaaagatgttataggacatgtgtatttccttgtggacacgtgtagagtgggtcgtcgttataccttgaacattagaaaaacagagatgatcaggagcaacatataggaatgctactgttgttaccgtgctgtgatgccgtactatgtaatgcctgaataaggagaattttgggggtttcccgccccgaattgcgtccagaataaatggtggtttactgtcgccc

SEQ ID NO: 26048 - DNA, 865 bp, Triticum aestivum
  Clone ID: PAT_TA_26048
caaaagtaattaaagtgtcataactggcaacgacttcaaaatacccagtccacggtacattgcaatttactacgcactcaatattcagtccacgacactacatgataataacccatcccgataaacaaagtaaactcagattacaacaccgcgcaacgcagagtcacaaggtctgtgcaacataacacgtgagagaggctgagatgttggccctcagaggtaatagaaggcgagcagcgaagtcaccacagttgccaagagaacggtggcggagccgcccggagacctcgccgccacattcgccttcggtggtgaagcggtcgcgccgccactggatgctgaaggtgacggtgcttcagcaggagcaccacccggcccatgtgcagcgtggcacttgttcaagacggaggcggattggccgcaggcggtggggagagcgagcacccgtgtcatgttgatcggtatcggagttgtcttggcgtccatggcagcgcagaggcacttcacggtggcgggggtgccgacggcggtcttcacctccgtgcagcaagccttggaaggccgagccgacttggtgctgggcgtcacatagtcgaggcagtctgcgaggctaatcaacgcctccatgcagtccggcgccggcgccggcgctggcgcccgggtagccgcccccgcggcgtcggcgagcgcgaggaggacgaggatgcacgctgcggtggtggcgccgccggtgagagccatggctgctctggttggtgcggtgtgcgcttgagcgtgagaggagtgggttcgagcgtgtggcgatggagctgggaggcttgggatgcggggaggggaaagaggtttgtggcccggcccggccggc

SEQ ID NO: 26049 - DNA, 3102 bp, Triticum aestivum
  Clone ID: PAT_TA_26049
ttgcttggtagctccagatgtgttggaactaacggacctcctccattgcgagataactatagcatcaaaacctttggatgcttcaagtggacaagggtcatgtgacatcaaaatcaatgatgatttctgcgcagctacaatggtacctcttttgctacagaagggtgtcctcaggacaaactgcatagactgcttagaccgcacaaatgtcgcacagtttgcatacggattagctgctttagggcgtcaacttcatgtgttgaagctcactgaagaacctaaaattgatctgcatgatcctttggccgatgatctgatggatttctatgaaaggatgggtgatacattagccatccagtacggtggttctgctgctcacaacaagatcttctgtgagcaaagagggcagtggaaggcagcaacccaatcccaggagttccttcgaacccttcagcgattctacaaatggttacactgagggtaaggagaaggaggtttggcttaaggattttaattactgctgtatttggccttggcaacaggcaatacgagcattttaataaggttgcaaaggaggtggatgagttactgctggagcagggtggcaagcgtctcgttccatgtggccttggtgatgacgatcagtgcatcgaggatgacttcaccgcatggaaagaactagtatggattggactgcttccggtcttctctacagacgattctactccataatttacgatgaagaacacactactggagcatccgctcgggattcgcgttggactagtcgccgtaagaacggctatcaacagcgagcaccagtcgctgcagggacaaccgcgcacagagggcactaaggccgctggtgacgcgagccctggccgtcccggttgcgttgcgtggggctgcgcgctcgacactgcgaccgggggacggcaagtgggggagggcgtcccccgaacggatggccccgcgcatgtccccctgcagcaaggcggcgaacgagccggacgcggagccctccagcagcagatgctcggcggtgcccaccattggcaaggatccccacactgcctgtgcgccgtcatgcatgtccggcaccgcctaagatgggcgcgatcacggcccgaggtcgccagtcaccaatccccaaagcgctgcaacatcgccgaccgtcccgtcggctacaagttgcggagattacacgctgccttgatggcccggcaatgctgccgatcaagatgaatgctgtggaaggtgtcgtcgtgtgggaataagcgagtggtgcatgtaccacttatgtggggcactagtgactccatggaggtgcctccatgtgatgtgtgctttgtggtaaatatgtttctaataagcatgtaatgtttcggtctgtgttaacgtgaacaaacgtgtccgtgtggtttatatagtggaagatagagacgccaagtgaggccgctcgtcgtcctggctctgggcatggcgctggccggggtggcgccgcgagggggcgccctgcggagggggcctcggcgagtgcgggaggtcctcccccgaccggcatggccctgcgcgatggccccgtgcatctcggcggcgggacgagccggactcggcgccctccagcagctgctgctcggcggtgcacaccctagggaagagccccagctgcctgtgcgccgtcatgctgtccggcaccgccaagatggccgggatcaagcccgaggtggccatcaccatccccaagcgctgcaacatggccgaccgccccgtcggctacaagtgcggagattacacgctgccttgatggcccagctctggtgctgatgaagatgaatgctgtggaagatatggtcgtgtgggaataagcgagtggtgcatgtaccacttaagtggggcactagtgactgcatggtgcctacatgtgatgtgtgcttgtgggaatatttctataagcatgtaatgtttcgtctgtgttaacgtgaacacacgtctccgtgtgatttctattgtcgaaaaaaatacataaaaagatattcttatatcaacaaaaaaaatctataaagtaggctacctacagaatacaaataacatgtgcactcttttatatagcgaacaatgccagtgggcaacaaattttgtgaggcagtcaaattttaggttgcccgcagatccatccacttcaatcatcatcattggtcctaggtcgggactagcaccttttagggagttcatgcatgaaagattcgctcttcaataatctcgaattataatgggctcttcagtcccctgcctagggccgcagggacgatggaagggatgacacctacctgtaacagtcactgaacttgctttcagcctcgcgctcctcttctgtctattttgctcccgtggtagtgaatgacatacatgaggatgtgttgagaaatatactttaggagggggcaccctctgagctaattttttcccactagcagggaaggtccaaccatagaataagggcaacataagatgagaaacaagtccaccgagttttggaacgtcttttctcaaggcggggatatatatatttgtgaatgaccccaagggcttggcggaagacgtacacaggtttctcgatcactcattgttcgaaaaaaggcatattttggataactccggtaaccgaggcgttttgacaaagaacctacagttggaagggaggtaccctgcgtgatgtgtggtaacaatcacccttagacatcggtagccctagcgtgtagaatgaaagaagtaaaaaagatggcgcctgtatggtatggtggatgccaatccgatcgtgagttttctgcatccatcccattgcccccgaaattggagttaatcggtgtaattctttgacatctaacatggttctaatatttattgtatggatggatggttgaaagaaataagtgttgttgtagattagtagaacttaaaatacccgagaaaattgtagctgggggatgaatcatacagtttgagatgagatgggacatatcatgtatacattaaagaccgccaagaacaaattttgcatctggttataaaaaaaaaaaaaaaaaaaatgtggatggtcgg

SEQ ID NO: 26050 - DNA, 659 bp, Triticum aestivum
  unsure (1)..(659): unsure at all n locations
  Clone ID: PAT_TA_26050
gaattcggcaccaggccgngntgacacagccttagtaccaccacggccgcccatccagccctcacccccgtccctccctccctcctacgcattcggcggccggcattctttacctacctgctacaagctctagccaacctcacagctcgcgttccctgctctgctagtgtctcggattcagcaaatggcggcgatgaatgtgtcgagggccatcggcgcggcgctccggaccccggcctcgtcaccggtggcggaggcggccgccgcggcgaaggccaaggacgccgagaagctgcgcttcatcgacgagatgacctgcaacgtcgactccgtgcaggagcgcgtcctcgccgagatcctcgcccggaacgtcgacacggagtacctcaagaactgcggcctcgacggcgccgccgaccgcgacgccttccgggccaaggtgccggtcgtgtcctacgacgctctgcagccctacatccagcgcattgtcaacggggaccggtcgccgatcctgtccacgcaccccgtctccgagttcctcaccagctccggcacgttcggccggcgagcgcaagctcatgcccaccatcaaggacgagctcgaccgccgccagctcctctacagcctcctgatgccggtcatgaacctatatctgtcc

SEQ ID NO: 26051 - DNA, 335 bp, Triticum aestivum
  Clone ID: PAT_TA_26051
aaaaaaacaagcatatactgtaaaagagaacacagttgccggccatcagcagtcaccaactgacagtccatatattggtaccatataaaaacatgattacatttcacctaataatgccaaatgccttctctgctgatgagggccaacacaaccacaaacagaaacaattttccctcaccacaaatacctctgagactatgaccacttgttggagattatgaaacaaaagaggagctatacccaaaccaaaccaaccatgatgtcaagctgtcagtcgtcaagctgaaaaaccaatcagttttgttgagatgccctgctcaatatgttctgctccc

SEQ ID NO: 26052 - DNA, 668 bp, Triticum aestivum
  Clone ID: PAT_TA_26052
tttttttttttttttttttttttttttttttttttttttttttttttcaccaactgatatccatatattggtaccataaaaacatgattacatttcacccaataatgccaaatgccttctctgctgatgaggaccaacacaacaacagaaacgattttccctcaccataaatacctctatgaccacttgttggagaatatgaaacaaaaaaggagctatacccaaaccaaaccaaccatgatgtcaagctgtcagtcgtcaagctgaaaaagcaactgcagtagccataagcaaaagcagctaaacccgaccaacacaaacagagatgttaaactaacatgtcacaacacccagaaaataaaaggaaattagttgctccttaactcagttttgttgagatgccctgctcaatatgttctgctcccttcagctcaagagaaccatcacctataatctcagatgacgagccccccgccacatttagtttgatgtgcaccgagccaaccttaacaacaccagctggagcctcgttaacaatgccttttgcttgcccatccgtatggctagttgataagccttctagtttcttgagcaatgtagccttcacatccttcattatcccagatgcaccgcctttcgtgcgatctgatgggtcgtgacccccggcc

SEQ ID NO: 26053 - DNA, 740 bp, Triticum aestivum
  unsure (1)..(740): unsure at all n locations
  Clone ID: PAT_TA_26053
gcattctttgacagaccctatggcaatgtggcatgtccgggcggagattgctccagcaattctactggtggttgattttggcggctggtacaaactcgattcaaaatctgcaggcggcaactcttcaaaaatgatacagcacactcaggtggcacggcgcaaagatgtcattgtgccttacacacatttgctccctaccctgcacctgtcagaaaatatggatcgccccactcttttgtacttcaagggagccaaacacaggcatcggggtggtttggtgcgtgaaaaactgtgggacttgatggttaatgagcctgatgttgtcatggaagaaggttttcctaatgccacaggacgtgaacaatcaataaaagggatgcggacatcagaattttgcttgcacccagctggggacaccccaagttcatgtcgtctgtttgatgccattgcaagtctttgcataccagtcattgtcagcgatgacattgagcttcctttcgaagggatgatagactacacagaattctccatttttgtgtcagtcggtaacgcaatgagacccaaatggctaacgaactacctannnaatatctccaagcagcaganngatgaattcagaagaaacctggctggagtccagcatatcnnngagtacgaaaacactcaccaaagtagcaaggtctctgccccannnnnnnnnngctgtgaaccacatttggaagannnnncancanaagttg

SEQ ID NO: 26054 - DNA, 872 bp, Triticum aestivum
  unsure (1)..(872): unsure at all n locations
  Clone ID: PAT_TA_26054
tggtctgccaaaacttattcacgtatgtacanncaagtgcatgttttgcaaggaaaatcctacaacttcaattattttggaacaacgggagtacattcgattcgaccgaaattcggttcactcaatgccgtaaaacttcttgtgtaattcgtactggacctttccatcgggaagaacctcgcttacactctccctttccctgcacctcttctcccatcgcgtgagcttggggcattccgcctctaagtcaatccctccatgctgctcatacccgtaaaacatgcttgaaaatgggatgaagacgacgtccaagaacccgaattcgtcgccagaaaagaagcacttgtccccgagcacctcctctagacgtttaagatgctcgaccaactcttccttggccgcctctttctcctcacccttgctggtgaaaaacttcgtctgggtgctgaacaccttgtggtcaatgaagtcagcccagaacctggcgtcggccctgtcggccgggtcgccggggagcaaacgggtttcctcgccccatacctcgtcgatgtactcgacgatgttgacggagccgcagaccggacggccgtggtggatgaggatggggatcgagcggtggacggggttcatgcgccgcaccagttcgctcctctcgcggacgcggaggtcctcctccatgtactcgaacgcccgcctagcttcacgcagcgcgatccgcacccgcatgccgaactcgttgcaccagaagtcgacgcaggtcacctcgctctgccgcccggcctccgtctccatggctttctccatgtcctgtcctgtcttcaaggtgggaagaattgcaaccttggattgggtcgaaccccggcccggccggc

SEQ ID NO: 26055 - DNA, 510 bp, Triticum aestivum
  Clone ID: PAT_TA_26055
tagcgtggtcggctccgaggtacagggtgccatcacaacgcgcagtgtatgtacagtgttacaacacattcgccctagtattatagtgtctctaatagcatcgcccagttactcgccttcagctcatctgagtgtcgctaggccgcctgcctgatccaagcagtgtcgctagggggctgctcgaggctttgcctgtgctcgggcgtgttttgggaggcttcaggacggccttgtgtttgctcgttgaaccagctgtcatccttgtgtttccttttggaacctcgtcaatggctcctccggtgcctccgtccctcgtcatcttcagtgtagtgatgatcgtccgcacatcttcccctgagctaggaactgcgtagctctccctccccttggagtgctgcttgcgcttattcccttttgcatccttactgcttgtgcttgaactttcctgcagatgcctcttcgccgagtgtttacaactttacctgcccgggcggccgctatttataactt

SEQ ID NO: 26056 - DNA, 373 bp, Triticum aestivum
  unsure (1)..(373): unsure at all n locations
  Clone ID: PAT_TA_26056
gccttttcacaacaaataattaatctggctgaaaagtctactgctgttagataatctggcttgacgaggctttgtattttactaatttacaagttacaggtagtggtaaatcatccctgaaaatagagaatgtgtttacatgccacccctaaatctctgaatctcttctccatgtattttactagcccttttctagttctgaatcaaagggacattagacggacctttgtcatctaaatctcttctccatgtcccttcacagcttcgccaaggatgaagttccgcgttgctcaactatccgtgattataccggcaattgcagcccaatatagtcgacgcctacgcagacctgttatgaattgtagggaaatnn

SEQ ID NO: 26057 - DNA, 557 bp, Triticum aestivum
  Clone ID: PAT_TA_26057
caagaaaacactttaaataaatctatcaagcataacctgagccccgagggccagactgagcgtcctgactaaatcgttccagccagacagcttcattggtccatttcaagttttcaacagcatttttctaagcagaaacacacacccctttcacatatggaagaatatataggctcggataagcttgcacaacacaaacattgcaagtgttgtaagcttcaaagaattgtagtacttgaactcaaaaactgttcagcagctgaagcgatagcaatctttcccctccaggattacaccttccaccgtcttgtgtgctcagcacacagcatctccaggacagaattgaactactcagtccatgtagcgcccaacatcttcgacataaaactgtaacggtccgcggcctcatcaatcaattttttagtcggcctgccagctccatgccctgacttgcggtcaatgcgaccaactattgggttggtctgcgggctgttctcaatgctagtgcacaagacatgctgcattgtagccaacaacttcagcgagtgcaatggcac

SEQ ID NO: 26058 - DNA, 1467 bp, Triticum aestivum
  Clone ID: PAT_TA_26058
ggtctcgatgatactttaccgtgccccacgccccccgagccgggctgagcgtcctgacttaatcgttccagccatgcagcttcattggtacaatacttgaattaaacaagaaaacactatacagaaacccatcaagcataatcagagccccgaggacatgactgcgcgtacagacttacatcgttccagccagacagcttcattggtctttttcaagttgtaaaacgcattcttctaagctgtaaaacacaccacttgctcatacgcaagaataaataggctagtttaagcacgcacaacacattcgcgcccagtcatctaagcacataaaactggaaggatccgcagccacatcaatcaattttttagtcagcctgccagctcttatgccctcaacttgcagtccaatgcgaccaactattgggttggccgtgcgggctggttctcaaatgctaggtgcacaagacatgctgcattgtagccaacaacttcagcgagtgcaatggcacaacgcgatcatcatgatcagctgtcaacagcatggttgctggatactgacaattatcaccaaagctttgctcccaaggtctcttcacgttatgaaggggagaatatttgataagccagccgaattcttcttccttatctgaacaaccataatctgtagtccaggcatgaccgattgtgaacttgtgaaaccgaagcatatccatgacaccaacatgagccagggcacacccaaaaaggtcaggccgctggttaatacaagcagcaattagaagaccaccattgcttccaccttcaatacatattttcttgttacttgtgtaaccagaagaaataagttgttccgcacaagcaatgaagtcatcaaaacaattctgtttctttgcaagtgccccagctttgtgccactcctcaccatattctccaccaccccggatgttcgcaatgcagacaacggaacccatgttcttgcataggacaggacgactaacactgaaagaaggggtaatgcttatgttgaatccaccataaccatatagcaaagttggatgtgatccatcgagttcgatatctttcttcgacattatgaacatgggaatcttggttccatccttactagggacaaaaatctgcttaacttcaaagcttgtgcgatcgaacccaggaacttgaaatttctcggaaggtcttcatttcagggattgtagatgctaagttacacctataaataataccgggagaaagaaagctcgtgaagccaataaaaacttccttgtcttcccgtctacaagagatctctgaaacagaaccaatctttagaggcaactgatgaagcaaatttccagttataaggtctcttatctgcagagtgtgcttaacatcttgacatgtaacacaccaccaactggtttccattaaccgcgtcagctgactcgagccccgcgccgtcttccgcacgag

SEQ ID NO: 26059 - DNA, 594 bp, Triticum aestivum
  unsure (1)..(594): unsure at all n locations
  Clone ID: PAT_TA_26059
gcacgaggctcannngagagctcaccacattttcttccatacttgctttgaaaaggcgtttaatatgcaatctgcattagactaaataattttctatgttgagcttccaattcatctcctaaacttaaagcctagacaatctgtgagatactaaatgactgaacttccctgaaccttgtactcatactacagtcaaaaaaaattgcccacatgataaattctgacattcgctggtgtggaaaggataacaaaagctactgctacataccttgacatacgccagcaacaacatccaaacacaaacagcgggcaccttcagcgagcagagcatgcagcgtctggtcaggggatgtgaagaagcttcaccaccatacaacgttgtcgatgtacacgaaccaagcctcataggttgtttgctctaggtccatctcttttgtaaatctgaaattgagttgaattgttgctcttggtcaatgagaggcaagatccatggagggagattggatatctgggttagaacttggtcttgaacatggtgtcaggacgctgtggacacagtcaggggcgcagctggtagaaagtcaaggaggaatc

SEQ ID NO: 26060 - DNA, 957 bp, Triticum aestivum
  Clone ID: PAT_TA_26060
ggaaagaaaaggacgagattatcactcaggtcatggctgaaggagaagagctatcgagaaagcaggctgctcaagaatctacaatacgaaaactgagagcacagattcgtgagtttgaagaagaaaaacaaaggttgaactcaaagattcaggttgaggagacaaaggttgagagtattaaaagagacaaggcagcaactgaaaagttgctacaagaaacaatagaaagaaatcaaactgagctcgcagctcagaaggagttctacacgaatgctcttaatgcagcgaaagaggctgaggcattagctgaatcaagagtcaacacagaagccaaagttgagctcgagagccgtttaagagaagcctgtgaaaaagaaaatatgctgattaacacaattgaggagttgaggaatgctctcaccagacaagaacaggaggctgctttcagggaagaacggttaaaaagagatcatgacgatctccaaaagcgctatcaggccagtgaacttcgttataatgaactggtcacgcaagttcctgagtcgacaaggccactcctaaggcaaattgaagccatgcaggagtcagctgctcgaagggaagaagcttgggctggtgtggagagaaccttgaactctcgccttcaggaagcggaggcgaaagctgctgcctcagaagaaaaggagcgatctataaatgagagactgtcacaaaatttatcccgcataactgtcctggagacccagattacaattcttaggacagaacagacacagctgagccgatctcttgaaaaggagagacaaagagcatctgaaagtagacaggagtacctagcaaataaggaggaggcggcattacaagaaggacgcgccaaacagcttgaagaagaagaagaagaagaagaagcagaagaagaagaggagctgcaagaagcagcagaacacatggggctgc

SEQ ID NO: 26061 - DNA, 1398 bp, Triticum aestivum
  Clone ID: PAT_TA_26061
agtcggcccgacgacaaaacctgtccttaacaggatggtactgacctgcatacaggtgctgcagggctgtcgtcagctcgtgtcgtgagatgtgtggtcaagtcccgtaacgagcgaaaccctcgttttgtgttgctgagacatgcgcctaaggagaaattgccaccgagtgacgtgccagcgctactacttgattgagtgccagcacgtagctgtgctttcagcaagaatttcaccattgggagccggtgcctttcgaagaaaggaccagtttcgggatcagaaactggtcacacaagttcccgggtcgactagccgctcctaaggcaacttgaggccggcaggagtccgctgctcgctgagcagaaccctgggctaggggggagagagaccttctctctcgccaccggggtacctagcaaataaggaggaggcggcattacaagaaggacgcgccaaacagcttgaagaagaaataaaggagcttagagccaggcacaaaaaggagctgcaagaagcagcagaacacagggcgctgcttgagacggaccttgaaagggaaagggctgccagggctgaacttgagaaagcgtctccccgcgacttgcctaaaattccacttccagatcgacccacgaatcagcttgaaggaaagctatcgaggcttagtactaggcacagaaaggagctgcctgaagccgtcgttcgccggggccgattgtgccgcattttggaagggaatgtctgcacacagtaatatgtcatactatctgaggagcatgactccaagtgcttttgaatcagcactccgtcaaaaggatggagaattggcttcttacatgtcacgcttggcctcactggaatctattcggaattccctggcagaggagttggtaaaactgacggaacaatgtgaaaagttgcggaatgaagctgctgctctgcctggcctaaaggctgaactggaagcactgaaacaaagacactttcacgctctagaacttatgggggaacgtgatgaagagttggaagagttacgaaatgatattgttgacctaaaggacatgtacagagaacaagtggatcttcttgttagccagctccagacattgggtgcccgtgtatagtgcaattgacccaacaagataacagttttgaaggccgaacatgtcccgtcagagttgagaaaaccgcggcgagtgtgggaagttgatagtcatacgaggaagatatattttattgattttgtgtacatcgtgaagagtggatctttgttgtaggatagtgtgttgtacactagactgaatagctccacagctctacattcattgatgattttcatgcaaagttttccttcacagaacacaaaaaaaaaaaaaagtgtattaccatatttgg

SEQ ID NO: 26062 - DNA, 378 bp, Triticum aestivum
  Clone ID: PAT_TA_26062
cccacgcgtccgcccacgcgtccgacttgacatatgcatcagcgagcatggtgatgaggtgagagttggaagcgtggatgtacttgacaaggaccaagtagatgcgagcaagcatggtgggcaatgtcgacgatggtcacgtcgatgagaagaccgaagaggaaggcttaaatgtaattagccagtgtctttggacaggttgtcgacagataaaagttctatagtttggcttgaggagtaacatagacaggcatgctggtgctataaggctatatctctcttcgtggacaagagcacataatgcttcaagtttcatggaagttttttaaattctattatgaggctcaatctgaaataaaatcgggtcttgctttaccc

SEQ ID NO: 26063 - DNA, 765 bp, Triticum aestivum
  unsure (1)..(765): unsure at all n locations
  Clone ID: PAT_TA_26063
tcgagcggccgcccgggcaggtacgtgaaaactggcgaacaaaggtggaggcaacagtgtcgccccatgcatctgaacaagtgaggacatgcatcgaaatagcgttgaaatgtgtggaggatgaccgaacgcgaaggcctacaatagcccacattgttaatgaactaagtaacattggtgttgctaaaggatcacccattcgccagtgggcggacaagctgactgcgttaaagaccttgttattatccactcacttcaaacattggctgttcctctttgtcgcagcgatttccatgtttttcgcatgggctaaattctgtccagattcatggtggcaaggcattacaaggagaacgtaaaccgcagcacatactggatgccttcatctacgcgccccgaaaggcggtagcagggagaatagtttctatacgaaggatgttagtgatttccatattagtttctgctgtcaagcaagcaaatggctatcttcggtcagtagagtgctagggcgtccactgatgtcccagccgcagcttctggagccgagctgcggtctcaagctttggcgaggcggcgagctccctccctccaaccaaggactggcgcgaggtgtttgacgaaanngtcagaaggaaggcattttgtttccttttctcttcgccttttttggcaataatgtgcaagtatatttgaaattggtttcatttatgcattagganntgtggattagcaaacaatttctttgggcatttaagcttagagccc

SEQ ID NO: 26064 - DNA, 532 bp, Triticum aestivum
  unsure (1)..(532): unsure at all n locations
  Clone ID: PAT_TA_26064
tcgagcggccgcccgcgcaggtacttccatggcttcgcctcacatcgctggtctcctcgcctacctgctctccctccagccttccaaggactccgcctacgccgtggccgaaatcagccctaagaagctcaagaagcacctcatctccttcgccaccgagggtgtcctcagcgatgtcccaagcaacaccaagaacattcttgcatggaacggtggtggtgagggtaacttctccgccatcgtggagaagggtggatacaagggcaagaatgagtctcctgcaccagttgacctcaaggaggacctcaaggagaaggccggcgacttcgctgataagattgctgagctcgagaagaagcttgagaaggacgttcaggacttcattggtcagctcaagtccgagtagacaatctgctgagcccgagattggacgggcaatacgccatctccggccggtcatgagtcgatgaacggctctgtctgaagcacgaagaggattgcgtacctgcccgggcgccagctcgatcnnttc

SEQ ID NO: 26065 - DNA, 627 bp, Triticum aestivum
  unsure (1)..(627): unsure at all n locations
  Clone ID: PAT_TA_26065
tttagcgtggtcgcggccgaggtacttgagcgtgccgtatgtgcccagacctccaccaccactgacccgaaggaaacatcggtatggacgataagtgaccgcgccagccagcaccggtagccaactccaccacaagaacaagagccctgatttgaccgatgatcataacaatgcccatggattccgccataggcctcgttcatcgatccagtatgcgacccgggaagactcaacaaggccagacgttgggactttcatcatgaggatcccctcccaaggcttggcaattagctacgtaatacttatggacctcttcgccgcctttccacggaaggcaacatatgcccttccatcgctgacttaagtagatatcggcaatgcaatcaggctgatagtcaaaatcccagtcatattgtgcatttatgcatgcgccgccgtcgccgaaatctccacgattaacgttaaggcaggatatcggagcccagtcgaatttgttgccaggaggacagcgctcagcggcgaccgagacggtagctgcagagatggccgcgatcaggatagttaaagtcttcatgctggcgatgtctgtnnnngtgatgtttcgtnnnnncaantnnnntcgtttcn

SEQ ID NO: 26066 - DNA, 778 bp, Triticum aestivum
  unsure (1)..(778): unsure at all n locations
  Clone ID: PAT_TA_26066
cagnaccgccggactgctgtcgccggccgttcctacctgtacctggccgcccgccgagatcaatctggttctggtggtcgctcgtcttcttgctcctcctctgcttcacaccgtccattgccaaaacaaggtgatgctccgcttgggtgcaggcattcatgctgtcgccgaatagtcattcatactgttgataactactcaagcgtggatgtgcatgcttgtgttggtggccaaagtaacagggaggatattaggaagctcaaggaggctggagtgcaggccatgtgatcaagggaaggaccttgtgcacaagagtcatcaagctttcagggtgaaggcatttatactgtcgccaaataggcattcatattgttggcaactacttgagcgtggatgtgcatgcttgtgttggtggccaaagtatcagagaggatactgggaagctcgaggaggctggagtgcaggttgtgtccggaaccctggctagagtctgccatgtgatcaagagaaggaccttgcgcacaagagccatcaagctcctagttctggatgaatccgatgagatgttgagcagaggcattaatgaccagatatgtatacctccccccagaactttaggttgatcttcaaatgtagtttatcattctgtcctgtcagctcgcttagtcttttcgctgcagaattcaagttgtcacctggtggtattttttttaatctctgtatcaccttctgacttgttttttcattgagcaatacaaatgtcttgcactttttcgac

SEQ ID NO: 26067 - DNA, 417 bp, Triticum aestivum
  Clone ID: PAT_TA_26067
tttagcgtggtcgcggccgaggtacttcaacacggcccaggtgagaaacgggatgagggcgatctccaaaaactcttgctcgtgatcggcgtaggatgatagcatcgggttggggtgcttggtcaagtggtgagtgcggtgatattgccagaggtagtccaattcgtggcaagctcgatgatacgcgtagaagaatccatcgagaacgactgagtagagcgccaactcgaccggaagccaccagctgagttgcatgcctccgcggcgtcggtaggcaaagagcatggtcatcattggccgaatcgaggtggtcaattgcagtgatgcgaacaccttgttgacaccaacatctgggacctcatcccgggcgtgcttgtcgccgtcgaggtagccgtacctgcccggcggcccccccaa

SEQ ID NO: 26068 - DNA, 1047 bp, Triticum aestivum
  Clone ID: PAT_TA_26068
aaatgaatttaatctctataccccaggagcctgaattagaagagtttgatgatgattacttaaaccaccgccaagatgccgtgaagatgatgagggctgccacaaaacattctcaggctgccagcaatgcattcttcagaggtgaccatgctgctgccaaggaactctccctcagagctcaagaagagtggttggctgctgaaaagttaaataataaggcagcagaagaaatatttcatctcaggaacagcaacaataacatttggaagatagacatgcatggtctacatgcatcagaggctgtaactgcattggagaggcatcttcacatgttagagttccagccaccagggaataatccaacttcaactgatgaattagataagtctgaacccacaattgctgtcccaaatgaggtggcagcagagaaagtggtggtgtttcttcgccctagacagtctgtcttagaggtgatcacagggattggcaggcacagcaaaggacaggcttcactgcctgctgcagtcaggggcttccttattgaaaatgggtaccgatttgaggagctgaggcctggtgttttctctgtccgccctaaatttcgccgcgggtaaacctgtgcaagactgaaaccattccatcaagttccgttgttcggcaaataaatttctgtgaaatgtgctgtcaacgaaatagaacgtagaaacttgggcaacttgtagttcgtgtatcttgaatgtgggaactaggcgtcgaccagttggctagtgatgcgctaccagctgcgcgcccagcctttcaccatcgtccgagccttgtgttccgcagggtgcgtgcctgattttagtttttcttaataaattgtcgtaggggctagtccgtatgggtctccttttttgttgtatcttgaatgtaacaagttttacagatactaatgttattgtgtagccacctgacaagagatgcataattgtatgtaactatatacaggatgacaatcaaggccacaatgtactgttattttgcttactgctgcaaccaaggctc

SEQ ID NO: 26069 - DNA, 537 bp, Triticum aestivum
  Clone ID: PAT_TA_26069
ctcggatatgcaatgggtcatgcaacgactcttcctcgagccagcctatcgaaatgctgtatttacatggcagtcgtccacatataaagatacacagggttaggatccattctgccaatcactgccccattccacaccgcttcgcttgaacagttgagtaataggacacctcctctcagtctcgctcgcaaacttctcaaagtccaccttgctagcctctgcatccaccctgaccttcaagctgatagctttccaattggcgttcccttcgactccctgcgtcaacacgctcggatccaggtggccggctacctcgacatcccacttcccaagattgatgcccagatccttggctaccaaagatccagtcacctgcgtgcacgaggagagcgaggtcagattgaagtgcagtggcgatggagctgcatctttgccgccaaacgcagggtaggcatcggtcgtgagcttgtgcgaggagttcttgacggagacctcttgagcgacgccgtcaccggtacctcggccgcgaccacgcta

SEQ ID NO: 26070 - DNA, 503 bp, Triticum aestivum
  unsure (1)..(503): unsure at all n locations
  Clone ID: PAT_TA_26070
tcgggcggccgcccgcccaggtactgtttctcctcgaactcacacatactcttcccatcatcagcatcaaaccgcccttcaattagtcttatcaacctcctcctccttctccccaatactcttcttcaaatcaatacaagcctgctgctccgggctcggcggataaatatcaataaaagccgcatcagcacattgatcctgatatttattcttcatcctctccagcccctccctctcgtcaatcttcttcgccaaatcaatacacgcctgctccgccggcacgggagggaagatgtccggccacacgcgatccgcgcattgatcttggtacctcgcccgccaccacgctaaggaggactgatcaactccaacaagaatatatatgtaaaaaacacccttcgcttcgttgtgtgttcttggtggccatcaattcatgcgcgtctcactctcccgtagtccgtcttnnnttcagnnntgatggaagtcnatcatttacaaggcgg

SEQ ID NO: 26071 - DNA, 365 bp, Triticum aestivum
  Clone ID: PAT_TA_26071
tagcgtggtcgcggccgaggtacagcaaacccatatcttctgctccattcaatgcaatgcaaaacattcatctgacagatggtccagcgctctcttcctcagtcctcgatactccttcttcattcccctgctcctcctctcgccacctgtatcccaacccctcgtcaatcgcatccatctaatactgactagccgcctgctgacaagcctttaactgatccaaataccacccacaaatcgtcagactcccctggttctgatccatacactgacggaaattgttgatatcgttcccgcaagcgccctgagcggcgttggactggctcatcgcggagctctggtacctgccccgggcggccgctcga

SEQ ID NO: 26072 - DNA, 322 bp, Triticum aestivum
  unsure (1)..(322): unsure at all n locations
  Clone ID: PAT_TA_26072
nnagtgcttcaacatagtgaaatgtattgtgtatatacggtagatatcaagaaaaatgtgagggagaggctgtcgcgctctcctcaaaaacccagctcacaatgccctccttcccgcatgctcatccaacatctccctcgtgcgtcgtccacctacaacttcatccccaaaacctgatgcaccttcaaactctgccttatgctcaaatccaacataatctcctcactgccacccggaatcgcatacgccctcacatcgcgatacaacctctccaccttggcaccctgtccaccacgactgtacctcggccgcgaccacgcta

SEQ ID NO: 26073 - DNA, 381 bp, Triticum aestivum
  unsure (1)..(381): unsure at all n locations
  Clone ID: PAT_TA_26073
tcgagcggccgcccgggcaggtacatcatcgaatgcagcccctctaatctatgatcacatcnggctaaaactttggctgcctctgtgaaacatagtggtatgcctttctttaattgtgctcttatttgcactctcctctcaacatacaacagattagagtggtgcaacttcctgcaagccaactcctatcttgcagcatcatcgtgcaggaggatcaccaaccaacctcagatacaaagcttcaccgggcaagcatcgggtagcctacccacagaattttactcagcttgtgttcaacgttcttgaagcaccaagagaaacattttggtccatcattgtttgccttttcatgaagatggcgtacctcggccgcgaccacgc

SEQ ID NO: 26074 - DNA, 532 bp, Triticum aestivum
  Clone ID: PAT_TA_26074
tcggccggccccccgcccaggtaccccgaagagatgatctccactggtatctcagccatcgacaccatgaactctatcgctcgtggacaaaagattcccatcttctcagccgctggtctgcctcacaacgaaatcgctgcccagatttgcagacaagctggtctcgtccagcccacaaagggtgtccatgacggccattctgacaacttctccatcgttttcggtgccatgggtgtcaacttggaaaccagccgattcttcaccaaggacttcgaggagaacggcagtatggagcgtgttacgctcttcctcaatttggccaacgaccccaccatcgagcgtatcattacacctcgtcttgccctcaccaccgccgaatactacgcctaccagctggagaagcacgttttggtcattctcaccgatctgacttcatactgtgatgctctgcgtgaggtctcggctgcaagagaggaagtgcctggtcgccgtggttacccgggttacatgtacctcggccgcgaccacgcta

SEQ ID NO: 26075 - DNA, 448 bp, Triticum aestivum
  unsure (1)..(448): unsure at all n locations
  Clone ID: PAT_TA_26075
tcggccggccccccgcccaggtacgtcgacgcgagctggactttgggcgccgacgccacggcgcagatgatgacgcgtatgatcacgaggatgaagaaggagggtgtggtcgaggtcactcctcatcaatccgccaaggagaagaaggagatgaaggagtcgagtctgctgcgtctcaattcgacatatgtcaagaaggggatgagcgagctgccgaagagtggtgatcgtgggcagtggacgccgagatcatactacttcaaggatatcataatggcgtggtttggcgacattaagacgggttcctcggccgcgtccgcgcgcggagcttgtattgcttcattcaaagctcatgacttcgttactggctaagctgacatcgatcgtgaccgtagtgtccatgcattctgcctttgctcttcgtgtacctnnnngggcggccgctcga

SEQ ID NO: 26076 - DNA, 387 bp, Triticum aestivum
  Clone ID: PAT_TA_26076
tcgagcggccgcccgggcaggtacaaacacatagaaaaatggagtaggtgaacaaacgcttaagatccccagtagtaaacagatagaaacaaaaaaagtcacaccacatcaacaaaatgtcagtatagtatcgcaccttccatacccagatgatgattctccgtcaaatggtaagccactaaacgtcaaaaacccaccgctatgaacattgttcctatgataacatgtaatccatggaaacctgttccaaaatagaaacaagatccgtatgcaccgtcagttatagtgaaagaagaaactgaatattctacatattggaataatgtaaatacaactgctaaaactattgtaaacaaggctccgtacctcggccgcgaccacgctaaa

SEQ ID NO: 26077 - DNA, 754 bp, Triticum aestivum
  Clone ID: PAT_TA_26077
tcggccggccccccgcccaggtacagagacgatgcgctgacacaccagcaggccctcaacgctcacccttgacccaaagcaaccagctccctgcactgcgcttccacaggaccgcaccccttcacttatttcacgggcgcgttgggatcgacggtgcctttcgacttcgcagtttccggattgccatcgccctttgtcgatttctcggatccagctccaatctttgtagagtgcttcgtatccgtgtttgacataccgccttgcttgacggtgatgtcgccctgcgacttgcccttaggcttgctcgccgaggtagctgcaatagctccttcgccgagcttcatcgccttgtcggaagtggtcgaatcatcaccctgcttcttctcagctgtcttgacttcgtccttctcggcaatcttgtccttttgatctttcttctcgtcggacttctcatcggacttgtcgtcggaggacttgtcctccttcttgtcttcggacttttcttccttctcctcagacttctcctccttctcctcagacttctcttcagacttctcctccttgtcctcggagttctcctctgacttctcactctcgtcgcccttctcctctgacttctcctcctcagcaggagcctcttcctctccctcatcggccttttcagcgtgatcgtcgccgtgaccatcgtggtctccgtggtgtccagagtcgtgcgactcttccggccagaggtacctcggccgcgaccacgcta

SEQ ID NO: 26078 - DNA, 422 bp, Triticum aestivum
  Clone ID: PAT_TA_26078
tcgtggcgtggtcgcggccgaggtacgcagcacctataacgctagtaaggatagcaactaacgccataaatacataaccgctatccaacgcggcactcaatatcatctgctttgcaaagaaacctattataggcggaatacctacaaacgaaaacaatgttattgctaaactaattgctagataaggattaatataaaaataaccttttatttgacttattaactgtattggtgagttgtttttctctgtagctactatgttgtatagatcttctttagattcctctttgtttacatagagataaaaagaaaaacccatagtaacaagtattatgaaggcatttaagttagatacgctatattgtaatatgtagaatatgtaagactggatagattctgtacctgcccgggcggccgctcga

SEQ ID NO: 26079 - DNA, 2011 bp, Triticum aestivum
  unsure (1)..(2011): unsure at all n locations
  Clone ID: PAT_TA_26079
ngaacatgggtgntccaaacnctgggaatggngctctttcnnctgataaatcttcanacagaaacatgggctggggagatctcaaagatgctgttgaagaagctaagacccttgcaggagaccgcctgtttgaactccatgagactcaagaggataatctaatactgtctaagcagttagaagatctgcagggtcaattaagccccggctgcggcaccccctccgcgcaacctgacgcgcgtctgggcgatctctgacgcctccgcgatgctgccttggatcgcctcgtgggtgggcgtgtggtgccgctggacgccagcatccacctcctgcccgggctggtcgcttggtgtgctgaaggagaatccgtcgacaatattaaacaatccattaccgcttatgaggccaaaatcgaagaactggaacactcagattctaaaatccatggctgagaagaatgatcttgagatcaaagttgaggaatcattgcaagattcaggtaaaaaagacttcaaggatgagattcatgtcatggctgcagcactctctaaagagatggaaatgatggagaatcaattgaatagatcaaaggatgcggcttctgaagcacttgcattacgtgaagaagctgaatcgttgagaaccttgttagctaagaagatcagtgagcagaaggaaatatctgatagatacaacgcacaagtctctgagatcaagtccctcaaagaattgattgagacgttggaaaaggaaaatcaggagttggaatttattgtggatatgtatgggaaagaatgttctgagtcgaggacaattacagagatcaaggaatcagaaaatcgagctcgcaagcaggctgaatatttgagaactagtctagaggagcatagtcttgagcttcgtgtaaaagcagcaaatgaagccgaaactgcatgccagcgaaggctttgcattgctgaagcagaactggaagagttaaggaccgatgtagatgcatctgaaagagatgttccggaactcaaggaggcaataagaattaaagaagcagaaggagatgcttatatctctgaaattgagacaattggtcaagcatatgaagacatgcagacacaaaaccagcatcttcttcaacaggttgccgacagagatgattttaacataaagctagtatcagatagtgtgaagacaaagcaagcctctgcttcccttctctctgaaaagcatttgttacagaagcaactccatcaggtgaacagttcgctggagtcatctaaacaaaaactctcgcgtggtgaagagcagatgaaagcctatgtcgcacaagctataaaagcttcttcagagaacaggcatcatgcaattaccattgaaaagaccctgctggaggtatctgaagcagagaaggagctcaagtggcttcggtccgccgttggatcctctgagaaagaatatgagcaaaaccagaaaaaaatagctgagctcagaacggagctggagcgtgagagcgagaagagaaagcttgaggaagaatacgaggaggtgaagaatgaagtcacggagctgacctccgagaacgaagaggctactatccagaagctccaggacgagataaaagaatgcaaggctattctcaagtgtggcgtgtgctttgaccgacccaaagaggttgtgatcaccaaatgcttccacctgttctgctcaacatgcatccagaggaacctcgagctacgccaccggaagtgcccgggctgcggcacccctttcgggcaaaatgacgtgcgagaggtgaaaatctgaagcctcagcgatgctgccttggatgacctggtagtaggtcgtttggtgcctctggacaccagcatcaacctgctgcccgtgcttgtctcttgtagatatgcaatggtttccgttgtcccgtgggggcacttagatccagcaaagaagtaataaaacctaagtaaaataaatgaacaagtaacaaagaagtgaaaaagaagtttgttgtaacttt

SEQ ID NO: 26080 - DNA, 942 bp, Triticum aestivum
  unsure (1)..(942): unsure at all n locations
  Clone ID: PAT_TA_26080
tagcgtggtcgcggccgaggtaccttgaccgtcaccttgatactggctttgnnnnattttnnnnacgactacttttgatggcaccnnnnnncctcaccgagatcctcaagacggcatatcgctactaccagaaggagaagacgccctcaatacgaagggctctcaagctcgtcctcgcctacaacctcacaatgcacgttaccatgatcgaaggactcacagaacaggaacaattcagngnccgcntcnnngatccaaagggcaaagtggagtggcttcaccgttgcgcctnnnntgatcaacttnnaagtcaagtgcgctctggcatacatgtggcgcgtcgagcggccgcccgggcaggtcgagctgtcatctctgtatcagtccgtctactccggagagaagctcaaacactggccgaccatcttcatgcttgcggcgattctccttgcgatctgggaagaaatgcagttcgactgccattaccgtgtgccggacgagcaggctgtcaacaaattctgcgatgacatggagacgactcccgttggtgtcatcgttggtctgttccaggcgatctcgaccaagctacccgctctgcaggagtgggacacgaagaagcatcaccaccttctcaattccaacgtcgctgtgtgtgatgctctgacggaggtcaagggccacgtcaacaaatatgagacctacctcaaagaccgctctaacgccaagttcaaccctgacgatttcgactgtctcaccaacaagttcctcagcaagctggtcatccgcgcgaactagatcatgcatcacggtcttgcacttgcccgctcacgatatcgatgaacatctgtgnttatacatgacgacctcgactttacgcacgatgaatcacaccactcacgtcnacgacgatgggtccatgccctcacgagaannnnnngcatc

SEQ ID NO: 26081 - DNA, 363 bp, Triticum aestivum
  unsure (1)..(363): unsure at all n locations
  Clone ID: PAT_TA_26081
ttagcgtggtcgcggccgaggtacgcacgggaagatgcttgcttagtcgttccgtatctcatgctcgtgatcgctcaagttatgttgatgtgtgaagttcgtgtgttatcgtgaatgctcttcgaacttcatccgttttgttgcattcctccttgacattattctgtgatgttgatgattcccggcgaggagggttcgtccaccggcacagaagttggcttctcagtgaggtgatacgcttaagcgccctcatcatcgtcaccgacgcggatggcaccctcgccgttgagaccgttggcccagaagccaccgaggtcggcgtgcatctcgggggtacctgcccgggcggccgctcgaacaann

SEQ ID NO: 26082 - DNA, 583 bp, Triticum aestivum
  unsure (1)..(583): unsure at all n locations
  Clone ID: PAT_TA_26082
tcgagcggccgcccgggcaggtacgttgcgcctgctcttccgacgactctgtcaacatcaacacttgtcgcgtcccagaccgtcgacaacaactacgttgcgaccgttgtcgagaccgtctacacatatgcgaccgccgccgtctcccaaggcgaggatggtgtcctccacgtcaaccccaaaaggcaccagcaccacccccacggtcacgctcaatagcgactttcgaccaaaatcttcacgacttcaattcttactagctcggcttgttcgcttcactctttcgcgcaaagacagccgatgcccgaacctcttttcatattgcacttgcttcattgtggattaacataacacacacctttcgtcaacaacaaagagaaactcttcacacttctgcgcctttgtttgagacgaagccagaaggcacgtttttccctcttctctcagcgaaaacattgatgtgtttcccgctgctggccaaacagagaaggaagctgttcatctctactcgtccactgtaccgccgccccgagcgcgctgagctnnntgccgtcaccagtnnnnnggttcgataacgacccga

SEQ ID NO: 26083 - DNA, 452 bp, Triticum aestivum
  Clone ID: PAT_TA_26083
tagcgtggtcgcggccgaggttactcgttcgcaaccacaggagtcacgccggcggcagtgagggcggtggtcaggaactcgacatgggtctgttcatcgctggaaatggtctggaggttcttgtagaacacgttatcgagaccgacggcctggaagtcggcgagggtgaacttctggagaacctccttgtagaatgtgttctccaagtgctcaagagtcaacgcgtagttgaggatcacaccatcggagggaccgcccttggtagcctggcgcttggtgggagccgcagcggacagcgccgcgaaggcagtagcgatgagagtagaacgcatgttgattgatctgaacgaatgtatgtgggtaggaggtagattgatgctgtcggccgccccgggcggccgctcgagtgactcctgtggttgcgaacgagtacctcggccgcgaccacgcta

SEQ ID NO: 26084 - DNA, 785 bp, Triticum aestivum
  unsure (1)..(785): unsure at all n locations
  Clone ID: PAT_TA_26084
tagcgtggtcgcggccgaggtgattggtgtcaccaagggccgcaccaaggctctcctcatcttctggaccgtctgcatgactgccttcaccggtgccatctccgtcgccaccaccaagaacctgacacccacggtttacccgcttgtgacccttgcttccatcgccgtcggagctgtcatcattccctgctccatcatcgcgcaggtcatctgcccgaccgagttcatcggaactgttaccgccatcactctcgctattcgctacgtgggtggtgccatcggcttcacggtctactacaacgtcttcttctccaagctgaagcacaactacctgccaaagcttgctccaagcgtcctgaccatgggcctgtctgtcaagattgtcagcatcgaccaggtcactgcagagctcactcgctatttcaccatggcggcgcagggtcaattcaaggccttggagactgctattcgcacagaggactttatcaacccctccagcaaggacactgcatacgacatcatcatcggcgtcacgcaagaggccttcgcaaaggcttaccgctggccatactggatctccatcgctttcggtggtgcttgcatcattttggcgctcttcatgagagatatccgccagcacttgtagagaagtgaggatgcttctctttttcgtatcgttgttgggagtgctgaaatatgtgaggactagaaaaggctccgctctgtgacgaaatgcaggcgggccgcgaattgtacctcggccgcgaccacgctaaatnnnnnnn

SEQ ID NO: 26085 - DNA, 283 bp, Triticum aestivum
  Clone ID: PAT_TA_26085
ccggacccaacaccgtctgtactgtaccccaaaaggaagaagaaaacatgtagtagtaatgttgtaacggagttacccgaaatctgtagctgttttgtggcgcggcgtcgctgtgagcgagtgtatacgggctgttccgtggtgtgcttgtgggtcgcgtgttgcgttgccgtgggactggcggaagtgtcgtgtgttgtgtgggtgggtgctgtgtatttgcgtacctgtacgtgtactgaccatgatgccttgtttgtgcgttcaaaaaaaaaaaaaaaaa

SEQ ID NO: 26086 - DNA, 626 bp, Triticum aestivum
  Clone ID: PAT_TA_26086
acagtgccactaaccaagtactgcaccttcccgcacagagctgaggcgaactatggagcagcgaaggtcatgctgaggcctgcttgccctggatctggtgtcactgcaggtggagctgtgagggttgtgctggagatggctggagtagaaaatgctcttgggaagcagctgcgaagcaagaaccccctcaacaatgcaagggctaccgtcaaggcgacgcaaatgatgagacagttctcagacgtcgctgcagagcgtggacttccaatggaggagttatggaaatgataaaacaaaatcattcaactgcctgagggaattcttttcttttttctctactgtatttcttgagtttgttttctgttgtatctatatattgggataaataggggtgcaaatgggggtaccctttgggggtactctatatgacttctgaaaatttagttcacttggttgaactaaggtgggtcggactttgcatactatggacgattgttcgtcaagttttcttccttaatctcctctggcattgtagaaaattaagttggtctccaaatacatgtagcaaatctacaaaactgctttttttctggttactgagtttgttacagattggtaaagcaaaa

SEQ ID NO: 26087 - DNA, 680 bp, Triticum aestivum
  Clone ID: PAT_TA_26087
cccggtcgacccacgctccgcccacacttctctgctcctccgctccctcgcggcctcgcctcccctcgccggagcatcaccccaagaacctgccaaaaggcggccaccgccacagccatggcgatggccaccacctccactgccgcccacgttgttcccgcactgttctccttccttcaacagcgcctccgtctctgccccaaagcccgtatctccacctcccgccgcctcctgctccctgtctccaagttctccacccgggacggttcggcctcctaccaagaagaggatgaggaaggggaggcggaggattctgcggaagccgccttcggggacgaggacgacgagaagccgcagccggaggcggtgtcctctacggagtttcagttcgcggcaccaccggagggatacatcgagccggcgccgttcgacgagttgccgccggaatcaccagaggacgtggcagcagcctacgagtcgctctacgggccggccttcagcggcgagtcgttgatggggaacaacgtgttcgaggtgaaagtggtggaccccgtcgacatggaccgggagcagcgccccaacgacgagttcagcgagcgtgtcgtgcaggtcagccgagtcaccaaagtcgtcaagggtgggaaggcagctctcctaccgcgccctagtcgtggtcggcg

SEQ ID NO: 26088 - DNA, 892 bp, Triticum aestivum
  unsure (1)..(892): unsure at all n locations
  Clone ID: PAT_TA_26088
gcgcagatcgccgcgcgcgccccgccgcccatgccccccgccgccgcgcccgcgggcggcgaggagctcgacctcttcatgacacactatgtgctgctcctctgttccttcaaggagcagctccagcagcatgtgcgcgtccacgccatggaggcggtgatggcctgctgggagctcgagcagactttgcagagtcttacaggggcatctcctggcgaaggcaccggggcgactatgtctgatgatgaagacaacccggtcgacagcgagagcaacatgtttgacggaaacgatgtgtcagatggcatgggcttcggaatgctaaccgagggtgagagatccttggtcgagcgcgtgaggcaagagctgaagcatgagcttaaacaggggtacagagaaaagcttgtggacatcagggaggagatactgcggaagcggagagccggtaagctcccaggagacacggcgtccactctgaaggcgtggtggcaagcccacgccaaatggccgtacccaactgaggaggacaaggcgcggctggtgcaggagacggggctgcagctgaagcagataaacaactggttcatcaaccagcgcaagcggaactggcacagcaaccctacctcgtcctcgtcggacaagagcaagagaaaaaggaacaatgcaggtgacggcaacgccgagcagtcctggtgtgcgggcgcggctggagagcgaagaacgaatgccccatatatgtacatagcgtatatgtcttggagattccatgatggagaaggctttgacactgctatttattgctcgggagacgacgtcggccgctattcgcgcgnggcgtctcccggaggaccccaccatttgtgttcccccaacaaacccccccaggggggtt

SEQ ID NO: 26089 - DNA, 664 bp, Triticum aestivum
  Clone ID: PAT_TA_26089
aacaagaacagcttataataggatgtataaaaaagtagtagcattattctgcacagattcagaaaaacagggtaaggaaattggtgataattatacactatcatatcatggttgttgctactctacaagatttactcctgcaaataattaagagcgctcgacgtcgctctcagcgtcgccccggcgagacgacgtgcgtccgcgtcactcacacgtcgacggtgcagtaggacggctgcgtgaacttgagcgagacggtctgcttgccgcccaccgtggcgctcatggcgaaggcaccgccgacggagccgccgctggcggagagcagcgcggggcagttgacgaagatgtggtagccgccggagacccagctgccgaccttccacttgacgcggccgtccaccttcacgtgcagcagcacgtacccggcggcgatgtcctgcttcatggcgtccgccacgtagggggccaccggcaccgagtccccggacatcaccggcgaccacaccgactggtccttgtgtccctggtagatcgccggcagcgacaccggcaccgtcaccggctcgtcgcggtacgtggtgaaggcgtgcagggtcttgtagtagatgcccacccggtcgttcgggttccgcgacgcgatggtcacctgtgtcatacaccc

SEQ ID NO: 26090 - DNA, 1277 bp, Triticum aestivum
  Clone ID: PAT_TA_26090
attgcaacatgccattttggcatagatcttcagacttaacagaatacaccatacagtttcctatctatatggaagcatttgctgaccttgagttacatagtctgcggagcgcatgagttgatgatgggtttctgtatctaattttacttgattttgcttgtttcgtgtacttgaatcaaatgatacaacctgcgaagctgctggtgtactatcttttagtgtaaaaacttcttttcctttgctaattttgttcgcattctttgcagtcagggagagctttgcctgcaaggaagttctggacaagcacaagggcttgccgcggctggtagctggggacctcatggcctgctcctctaacagttaccaagctgagatcacccttgtactgcacaatgtatccacccacctctccggcacccttggtgctgctgaaccatggcctccattttgccgccacagggagctggagctggttgacagagagtctactggaagtgacgggcactctcccgtcagtgtctccactgtaaacccagactctgatgttgttcttcatcagctcccggataataggcaggactgttttggcgctgtcgacccagcgtgtcaagacgtcactgcaggctgaccaggggtggtcgaggcgggtgacgttggcgtgcatcgccttctgcacgtccgggcggttgaggtacgcttccacgtagtagtccgtgcacggatcgaagttttcgatcgagggggcgatgggcggtgtgacgagcttctccgactggcagttgggcgcgtagatgttgtagatgtcgatgtcccggaggctctcgctggcctcgtccgacgcgtcgtcgcagagcgcgctcggcgccgcgccggcgccggccgccgtgaagttgcagttcttgtcgatgccctcggccgtctcgtcggagatgagcgcgtgcgtccagaagaagtcgtacatgcccttgttgtccgtccagtcgttgatcaccgcgttcccgatcatgatgcctttgaggttgatggccggggaggcgtggcggaggatgtcgtgggccagctgcggcacgtagtggccggcgtagctctcgccggtgatgtagaactcgcggcccttgtactccgggaagcgctccagccagttggccaggaacaggtacgcgtcctccgccgtcttgttgtccccgctccggccgtagtccgccgtcgtgttcgagtacgagtaccccacccccgccgggctctccaggaacagcacgttcgccgcgggttccagg

SEQ ID NO: 26091 - DNA, 2073 bp, Triticum aestivum
  Clone ID: PAT_TA_26091
ctttccaccctacctccccaccacttctcttctcctcccctccgctcccgcgcgccctcgccctcgcccgcccgtcccccaaacaacgcaccaagaaacagtcgcggcccccgccacagccaaggccatggcgatcacctccacctccgctcacgccctccctgttctcgtccctttctcccaccagcgcctccgtctctgccccagcgcccgtacccccacctcccgctgccgcctgctccctgtctctaaattctcctccccggaccgttcggcttcctaccaagaagaagatgaggaaggggagggggaggattctggggaagcggcccacgcggacgtgggggacgagaatatgcagacgatgccgggatagtctacggagcttctgttggcgtcaccaccggagggatacaccgggacggcaccatgtcgccgaggttgacgccttaatcaccagaaggacatagcgagcagcctacgagtcgcacgtcgggccagccttcagccgcgagtcgttgatggggaacaacgtgttcgaggtgaaagtggtggaccccgtcgacatggaccgggaccagcgccccaacgacgagttcagcgagcgtgtcgtgcaggtcagcccgagtcaccaaggtcgttaagggtgggaggcagctctcctaccgcgccctagtcgtggtcggcgacatggaagggacacgcttggtgttggcgtcggcaaggccaaagaagtctcagaggccatcaccaaggctgccatgaacggccgccgcaatcttcgttacagtgccactaaccaagtactgcaccttcccgcacagagctgaggcgaactatggagcagcgaagagtcatgctgaggcctgcttgccctggatctggtgtcactgcaggtggagctgtgagggttgttgctggagatggctggagtagaaaatgctcttgggaagcagctgcgaagcaagaaccccctcaacaatgcaagggctacagtcaaggcgacgcagatgatgagacagttctcagacgtcgctgcagagcgtggacttccaatggaggagtgatggaaatgataaaacaaaatcattcaactgcctgacggaattcttttctttttctctactgtatttgtttgagttcgttttctgttgtatctatatattgggataaataggggtgcaaatgggggtaccctttgggggtgctctatgtgacttctgaaaattcagtttaagtgtactaaatgagactgctgagagtttggttcagttgcttgaactaaggtgggtcagactttgcatacgtatggacaatcgtacgtcacgccggtttcgttgatctcccggcccttggtgccaaagtaccgaagcagccctatatacctaaaaagttccgcctcccccgccgccccgcggtccccgctccggccgccgtccgccgtcgtggccggggacgcgtgccccaccaccgccgggccctcctgcggcgccacgtgccccgcggcgccctcgccggcgtgcccggtcgcgcgcccctcggccccgcggtggcgctccggccggcggacccgggacgcggtcgcggcctcccccggcccctggtccccgcgccgcgcgtgggccgccggccggcgcgcgtgccgcgaccccgcccccgccccgccctcccgccgcaccccggccgccgcctccccccgccgccggggggcccgggcgggcgccgcgcccccgcgcacgacgccccgccgcccgtgccccccccggccgccgcgccccagcggcgcgccccccgcccccccgccgggcccgccgtcgcgggcccggccctcggtcggcggcccgcccccctcgccggccccgccggcgcccccgccccgcgtgccgaactcggcgcggccggccggcgcgtccaccgtcacgtacccggcgtactgcgcgaagtccacgccgctcggctgcccgggcagcgcctccacgcggtcggcctccttgcgcccgacctcagcagccggcacaggcctggatcttctgctagccgtcttctcgaaaaaaaaaaaaaaacgccctaggg

SEQ ID NO: 26092 - DNA, 822 bp, Triticum aestivum
  Clone ID: PAT_TA_26092
tgcaataaattaagagcgctcgacgtcgccccggcgagacgacgtgcgtccgcgtcacacgtcgacggtgcagtaggacggctgcgtgaactgagcgagacggtctgcttgccgcccaccgtggcgctcatggcgaaggcgccgccgacggagccgccgctggcggagagcagcgcggggcagttgacgaagatgtggtagccgccggagacccagctgccgaccttccacttgacgcggccgtccaccttcacgtgcagcagcacgtacccggcggcgatgtcctgcttcatggcgtccgccacgtagggggccaccggcaccgagtccccggacatcaccggcgaccacaccgactggtccttgtgtccctggtagatcgccggcagcgacaccggcaccgtcaccggctcgtcgcggtacgtggtgaaggcgtgcagggtcttgtagtagatgcccacccggtcgttcgggttccgcgacgcgatggtcacctggacgtcaagggagagagccggatcggcgaggtcgatggagcggagctggatgtcctggaggtagaaggagggcttggaggggtgcagggcgaggtagatgacgagcgcgacgaagccgacgaggacggcgagcgtgaggatgcaggcggcgatggagccgcagcaccgccggaggatccagtcgtggtgaaccttgcccttgctcatggtggcctgatcaactgggcttcggtgtgtgtgtgtgtcttcgagtgagggctgctaactaggactgtggctgtttgcgatgtgtagcatgtgggtcgaaggaaagctcggtgtgagt

SEQ ID NO: 26093 - DNA, 679 bp, Triticum aestivum
  unsure (1)..(679): unsure at all n locations
  Clone ID: PAT_TA_26093
gccggcgtctctcttcccctccattcctcctcttctccacatccacccgaacggaaccctagtctcccatcacttggatccggtctttgacattctccggtgcaggacgccgtaagaatttcgctagagatcttgcagctgccatggcggacaatgaacctgttgacccaaagaattaccttgaggaacgctgcaagccgcaatgtgtaaaatcattgtatgactatgagagatgtgtgaagagagtcgagaatgatgaaactgggcagaagcactgcaccgggcaattcttcgactactggtcatgcgtcgacaaatgtgtagcaccaaagctctttgagaagctcaaatgatggatgggatggcgctgattgccccagatcccaataaatcgatccactgtcctgatttctggttgtgctgaacctgtaacaaggagcttcgttctatctgttgctaaaacttgtcaaaacaagcaaacacaattattttggcagtgggaacaattacttttattttgctcatgtaatgcattctgttctgttatacttggacagatgaaagcatttctgctttacttcaacccatcttcaataatttttgcagattcaaaaaaaaaaaaaaaaaaaaaaaaaaaaaaaaaaaaaaaaaaaaaaaaaaaaaaaaaaaaaaannnngg

SEQ ID NO: 26094 - DNA, 1913 bp, Triticum aestivum
  Clone ID: PAT_TA_26094
cctgcaattaaactgctttgatttgcatcgctttacaacacggtgctgatcagaattatttgtctttacaattaaactgctttgatttgcatcagctactagtaggcacttactgtacatgcatatgaactgtacacacacataattaattatgcatcagaaatcaatcagaatgatcacatagacattatggacatgttgcgtctggattggagctgttggagatgaggacgatcgatcaggcctggatggaggtgggctggatgacggcgtccaggtcggccctcatgctcttgttcttctccacgttgtggtcgggctggagctcgccgtcgccgccccagatctccgggatggctcgccggaggccgccgatgctctccagcgcgtagtccgcctccttgctcctcgccctcttgccaaccagggccgtgcggaggccgagcgctttcccggcggcgatgttcctctcgctgtcgtcgaggaagagcgttcggcctgggtttgtgccggcgacgcgcagggcggcgacgaaggcgtggacggacggtttcaggacgacggcggggcggtcgacgtcggcggcggcggcctcgtcgtcctcgccctccagctcctccccgaagaggtgcgggttcatgtcggcgtctctcttctcctctctgcctcctcttctccgcatccacccgaacgaaaccctagtctcccatcacttggatccggtctttgacattcttcgacgcaggacgccgtaagaaatttcgctagagatcttgcagctgccatggcggacaatgaacctattgacccaaagaattaccttgaggaacgctgcaagccgcaatgtgtaaaatcattgtatgactatgagagatgtgtgaagagagtcaagaatgatgaaactgggcagaagcactgccaccgggcaattcttcgactactggtcatgcgttggacaaatgtgtagcaccaaagctctttgagaagctcaaatgaatggatggggtgggcgcttgattgccacatgaccccaataaatcgatccactgtcctgatttctgtacttgtgctgaacctgtaacaaggagcttccttcttatctgttgctaaaacttgtcaaaacaagcaaacacaattattttggcagtgggaacaataacttttaattttgcttgtgtaatgttcgttctgttcccagttacttgggcacatgaaagcatttctgctttacttcaatttatcttcatcaagtaatgcattctgttctgttatacttggacagatgaaagcatttctgctttacttcaaccgaacatcagtaatttcagcgtctcgaagcacacgacgccgtcgaagcaggcctcgtcgacgcctagccgctccagcgccctcttcatgtgcgcgcggtccgagttggtgaacaggatcttgcgctggggcatgctctggagcgcggcggcgagctgcgggtcggcggtgatcacgtcgtagggcagcctcccgtgcacgtagctgtggtactcgtccgggtgcacgtcgtggccgagcgcgatgaggccggcgagggtgctgccgtgggagcggaagaggtcggcgcggagcgcggcggccttgtcggcggcgaggccgaacctggcgacgaggaactcgtcgatgttgcgcctcagggcgggcccaatgccggtgttgcccgggtacagcgtgtcgtcgaggtctatgaggaggcagtcgaagggggagccgacgggggactggaaggccatggccggagagctagccgcgaggagcaggaggcgatcgtacttggacgacggagcaagggagcagaggggtccgcggtggagcaggggagcagaggagtcaggatgccgaagtgcagggcgagagaggagcgagcgaccggaccggccggc

SEQ ID NO: 26095 - DNA, 1065 bp, Triticum aestivum
  Clone ID: PAT_TA_26095
ttttttttttttgttggtttgttgtatttccttcctgtctttgtagactacaagactatatgggacggctaggcccgaaggagaacatagttgaactatttacttttaaattttttcggtcttcttggaccttccgtgccacccgaagacacagaaaggatctgcaaacaaaatcaaacgagaggtctaaaaacaggcgttgtcaaaggactgcacaccagtgtcggtgtctgctccgggggttgaactattcctccgtaggttttgcgcacagctttttgctgagcttgtttgtttgtttgtcccatttacgtcctttcggagtccaaaactatgtaggacggccttgcgccccaggcaaggcagtaaatctatttacaatcaaattctttcggtattctttgaccttaggggagacccccgtgcctaaggcaatgccaaaggactttaaacaaatgcgagtctaaacaaaggaaatcaaacgagtgttgcagcccaaggctgcagaattttcgcgccaagctttgcagaattttcagcggatccttccgcttcgcacacacacacacatgctgcaaattcgaatgcaaaattcgaatgcaaagcagctgtccaactcgctgtcttctcttgtcctcaatatgcctttgtggaactgcatgccttccaaagcacacagctacgcaggttgatcgcagagttgtggattccaccgactgttccagctctttaaagtgcacttttccttagaggacccgaatctctagagggaaagaggtgcgatttcggttcggatttcgaggaggtgcgcgtatagggcagagtggactgcttcttcttcttcttcttcttcttgtttgtagcgtagagggctgttcgttcgaatcgtgctgttgttctgtagcttgtatttcgaggcggatttcgagaaggatttcgggcggatttcgagaggttttcgaggaggtttcttccagactgtctcggttgcccttccgagaggtgtccccccgccggccccagtttcccttccgaggaaggtacctgcccgggcggccgctcgaa

SEQ ID NO: 26096 - DNA, 547 bp, Triticum aestivum
  unsure (1)..(547): unsure at all n locations
  Clone ID: PAT_TA_26096
tagcgtggtcgcggccgaggtactaagtatgaatcaaattccacttcttcgtcgtcgttgttaagaaagtcagggtattggtaacttcaatatcattgatgtccttccacaaatactgttaaagatggatctgtaacttcatccattaaatacaataatttaaatgagggaaatgcaattaatattaatattaaggcaggtgtaatagttcatataagttctattaatgttccatggttaaggtatttgttacttataggagatttagtgctaatataatttctaattattgaaaccataattcacgctactccaaatagtattataactaaatagaacatgatgttgtcgtgtaattctataagtgcttccatttgaggacttgcactgtcctggaagtatacacctcatggctgaggtgcgtccagtgagatagtaaagttgttaaataaattccctgcccgggcggccgctcgttatatttctaatattaacaaggtttaaatcaaatgaaaggggtacctggcnngnncggccgctcgaatcn

SEQ ID NO: 26097 - DNA, 658 bp, Triticum aestivum
  unsure (1)..(658): unsure at all n locations
  Clone ID: PAT_TA_26097
gcggccgcccgggcaggtacacacatggctgtctggtcgtttcgcttctcgcatggttctctgttcaggtgcatgcagctcggctcgagttgcatcaaagcttggacatgaagaactatgcattcaagagaagcggacgcagatgactgcggatacacacgcaaacatccaagcagcatttctggcagtgtcactcggcagggttttcggcttctcatctcggcaaatgaaccactctccccttttcaatccgactgggaagtgcacgatgatggagctggattcacctgcaggtcatggagaggactactagatctttccgaccacccaaacgaccgattgaactttgttctccttttcgcggattttccttgtcatcttcgacgtccccaacatgcactacatcgcaacaacccctacatgatcaacaacaactttccaccaacatcatacacaagcacgaatccatcacatgccctttgcaatacatcatctacacaatcacaccacccctatccggacctggactttcccaacagcacacttcccagcacaatttctcgcggactttctaagcgcacgggctgcttttcaacgaacatcgaaccaggaaatcaacacatcacaacggcggagtacctcggccgcgaccacgnna

SEQ ID NO: 26098 - DNA, 581 bp, Triticum aestivum
  unsure (1)..(581): unsure at all n locations
  Clone ID: PAT_TA_26098
tagcgtggtcgcggccgaggtgacgtccgcttggcgtggccgcggccgaggtacctcgagtgctcggccaagaccaacgaaggtgtcagggaggtgtttgagcacgccacgcgcgccgctcttctcacgcggaagaaggagaagaagcgctgcacgatcctgtaaactacgcacttgtcatcaccacacgcatgtcataccacagtccgaaacacaacaaccaccacacttccgtcttttacgatccgatcgaaattctctcaggacacttttaatctttgcggcgcggggaattgaagatgagggatgagatgagcaggaaagacaaggacactgaggggcagctgttgcgagcaaaaggctgcgaccttcctcttctgtgatgcgagtcttgcgaagctgttgcatgggcgttcttggtttcattgttgatgctttgggaaatggggagctcagaaccggcgcgcactgcggaggagaagcacgagacaatgccttgcgaaggacatcacgacgcgggagctggctcggaatctagcctctttcacggtacctgcccgggcggccgctcgaatcnntnn

SEQ ID NO: 26099 - DNA, 988 bp, Triticum aestivum
  unsure (1)..(988): unsure at all n locations
  Clone ID: PAT_TA_26099
ccgcagcagaatcaaacgcagccggcggcaccaactttcctcttccttccgcgtgacctagctttcttgcgtgctcagcgatgggcgtcacctagccttctcgcgtgcccgccgatgggcgtcgaatcgccccagccaacatccgccgcgaccgccacgacgagctgggagctcttgtcgccctcttctccgccggtgtccccctacgctccggccctccgcaaggccgaacggctcttcatatggcttctgccaatgggcatcttgctgtggtggagtacttgattcagaatggagcgaatgttaactctgcaaacttggagaagaacacgcctctccactgggcatgcctcaatggacatacagaggtaatcaaggctttgatatgtgcgggggctatcgtaagtgcactgaacagccatgagaaaacccctatggacgaggcactgacccttggaaagatggaagtggtcgatgcgatcggtgcagcagtagctcaagcagagctcaatggtgttactgtttcctaagcagacccgacattctccttgtgcgatggatgacgatgatcggtcaccctcttgtcttttttcgccacagtttcttccggtctgtgtcacttaagatgctgatatgctagtatatggggcatcagggtgtgttgagccaagagttaactatcatctgtgtctgcaatcacctgttagtgtcaaatgccctgaaagtctggctgctgactatgtgtgcagcagtcagatgtattatcttgttctataagattgcaggtgtctggtaaggccatcgacttgtgctgctgaactaattcatttctcgcgcaatgtcctagatagatccctgtgtttacagtgagctgacatttgcatttatggtttcttgtgttggtgttgatccctttcagcgttcaaatacactttatcagttatcaacttatccttatgtttctgatattattatgtatattnctgtt

SEQ ID NO: 26100 - DNA, 591 bp, Triticum aestivum
  Clone ID: PAT_TA_26100
tcgagcggccgcccgggcaggtacaaatgctctcagtctcaggttagtcgaacaccaagccattcatcagattggataccgaaaattgatcaagtgaatttgaccattagctgaaaggcaagatatacataaatgtagtaaatcatgtatatgtaaggaaggtaaatactaaaacgtttttagtaatctattcatcatctaaagtggcttacaacaagtggcgacaaaccaacatgttcactgtattgactaatataatccaatccttggcagtctaaacatctgccatttaaacatctattggctattcccctgcgctgcaccaagcaaagccctccttgcacctgtttgtccagagacctatgaagacgacgcccctcttgaggtccatgatgaagatctcatcgttgacgcaactggaaaaaaaatcacctcaagccatcttcttcttataggcacgtgcagacccatactccttgtgttcttcttgattttatagcagactctactcatcaaatagagcccacacctttgatttcagcatcttataaaattgttgcaaaggattacctatgaaagatgaaccgaact

SEQ ID NO: 26101 - DNA, 813 bp, Triticum aestivum
  Clone ID: PAT_TA_26101
ttcgagcggccgcccgggcaggtacaattctctacaagacaagtctactaaagtgggccccggccaaggtacaattctctacaagacaagtctacgaaagtgcgccccttccattgctccagcctcggcggaaaaccaaaagcatgccatggtaagtaggcatcaatgaacgccatgcgagtgacacctgtttcccttttcctccaaaatcgtcgatgtccccaggtcgttccttcgttcgtaaaaccctcttgatcaaataaaaacaaaaagaatggacggcagggcccagtggtcgtcataaggatcgtagtagcatcaaaaaatggtaaagaaggtcctgccagtgacggaagcaagagccaactcttggtcggcaagagagaaggtgggtgaagtaaaagttgacaatcgcgagtcagggagtctgcgattcccttgatgtcggatgtttgagctcggtggtgcattcttcgcgtcggttcgcggagttgtgcatcgtatctgcaaccgcttcgatgtccggatcgaatcagttcgattgctcaaatgtggtgacgagttcagatccagatgagctgctcgctggccatcgccggtgaagaagtgagtccgtggatctcagcgaggtattcggacgcgcagaactgcgcaagatccagcgaggtcatacatgcgatatcctcttgtgtctcaacatcctgcgcagctgtgctcaggtcctcgaccgcttcatccaactgagcaagttcgttgctgaacgggttgtgctcgtttgtttcctcgatcgtacctcggccgcgaccacgctaa

SEQ ID NO: 26102 - DNA, 449 bp, Triticum aestivum
  unsure (1)..(449): unsure at all n locations
  Clone ID: PAT_TA_26102
tagcgtggtcgcggccgaggtaccacactaccanctaaatagcttccttattgtaaccggcacactatcaacaaggcccatgtaaactactccaaagctatctcttctaataagattcttattctttaaaattggactgagctccttttttttgaaaagtttcacaaaatttacattctccaatgtaggcccaccataccgcacgtgattcctgtgtgcttttctgtcgaagatgtccaaattgttcaacttgtagagcacgccattgttagagctagaaatacttgcaccttgtgggcttacagttttctttacatcttgcactccccttaatggccactgatcactggaagcttcttgctccccttgctgccaatgatcttctctaggtatctctacatattctgcaagtccttctgttccagcgacctgcccgggcggccgctcga

SEQ ID NO: 26103 - DNA, 395 bp, Triticum aestivum
  Clone ID: PAT_TA_26103
tcgagcggccgcccgggcaggtgataaatgcaagccaccaacgtttttcatctgtccaatgacacaggagatcatgagggatccacacattgctgccgatggattcacatatgaaggtgaggccatcaaggactggcttcaaagggggcataaaatgtcccccatgacctacctcagcttcacacaccatgagttaatgccgaacaatgcccttcgttttgcaattcaagaatggcaaatgcatcagcaaccgtgattttttaaccttccatggtttgcaagtgtgtatagtctgtgtagagaatttattttcccccactttagcagttagcgctttctcaatgtttgggcccaaggccgagaagtgatgtacctcggccgcgaccacgctaatc

SEQ ID NO: 26104 - DNA, 241 bp, Triticum aestivum
  unsure (1)..(241): unsure at all n locations
  Clone ID: PAT_TA_26104
tcngccggccccccgcccaggtacccttcatcctcggagtgatcctcatcatctccttcttcgtgtgggagctcaagtttgcacgcttccccatgtgtcccaagggtctcttccgcaaggataagcagtccatgattgtcatcttcctgattaccttcctctccggcgccaacttcttcgtgctcctcctcttctggccaactcaggtgtataacatgtacctcccccgccgcccccccga

SEQ ID NO: 26105 - DNA, 510 bp, Triticum aestivum
  unsure (1)..(510): unsure at all n locations
  Clone ID: PAT_TA_26105
tnncgtggtcgcggccgaggtgtgagatcgcccaggccgccgcccccgctcgccgcttccagagctctgccatcggcgctctccaggagtccgtcgaggcctacctcgtctccctcttcgaggacaccaacctgtgcgccatccacgccaagcgtgtcaccatccagagcaaggacatccagcttgcccgccgtctccgaggcgagcgctcttaagcgacaacaacggtccttcacatcatctctccaacacgacttcatgagtaaccacctcgacctctctcggcacagattgtcggtgtgatgggcggtggattcttgggatgctggctctttctctcgctttcaacggcgttacaatggggctttcacacaattgattgcatgggctgaatgggtttcgagatatcacaacggtgcaccaaggtggaagggtagcacaacatgcaatgtatcataatgacaatggtgcaaaggcgaaagccgctgatcaaacttcaaaaaaaaaaaa

SEQ ID NO: 26106 - DNA, 253 bp, Triticum aestivum
  Clone ID: PAT_TA_26106
tcgagcggccgcccgggcaggtaccaagccatgaaagcggcgatcataccgaaaccaccacctgccttgaggatagtcgggtttggtgcaccctcagcagtgaagtcgaggtaagcaattccgagcatgaggaaggccaagtcaagactgaggaatagaaggaagaaggccacggtcgatcggacggtgagcatgagcaacaggaaggtaaagatgaaccatcccatgaggtacctcggccgcgaccacgcta

SEQ ID NO: 26107 - DNA, 709 bp, Triticum aestivum
  Clone ID: PAT_TA_26107
gggatgcgagccggctccatcttggacgaggtctggttgggacgccgacggcatattgttgcccttccagccgcggttgggttgggggcgacctgcctttcggcggtgggggaaaggaaaggcgatccgttggaggggtcactggaggcggctcatcatctggctgggatctatcatgtatgactctccttcgttcctctgccccatgcaacaacaaggattgggaagaagcgaagatctaggattggggtgattcagcagattcgtaggtgaggcaggctcctccacccaccccgcggaagctcgccgaaaggaagaggcggcgccgaccaactgcgtgatggggtattggggtgcacacacaccgacctcctgcaggtacaccgctgcgttgctctggaagcgcatcctcctccgccccactgccgacccgaccggcgcacgacgcaacgccgaggcattcagtgtcagcaggaatccatccactccattctccgcagacctaccctgtgctacgtcgcgcgttcatcgtcagggcgtccgtcaaggccaaggtttgttgctctctgataaatttgtaataggaaaatgtgatttaccttgcacacgggtttcaactttcaaagtttatttaacaattacaatgtaccactgcacaatttatctggttaagggtgtgattagtccatagttgggcttaagtacttgc

SEQ ID NO: 26108 - DNA, 403 bp, Triticum aestivum
  Clone ID: PAT_TA_26108
tctagcggggtcccggccgaggtactgcgtaaactgctgtctttgctcgttctcgttggcctcgactcatgaccaagggggtggccattgcttgtaacgtcccaactgtcgcaatctttcgaaagcctggcacttcccacccgtcgcatcctccaacgcctaagctttcttcgacgggcaaggcggcggagcaaatgctggcttaggctcgcaaggattataacaacctccataccagataccacactcattcacataatccgcacacacagtcgcacacgccgcagacgacgtggaagccggaggcggaattgtagagtaggagcatggaggcggagtgtaggttggccgaggcttgcagtcgtcgtagcagccgccgtacctcggccgcgaccacgccaaa

SEQ ID NO: 26109 - DNA, 321 bp, Triticum aestivum
  Clone ID: PAT_TA_26109
tagcgtggtcgcggccgaggtaccttccgaggagctggcttctgcctttgctgaccctctcatcataaggcacccccagggtcacactgtccccaggcttggtttgcactctcccctgtctttccatgcgaataactgtcgaaatttcttgtgaatagattgagaggcagattgtttgtcttttacagatgaggcatctgtgaagcagctttctgaatggagcgcaagcatcctggacgaatattaacggttgctcggctcatgcatgagccatgcatgcctgcatgcgtgcgtgaatcacctgcccgggcggccgctcga

SEQ ID NO: 26110 - DNA, 1058 bp, Triticum aestivum
  unsure (1)..(1058): unsure at all n locations
  Clone ID: PAT_TA_26110
cagcgttggagttgggctaacccaggcacctcccccaagccccatgtttcctgtgagcgaaaaaaagggcctgcttcggtgcttccatccccttgtcgctgtttcctcccgcgagccatccccggcttctaccgaccccgccgcttcaccgccgccgccgccgccgccgccatgaaccagccggtgcagaagaacaccctctacgtaggtgggctggcggaggaggtggacgagaagatcctgcacgcggcgttcgtgccgttcggggaggtcaaggacgtcaagacgccgctcgaccaggccacgcagaagcaccgctccttcggcttcgtcaccttcctcgagcgcgaggacgccgccgccgccatggacaacatggacggcgccgagctcttcggccgcgtcctcaccgtcaactacgccttccccgagaagatcaagggaggggagcagggatgggccgcgcagccagtttgggcggatgcggatacttggtttgagaggcagcagcaagaagaggaaatgaagcgccttcagacagagcagaatgcagcaatgaaagaagcagaaaggcttcacagggagaaaatagccgcagaaaagaacggggagacggatgaagcagatcccatggccgtggcggaagctcaggctgtgaactagagctcttgataaatccttggatgctaacattggaacaagtactgtatgcatgcgcatttgccaagtacgtacatggttttcatagtggattggtgtaactaccttgcgcgaacttgctagggctagttggtagctgatcccacttcctgaagggatgcttccgttcattctggccgtgtaacatggaatttatgttacggtaacatggatgttatgtgtttcagttatgctgttgcaggtgagtgggttgaactatttcacattcatatctagctggagatccgtagacgatttgagcgttggacatgtttcatgattgtgcacttcaaactaggagcctgacattaaggactagctgctacattatttaaaaaatatatttttcnaagaatctt

SEQ ID NO: 26111 - DNA, 525 bp, Triticum aestivum
  unsure (1)..(525): unsure at all n locations
  Clone ID: PAT_TA_26111
tcgtcgagcggccgcccgggcaggtactatctctatcatttgtgcagcctccttatagcagcggcatgttaaatgtcgcactatgatcaatcgtctcaggtgtaatctcaatccgctgtcccgtcgtgccaaacagcacgtcccacagtcgagtctgcttgccatagttcgagctcttcttccagcctctccggtgatgaagattatggtcctcaacagccagctcacaaccgaatgccttcaagaacggcgacgcagcactcgtcgtggtggagtagatcctcaatccgctgtggccaaaagcctctgagaagatgacatattcgtggcagatccaccagtcgtggaagcccatcggcagttggaaggcgtacctcggccgcgaccacgctagaccacgctagagggcgatctccaaaaactcttgctcgtgatcggcgtaggatgatagcatcgggttggggtgcnnngtcaagtggtgagtgcggtgatattgccagagacctgcccgggcggccgctcgaa

SEQ ID NO: 26112 - DNA, 740 bp, Triticum aestivum
  unsure (1)..(740): unsure at all n locations
  Clone ID: PAT_TA_26112
tcggagcgttcgacttgtgtgtacctgccggcgagcgccatgtcccaagtgccgaacgccgagcgcgacggcttcacctgcggcacgctgttcacgtgcctctgcctcccaggactctccaanaagaagccggaggaaaccggcgagagtcggcagccagcggcgccggaacaggaccggcgcacggagcaggaacccccgcaggtgctgctaacccgcgcggcgtccctggagaagctcgagtgctcctcgctctactccggcagcaacatcgtcttcgacttcctggtggagccggggggaagggacgaccgtggcgccgtccatggatactgcccgtcgccgtgcttcgacctgccggtggagctgataggggccggcgaacgatgcggcgtcgtcgccaacgacgcgccggtcacgtccgccttcgtgttcgacggccaccgagatggcgcagctctgaagaggatggcgtcgtgcctggcgtccagcgtaccgacgggcggcgaggcgcggccgacgcatctcgtgaggttcctgtccgcgtcgggttgtgccgtgccggtgcggcctcccgtgacgtctttcggtggcccggcaaaggggggcggcggttgacgagtcgtgcccgcggtggcatacaacgtgaagccgaaaacgatgcgagaggaaaaccgtcgtttgcatgaagttggtgtcgcatttggttttcacaattttgacaaaagaaattcaattcc

SEQ ID NO: 26113 - DNA, 934 bp, Triticum aestivum
  unsure (1)..(934): unsure at all n locations
  Clone ID: PAT_TA_26113
gaattcggcacgcgccccccgcggccgcgacatccgcgcgagcccagcctccagtccgccccggccgccgtgctgctgcggtgctgccaccggtcgccggcccctgcctctccggctccgctccggccaacactcaaccctggccccgccactgcccgaaagcacagataatttctggtttccttccttacattctacagttctatccaggaggggatagggggtgctatgcttcgccttggcctccatccttgcccccacttctctccgccgccatcccaccccaccctcccccgccggttggccgcctctccgctcccaaggccaccctttccatccgccgtcaccgcgccccgagctcgaaaccctccgcttcaggccgccgtcagcggagccgcctccggagaggaacggcggggcgcggatgaggacgaggaaggcgcggacctgcacgaggcgctcaccaagacgcggcggctcgtcgagtgcgccatgttcgcatccgttgccggtctcgcctacttcctcagcaactccctcgccatcgagaattacttcagctgtttttttccgttgccaatagtcatctcctccttaagatggggattagaagccggcaggaaaactatggtggctactgttttactgctcttcacgttgtctgggcctgtcaaaagcattgacttatctgcttatcatgggagtaattggtccatccaaggggtacnagtggagttgggagacaattgggattgttccaacataatctgcgcaattatactgcaatgggaacttttggganagtgttaatganaccttcttgatacaaaaatatttcaattganaccntaaanaatcncctgactaatctggnggaactgggntaaancatccaccaaggnncaaaatttacttggaanngtncgctatnggn

SEQ ID NO: 26114 - DNA, 428 bp, Triticum aestivum
  unsure (1)..(428): unsure at all n locations
  Clone ID: PAT_TA_26114
ttgggggggccgcgccggaggtagacgcgcttcatcgtgcacgaggagaaagcggaggatggcccatccggcggcgccggcaaggacgcctcgtagagcaagcgcgtggccccccattccgaagcgaagccttctgagaccacgaacgccgcactaagttcgtcctcgtcggacgccaggcgattaacttgttcgtcatgggcggctcgcttcggttgagggaggtagatgggatgatggagccggtgggagaagagagattcatggatccggcatgatagagctggtgatatcttcgagggcgtttcctcccgaggtgtgcaagtgggcatttctgctggtggtgtacctgcccgggcggccgctcgatgtccttgcatcaagacgcaccgtctccgacaatgnnnnnncctgtgcatttgctnnnn

SEQ ID NO: 26115 - DNA, 1538 bp, Triticum aestivum
  Clone ID: PAT_TA_26115
tccgcccgggttccgtggccggctccgccacctctgcctccctcgctcacccaccccccccacccccgacggcgataatgctcctcgtcgacggcgagcccgtcccctgctcctcccccgaggggagcagcgggagggagctcgtggcggcgctcatggggaaccccggtctgcgcgccgcgtccgagcggctcagggccgcgccggagacgccggtcccgtcggggccggaggggcccaggcacgtgtacgtgttccagcgggagtacgccacggtcgatccggcgcgcgtcgagttatgtgggcacagatgagatgactacatgtgtgggtgttgcaattcgcaacaacaagactgggaatgacttccattacccatatggacttcccaaagattgtagaaggagggttcaaacagatgctcgaattacttggtgatgacgacgaaccatttgatgttcacctgattggtggcttcgatgatgcttctacaaaggtagtctattctgctggaggaaagcacagcatacaggaaggatactcccatccactttgttgcaagatagttgaagtgctgcataaatcccagcaacggttccacctccggtctttctgtgtccttgggatcaacactatgactgattcttatgggaatgcgcgacccatagttggtggatttgtgatgcaaacatcatctggagttgttactcctgcaagctttgacatcacttcaaggtgtcctgatgaaatagtcagaagaattcgtgtgagtgtttcttcttatgatccaaattggcgaggaaagttgctggagacttacgacacacacgctgatattttccagattgcccctgcctgctggatgccagattgggcagaaatggcatcctcacttaaccagctttcagactctgaagtcctgcttcaatgctccacctctccagctgcagaaccacctcattttgtggaaactgagagaaggatatggaaatacttgatcgagaacccagactgggaagacatatttccaaagtacaagccccgggtcttccattggaccaatgatggaaggtggtcaaggcactcttagcattatctttttcctgtcttgtcatccattggtgcttacaagcggaacggtgacagattatggtcacaccagcacttatacgatcccagtcgtttcctccatttccatacgcctttcatcttcagttatctcatgcattagccacgggtgattcaggattatttggttcttccgtaaatgtatgctgagaaaccggtctgaagttgatgcattaagcacggtttgtgtgttgtgtggtagattcattgttggttcatacctaacctctgaaattcgatttggtcggttaaatgtttgcatgcaacttacctgttgtggtcagaggcgttgtgtacactaaggatgggtgggtgattttattcggggtttgcaatgtgtgttctgctcgaaagattcaatggttgtttggtttcatgcccatcatgatgccccactaaaaaaaaaaaaa

SEQ ID NO: 26116 - DNA, 314 bp, Triticum aestivum
  Clone ID: PAT_TA_26116
tcgagcggccgcccgggcaggtactcctcctccaccaaatagaggatcgacaactactcggtctggaacacatgaaggatgaaaggtggcgtttgtttgaacaagggtgcttggatgcgccctttctgggctcagcatgaaggtggccgggcgttttcgataatgcgatcatgggatgggtttgcttttttttctcgagttatttccacacaacaacattgctgcgctcacaataccatcgtcgcccgctgcaggaggcggcgcgcgcgaagtgagcttcacatgacggctgtacctcggccgcgaccacgcta

SEQ ID NO: 26117 - DNA, 1790 bp, Triticum aestivum
  unsure (1)..(1790): unsure at all n locations
  Clone ID: PAT_TA_26117
ccagctcagccacccgtcacgttcctcccccgcgtgcgaccccaaatcctaaaccctttccccatggccgccggcgccggcgccacctcgcccaagcgcctgagggtctactcgtcggccgccggcgacgccgactcctccaacggcgcggggaacggcaggcgcgtggggacccacaacggcagcttccactgcgacgaggcgctcggctgcttcctcatccgcctcacctcccagttcgcaggcgccgacgtcgtccgcacccgcgactcccagatccttgattcactggaggccgtgcttgacgttggtggtgtctatgatcccagccggcatcgctatgatcatcaccagaagggcttcaacgaggtctttggacatggctttaacacgaaacttagcagtgctgggcttgtttacaagcattttggtaaggagataattgcaaaggagcttcagcttaatgaggagcatgaagatgttcaccgtgtgtatcttgccatatacaaaagctttgttgaggcacttgatgcaatcgataatggaatcaatcaatatgacacagagcaaacccccaagtatgtgaacaatacacacttgtcttcacgtgttgggcgccttaatccagactggactgatccagatcaatcacctgagaaggaaaatgccgcatttcaaaaggcaatggcacttgccggaagtgagtttatggagagtgtccgctttcatgttaaatcgtggctacctgcaagatctattgtcatggagtgtttgctgtcaagaggaaatgttgatccaagtggagaaatcatggttttagatagattctgcccgtggaaacttcatctgtttgagctagagcaggagctgaagactgatcctctgaccaagtatgtgttgtatgaggatgagaggagcaaaggctggcgagtgcaggccgtctctgttgcacctgacagattcgagagccgaaaggctctcccagagaagtggaggggcatgagagatgatgaactgtccaaggaaaccggcatccctggctgtgtgttcatccatatgagtggcttcattggtgggaacaagacctacgagggagcgctggaaatggcaagagctgccctcaaatgctaattcaaccgaagcaacaagcagtaaaacagtcttacccatgttacgactgattgaggttcatatgcggcgctgcacttgcaccaattttattaccattgactagttggtatttgagtatgtatgttccgtggcgtgaaacatccacctgattagcagagattggtatccgtatgaggctgaacaagtagagttatatcatttgattaaagacgatgaaactcgttaatttcttgcccttcaccagtgtttcattactgctacaagcataagcgactgaataactgtatcttacattatctgcagtttggcaactgcaagaagattagtaaaaggtgaacatctgaatagtaatttgcagacgaagaatacgacggtgaaacactatgggatgcctgtacgtagactagatacaaccttatgcacgagctatgcaaagcaaggacaagaattttacagacatttcaacagttttgggttctgaacgacgcggtcacgtcttgacacgcttggcgtccgcataagcagtctccaggtcccccaggaagaagaggatccggtcagatatctgccgcttctccgcttcagcgccctgcgntgcgcgtccttggcgtcgcagctcgtgcccaggtagctttggatctcgccttggtagatcaggt

SEQ ID NO: 26118 - DNA, 396 bp, Triticum aestivum
  Clone ID: PAT_TA_26118
ttcgagcggccgcccgggcaggtacccgtggcgcgacgaagacgaatgcgtccccgtggctcaatcatgtgcttcagatctacgctctgttcatgttgttgggttgcttcacgacccttcttatcccggagacgaagcgtaagacgttggagcagttggctggtgaggtccccgggacgccggagtatgaccctgttcttgcgggtcgtcagcatatccagtatgactcggatccgtcgaatgaggttgctcatgagaagggtggcagctctgtttagactttgggtgaaggataggggattgctgtttttttgaaagagcgataaacatacttgaacatatccagtttgctcgatacctttcgttgttatgtacctcggccgcgaccacgctaaa

SEQ ID NO: 26119 - DNA, 317 bp, Triticum aestivum
  Clone ID: PAT_TA_26119
tcgaccggccccccgcccaggtacctctccttccaccccttggtcctctcttagtaggagccggcaagctctgtccgctaattgaatgggagtctttcattgacattttctctatttgagtatctagtttttgaagttcatcgataatcatctctatactaggccttttcactctctcaattaccacacagctcattgccagctcgatgcacatcttcactccctcgtgctctaggtccgccccttgttggcgccgcggccgcggccgcgcgcctcgccgggctccaggcccaggacctgcccgggcggccgctcga

SEQ ID NO: 26120 - DNA, 226 bp, Triticum aestivum
  Clone ID: PAT_TA_26120
tcgagcggccgcccgggcaggtacttttcaaactgtctagccgtagctacacagccccagcaatgctatcaagtaacaaaagcattggcaagcttggatgccagtcttcaattcaagtctgtatcgctcgcatgtccacgttgtccacgctcatctttcctctacgaagcaccagcaccggtgatggttggtggaccatccttgtacctcggccgcgaccacgcta

SEQ ID NO: 26121 - DNA, 413 bp, Triticum aestivum
  unsure (1)..(413): unsure at all n locations
  Clone ID: PAT_TA_26121
nnnntctagcgtggccgccgccgaggtacgacaagatactggccgacgccgcactctctcttttccggtcaacactacccacgagacctgcgatccagatcacacccgccgacttgcactctactatctcacctcgattttccgattcaaactggtcacgccgaatctctcgacggttgaaggaggttcatggctggctattgggtcaacattggcgttgagaaatcggcttctcctaccgcatggtcacttctgtccattgccgcttgctactgctctctggtcgctgtcgctttctgcactgcgtaactacgctactgttgggtctctacggagtatttcaaaatacaccgtctcgtctcttttgtatgtagtcagttgattttctgtacctcggccgcgaccacgctaaa

SEQ ID NO: 26122 - DNA, 562 bp, Triticum aestivum
  unsure (1)..(562): unsure at all n locations
  Clone ID: PAT_TA_26122
tcgnnnnnncgccnnnnnnggtccgagttggagcttaagcgtcgtcgtaaatctctgcggccgccccggctggtaccagcagaggaaagggggaagccatctgtatcgagccatcgtaagtgcctcacagtctagcatagggaagcataaggcatctcacgccattaaacaaggttatatgcaccatagcagaggacatccttttccacctccgccccgcccgcgctgcatctgcagcaaagcagtgatcaaatggtcgcaagatgcatagtatcactaggaagacaggcgagcgaaggcaggatattcgaggatcaccttttgatgaatacttttagcagatctatgaatcaattttgagagtatgtctggtcgtggttcagcatagtattagtattataatacagcctatgcatttgctgctgcctcaggcaatatgacagggcccaaccatgaggcatccgggtgcgggtaataagcaccttcggctggaatttggactccgggcatcttcagaagtgcaggggcagaacatcgttttcatgcagccatccnncnnnnn

SEQ ID NO: 26123 - DNA, 306 bp, Triticum aestivum
  Clone ID: PAT_TA_26123
tagcgtggtcgcggccgaggtacttggcagcgatgagaagagcagcacatcccacgagctggtagtgacgcttgtagacaactcttctcgagcagtatcgatcggcctggtcgccgccgaggtgaagagtctccggtagtaattgaaaggcgtgatgagcttcgaggagaaaatccaacaagtaaggcctcatgaaccactgaatctcggtctggatttcgatggattgaatatcaggcatcgtctcggcctccccgggcgcccgctcgtcgagaatgtcttcttggtacctgcccgggcggccgc

SEQ ID NO: 26124 - DNA, 663 bp, Triticum aestivum
  unsure (1)..(663): unsure at all n locations
  Clone ID: PAT_TA_26124
tcgaggcggccgcccgggcaggtacaaaaaaatcaatacagactaccgttaactaatacctcagggagcactttgaagcagggaaaatatcatgacagctttattaacatgattctcgacaagtcgggtattatacttttttcaagcttgacctcctatatggagtatcttatacagcagagcaaggtagaaataacaactgggataataaaaggaattactactcaggtcgaccgaccaaaagctaattcaaatatgtgatttcagaatccgctctatttgctaaaaatggaaaagcaaaacatggattatatcgataacctttaaaatagttatgttgcatttacatgatagcttagaactacttaaattagcacgatgaatctagataaaatagtgaaagagaactcaccagccttgctagttctctcttttggttgcccacaaatctcacagattgttagagttcaccaacgattgcttgtccaagtagtatagaaatcataactctacttttctttgagcagtaatcgtaactctacctagccaggtgatatatgtagctcctnnnttgtatcaacatgagttgaagaagtataaacagcaaatagcgttacatgccagtgtgtgcgtgtgtgttgctagctagtccatcaatagant

SEQ ID NO: 26125 - DNA, 644 bp, Triticum aestivum
  unsure (1)..(644): unsure at all n locations
  Clone ID: PAT_TA_26125
tcgagcggccgcccgggcaggtgttgagcagaaggcgaagcagaagatggtgtttgtgatgaacaagttgatgtggctcgcgtgcctctgcatatcagcagccttcatagcgctgacctatgtcgtggtgggccgcaatgacgagtggctggcctggtgcacgatggcgatcggcaccgtgattatgctcaccaccattggttctatgtgctattgcatcatcagccacaggatggaagcgcagagcatgaggaggatcaggaggtcctccatgagccagtcatggtccatatcagtcgactcggacacggagctagacatgaccagcagaaacaagacgatgtatgcgctctaggacgattggtcgatgaccgacacctcgtgcggcagagtcatgtatatatcatagcccgtttgcccgagcccgcaacacggcattcagcggattcgactcgagatgtatctaggcctaggagcatggtagctgtatgtatcatgtatgtatgcaatgcaagtgaagcctcctttgcacaaacaaagggaggcatgtggatgcagctcctnnntagactggttccaggcagagccactttttataggcactatatataggaggtagtagtcccccgccccggcccccgcta

SEQ ID NO: 26126 - DNA, 664 bp, Triticum aestivum
  unsure (1)..(664): unsure at all n locations
  Clone ID: PAT_TA_26126
tttagcgtggtcgcggccgaggtaccaggacttggcctgtgggaagagagaggcgtcccacttctcgttcatcctcttgcaccagtcggcctcagcttcgtcggtagcctcaacacgggtgataccatccttctgaactcgcttcatcaactcctcgatccactcggcctggaactgggtgcagctaggtccattggagaaggcagtaggtgcctgtggaccgtagcagaagaacatgttggggaagccaggaatggcaattcccatggatgtcttgcatccatccttccagtggtcggcaatggtctgacccttgttgtcttgaatgttgagctggccaagcgagccagtgaccgaatcgaagcctgtagcaaggatcaagatatcaatctcctgcaggcccttcggtgtgacaagaccctcggccttgacatcttcgatgggattctcgttgacgtcgatgatagtcacgttgtcggcgtcgacaacctcgtagaagcgctgctcgagactggggcgctttgttccccatgggtgaggtgggacctctggtgcaaggatcttctgcttctcctcatccttgacgcgagcgaggacctttttcctccagaacttgtaggcctccatattggcctcgttgtcgaagagcatgtccttgtnnnnn

SEQ ID NO: 26127 - DNA, 382 bp, Triticum aestivum
  Clone ID: PAT_TA_26127
ttcgagcggccgcccgggctttttttttttttagaagcgaaatactcgatgagtatgctgtgatagctttgtattgatcggagataaaaattgaagctacgccgtcccgtagcattcgatacgaaaattgtggttatccaaattaagacattaatgtaggtagacatcaactctttcctccttgctctcttccatggcggccgcttctatgctggacgctctccgaagagagacgtctagtaaccggcgggagcagatgggtgggtctcctcacagtcgtcggtgacggttacttggccatcctgggcttcgtgcactggctgcgaaccgctggaggtggtggatggctgaggggcggtgtacctcggccgcgaccacgcta

SEQ ID NO: 26128 - DNA, 277 bp, Triticum aestivum
  Clone ID: PAT_TA_26128
tcgagcggccgcccgggcaggtacgtggtcgtcccagttagagccgagcagcaaacttcacctgattcgatggatttgcgagcacgtatcgagatatcgagctcaactggtgagacgagaatggagatgtggtattgcctcctcgctcattcggctttctccagctctttcctcgcaatcatgcgtcgaagcccaactcgctcttcagcttgtcaacaagcgcgatgtatctctgctgggcgccatccgcggtcgtacctcggccgcgaccacgcta

SEQ ID NO: 26129 - DNA, 426 bp, Triticum aestivum
  Clone ID: PAT_TA_26129
tcgagcggccgcccgggcaggtacattcgcacttcctcatgataccaccaaggacctctctgcccctcgacgatgcctttcgccctcctccatcacagacgtatcctttctcccccctcagtcatcccgccgtatttactgcgaagcattctgttgcgcagcctccgcgttcgccgtctcgacagatctcaattcctgctgcttgccgttctcccactttgcgaatcgcaggtcgatctctcctctcttctcggccttgagtctctgctcttctttcaatgagcgacggaccacgcgggaggcgacggccaggtagcggttgtaggtgatacccgcagctttccacgcgaatgccattgtgtgtgtttgtggtgggttttgacatggtgcgctgcccggccgcccgccccggccgcgaccacgcta

SEQ ID NO: 26130 - DNA, 340 bp, Triticum aestivum
  Clone ID: PAT_TA_26130
ttcgagcggccgcccgggcagcgtcgtcgcgccccaggcaccccgcgcgaagtccctatcgtgagaaatttccgtgcgtgtcccttcgcccgccctacgtctttcctgctatttcacaatccgtgccactccttcaatgcatcccatccgcgcttgtccttcttcctatcccacgtttgcctcttctctcacctcgcatcgctcctcgcttaatcgtcgtatgtgctcgcaagcttctgtcgcggaccagtggcctccgccgcggccacgcgaatctggtttcgtggtccatcgccgaatcgcgctctgattggaggtacctgcccgggcggccgctcga

SEQ ID NO: 26131 - DNA, 1327 bp, Triticum aestivum
  Clone ID: PAT_TA_26131
ggtcccttggtgttttttgttgggcggcctctttttcgaacaaacaaaaccttacacttcattcgctgctggtccagcgtgttatatatctgaattaattgatattccactgattttatttattttatttcatcacagttcatacacgcacgcacaccatggtccatggaaccgtgaaccgatgtcgatgtggaattgtggatcactaccccgcccgggtgaagttgaagttgctgcaggagaagcccattgccgggaggtacggggtgaagctgagcgtcttcttgtcgttgtcgagcaccaccagcttgctctccaattggaaccctccgatcaccaccgccggcgtcccgcccgccgtgccgccccccgcctggacgaacgcgaagcacgccgtgccgctgttcacctgcgccatggagttgccgcccaccaccgtgaagttcgtcccgccctccagcatcacgtccacctgcgggacggagtagcccgaccgcgtcggcgacagcttggacgagtcgtagcacagctcgaacggcgccacggccgcgaccttcgcgctcgagcccatggcgcggtcgaaggccgtgatgaaggggcggtacacgtcgctgcggagctgcgcgtaggggatagtggtggagaggccgaccacgagcgcgccggagccggagacggccacgcgcgtcccgtcgatggcgacgccgttggtggccgagacgaagtagccggggttcccggagaagggctggcggagcgggacgccatcggagaggagcgtcgtgatggccggccggtccgccgggggcgcgaggaagaacgggccgccgccgaagatggccgcgcccacgccgttgccgctgaacccggtcctgccgtcgctcgggaggcagagcgcgaacgagttggccaccttctgcgtactggccacctgtgccgggaacgaggcgctggagcgcgcgagccccgcgacgccgacggcgccggagggggccgccgcgcaggtggcggtggcagcgaaggagaccggggacagcgggttgctgccgtcggtggagttggcggagagcgtgacggtcgtcgtctgcccgctgcacggcgtcgtgatggccggggcggagaggtcgaggaccagcgggcggccggcgctgaggggcgcggtgtagagcgccgtggacgcgccgcccttggtgatcttcgtgagcagcggctttccgctggtcgccgccgtggagacggcgagcaggaggagcaccaggactggcttggactgccacattttggccggtgatgtgttgggcgaagccgatcaagctcgggagatttg

SEQ ID NO: 26132 - DNA, 309 bp, Triticum aestivum
  Clone ID: PAT_TA_26132
tcgtccagcggccgcccgggcaggtacaaattgcatcttaagcacatcgtccatcaccagctcagatgattcagtgtgaacagcaacaatatctgcgtgcagctggtctttcagctttggaaacaagacaagtctcgtcaaaatgttgcagagcaagttagcagacgtggaaattccatgcagcatcaaacccacaatatttccacatatttcttcttctgaactgagaggcccttgcacagccccatcgaaaccacgacctgatatcatcccatctagcagagaagtacctcggccgcgaccacgcta

SEQ ID NO: 26133 - DNA, 576 bp, Triticum aestivum
  unsure (1)..(576): unsure at all n locations
  Clone ID: PAT_TA_26133
tagcgtggtcgcggccgaggtactacttctactgttcaccatcatttccattgctcatctctgcaaaaaaataaataagatagcaagaatactaagaagactaggtccgtaagggtttctttttctgtttttttggaattatttttaccatgtttctttgagtgacgcgtgtgcaggtgcagcccttgtttaccttcacctgtccagctcatcgtaagggagagttcctttgctttttatatttgtttgactggccggtttgcatggtcaagctgacgtgcctattctatatttcctgggtttccttcattcgacgcgtctccgtatgggcatgcaggtctgcgccacccgccccgccggccgcgcctccaccgctttgaccggtctatctctgtctctcccgaaaattctagctcaatcccatgtcgtggctttgtcaacctatgtgtgtataaaaagccccccgtagcgtgggtctctccagtcaccgctgcacccagaccgctcctcaccaatacgcccatctcttctcccgatgctgccctccagccgagncctgcccgggcggccgctcga

SEQ ID NO: 26134 - DNA, 338 bp, Triticum aestivum
  Clone ID: PAT_TA_26134
ttcgagcggccgcccgggcaggtacgagtcggaatacagggcggtcgcacgttcttttctctcatcctctgcgctacttttttgtccaagaattaattacagcacatttttttgaacaagaacagggaatggaattgaaacagaaggggatggtgtgaatacagaaagcggatttatactatttatctcacaggagcatttacggtgccaccgacgattatgcaaaaaaacatttcgaaaaaaaaaaaaaaaaagcttgtacaatcactgtactacttaaccacgttcgtagtcttgacacggcgacctgaaacagtacctcggccgcgaccacgcta

SEQ ID NO: 26135 - DNA, 666 bp, Triticum aestivum
  unsure (1)..(666): unsure at all n locations
  Clone ID: PAT_TA_26135
gttccaaattccagcggccgcccgggcgggtactcttcctccccttgtcccctcaggttgcggcgaggctgccacgctatcggctcggcctcggtatggagcccgtggtttgaccccctgcagaatagtttgtgctcaattcgcacggtgcgtgtgtgaccgttcctttggcctccggccatccactcccctttgctttgaactcgggggaaccaaaggactttgctttgaactcgggggaaccaaaggactttgctttgaactcgggggaaccaaaggatgatctgagacagttccatctggaaacatgggaacaccatatgactcctgtgtcagatttttgggacttatgtagtggaatgtggagcaaaaggacaggacctgatcccaacgtcatgctgttttgccgccgacgcggccccccgacaccttctccgttttcacttcccagannagaatgatctgctccatttaaccttttcttttggaaatgacggctttccttctccataaccttctcaacactgaaccgcaacatgttgtcaccacagngcagtgccaccgcatttnnngacacaaaactggtattactaaactcaaaggcgccacagcnacttgaatctaatcctggcaaatgcttggccatacgnnncaccaatttannan

SEQ ID NO: 26136 - DNA, 336 bp, Triticum aestivum
  Clone ID: PAT_TA_26136
tcgagcggccgcccgggcaggtcacactcctttcactcaacatggctatcgaccgacgaccgcaagattctatgaagtccacctggcgtggcgatgagaagcaatggggattctcacacaagttccttatctggctcgacgccttccatactgttccaggccaggagcctcctattcacgcgaaggccgacaagatgccggtattatccgaatggtcatgccacgtctggatcttattacacgccatctggccgatgctccttcagcaagcctacatctcgcggaccggctacgatttccacccttttgccgtgtacctcggccgcgaccacgcta

SEQ ID NO: 26137 - DNA, 268 bp, Triticum aestivum
  Clone ID: PAT_TA_26137
tcgagcggccgcccgggcaggtactatcactcccgctaattgaagctgaccttgaccaaaggcaccggaggaatcatcttcagtctctcaaagtcttggaagacttccagaatcgcctcagacgaatcgacaaagccatgccagccatgcttcctcgccttgtccatgctgaacatcagcggtgcaggcctgcacaacgtcccatccaagaagccaaacacccgatcgacgtctttcaactcctgcgacctcggccgcgaccacgcta

SEQ ID NO: 26138 - DNA, 917 bp, Triticum aestivum
  Clone ID: PAT_TA_26138
tagcgtggtcgcggccgaggtacaagttcgaaccagacaacaaatacagcagaacatcaaccgacatctcagtttcaggtctagagagtatggatggggtccctcagccttcaatcaatcatctcgagctcataccttgacagtctcgaaccccttccaaccggacaggtagccacgaatctctggaccataggcattcactcctcctgagtagcaagtcatctcgaaagccttgcctggaaccgagccacccatatatgtcgagcgagtagtcgggaacagcgacggagcagccaagtcgttgatgcgcttcttccattcatcgctggcttccttggttgggttgacgtatttcagtccttggcgttcaatctgcttaatagcgtccctaatccaacgaacttgaatctccaccgtcgatggtccattagagagcagagtcggtccgtgaggtccattaatatggaacagatttgggtagccggagatggtggtccccaggaacgtattcgctgccgctttccactcatctttgaggtatgttccattgatcgacttcagacccatgttcgtcatgcctccggttacctgaatcgaaacgccaaaatcggcggcttgataccttgtgctaccttcgcgactcaccacgtcgaacccagtagccaaggcaatgatgtcgaactctcgttcttcgccattggcaacaatgcccttctcggtaaatcgttcgatcggtgttccattctcctcattgatgtttacaatggtgacattgtcctggtccaacacctcgtagtagttctgctcgagacatgggcgctttacgccgaacgggtgtggaggctcttccgggaagagcaccttcttcttttgctcattcttgacacgcttcgacacctgcccgggcggccgctcga

SEQ ID NO: 26139 - DNA, 302 bp, Triticum aestivum
  Clone ID: PAT_TA_26139
ttcgagcggccgcccgggcaggtacagctacactgacatcaccgcagtgacaaggcatttcagagataaattgggccaagggggctatggctcagtctacaaaggtgttcttctcccaggagatatccatgttgctgttaagatgctagcaggtagctccaattgcaacggagaagattttataagtgaggtctccaccattggcaggatccaccatgtcaacgtggtccatctcatggggttctgctcggaggaaatgagaagggccctaatctatgagtacctcggccgcgaccacgcta

SEQ ID NO: 26140 - DNA, 623 bp, Triticum aestivum
  unsure (1)..(623): unsure at all n locations
  Clone ID: PAT_TA_26140
tcgaccggccccccgcccaggtaccgaagaagggacggaccaacacaccgtggactccagcagaagagcagagactcaagaccttgcgcgatgctgggagtagttggagtgagattgcaaagacgttcccgacgaggacagaagggagcgtgaagaagcattggtataaagacatgcactacgcagagttcgccgaagacgaggtcagcaatttcagcgcggcactgctgcaggccatcaaggactacgagaacaacaaatggaaggtcattgggcagaaagtgggaaagccagcgaaggcgtgcgaacaattcgccaaagaacaaggctggaaaatttgatgggtctccatcaacaaatccccagaacaacgcatcacgatcgcacgacttttcacctctacgacacctgtaatgagataccctttcgctttttgacttttttgactttttgggatttggacacgccgtcgagaccttgtgtcttctcgccacttaggacgggaaggcaaggaattgggcaagcgatgacgggaatcgcatcgcatctcattggggcgagcgaggcgttttggatggcctcaaacgaggaggtcgagttgtacctcggccgcgancacgcta

SEQ ID NO: 26141 - DNA, 599 bp, Triticum aestivum
  Clone ID: PAT_TA_26141
ttttttttttttttttaaaattgcaccatcatgcatgcaagattggactaggtactcatgatcatttgatgtacagagataattagacattacaacattcccgtgaaccagaaggatatcgaacctgcttgtcgtcttcaaacaaaaatagaattcttgttctatgtcaagggaaaaactagctagagagcttctctgatttggaaggtcttcaaaatatttctagccttatcgtactcgttcagcgccaccaatatgttcttcaaacgacgagccagcccacgtatctcttcttcactaacgcctgaaacgtgtctactcttgagcttgtttgatagttccaacacgaaatctgtgaaaggctgcagcttcttgtttggtgaagaccagactcctgaaagtgatgcagctatccgttcggcccttgtgatcgcatcatggacttccagaatgatacttttcatatgaggaagaatctttcctatcaatagttcttctagagcaagtttctccagggcatcacctgcaaggacctttttccacagacacacatttttaagcagccgtgtggccactccgaatctgtatgcagcatactc

SEQ ID NO: 26142 - DNA, 511 bp, Triticum aestivum
  Clone ID: PAT_TA_26142
tagcgtggtcgcggccgaggtacaaggggaacgtcgccgggttgctgtccagggtgacgttgacttgcgccgtgggcttggcaatcagatggtgctggagacgagcgaggaattctgaaacgtagccgataccgacgccgcggccggtgggcgactcgaacatgttatttccggagaattggaggtcgatggaatattcgtagccttcccattcttcgtaggtgaagaggccacagaatgaagaatagccgagcgcgactgtttcgtatgcacacagcgattgggcgttgtagacatcaacaacagtccagtcgaaaccagtgctgttcgcgttgaagcgcttcacagcatctgcgaggtatttgttctcgaacaccaaggaagcattgtttccgccggtggaaacgggcttgtttgagttcgggcagttgaaatagcccgccaaagaattgttccaggctggcggtcctgacccttcaatcgatagtacctgcccgggcggccgctcgaa

SEQ ID NO: 26143 - DNA, 1490 bp, Triticum aestivum
  Clone ID: PAT_TA_26143
agataacttaacatataggtcatttcattatttctaagacataaacagaacaaatagtcccatatcagaattatcagcaacatgacaaaataaaaggaggtccgtacatctcggaaccgagactccaatctcatgtctcagacatgaaatatattctttatcagatttgaagtaccacaatgggctaataatgacgcgcccgcccgggcaggtacaacatgcctttcttttcttggtcctctcacaaaggcatggctcactacacagtcttaaccactgggtgtctacctagactatgttgaggtcactgtagccgcagttccggatccaggcgaggtagtgtgaaacttaagacatggagagaagggtcttcttgacttcttgtattcctctcatttgctactgttttgtaatcgggctgagcccaaatccagcatgagtaggcctaatagattttgttgtctttcttttcatgtagtggccgtggtcattgcagcaggcgccgtgactgtctcaacctcctcttccgtctctacggcccgtgctcctccttccgagtcatgaggaatcacaaggatgtaagcctcttgttgctgcaggttggcattgcttggggaggcagtagctgcaggctttgagaaggatgctgtgtatacggttctcctgttgttgtagcttgtgggagacgcggggtgcagtgtgcaggccgagatctcctctccctctcccatctccctctctgcttcctcctccagcctgctcttggcgggatcaagctgcgggacctagaagaagcagtggcgtcttgggttcgaagttcgaacaggcgaggttggcaaactttaattctcaaagagttgattggttcataacaacggctccagcaggttcctgcacaagaaatgttggagatgcatcttgcaggaactcacagattcctttcagtaatcagtacgccatgtcctctctaatttgatcacatccaagttttaattccatcaaccgcaatttctgatccaacaaattttgattccatcacccacaatttttgatccaacagatctgggaagcccgagacggtaccttccagatctaggggagagggaagggaggcgccggtgccaccctggtgacgacccttcgaccattgccacatccacgcaaccacgacttcggcagagaaaacaggcggcacgaatcaagggccgtactcatatcccagaccagctacggagcagtggctaccttgacgttcgtccctctggagctgctgcacacacacataccctgacctatatgtcaagctccaccttcgcacgacggatccgaggcgtctcacctcgagcagtcttcttcctggaggtgcacgaacgcgaggacgacggtcccgcgctcctccagtcgatggcgacgcctggacagcgaccaggaggcgatgcagtgcgcgaaagttcggacggggtcggggaggaccaaccggaggtgcctcg

SEQ ID NO: 26144 - DNA, 634 bp, Triticum aestivum
  unsure (1)..(634): unsure at all n locations
  Clone ID: PAT_TA_26144
tcgagcggccgcccgggcaggtactttcctcatggcnnncagacagcttcttgaacactgcattcatgtcatcgatggtcttcgcctcgatacaactcatgttgctttcaggctccctatcatctccagccaaatgcagactttcaacatgtgctccttctggaagactgtcgtgttttgtgcactcgacagcctctgcacatccaactttatcttcgttttgttcaaagtaattgttcacatcaacactagagtgttcctttagaacagcagaaatgtcctccactgattttgcatcaatgacatgcaactgtccagatccctccaaaggctctgagtcaatatcaccgcctgacatgtgtgcggtttcagcgtcaaggatgggcccatcaaccccaccagcacttgcttgtttaaaggccatctctatgtcctccagagacttggcatcaacagccatcatctcagcatcagttttagctgtcctaggctcatttttagtaacttccagttcagttgctccaactgctaagtatgcttccgacggagtattgactgaaggtgtttctgtgacttctggcttgtcacgtggtaggtngtttctgtagnctttcangntntgttccttctggaa

SEQ ID NO: 26145 - DNA, 246 bp, Triticum aestivum
  Clone ID: PAT_TA_26145
tttttttcttttatctcataagcttcatactcatacgtagatacaacgaagagacaaacatcatcaattatcccacactttcttctaaccgaagagagcgtctccgagtctgatgttgacggtcttggtctgcgtgtagttggcaagagcatcttctccgagctcgcgaccaataccggactccttgtaacctccgaagggcaattggtggtggagcgtgttgtacctcccccgccgcccccccga

SEQ ID NO: 26146 - DNA, 545 bp, Triticum aestivum
  unsure (1)..(545): unsure at all n locations
  Clone ID: PAT_TA_26146
nnnntcgacagctccgagcgcgcgagcggccgcccgggcaggtctcagagttgtgtcttagttttcttcctcctctttttgttctttgtctgttaatcagggcccggtgctctttgcgaatcatatactcactcactcactaataattcaacccttccgccaacgtaacatccagaaaaatccaacacatccagcatattcacagtcgccggtcgacttgccctaccacgccaataccaactataatcaactcttgcttgctcagcacgaccttcgaaatatcaccatttcacaaccacgaaaccatttccaagcaacgaagataatcaattcataatggccgctatccagctcaacttcactctccgcacctccgccaactgcaagaccgtccacttgctcggttcctgggacaactacaagggtcaactcccgctctccaaggactcctccaagactggcggctggaagggcaccttccgcttccagggacagaccctcaagcaaggccaacgctactggtacctcggccgcgaccacgctaa

SEQ ID NO: 26147 - DNA, 440 bp, Triticum aestivum
  unsure (1)..(440): unsure at all n locations
  Clone ID: PAT_TA_26147
tcgagcnnnnnnnccnnnnnnnngtacgcaggatacaggttgtaagagcgccccgctcctcttcttcgagcgcgccgcccggccaggtcttcggctctgcatcttcccaacaagcagctttgatcagctccaactcggtccacaaacccacctcaagagtccaccgtccatcaacaatatgaagctctccgctttcgtctctctcctcatcgtcaccatgagcgctggtgtcctcgccgactacaccaactacaacgactgcaaaagcgatgcggaatcttcttgcgctttccagggacgtgagggcgattgtcacaaggaaaagcacaatggcaaagtgacctacgcaccatactgcaaatagatgcctctcgcaggctcttctggatcggccatactcaatcgtctcattctccggtacctcggccgcgaccacgcta

SEQ ID NO: 26148 - DNA, 388 bp, Triticum aestivum
  Clone ID: PAT_TA_26148
tagcgtggtcgcggccgaggtgcaccgcacaaacactccaaccccaccgccaattcgacgatcgacagacgactaccgcagtcatggccaccgaattgacagttcagagcgagcgcgctttccagaagcagcctcacatcttcttgaacggcaagaagaccggcggcaagtcaaaagtcggcaaaggaggacggagatactacaaggacgttggtcttggattcaggacgcccaagactgccattgagggctcttacatcgacaagaagtgccccttcaccggcctcatctccatccgtggtcgtatcctcaccggcaccgtcgtgtccaccaagatgcaccgcaccctcgtcatccgccgcgagtacctgcccgggcggccgctcga

SEQ ID NO: 26149 - DNA, 468 bp, Triticum aestivum
  Clone ID: PAT_TA_26149
tagcgtggtcgcggccgaggtttattctctataccacctcgatcgaattccttgactacttgacctagagaacgcagacatggctcttccaacaggaacctcaagcggcttcccagtcgcagctctgacagctgacctcgctcccaaactccccgcccacagctcgatcctcttcgcccaaaagaaagccaagaacctctccttcgagacgatcggaaaagagctcggacgtgaggaagtagcagtcgcagccctcttctacggtcaatccaacgcaacagacgaggatgttacgaagctctgccagattctcgatatcccagaagatgcactacgggccacagagatcacctctcttcccgaccgtggtcgctcgatggagatgcctcccagggagccgttgatgtatcggttgtatgagattgtgcagaactacggatacgcgtacctgcccgggcggccgctcga

SEQ ID NO: 26150 - DNA, 602 bp, Triticum aestivum
  Clone ID: PAT_TA_26150
tgatcgcccccttatcagcaaacactctggcaaagatcgttggtgggttatgcgacaacctcctgacatgcatagtgcgggcgtgggactacaagaagccgatcttcgccgctccagccatgaacaccttcatgtggaacaacccgttcacggcgcgccacatcgagacgatcaaccaactcgggatttccttggtcccacccaccacgaagaggctggcctgcggcgactacgggaacggcgcgatggctgagccttcgcagatccatacgaccgtgaggctcgcgtgcaagtcacatacgttcggcacgggcaattcacccgcgatcccttccagcagccaccctgtctagccgatgcagtggtcgatatgttcacttcaggtgttcaagagcttagtgtttcgcgttttctgtgccggcccatgtctgggtgtaaggagtggagagtatcatcaggtgtttgtttgtcggtgatgtctgtgttaaccaacgtgtcgtacctatggaacatggatcagtatatttgttactgtactagagatgttagggcgtagagattcaggaaatgttgttccagccataatgttatgttatctgtgg

SEQ ID NO: 26151 - DNA, 1045 bp, Triticum aestivum
  Clone ID: PAT_TA_26151
attccctccgcccgcggcgcgccgctccgggcagcctcggtcgctgccgccgccgccgcctccgcctaccgccgcccgacgacgccctccggcccctcccgccgccgccgccgtcttcaaccgcttatctgcccacgctcctaccaaatcgcctctcagttgagcgatccaagtaaagcagatgactacatcagaaccggtacaggaaagctgggagctggaacccagcaggcctcgggtcctccttgctgcttcagggagtgtagctgctataaaattcgagagcctctgtcgtgtcttctccgagtgggcggaagtccgagctgtggccaccaagtcatcattgcactttgttgatagatcatctctgcctagcgacgtcattctttacactgatgatgatgagtggtctacctggacgaagataggagacgaggttctgcacatagagctgcggaagtgggcagacatcatggtgatcgcccccttatcagcaaacaccctggccaagatcgctggtgggttatgcgacaacctcctgacgtgcatagtgcgagcatgggactacaagaagccgatcttcgccgcgccagccatgaacaccttcatgtggaacaacccgttcacggcgcgccacatcgagacgatcaaccaactcggcatttccctggtcccgcccacaacgaagaggctggcctgcggcgactacggaaacggcgcgatggctgagccctcgcagatccacacgaccgtgaggctcgcgtgcaagtcgcagacgttcggcatgggcatttcgcctgtgaacccttccagcagccgccctgtctagctgatgcgatgatggtcactatgttcaggtgtttatgtttagtacttgagttttctgtgccgcccacatctgggtgtttatcggtgatgtctgtactgacacaacatgtagtacctatggatcggcatatttgttactgtagtagatgttattagggcatagagactggggagatgctggttgttccagccataatgttatgctatctatggatgg

SEQ ID NO: 26152 - DNA, 338 bp, Triticum aestivum
  Clone ID: PAT_TA_26152
tcgcgcgcggccgcccgggcaggtaccatgcagatggaaatggagaagggcgacacgcagatgttctttgacttgttcgttgcaatgtgcaaccacatcgacgacgtcgtagagttcggctccggccgaacccccgatcttgccaagtgattgtccatcttgcgaatgaatcaaagcaaacctatccctcaactctctccaaagcattgcacacggaccgatctcacctcgcatcgccacgagcccaaattgtccgctcgacgactcgccacttcttttcaaaaattgctcggaactttccttcttgcattcgcagtacctcggccgcgaccacgcta

SEQ ID NO: 26153 - DNA, 417 bp, Triticum aestivum
  unsure (1)..(417): unsure at all n locations
  Clone ID: PAT_TA_26153
tnntccgccggccccccgcccaggtaccgatctgtcactgcggcaggtaatctgctcgtggcggccgttgcttggtaatgatggtatgcggtcagtggttcaggaaaatacccgaagtctggagggccgacgacgagctttcgctcaagtcaaccctgtcgtcggggtcctggagtgtgtgcatgcgaggcaatgtcgtttgaagacttggtcggccgcgctgataggaatgcaacaatggcggacctcacaaagcgtaagggttcagcgatctgatggtcaagcatggtggactcttggtcagatcggttctcagcagaactggcactctggtcatctccttgacgtcttggatgtaatggccgttctcctcgcgtagcttgaaaaatccaaggtacctcggccgcgaccacgcta

SEQ ID NO: 26154 - DNA, 373 bp, Triticum aestivum
  unsure (1)..(373): unsure at all n locations
  Clone ID: PAT_TA_26154
tagcgtggtcgcggccgaggtacgtcgaactcgagaaacacaagcaggctcccattcccattgccattacagccgtgacccgggctgtttcaagtagactcatactctgctgggcgaagtcagcatcctcccacccgatttttcgtaatgtgtgtcaacagcgtaaaattgccccgcgaagggaactcgctctcgcaagtcggtggcgtgacctccgagctgacgacggtgatggacaaatccgcgacgtcgttcaggtcgacttccacgttgtcgaacgtagagaccctccaatgtagattctccctcaaataaggctccacgtctcccatttccatcgacttcagctcacctgcccgggcggccngctcga

SEQ ID NO: 26155 - DNA, 308 bp, Triticum aestivum
  Clone ID: PAT_TA_26155
ttagcgtggtcgcggccgaggtacatgcaccacccatatcacatcatatgtcagcacaagcatcgtatgtaactgtaaacctttcttctttccctgttctttgtcttctgtcttcctcacaacacctccccaagtgcgctacttctggactttgtctgtcattgcctcgtcacatattcaataccctccaactacctcaagtcgaggaatggaatgaaagatgatggaatgctttacaatgacctcgcgtgcgcacggtgcttctccatgtgctcgtgacgcttgtacctgcccgggcggccgctcga

SEQ ID NO: 26156 - DNA, 293 bp, Triticum aestivum
  unsure (1)..(293): unsure at all n locations
  Clone ID: PAT_TA_26156
tagcgtggtcgcggccgaggtacagccttctggagatgctcagaagtccatgcaacgtagtagttaaaaaagcaagtcttgaaaaatccacgaacacccattgtgttcccgccttgatgcgattgatgtccattatcattcgcgaaacaaccccatgtgcgccagtacctgcccgggcggccgctcgagggttacttacgtatggatcccagcccccaggcattannngaaccaaacggctcttattgtgccatgcatncnannnngttggtacctcggccgcgaccacgcta

SEQ ID NO: 26157 - DNA, 429 bp, Triticum aestivum
  unsure (1)..(429): unsure at all n locations
  Clone ID: PAT_TA_26157
gacaagcttccaacttgttgagggcatcaaaatagaacagtaagatatggtatatacacacttctcaactcatcaatcataccacgctaacatcattgcctccttcggcaacttccttcatctaaaccgaacagaacagatctacttgatcaagaagtccacaaccttcttcccaaaactcctctgcacaggcgcactctcgaccctcgaaatattccccttgtcatcactgaccaagttctcctggctcgacatctccgcggtagcgatggactgcgtatccggcaatctcgggttgcgggtgcacaaaccgaagatgactnncggaacacacaggcagataccggtgatggtcaacaaacgctgacagtggcggtaggacaagatgatggcttcgcgctcgggtgtacctcggccgcgnccacgcta

SEQ ID NO: 26158 - DNA, 644 bp, Triticum aestivum
  unsure (1)..(644): unsure at all n locations
  Clone ID: PAT_TA_26158
tcgagcggccgcccgggcaggtgctcctgccaccacgttcgcccatttggacgccaccaccgtgctttcccgtggtatctccgagttgggtatctaccccgccgtcgaccctctcgattccgccagccgcatgctggacccccgtatcatcggacaggaccactacgacaccgccaccaaggcccgccgccgcccgcgcgggtacaagtccctccaggatatcattgctattcttggaatggacgaactttcggaagccgacaagcttaccgtcgagcgtgcgcgtaagatccagcgtttcttgagccagcctttcaccgtcgcccaggtcttcactggtatcgagggcaagctcgtttcccttaaggacaccatcgcctctttcaagtccatcatggctggtgagggtgatgacctcccagagggtgctttctacatggttggcgacttctccgaggcacaggcgaagggcaagcagattctggccgatcttgagaagtcatagatggttatcggatgatgcattgagggagagaaggaatcaagctcgactaagcgttttcacattgtacctcggccgcgaccacgctaagtgagnnnacgaggcagttgaggtagtgaaaaggagcgtgtaagcgtaaann

SEQ ID NO: 26159 - DNA, 362 bp, Triticum aestivum
  unsure (1)..(362): unsure at all n locations
  Clone ID: PAT_TA_26159
tagcgtggtcgcggccgaggtacaacacccgatatgcaacaccaagctgcagcgtgatcatgatgtcttgcttgttgtgttgaaccgaccttatgcccaccttccttctgcggtctccggcaattgcactgccgcagcataccagcaagcctcatgtgaagcgtcgacccaccacttcaatgccatctcaagcacatactggccctttccaagtcattctgtcaatcgtgccacggccgctcacttccatccgccctgaagctccgtgctcaacgggttgtacctgccgggcggccgcgcttgcctacgctgctactcttcagccgttctacaacgntnnnnnnnnnnnnnngnnntcgnnt

SEQ ID NO: 26160 - DNA, 1282 bp, Triticum aestivum
  Clone ID: PAT_TA_26160
gccgggacaaaaccgggatttcagatcaccaggaacaaaatacaaaattcatcacacacttgatggaacgagtgacacatgcatcttggtgctaattaacatcacactgatagagtactgaaatcatctctacaaaaaggaaaaaaaaacagtgaagtgaaacatgtaacagcagtgacatgctctgtgacctagataaccaagtaaatcaagctaatagtgcagggagagattcatactatactttagagagttccttatttcttgcctctgaccatgcctcctgtgctgcagctgtgtgccagctgacgcatgccaatacctctagctagcaatggccgctgtcgcctccgctacagctagccccgacagccaacacacaaccctcagccaccgtgtcgatcttcaattcttgaagcatacatcacagcaccaatttggaaccaaatgtgatatctccttgtttgcggtggcgtcctccttccgctgcttcttcctcctcttcttgcgccggttcttcttcttctcctcctacctcctgtggtctgcgtcgccaagttccaccacggtgtccttgtcaacctcctcgtccagtggcggggtgttccccccgccaatccctggtgcgcctcgcgccaccgcaccaagagatcaacggtgttgcaaggaatatggatcaacaactattgattaagtcagtagaatcagaatatacagtagatgtgattctttcaagagattaaatttagaaaatagaatagatagcgatatgccattctgaaagtaaggtccatctggtgtcatcttggcctccaaactgagcatgccccgctctatgcaaactatagtatgacattctgaaagtaagggcgatgtagtccgtaggaatatttctggccaaacgaaaggaccccaccctctcacgccgggtgacccgttccggccgccgctccacccagcatgacagaacccgtcctgccgctctgcctcctccccggcgccatcgaccatagggactctgccatccatctccatggatcaggattcattattgagtgtattgagaggaaaaaaggggtagcagacgagatgagagggggtggggctgtgagggaaggggagtggaggaggcggcatgcgggggagtggcggagacgccggcgatctgcagcgtttcatccaccgctggggcctctcctcccgccgtcggtcgcgacctctcctgctcctggtgcctcccagcgtggcatccaccggatcggatttgttcctcgtgccgaat

SEQ ID NO: 26161 - DNA, 607 bp, Triticum aestivum
  unsure (1)..(607): unsure at all n locations
  Clone ID: PAT_TA_26161
gnnnnngattgccggggccccgcccgaggtactataaacttgactgactgcaagttcctttcaacctggtggcggccgaggtacaatatttggtttgacgttaataagtttttatccggataccgtcttaatactagtctcgttatgttatctttaataaatgaacatgcacactattaaactgttaaactgtttttttattattttacactactgttcgtgtaatcaagataggaacttttctaaagaaatagattctattactataggcatagagctgtgtaatataccacatatctcagaacattgtccaaagaatgaaccttctctgtttatcataactgatatttgatttaatcttcctgggtatgcatcacatttaatacctaacgaagggcaagcatatgagtgtataacatcaccagaagagattataaatcttacgtgagttaattcgggaagtattacccggttatcaacttctaacattcttaatgctccgtctgctaaatcagattcaggtccctcggccgcgaccacgctagtgactctatgcgagcgcgggtagccttgtcctcatcggcgtacctcggccgggaccacgcta

SEQ ID NO: 26162 - DNA, 643 bp, Triticum aestivum
  unsure (1)..(643): unsure at all n locations
  Clone ID: PAT_TA_26162
tagcgtggtcccggcccgcggcccggctacgtcacaatcgtcggcatccaaccctacatcgaaagacgtttcagcatcgtcatcctcgcctagactcaacatcagtgcctcgactcaacatcagtgcctcgacgcctccaccgccattatgcctccagccatcagccttactatgctggcctttgctggtctcctctctgatcaagttctcgcgaaagggccatctgcctcgtgcactaccactatgaccgaatttccaggctgctgtccatcctgcccgggcgccccctcgacatcgtccataccatgcggaggatgtgccttggagaaagtcaccgagaccgtgcaatgctttgcgccttgcgagacgaccaccttgacggatctggccttcacgacgacggagtgggcttgtgcagctacggaagattgtggaaaagttggagggaagtgagggaggaatcaaagtgttcgacagatgaagaggaagacacaaccggcatggaaatgaacacctctggatatgtcgacttatgatagtggcactttgtttccgtattccgaccancgctatgtctgtcgaacgacaacttcgaacgcgcattactatcaagtcgtcgttgaagcacgactcctggnngag

SEQ ID NO: 26163 - DNA, 421 bp, Triticum aestivum
  Clone ID: PAT_TA_26163
tcgagcggccgcccgggcaggtgactgcagagggcggcgtgcagattttgagcaaggagatacggctgaaacgaaggaacgggctggatgatttcgaggattggtggtctggaaagaagagttggtcccagcagttacatgactggtggaacagccgctagctacctaaactccttctgcaggcatccttgtagctcaagatccatgatgaatactcctcttaggtttagtttgctatatcaatttagtcgatcactagcaggtggctgaaggtgaatgatcaatatcccccccccaggtctagttagtttgtttctcatgtccgatcactctgcaagaacctaatcctttgtgatatctgtttaccatagtctgtcgataatcatttcaattatccttgctttctactaaaaaaaaaaaa

SEQ ID NO: 26164 - DNA, 359 bp, Triticum aestivum
  Clone ID: PAT_TA_26164
tagcgtggtcgcggccgaggtcgaccgcaagccggcgaagaagcgcaagcgagaggagtaatgtcctcaatgcacctgacaaacatcatctttgcttttactttgctgacgcttctttgcgaatgggagggatcacgatatggggtgaagggtttcactgcctgtggagtcaactgtgcttttatggtcctggcatgggcctttacgtgtaacgctggaaatcacaaaattcggggatggagttttgctagagtggacgcttttgtcgctcgactacttttgttttgctctcgctgagctcatggacatacttcttcttcttcttcggccgctttgtacctgcccgggcggccgctcga

SEQ ID NO: 26165 - DNA, 632 bp, Triticum aestivum
  unsure (1)..(632): unsure at all n locations
  Clone ID: PAT_TA_26165
tagcgtggtcgcggccgaggtacgtcctgatctctgttcccataaggatggtggatatcatccctacctctagaagccagatgtgtcctttctatttcaggtttgatgtctcgagcagacacatcctttcgacggggatcacgttcttctccatcatgatgccttctcgcatcatttacacgtctggatcgcctatcctgcagaacttcttcaccagattcaaggcgtttctgatgatctttgctgctaccagacctcactcctctactgttttcactattcagtgtcttcaaatcgacttgatcactactattattgtgtctagggggctgctcaaccttagaaatgatcttctgccttttactagaatgatcctcgtgatcaccctcattcgtatcactagccatgtgaggttctgagatagcatcatcagcatctgcttcagcactatcaaccaaagcaagcctatcatcattatcagcaaattgatcctctgtgctcagcttgtctgtcgtttcatcagcaacagtaggtgacccttttaagccatccttagtttccgagtcatcaacaggtttgctatctctcggggtatcacggcgtctctttgnnnatgttgtttggcnnnnnac

SEQ ID NO: 26166 - DNA, 434 bp, Triticum aestivum
  Clone ID: PAT_TA_26166
ttttttttttttgtggagtgaaagaaccgattgctcgattgatgatcaatcgcccttgatgggcgatctaaactatgcaacaaggaatgtatcaaaaagccgcgcgacaacacgttcgctgcaagccaagcaatgttccatgagaaccattaaaattattcatgaccatcgccatgtccgttttgcttctccttgggggttccgtccatccccgtaatgctgctgcttgcttattgccaaggttcgtagagagtgttcatatgcacaaggattgctgtgatgcgtcgattcggtcgcggacgtcgtctggttggagcgccatcgtgaaggatcgtaagccggcgtctcgcagcgggagacgtcggtgggaaactcggggtttgtctgctaaagctgggtgaacagccctaagcacctcggccgcgaccacgcta

SEQ ID NO: 26167 - DNA, 610 bp, Triticum aestivum
  Clone ID: PAT_TA_26167
tcgagcggccgcccgggcaggtctcaaagccctgcaaagaagcgtaaacagaaagagaagaccgacaaacctactactgcggatgccggcaccaccaagccagagtcatttcagaaaagcaccaagggccagaaatccgccaaggcaatgcctgagggagaatcgagcagcaagaaacccgtgagcatgccgttcttgaatgacagtggcaagaggaaatcgccaggtttcctatcggacaaaccgattcacaagaaacaaaaacacgagagacccacagatgacaggcggtttgtcggggatggcagcagcgttggcacaccgtttgtcaggaataatgtcaagcagaaacagtccatcgccgagcttgctgctctggctggtaaggataaactgaccgcaggggaggtccggaagctgctcaagcccgaaatttcagccaagggtggctaactcatctcttatcttgtcagcacttgtagaaaagaggaccctgtttctcgcaaaccatgtggactaaggcggcgattttgttggtagagtaggtttctgttgccttgagctgtaagatgcacgaatggatctatgtacctcggccgcgaccacgcta

SEQ ID NO: 26168 - DNA, 244 bp, Triticum aestivum
  Clone ID: PAT_TA_26168
ttgcgtggtcgcggccgaggtacctccttattggtttatattttacctattatacatacacacagttaagtaaactgtaagctgttaccttatattaattttggtgtgatatatagtgttttaaataggaaagtctactactgttttataaatattgctatgtcattattagtggggtaaaaaccttggtattatacagaaaatatattaagttatacgtacctgcccgggcggccgcgcgcga

SEQ ID NO: 26169 - DNA, 775 bp, Triticum aestivum
  Clone ID: PAT_TA_26169
gaaaggggatcaaacaccatcaacaataggctgtttaaaaaataaatgacatgtcaactggcataaaaaatctttaaatcatgtttgacatgaaaatttggctattacaaatgggaactaaattacacctgagaaaaaaaacatcaagaagctggagagaacggacatgaaagaaccacctgaacatacaattgccccaacaggatagaaatccatctccatcgatcaaacttgttttcaccctgtcgtacgtaggggagtacacatacggcatatctgatgccatcggttcatcaattgattcaaaagaaaagttccaaccaagcatgcatgagcacatcccaggagctcctagcactgacttccaacacctataacatattttaataccatggagcagtattttccatatgagatcatcctcacctactggtccagtcacatgaatttttacaagccaatacaacttttaactgtcggactgaaaccacaaagctataggcctgaagaacaaaaggcaaaaatcctcaaattaactgaccagccacttgtactggaataacatatctctccgtagcgcattatagcatcatgttaaaccaaccggtggccaacaaaccagctttgaccaatcaaaaatagatcccacaggaatccccaaagagcaacactgcagctcgtccagagaatatcgtagatgttgctgcaagagcccgacccgccgcatcgatgaccagcagtccacctgcaagagggcgcaggtggaggccatgat

SEQ ID NO: 26170 - DNA, 389 bp, Triticum aestivum
  unsure (1)..(389): unsure at all n locations
  Clone ID: PAT_TA_26170
tagcgtggtcgcggccgaggtggttgttgtatttggggaaaccggtggaggagaataagacgttgggggagtgtgggtggaggagtggacagatgttgaatgcgtttcttttcaatgagtagggaaagggtggaaggcaggcgttgattcaactgttggcaggactttgggtttcgttcttgcattggcattggcgttggtatgggcaaaggacggatacggctctttcatttgcagtggtgaacatcatcacggtgccacagtccgtggtggagaagaagaacaagattgagagaagacgcagggaagaagaaaaaggtcctgccctccctcaagacagcgtagacggtctctacatacatacttttgtacctgnnnnnggcggccgc

SEQ ID NO: 26171 - DNA, 550 bp, Triticum aestivum
  unsure (1)..(550): unsure at all n locations
  Clone ID: PAT_TA_26171
tagcgtggtcgcggccgaggtaaaatgtctcagggctcaagtgattcaccgaagcgacgagaccttgaaagcagctttttcaagtgtcagtagcgggacgttctgtcaatcggggaaggtttttggtgacaagacctggagatatcagaagtgagaatgctgacatgagtaacgagaaatcctgtgaaaaacacgatcgcctgccagtggaaggctttctgcgttcagtcaatctacgcagagtgaatcggtccctaaggaacccccgtcgggccgcccccccggcgggtacgagaccaacctccacagacggaggttactcgcctcgccattccccagtgccgccgtcatggtatttgtagaaaaaatatgccagccgtgaaagtaaaaaattgtcgttttcgctcttggatgaacgccagtcctgtggttttctgctatcaaatcatgtgcatgattgatgaatgaaaatgtgtggaaaggtgcgtttaaagggcggcaacgaggccgaagacggcgaggcctccgccgccgccgcccgagaacctnn

SEQ ID NO: 26172 - DNA, 614 bp, Triticum aestivum
  unsure (1)..(614): unsure at all n locations
  Clone ID: PAT_TA_26172
tagcgtggtcgcggccgaggtatttaccggccggctgactactacaaattcttcttccgagacgccaacgcccacccagccttctccttgctctggcactctcgttgcatcatgcggatcaaagtcttcggttggctgctgatggtcgaccgtctaaacacacgtgacatgctcaagcgtcgacattttgacataggtgacgaccacagctgcctgctctgcggcaatcatgacgaagaaactgtggatcatatgatatttacttgcacattcagtcaagcttgctggcgtaaacttgggatcagctggccacccttcacctgccgcatacaactacttcaacaggctaaacactcctggggacgtccattattctttgaaaccttcctggtagcagcctggagtcactggaaagaaagaaacaacaaacatttcaggaggattacgccaactgtcggtgggtggctgaatagattcaaggaannctttggtctcctccaacataggactnnggggagtcatcctgcttttatttcttcttttgtttctgaattgaactaataacaccactcctcgaccatctgccccctctggaagggcagcatggcaaatag

SEQ ID NO: 26173 - DNA, 529 bp, Triticum aestivum
  Clone ID: PAT_TA_26173
aatgcaaacggcacatactatatttcttgataaagttccaagttccaaagtcatcaaattatgccctttgcttattcatagaagtacttgtcaaccgtgcatgcatgcagacatgcacggccagtacaacactcaccatatacatgcaggaactggaagcgttttacttcttgcacacgacacctttgccgtccatgccgctggcgcaggtgacaccagcgagctcagatagcaccgcggcaccgtcgtttccacggctgactccatagcgcgccacgctgcagtcggcggcgaacaggctggaggtggtgaaggtggcacctcctcccatggtgggcatggaggccctcacgtcgaaatggttgacgtagtcggagcggtacgtctgtccgaccacaccgtggacgtcgtcggtgagcgcgtcgaacttgaacgccagctcgaggtgcgcgaggcagtcatcggcggtgacgccgtagcggtgcaccctcgattcctcctcggtgatgggcacggcgttggccctgac

SEQ ID NO: 26174 - DNA, 638 bp, Triticum aestivum
  unsure (1)..(638): unsure at all n locations
  Clone ID: PAT_TA_26174
tagcgtggtcncggccgaggtacgcttgattttacaggtttaaataatacaaagtcttttagaaacaaatttaggcgcttttctagttagattatagtagccttatctagtttcagtaaaacttaaatcggaaaaaaaaaaaaacataatattactaaatatactcagtgatgaaaaacggttgcatgcctattgacatatacctgactcgtggccgcggccgtggtacctttaataaattgaatctttaatacacatacaaataatgaggatttgaaagagtcaccctttatttagtctggttaatggttatcttatcgattcaccacaaccaagtaatctaagctatctatgaaatttcggttcattactgggattttgtcttgtaatacaaatcgttactggtgttacacttgctatgcattataaccctagcgtatctgaagcatttaactcagttgaacacataatgagagatgtaaacaatggatgacttatacgttatcttcactctaatactgcttcagctttcttctttttagtttacctgcacgtgggtagagggttatactacgggtcatacaaagcccctagaacattaacatgaacaatcggcacctgcccgggcggccgctcca

SEQ ID NO: 26175 - DNA, 256 bp, Triticum aestivum
  unsure (1)..(256): unsure at all n locations
  Clone ID: PAT_TA_26175
tagcgtggtcgcggccgaggtaccaccaccatcatccgaatgaccttcttcgaccacgacctcctctatgaacacccacctagagtctcctcgttttgagttcttccgcggagggactgcagcaatgggattggcatcaagcgggacaaatgaggaaccaaggtttctgcttctgtgttatattgtttgcattagggcatgggtcttgtgaacgacncctgtgcatcagacctctcttctcgactaaaaaaaaaaa

SEQ ID NO: 26176 - DNA, 590 bp, Triticum aestivum
  Clone ID: PAT_TA_26176
ccgtcccgtttccccaacaccaccgccgccgcgcgagcgccgccgccgcccgccgcctcctcctcctcctggccgtgtccctcgccgccctcgccgccgcccgcgcccacaacatcacggacatcctacatccctactcgctactctcgctactcaccaactacctttcccctctccaggtctgcgacctgcgacacggccaacggccgcagcactgcctcgtgcctcgtcctcaccaacggccctccgtcctcgctcgcctctcccctctccctcgccgacatcagctccgcctgccgcctcctcacccctcctacgaccctacgaaccccaagaagcttgcactcggctccaaggcggcctccgagcttcaccagcacagcggtgccacctcagcggacgaggcctcctgggcaacacgaacctccgcggcggaacagtcggcttcgcctcggccgagcccggctcctcgtttcacgccacaagcccggatcccgagttcaagggccagctcaacctctgcctcatctagggctccgaccccaccaccttcccgggcctcttcaccggcccgtccgccgcctttctca

SEQ ID NO: 26177 - DNA, 431 bp, Triticum aestivum
  Clone ID: PAT_TA_26177
tcgagcggccgcccgggcaggtcaatctatcaaaacacgaaatgcagcgcattctcagcctcgcattcctcgcccggggccccggccgtgggcttgccgctccatatactcaggaggaccaggactcgggcacaacaacatcaaaagactgctacgtcgaccaatccggcaaagaattctgcggccaatccctcaaatccttgaaatcccaataccaatcccaatgcgccgacaaagtctggacccagcaatatccgccctcccccgaacaccaagcctgcatcgacttgtccaaaaacatccgcgaaaaggaagccctggaacacgacagatcgcagtacctcccccgccgcccccccgatcatgcaatgccatacatttaggccatcaggaggtccccagttctcgccacctcggccgcgaccacgcta

SEQ ID NO: 26178 - DNA, 1024 bp, Triticum aestivum
  Clone ID: PAT_TA_26178
acacgccagggtatccctcacgccggatcccctctctctctctctctctctctgtccttgtgcccgaagccaaagcccgggacgcgacagacggcgcacgcgctagtctgaaattcggaccaattaaccggtgagcctgtggcgccagcgagccacagccgaccccgccatggccggctccaccgcggtgctggccgccatcctgctcatcgacctcgtcgccttcggcctcgccatcggcgccgagcagagccgcccctcggcgagcctggagacggacgcgaggaaggagtggacatactgcgtgtaccgcccggacgcggccaccgggatggccggcgccgcgctcgccctgctgctcgtcggccaggccgtggccgccgtcgccagccgctgcttctgctgcggcgccgcgctccggcccggcggcgcccgcggctgcgccctcatgctcttcctctcctcctggctgacatttctcattgcggaggcgtgcttgctggctgggctggtgcagtccgcctaccacaccggcttaccgcacggtgatatttgaaaacccgcccgactgtgagacggtgcgtcgaggcacatttggggccggcgcggcctttgccttgatcaccggtgtgctcaccgggttctactactacaacttctccaaggcacgggtggcctaccaacgcccggaggccgccatcgacatgagccggtatagctgaagattggtgcctggttgaggggctactcgagtctctatgaagctgctgtaacgcattgtggggaacgattcactatgaactagctcaacagttttgataaccgttatgtggccatttttatatagatttttgcacatataatgtgtgagccattctcccagcccttgtgccgtgtcaggtattttgttccctgtacccacctttgctttcgcttctttttgcattagggtgaagtctgttttaaaccctaatcttgtagagcgcggcggaaatagacccccatatttaaatccctgaagttc

SEQ ID NO: 26179 - DNA, 207 bp, Triticum aestivum
  unsure (1)..(207): unsure at all n locations
  Clone ID: PAT_TA_26179
ttcgagcggccgcccgggcaggtacggccgccaggagcaatcgagctatggtcatcaagagcagtcctatggcnntgaagagcagtcatacggtcgcccggaggaacaaagctacggtcgccaagaagaatcaagctatggccgtcaagagcagtccaactacggcggaggtggacgcagcgagtacctcggccgcgaccacgctaa

SEQ ID NO: 26180 - DNA, 1140 bp, Triticum aestivum
  unsure (1)..(1140): unsure at all n locations
  Clone ID: PAT_TA_26180
cttgcagcagctaggnatgttaaccccatctggacctatgggtcaaactcactggggtgatgcagcatcaaacactccaaatccatcaattcattcaacggatgcacaattgaagcaagagctcgctgcagtattcaagaaaatcggtgacaaacaaacatgtacgattggtttgtatgaactctaccggataacccagctgtacccaaaggttgatatattcgctcagcttcagaatgcaagtgaagcatttagaacgtacatcagagatgggctagctcaggtggagaagaatgctgcagctggcagaacaccctctagtcttccattatcaactccacctccaatagcatcaataccctctccaaagtttgcaccttctcctgttcatacaaaatcgataagtagcaaaacggattgtaatgaagacgacgccttcagagtccaaggagactctgatttgaggttacaatcagatcaacagacagatagattccaatcctcagcagggacattggatgctctcagggaaaggatgaagagcatccaagccgcagctgtggggggcaatttcgatgtagctcagactcggccactgtcaagtatgaatggcaatacgctccatgggggggcgcgagtggatggtgagccacaaacacaaagtaatattccacccatggacgagagagcattatctgggctgcaagcacgaatggagaggttaaagagtggctctatggaaccactctaaatatagttgacagttctatgagaaatacctaccattgtaattgactgtaaatttgcagcatagtcatgctatttgtagataggtatgtcggatgcactacatgatgcggggccgacattttgtaacccccgttcctggtcaacccattcttgaagagtttctggtgtagttgtagagaagctagtcagaggttttgcttgtagcttgcctgttgagggcctaattagtattttgacacatttttttggtgccggttgagttttcctgtgttgtatagcaatacaattgagtgttatgaattaactgtattgatcagtactatgcggttaggagtacacttgagtgctggtgggcttctaaaattttcgtgatgtaaatacttactgcca

SEQ ID NO: 26181 - DNA, 383 bp, Triticum aestivum
  unsure (1)..(383): unsure at all n locations
  Clone ID: PAT_TA_26181
tcggccggccccccgcccaggtacaagtccgtctcggcattcgctcccatttccaacccagtcaactgcccatggggggaaaaggcgttctcaggctacttcggtgcggacaacaaggcgaagtggagcgaacacgacgctacggagcttctgcccaagtttcccaacgaaacagatatcctcatcgatgtgggcaccggagacaacttctacaagcagaagcagctgctgccggagaatttgcaagaggcggcgaagaaggcgggcaagaaggtcaacgttcgcttccaggacggctacgatcacagctacttcttcatcagcacttttgcggacgaccatgtggagcatgcggccaagtacctcgnnngccgcccccccga

SEQ ID NO: 26182 - DNA, 448 bp, Triticum aestivum
  unsure (1)..(448): unsure at all n locations
  Clone ID: PAT_TA_26182
tcggccggccccccgcccaggtacatgccaccggacgtgttcgtctcatcggcgaagatgtagtggtaggtgtctcggacattcacggtcagctcccaggtgaagggcgaataccagggagcctttgcgatcttccaccaagtgatgccatagtgctcttggaagcttgcatcggtggatccctcgttgtcggtgttccagttgacttcgacggactcgaatggctcgccgctggcgttgacaccgttggtgctctcctcggtagcttctttaatgtcgtatccttcggctttgatgcggtatccgtcctgctcaaaccagctggcgttgccctcttggatttccttgtctttgtcggcgctgctcatgattgcggtagttgagggactttgagatttgaggagagtgnatggagagtcgctggaagaccccggccgcggccgcgcta

SEQ ID NO: 26183 - DNA, 319 bp, Triticum aestivum
  Clone ID: PAT_TA_26183
ttcgagcggccgcccgggcaggtacctccactggcaacaagcccaagaagtcaagcggcgcggccaacccgatgctcattcccggcgccactggtgtcctcggtctcttcgcggccatgttcggtctgctctgagcgtgacaaaggaaggactatggcgaatttgatcttatttgtgttctgcggaggcgtttttgcgagaagcatggaggagcatagccttatactgccggctgtttccttggttggggaattgaacaatttcggacagacaaggaattgcatagactaatggtagtacctcggccgcgaccacgcta

SEQ ID NO: 26184 - DNA, 719 bp, Triticum aestivum
  Clone ID: PAT_TA_26184
tagcgtggtcgcggccgaggtacttctggtgggaaggccatggcgaaagccctgaagaagctcacccagttgcgcaagcttggagtgtccggcgttaacaggaagaacagcaaggatattttctctgcaatcaagggtcatgttcatctggaatccttgtctgtccagcttgacaaggacaaccaaggctgttgcttggatgatcagatatccttgccctggaagaatctacggagtcttaaattgtatgggcttcaagataggttgccgttaccaagtggccttgaatatcagcaagtattgagtgaccagtttagcaaactcacgaagatggatgtggagatggacactttaaatgaacaagacattaaattccttggtgaggcaccgaaactatatattcttcgcctccgtatcaaggagcccaatggccccagcctaaattttattgttaagatagacgcatgcgcgttggccgtctacaaaaaggtcaagatcctcgagattggttgcagctctagctcattatcagtggaatttggatcagagacgatgaaaaatcttgagctgctcaagcttgactgttccagtgggacgacatacgctcttgatggcttggattttctatctgaactcaaggaagtcttgcttattggtagcaatgatgctacattcaaggctgaactggcggacaaacttggcaaacacccaaagaaacc

SEQ ID NO: 26185 - DNA, 1891 bp, Triticum aestivum
  Clone ID: PAT_TA_26185
gcacgcggcgcgccccgctcccccccgagcgccgtccaggggcctcaaggtgttcgaccgcgcgcgccgccatggcctccatctccgccgccgccaaggccacctccgccgccttcgcgcacaagaaggagctcgccgcggcggcgccgccgcagcagctcgcgaggagccggcgcgcgcgggccgggcgcgttcgcgcggttgcgacgccgacccgcgcgccgcgctcccccgcgtccaccggctcggtgaagagccctatgacgacgacggagaagatcctggcgcgggcgtcggagcgcgcgagcctcgagcccggggagaacgtgtgggtggacgtggacgtgctcatgacgcacgccgtttgcgggcccggcaccggcgggaccctcaagcaggagttccgggacgtcgccgaggtgtcggaccgagagatgctcgccattttccccgaccacgacatctttatcagcgacgagcgggccaaccggtacctcgacgtcctcaaggaattctgcgaggagcagaagatcaagtacttctacgacatcaaggacctcagcgacttcagagcaaatccggactacaaaggtgtttgccacattgcgctcgcccaagaaggtcactgccgaccaggcgaggttctccttggtactgattctcatacctgcaatgctggagcctttggtcagtttgcaactggaatcggaaacactgatgcaggttttgtgatgggaactggaaaggctcttctcaaggtgcccccaaccatcaggttcgtattagatggagaaatgccaccttatttactcgctaaggatctgattttacaaattattggtgagatatctgtatctggtgcaacatacagatcgatggagtttgttggatcaacaatagaaagtctaactatggaagaacgaatgacattgtgcaacatggttatcgaagctggtggaaagaatggtgttgtgcctgctgatgaaactacatttaagtacctggagggtaagacatcggtcgaatatgagcctgtctatagtgatgctcaggccagattttacagtgactaccggtttgatgtgtctaaattagagccagtagttgcaaagccacattctcctgacaaccgtgctctagcaagagagtgcaaagatgtcaagattgaccgagtctatattggttcttgcactggtggtaagaccgaggactttattgctgctgcaaaggtgttcttagcttcgggcaagaaggttaaggttcccacttttctcgttcctgcgactcagaaggtgtggatggacgtgtatagtctccccgtaccaggatctggtggcaaaacttgctcccaaatatttgaagaggctggttgtgatacaccagctagccctaactgtggtgcttgtttgggtggtcctcgcgatacatatgcacggatgaatgaacctacggtctgtgtatcaacgacgaacaggaacttcccgggcaggatgggccacaaggaagggcagatctacctggcttctcccttcaccgcggcggcctcagcgttgacgggatatgtcacggaccccagggacttcctgtcgtagagatcttgaaaacaatgaatttgtgttgcggaccgtcctgtactggtactttttgttcgtgttcgaaactgtagtttagatgcgtcatgtgtgtgtcgtgctgagaaataagctactcaacgagtagcagttgtaactgagaaaggttctgttgtatgctttttctttccggcattactagtgtgctgtcaggaacaaacataactgttacattaaaaaaaaaaaaaaaaaaaaaaaaaaaaaaaaaaaaaaaaaaaaaaaaaaaaaaaaaccaaaaaaaaaaaaaaaaagggccccta

SEQ ID NO: 26186 - DNA, 370 bp, Triticum aestivum
  unsure (1)..(370): unsure at all n locations
  Clone ID: PAT_TA_26186
tcgtgccgccgccccggccgaggcggccgcgctcgaacacgaaccataccnnatcaagcaagcccgtcaagcaacaacttccaacatgcataactcttgcccaaagtgcaacgctgcggtctccagcggaaagacctgcggctcgtgcggagctacttgcccaaactaaagctcgaaagcttctccagacgagacctcgaggtcatacaagcaagatgtcggaatcgggaagctgtgacacggcatcatgaggagacgatcatacgagagaatgaaaggatgacgagatgagatacgatgcatacgagacaagaggcagatcgcagataacgaatggcatacgcattgcgaacgattgaaaaaaaaaaaa

SEQ ID NO: 26187 - DNA, 643 bp, Triticum aestivum
  unsure (1)..(643): unsure at all n locations
  Clone ID: PAT_TA_26187
tcgagcggccgcccgggcaggtacaggcgtgaatgataaaagtgaccttcagtcacatggtatctaggagcatacaagagatcactgctcccgatttaccgccgcacgaccgtcgttttcccggtcatatacgtcctcgttcccgcagtcgccttacttgctacgtcatgcgactctgctgttctggccgctgttttcaacgccctcgctacactcatcaaaacgaccatcgctcttgctgcgcaagtcttggtcctcctactcgccctctccgcggcgccggacgctgcatcaactggcactctcattggcgtcatttcgatatcagaactgttcaaagatctcgctgtcggaattgccggcatcagctactacctttcagacgactactccgtggtcattatcaacggagcgctgtgggcgattctggccagtcttgtggtgatgggtgcattgctgacaaggaaactgagggagacgccgagagtgggtgaggatctgccggaggaatgttttgtgtgggagggcgtatttgacgtggaaggtggagatgagaacgggttctgatcggactgaggtgccgtgttcctttctcacgactgccaacgatcatccgcgatgtacctcggccgcgnnnacgcta

SEQ ID NO: 26188 - DNA, 873 bp, Triticum aestivum
  Clone ID: PAT_TA_26188
ttcgagcggccgcccgggcaggtactccctcgcggcaccggcaggatcgctcacctctatgatcgcgcgcccgaccacgatcacgtcgccgcctcgctcgtttacgacctgcaaacaaaataaggggtaatgagcagcaggttgcaatgcagtgcaggtgagagatcagtgtcagtcagcacatatgaagcagagacttcacggtaaaaaaaaactccctctgagaaataactgctaggtgcgtgtgaagaaaacagacagagtggtagtcacacaaaactgaaatggtaactgtcccaccaaatgaggggtttcatactgctgaccaggagaatctcctccagcgacaacatcaactccggtatcgacaacgtggacgaacgctgggctcggcgctggagctgccccggccgcggcctcgcccgacaagaatccgataacgaaatcagaatgttgctcggcaaacttcacggctgccgtggtgtaatctccatgagcaaggttgctcggtgcgctcatctcagcaaccaagagtaacccttttccctttggcaaacccttcagcttcaagccatctatgattccaggtccagggactacatgcgctgtgacaatatcggcccagtctgatatgcggaatattcctccttcatattgcatagttaccgtgttccccatgtcagcgaatttgcggtcttcaaggatcaaaaagttgtgctcttcagcaatcgaacggagcttggcaccaaaatctggtgtaaaatcagacaagatatccacatgggttttcagcatgcaaatctctggaccaaccttgttggctagctcaaggagttcctttgctgttgtaacatcggcggcgacgcagaggtt

SEQ ID NO: 26189 - DNA, 817 bp, Triticum aestivum
  unsure (1)..(817): unsure at all n locations
  Clone ID: PAT_TA_26189
tagcgtggtcgcggccgaggtgcagcagatgttatacgtggatccgcactcccttggacagcaacaacagcaataacgaacaagcacgagacatacctttaactcagtgtcgacaacgctctgaagaatcaacgacgaacgatactggcgcctgcggccgcccgcgccggcagaccagcgccgccatgcccattggctcctcttacaactcataacagacccacaattcgggttgactctcgacggatgctgcttcgctgcctttctcggctgatgcttgttcctgtgggacagcagcatggtgatgcgtgaggagagaagacagtgatttgagttgcccgtgaaaggatgatcgtctcttgagacttcctggatcgaagtgctcgcctctttgcgcgtgcacatgtctttcacgacaaaccattctctttttcatttttgattttctgcgcgagcgacatctgctttgggtcggcgttgtgatactttggcgacggggatatggaaggcagggccaggacgtaattcaatgggaaacgtcctttgccctttccgctggacgtggggctgaaaaaggagagacataggaagacccctcccatcaacgtccttgtgagggaatggagtctgctctggaaaggactgcacgaatggacggaacggatggatacccaactgagcggagtggagcctactgggaagaatgaggatgctatgtgaaagcgaggagaatcgcagnnnagcaagggaaacgttcaaaaacaatggagttttcttatgnnngctacgtttcatgtttctacttgtcatcatnnnc

SEQ ID NO: 26190 - DNA, 478 bp, Triticum aestivum
  unsure (1)..(478): unsure at all n locations
  Clone ID: PAT_TA_26190
tcggccggccccccgcccaggtacttgtgctcggggaagacctcagcgaaaccatcagcacgctcaacgagatcgtgctgggtggtgccggaaagaccgccgtgaatgagcttctgcgagttgtagaccttggttccgagggcaagcatcttgcaagtctccttggcgatagcaatggcatcacccgtcaacatcttgactgggacaccgagctgctgggcctcctcggccgcctccgcgctgtcctcacggggagggtcgaacatggaaagcataccgagaagaacccatgggtcgttattcttctggtaggcgacaccgagagagcggaaaccacggcgagcgaactcagtagccttgtccttgaacatatcggcggtctccttagaacattcggtcaagttgagaacggccttgggagcgcccttggcgcaggtgaagcnnnntnnnnnnngnnnnnnncnnnnnnnnnnncnnn

SEQ ID NO: 26191 - DNA, 183 bp, Triticum aestivum
  unsure (1)..(183): unsure at all n locations
  Clone ID: PAT_TA_26191
tagcgtggtcgcggccgaggtacccaagcatgacgatccccgctggatacaacgccacttcttccggcttcgtgacctacaccaagaccgcgactgatgactgcgaggaggcctactcgacctcgaccgctgaggcgacctaccaatcgactgccgctgcgtacctnncgggcggccgctcga

SEQ ID NO: 26192 - DNA, 487 bp, Triticum aestivum
  unsure (1)..(487): unsure at all n locations
  Clone ID: PAT_TA_26192
tagcgtggtcgcggccgaggtcggccgaggtacatgagtttctctccaaaggaaaaagtaacttggaaacactagcaggatttattaccgacagaagtggagggttcctgcatcttatgggttatatgaataaactgagtaagctgaagattttgtgtgagtcgcctgcaggctgcgctgaccgaaccgatcttaaggaggccattcagcagttcattgaggatgaaaagcaagcaaatattggttctcgctctttatcgcttcatttcagcaaatgctgtgaagagctcctgaattccttaaaaggaccctgctacctcagctcactgaaattgcacggtgacttggctgcactgcctcagtttgttgtttcacttcggggcctcaaggagttatgcctttcgtctaccaaattgacgacaggtgttcttgaagctttgagtaatttgagctacctccagtacctnnnnnnnnnccgnncgctcga

SEQ ID NO: 26193 - DNA, 733 bp, Triticum aestivum
  Clone ID: PAT_TA_26193
cccagcaccatctttcttcataagtttctagtaccgccgagctccacatcagcgctatcctctatctactcactaaacagcgtacatcatgtgtggcggcgcgatcatctccgacttcaccccggagcgcgaccaccgcggcggcagcaagcggggcctctgcaccgctgacttctggccgcatgccgccgcgttcgacgaccctaccgaccaccacgacttctaccccgacgagctgaccggcgcccgctcgttccctccccagcaccgagcggcaggaggagccgagcaggaagcgggagcgcaagacgatgtaccgcggcatccggcggcgaccgtggggcaagtgggcggcggagatccgcgacccggccaagggggcgcgcgtctggctcggcaccttcgccacccccgagggcgccgcgcgcgcctacgaccgcgccgcccgccgcatccgcgggaccaaggccaaggtcaacttccccaacgaggacccgcccctcgacctcgacgactacgacgtcgccaacgtggccggcttcatccaccagccgtcgtacatggcgccagaggtggcgtacgcgcaccagctgccgcagcaggacgagcccgggatggagctctggaactttggcaacatcaacgctcaagtgcctatgtgatagatagaaactgttcgttttctttctacatgtaatattgcttttacctaattattattgtgcttatgatg

SEQ ID NO: 26194 - DNA, 703 bp, Triticum aestivum
  unsure (1)..(703): unsure at all n locations
  Clone ID: PAT_TA_26194
gccgcgcgcgnaacgggggcggacgaaccagtaccgcggcatccggcagcggccgtggggcaagtgggcggccgagatccgcgaccccgtcaagggcgtccgcgtctggctcggcacctaccccaccgccgaggccgccgcgcgcgcctacgaccgcgccgcgcgccgcatcaggggcgccaaggccaaggtcaacttccccaacaagatcctcgtcgacgggcccgcgcacgaggcctcgtgcacgatggctgctccgccggcggccgtgctcccatcccccaagaaggaggaggagggggaggggttggagcacgcggcgtgctcctgcgaggaggtgaaggcgctctccgaggagctgatggcgtacgaaaactacatgagcttcctcggggtcccctacatggagggcgggaccgcggccacggccgcccctgccgccttcggtgtcgccgccgaggaggcgccggccgagctatggagcttcgaggacagctactacccggggcctctggggctctgattgtaccgtgctcgtgttagtcgctcaaaacagagtcgagattttcccttctgttctgttgaattcatttttttttcaatttgtaactctggtaaaatgcctcaacgtaacttttacaagtttctcgtggccgtgtaaataggctgtttgacccactctgtgttgaagtaacctgtgttc

SEQ ID NO: 26195 - DNA, 787 bp, Triticum aestivum
  Clone ID: PAT_TA_26195
gcaacgcccgcccgcaacgcaacgcccccccgcccgccgctgaaaccgcctcccttccctcgcctaccctccgccttgctcccctcgttccatcgacccttcggcacctcggctcgcccgccacctcaaacgccacccggcctcgcccgccacccatgtgcggccccgccgtcaccttcgaccccagcccggcgccgccccgcccggcgtccacagcccggctctggcccgccgcctgcccccagtccgacgcttgccgcgcagcaccggcgacagcgccgcgcacgaagcgggagcgggcaaaaccatgtaccgcggcatccggcggcggccctggggcaagtgggcggcggagatcccgcgcgacccggccaagggcgcgcgcgtctggctcggcaccttcgccaccgccgagggcgccgcccgcgcctacgaccgcgccgcccgccgcatccgcgggaccaaggccaaggtcaacttccccaacgaggacccgccgctcgacctggacgactacgacgtcgccaacgtcgccggcttcttccaccagccgtcgtacatggccgatgccgccgcgccggcgacggaggtggcgtacgcgcaccagctgccccagcaggacgagcccggggagctctggaactttgacaacatcaacacccaagtgatatagaaactggtctcttctgcatgcatgtaatattgcctttaccaaattattaagcatatgatgaattacgattgtttagtgagaaactttgaatatcgtcaaacgaatattttactc

SEQ ID NO: 26196 - DNA, 361 bp, Triticum aestivum
  unsure (1)..(361): unsure at all n locations
  Clone ID: PAT_TA_26196
tagcgtggtcgcggccgaggtacgacgcgaacatggcagaacggttggccgaggagatcccagctggcagctctgccgctacggcaggtggtggcagtggattcaattctccggtgcaccctgagttgtggatccgccgccgccacctgccgcggcgggggattcgggaggcgcgactgggcaggggtggcgcaggcgtctgtagcgcgatgaaaagggcgacgacgtcgcacagtattactgcgctcaagggagaggaggatgtggatagcgatggcggtaatgatatgctcgatgactcgtgaggtgtgcgataatatcgaccaggtggaggctgtacctnnnnnnnnnggccgctcga

SEQ ID NO: 26197 - DNA, 1567 bp, Triticum aestivum
  unsure (1)..(1567): unsure at all n locations
  Clone ID: PAT_TA_26197
agcatgtctttttttaacataaatatctccaaaccaaataagttcacaactcaaagcaaataagtttcagttagaacttcaatgagatttggcgaaagctatcacaacattttttctacaaaaatatcattttccatgtgatgggatatttgttgcatacagtggaaacacgtaggctagggtcggagtacaaatatatagcatctccttcttccactccatgatccgcttccagttttcagggcgtgtcgagatcaacccagatgcacaggaggaggattgtgagcgatgcaaggaacgcttccgcgaattttggtgggaaccaacagagtacactttttccacaaatgggaagcctcggaaaccccaagttctgttgtgagcaaataggggtttccttttccttcctcgagagatgttttcatagctgataaagttcttcagtcttggttggaaccaaattgtttccttatgtcaccaaatgatacagtggcagaaccccttctcttaggcttttgctgtgatgaatgctccttccacccagtcatgtaaattacctgaaaggttgctggaatggttccatcttctaacccaaacattgactggtaaatggctgcagtagctagtgctgtatctctctttaatatagggcttctttgaaagagagcatttgtttctgccattgctctaagatgttccacaagttcaagagcactattgtacttgactgtatatcgatctacatcaactcctggaagggcgaagcctgcccttgacaaaaggtttcctgcatcacggacttgtgctaatggcgacattcgaggactgatgcctccctcacgttccatttgagcaatagtgcatgcaattcttagttccttcagagtctccccgccaagaattgctgcaagaaaaaggccatcaggcttcaacgccaacctacactgtatcattgctccaggtagatcatttgtccaatgtagcccaagacagctcattatcaaatcctgggagttctctttcataggaagatactcttcatctccaacgataaagttcatctcggggccgtcgtcagtagcactctccaactcccgccacttgttcaccatgtctaccgacatgtccatcatggtcaatttctcgattccaccgcggccgcgaagcgaccggcggacggcgccggccgaaccgccgaggcagagcgccgaggggaacgccttcctgcagtcctcgaggcggtcgaggaggttatcggcgaccgcgtctaccagtgggtcagtttcccgcatcgcccacgccgcccggtcccggtgtcggcgcttcagatcgcgatcgaagatcttgacgcggcccccgtccagcacttcgtccgccgaggaggaagagaagtggtgattgggaacgaggtggcggcggcggtggcgcaatagcagaaggcgacgtgcggcggccgangacccggaagccatggcgagcgacggagcgaccaacggcgggttggagggagaagagaaggaactaatcctccaaggggggggnccngtacccaaattcgccctaatan

SEQ ID NO: 26198 - DNA, 520 bp, Triticum aestivum
  Clone ID: PAT_TA_26198
tagcgtggtcgcggccgaggtactacgagaagcaatgggaacatttccaaatgtcaggacagggcccatacttcggccagaaagcttggttcactcacttccactcggagaagaacatcactagcgcgatcgaccgctacggtaacgagatcaagcgtgtcctcagtgtcatcgatctccacctcaagagaacgggccagccatacctcgttggcgacaaggtctcctacgcagacctgatgttcgttccatggaacatgatgttcgggttcatcatgagtgaagagttcgaccaggaatggaagagcagctatccaaagtgctacgagtggcaccagaagctcattgctcgcccggctgtgaagaaggtgcttgacaccaaggcggcgaagttggcggagtcgaagtagatgctgtcgctgttgaagcaggaggagacatgatgatctgcagttatgggcaggcaatggatatataaacaagatattcgagacatgtacctcccccgccgcccccccga

SEQ ID NO: 26199 - DNA, 1278 bp, Triticum aestivum
  Clone ID: PAT_TA_26199
tcgcgaggtagctacacttgacactcctccctacagctagctgaatcgagctagcaatggcgagggcatcgtcgtcgtcgctgtccatgggtgtggtcgccgcgttggccgtgctggtggtcctgtgcgccgccgtgcgggccgccgctcaggggaagacggggcctcccgctcctaagctatcgtccaactcccatgcgatccacccggggcggttcgggaagagggcccaggtgctctcctgcgacgacgaaaaggacagcaacaacccctgcgtcgccacctgcgacaaggtccgctgccccaacgagtgcgtcgtcatgtgcccaggctgcaatacctactgcatgtgcgacttctaccccggcgtgtcctgcggggacccgcgcttcaccggcgccgacggcaacaacttctacttccacggcaagaaggaccagagcttttgtgtcgtctccgacgccgatctccacatcaacgcccacttcatcggcaagcgtaaccccaccatgagccgcgacttcacctggatccaggccctcggcatccgcttcgccgaccatcgcctttacatggccgcccagaagaccgtcgtgggacaccgcgacatcgaccgcctcgagctggccttcgacggtatgcccatcgacatccccaccgggaacgacgcccagtggcagtccaccaccgtgcccacgttgaccgtcacaaggagcgccgcgaccaacggcatcagggtccagctcaagggagtgtttgacatcttggccaatgtggtgcccatcaccgagaaggactcccgcatccacaactacggcgtgacggaggaagacagcctcgcgcacttcgacattgggttcaagttccacgccttcacagatgatgtccacggagtgctcggccagacgtaccgcacggactacgtcaacaagctcagcgtgaccgccaacatgcccatcatgggcggcgccgccagctacgtctcctccgacatcttctccaccgactgcaaggttgccaggttcggccgtagccgcggcgcgatctcgatgaccaccaccaaggccagttaaacaccgtgcgtcgacggctagctctcgagacatttgagacttagcccaggaataataagcataaaggatttatgacatactgatgccaccaaagacacacatgatcacgtcatttggatacgcacataaacatgattgtgaaattgatactgcaaatgatgaaatgaaataaatttattaccgaaaaacaaaaaaaaaaaaaaaa

SEQ ID NO: 26200 - DNA, 327 bp, Triticum aestivum
  unsure (1)..(327): unsure at all n locations
  Clone ID: PAT_TA_26200
tagcgtggtcgcggccgaggtactgaatccttgcccatgagcttccggcagagttcatgagccaacccattggtgaccttctccctcataccatcttgctgggcctcccgctggacatggacaagccggtgagtgtaaaatttggtccataattctgttggtcttgcctgatgttcgctgttgtgttatcctgcggtttcttgctatctttctgattccatttgatctgcttttggcacatgttttatggttgctgattgatgtaaaacttgatagctctagcatctcaattctgtatgctgtaccnnnnnggnnnnncccctccga

SEQ ID NO: 26201 - DNA, 353 bp, Triticum aestivum
  unsure (1)..(353): unsure at all n locations
  Clone ID: PAT_TA_26201
tagcgtggtcgcggccgaggtacttcttacaactattataatgcctatatcactgctgagcaattgaagctcgatatcagaaaatataaaatcttatgtgataattatattactactagaaactttactgcttgcggtattcctagtattagatatattactattttatatattttttgaaagcatattaccacctctgtttatactaataggtttattcggatctagtaacagagttagagcaagtttctatttgttcttatacacattattaggttcattgtttttattgctatcaatacnttacgatgtnnncatctataatgggtccctnnnnnnnnnnnnnncgccgn

SEQ ID NO: 26202 - DNA, 787 bp, Triticum aestivum
  unsure (1)..(787): unsure at all n locations
  Clone ID: PAT_TA_26202
cgacaccaccaaanaattagaagccgcttttggattagttaattgtgaattacgattcaggtcggattttgacagcgaaatcaacgcggcgatctttggtactagtaccagtagtgcagtctaagcggtgccgagcttgtgcgaggagcagagcatcgtgtccatggagacccagcaggagcccaccacagccggggcggtggtggcgccgccgggggtcgccggcgatccggccggcggcggcgccggttctcgagaatggacctccagcgccaacaacagcacagcaaggacctgcagctcctccgggttcagcaactgacagagatgcggtgcttgccaaggtggagatgaatcggaagctgtcgatggtgaaggcgtgggaggagaaccagaagagcaaggccgacaacagggctgagcacaagatgtcgtccatcctatcatgggagaacaccaagaaggcggcggtccaagccaagctccgaacacgggaggagaagctggagaggaagaaggcggagtacgcggagaagatgcggaaccgggccgcgatgatccacaaggaggcggaggagcagcgggccgccgtcgaggcgaggcggcaggaggagatgatcaagtgccaggagatggccgccaagcaccggtcacaagggaccacgcccgccaagaagttcctcggctgtttcggctgagcaaccactgaaatataatcatagtgatcgaaagttgtgaaatagcttagctacaagatgtgttctctctactgctctttgctctcttc

SEQ ID NO: 26203 - DNA, 276 bp, Triticum aestivum
  unsure (1)..(276): unsure at all n locations
  Clone ID: PAT_TA_26203
tcgagcggccgcccgggcaggtactgttgcaagttttgacnnngacgattttggcgcttccggtgacgtttcattcgttgaatggagtgaggcatttggtgtgggatacggcgagtatgattacgaataagcaggtgcagacgacggggtggacggttgtggggttgagtgttgcgagtgcgttgggtttggcgtttttgtaggtgggggaggaggtgagatagaagatgatggaggaggatgaagagagatggtacctcggccgcgaccacgcta

SEQ ID NO: 26204 - DNA, 799 bp, Triticum aestivum
  Clone ID: PAT_TA_26204
gtcgcatcactggattatcactgtccgtctcacgctcctaccgaagtagagtaccaaatagcagcgaccagctcatctagcaccctgtcccggcggcctgatcgtcgtccccggcaggccggataggcacaggcgagcacagaagaggcgggaagcagctgatgagagccaggcaactgatcccccgccggagaaccgtccatccgccatgagcgacgggcagggcaatgctcctcccggaggctacttcatcggccgtccggcgaacaccgacgagaccaacgagaaagaaccgccgcaggccgtcgctgaacctgctccaggctgcgctgggtacttcctggtgattacttcgtcggccgtccgggagaaccaacggcagaacacggaaacgccggcgcctaaaccgggcttctttggccaaattctgtccatgcctcaggcggtggtgaagctaccagctagaccgacaggcccagccgccgtgcgccgtgcgcgtgaccacgggaggatttgaagtggaaatcgggtcccatgagtctcaattctgtttattggaactgtgcgagttctcttcattctttggaagctctgctctgtttttccttctttcactagcatttgattcctccatattcattcgtgtaacgccgacaaacgtaaactcgacgaaattgcaatccgtccatgtgaaatgaaaatggtgttgatttgttcaattgtaacgacgacgcaaccgatcccgaacccatccgcaacaacgcgcctctttcgctccccggcgactgggtccaataat

SEQ ID NO: 26205 - DNA, 465 bp, Triticum aestivum
  Clone ID: PAT_TA_26205
tcgaccggccccccgcccaggtactgccgcggattccaggtcttcgacaaggacctcacgggcttcatcggcgttggacaattccgatacatcctcacgaatttgggcgagaagatgagcgatgatgaggtggatgagttgttgaaggcggtggataccagttcgggggagctgaactacatggatatggtcaagatgattttgcagaactgagcaagaggtattgagggagagacagatcgttctggattctactgcgaagtctcgttcccgtcatctctcaaaatgctctcttcacggcgtttggacggatgattttgctgggcttgaacctggatatgatgtggcgcggcgttgcaattggaaggaagacagagagaatcgagacataagcggcaagaatgtgcgtgaccgagggaagaagatgagcaggtgatacgctgtacctcggccgcgaccacgcta

SEQ ID NO: 26206 - DNA, 256 bp, Triticum aestivum
  Clone ID: PAT_TA_26206
tcgagcggccgcccgggcaggtacaagaaccaggaggagtggttgacgaagacgattacgagtgtggcaaggatgggcctcttcagcagtgatcgctgcattgatgagtatgcggagatgatctggaatgtggagccgttggctccgaaggactagatgagtttgatgagagatggacgggtgaaaagttcgtaatgggtcgatgtagcatgaaatagagcaacgacatgacggtacctcggccgcgaccacgcta

SEQ ID NO: 26207 - DNA, 429 bp, Triticum aestivum
  Clone ID: PAT_TA_26207
ttcggccggccccccgcccaggtaccatctccccatctctcgtggacagggttgggcttggggcgcacgcagcaaggatagagcctttgcgattggcgttggcactggtggatatgttggagacgagggctggagtaattccaaggcgagcgctgccaatgatggtgctgagcgggcatagaagctcagtgatggctttgggatttaaggcgaggcgttgtttggtaaggcaaaagagcaccaggcttgccaccggaattgaaacgatcatgattttccagaaaggctagaaagacgtggcctgggcccagggccttcggaacggcacagcatgagctggagcagaaagatacagaagatggcatcagcttgaaggcatttgacatggtagactgtgcgaaatactgtacctcggccgcgaccacgcta

SEQ ID NO: 26208 - DNA, 744 bp, Triticum aestivum
  Clone ID: PAT_TA_26208
gaattcactaagtgattagcgtggtcgcggccgaggtttttttttttttttaacaacatgaatacactcactatatacataactctttaatgcaaagttgcacacacttgagaggaacaaaaagttacagacaattgcagtaatgcacggacctgttgcccacaagcacatactgatactacattattgcagcatactgatactacattattgcagcaagccacacataattttattcattacaaacccttgacaagaacaagaaactgcagacagtacagacatgcacgtgtagctaataaaactcgatcgactcagactcgtacaacattatacgctgcaaggagcgcataattttattcattacaacacaaaatagacaagtacgaaatgaaaatacgaaactgccaggtgcacttgctccagggcttgttgcatctgttcatgggcgggaagcaaggattctggcgctccatcctagccaatgcttcgcgtatctctccgataccttgcatcacctgtcccaggtcacttcttagatgccggatctctctgctgagataagacatcctctgatccatgttcctgctcagatctgccaggatttcgacctgttcatgggtccatggccttcaaatgcacagcaattcacgaggagtcgctctacaacccttttactttcaaatcttccctgccttaccgatcatactctcatgatccgcctagtacgcaagctgtcataaa

SEQ ID NO: 26209 - DNA, 902 bp, Triticum aestivum
  Clone ID: PAT_TA_26209
agcaggcaagttgcgttacatactcacatggattttttacatcgcacaatgccactgacattgatgtacacgctatacaggaaatgggtgccggaagaatatgatctccagctatactagagaggatcacctagcattatttagtcacagaatgatctccagctgcttgtttgcttattcttctttcccaagggcggagccgccactagaattctgatatgtggctccaatttctgggttcatcagcttgtgctcttatccttgacagtgaaaaggacactggagtcaaaaacttgttgtccagcggtagccttcagtccttctatataacctgcccgaggcgccttcacaacatgctccatcttcattgcttcgataaccatgacaggctgaccattttccacgtgtaccccatccttaagcaaaaccttaacgaccaaaccagccattggtgccaaaacacttccttttggatgggatcttccctcggaagcctggctaggttgagaactatcatcaagtaaatgctcagctctcatcgtctgcctgtaatgatggtgatgcttcccatgccagatgtgtatatgtttgctattatcctttgaataaaatgcgattgtcacgtctgttggcacaccacccacttcaacccggaaatcatgttcgctcccaccatctactttcacatcaaaaccaggagaagagccagcttcagtctcaatgaagtagcctccatcagatccatatgtaaccaataatttaaggagctcccccctccacccctcaagttcttcatctaactcaaattccatcaaacgcttcgcagagtgatgcatcctgaaaggtggacgggtataccatactgaaagcgtcttgtcacgaagggattcttcggagctaat

SEQ ID NO: 26210 - DNA, 247 bp, Triticum aestivum
  Clone ID: PAT_TA_26210
tcgagcggccgcccgggcaggtaggccaacgggggttcgaaatttgattctgagaaactattgaccctgctctgatgaggagcctgtcgatatcgctgtgtcgctgtcgtgatggtatagactgccgtgaatcattcgcaagagtggtgtgaagttggagtagtacctccgccgccgcccccccgcaaaccatcctcctcatccgtcactcatcagaagaggtgaaacctcggccgcgaccacgcta

SEQ ID NO: 26211 - DNA, 1012 bp, Triticum aestivum
  Clone ID: PAT_TA_26211
gctcgacggcggccccccgtccgtccgcctcaacagttacgttctttattctgtagcagcacctcgaccgtccaaacattttgcagattacacagaaaccatcatacacgcatgatcatcactcatcagcatgcacatcgttagcacatctcggccaccctggtcaaacggccgcggaagacagctgcctcggctgcgcagcacgcccgggtgctccctgctcgcctcccccaacaccaccatcgtcgttgtcgtcgtcctcgtcctgctcccacaggaagctggcgtacgccgcgaggacgtggctgtcccgcggggctgcctgcaccgacttctggaagtaggtgagggacctctcgtggtcgcggtgcaccgcccacaccagcttggcgtactgcgacatgatctcgccgtcggtcgggtcggcgagcatggcgcgcgagtagtactcctccgcccttctcgggtcgcacttcacctcgtgcaggaactgcgcgtagttgcgcaggaacagggcgttgccgggctgctcgtcgaccatctccttgtactgggcgtccagcgccagcaccgccttctggtccaccccgctggccatcctagccagggcagcctcggagcccatgccggcggtgaagaggccggaggcgaggcggtcgatgcccatgcccctcgccaggaacagcggcagctccggcagctcaggctgcgccgtctgctcctgctcctcctccatctcctgctcctggtggggctccagcttggctttgctgaaggtgttgtagatggagaaggagagctcggtgtggaggccggtggttctgttgctgtcgttgtcgccggaggaggaggggttgagcgaagggaggtggccgtcggagaaggcccgccggagctggagggaggaagggggcgaaggggaggaggaggaggtgaggaaggagcgcaggaatggcgtggaggagctcctcagcagcatcctctcctctcctctccgcgtcttcttgtgaga

SEQ ID NO: 26212 - DNA, 1077 bp, Triticum aestivum
  Clone ID: PAT_TA_26212
gtcgagcggccgcccgggcaggtcaacgccagatgcttcttgactttgctcggaaatccatgcctgtgatcggctacaaccactcgggcgctagcggcgccctttgcgcctgcctcgcagctgttgtctgctcatcgcatctgtgctgcctccgtcctcttggcagctcggctggtgagggtgctgctctaatcagcaaagcaagactggacagagcaactgagctacgggccgacccccattctgcagccaactacagcaggtcaacccgttctctttggcaggcgtcgttcgatgccttctttgggcttctgacgaaatactgcgacagcaagtatgggagcattctgcagaggttcagcatgcagggatccaactcaatggctggacctgaagcctcgaaggccgtcagcagggagatgcccgtcgagctactacgtgcaagccttccgcacaccagcgaagaacaacgccagatgcttcttgactttgctcggaaatctatgcctgtgatcggctacaaccactccggcgctagcggcgggcattctactacttccgaacctgtccccggttaaaactacatgtgctgcttgtccttcagatggtgattacagaattgggatagacatgcttcctgtttcgcaagatgtgtgagcatggagaagttccgttggctccgtgtcaaagttagcgttcgtgaggctgtgactaggatggaggttaatttaatagaaccagcattccccttcatgtgggtgtataatacccgcctgatggctatataccatgacagattgtccatgtatgtaccctgtgttgtaactgtgcagtgatggaccagatggaacctagttttaacccttattttctcccggtggaaaaacaaggtggtggggggtggcaatggctgtgcaagtagagtttctataaactatcttgtggttgcttcttggtggtggacgtgtgggggatctttgtgtgagtggtggcagtgttgaagctcagtttggtctatccatatgcattggtgagatatgagatgtgtgtgagtctcttatttgtaagcttggttat

SEQ ID NO: 26213 - DNA, 613 bp, Triticum aestivum
  unsure (1)..(613): unsure at all n locations
  Clone ID: PAT_TA_26213
tagcgtggtcgcggccgaggtgatccacccaatcacacgttatgtgatgaactatcttaggctgttggtcgtttacagtgatacgcttgacaaactcttggatgaggatgctgccggagatgctgatcataatgcttcaaatggaggtgctgatgatgacgaggagtatctgcagagcttgaccccacttggacatcggttggtgaagctcatgtcttacttggaggccaatttggaggaaaaatctaaactgtacgaggacggtgcactccagtgtatattttccatgaataatacactttatattgtccaaaaggtgaaggattccgagctcaggaggattttaggtgatcattggacacggaggcgccgtggaaagattcggcaaaattccaagagctaccttaggatatcgtggacaaaggttttgtcctatctcaaggatgatggtcatggcagtgggagtgtaagtcttgggaattcaagctcgagggtcaaagagaaatttaagaacttcaactttgcctttgatgagatttacaggagtcaaacgctttggaaggtacctgnnggnnnnnngnnnnnnnnnnnnnnnnnnnnnnnnnnnnnnnnn

SEQ ID NO: 26214 - DNA, 423 bp, Triticum aestivum
  Clone ID: PAT_TA_26214
tcgagcggtcgagcggccgcccgggcaggtcgcaaaaatggcaccagcagcaaccggaggcaagaagcagaagaagaagtggtcgaagggaaaggtcaaggacaaggcccagcacaacgtcctcctcgacaaggccacgaacgataagctccagaaggatgttcagtcctaccgcctcgtcacagtcgccgttctcgtcgacagactgaagatcaacggatcattagcgcgcaagtgcctcgccgatttggaggagaagggcgtgatcaagcaggtggtcaaccaccacgcatgcaagatttacactcgtgctgttggtggtgccgattaaacgaacaacctcgcgcgcggtggagcagggacattctgcaggaatcgattgatatgaatatctgatggcgtacctcggccgcgaccacgcta

SEQ ID NO: 26215 - DNA, 409 bp, Triticum aestivum
  Clone ID: PAT_TA_26215
ttcggccggccccccgcccaggtacgccattgctcagggctacaagagctactctccatgcaactcgttcaacgtatttgaggtctggcaggactccgtcatggtgggcacttactgcaagctgtttaccgagaagttgcagtcagattggttcagctacaagggtggaaacgctcttggccacctctttgaggtcaagaatgctttctcgtatgagtttagcagcaaggattacgggacgatctaagtggtcgtcgttgattgaaagaagcattgattagacggagaatggagcaggggaagtgaaagaggatttttctttgtgatgaaactcggcttttcggttcgctcttcttggacatatattatttagcgatttctccgtacctcggccgcgaccacccctcga

SEQ ID NO: 26216 - DNA, 601 bp, Triticum aestivum
  Clone ID: PAT_TA_26216
ccgtgttctgggggctcctactattcatgctcgtggcgacaacaatggcggtcgagtacggtgcaaggagtcataacagtggtccttggagttggtgcgatccggccacgggctacaaggtgagcgcgctcacgggctgccgggcaatggtgaagctccagtgtgtgggcagtcaggtgcccgaggctgtcctaagagattgctgccagcagctcgccgacatcaacaacgagtggtgcaggtgcggggacctcagcagcatgttgcgcagtgtgtatcaggaactcggcgtgcgtgagggaaaggaggtgctcccaggttgtcgaaaggaggtgatgaagctcacggcggcgagcgtgcctgaggtctgcaaggtgcccattcccaacccgtcgggagacggagcaggtgtctgctactgggcggcgtatccggacgtctagtcaagcgaatctgcatcttaattggtgcggtgcgtgcgcacaagataaataaaattaagtaatggtgtatgtgcctctgcgagatgcatgggtcatgaataaatgtgaacttagtttcctgttgatggataacactagtatctcagatttgtacctta

SEQ ID NO: 26217 - DNA, 1241 bp, Triticum aestivum
  unsure (1)..(1241): unsure at all n locations
  Clone ID: PAT_TA_26217
gtcaccacttatatccaaggaccatgagcgagcttacggcgctgattaagatagtactaaattgaaacaatgtggatgaagaccgtgttctgggggctcctagtattcatgctcgtggcgacaacaatggcggtcgagtatggtgcaaggagccataacagtggtccttggagttggtgcgatccggcgacgggctacaaggtgagcgcactcacgggctgccgggcaatggtgaagctccagtgtgtgggcagtcaggtgcccgaggctgtcctaagagattgctgccagcagctggccgacatcaacaacgaatggtgcaggtgcggggacctcagcagcatgttgcgtagtgtttatcaggagctcggcgtgcgtgaggggaaggaggtgctcccaggttgccggaaggaggtgatgaagctcacggcggcgagcgtgcctgaggtctgcaaggtgcccattcccaacccgtcgggagacagagcaggtgtctgctactgggccgcgtatccggacgtctagtcaagcgaatctgcatcttaattggtgcggtgcgtgcgcacaagataaataaaattaagtaatggtgcggtgcgtgcgcacaagataaataaaattaagtaatggtgtatgtgcctctgcgagatgcatgggtcatgaataaatgtgaactttgtttcctgttgatggattaaaaaagtatctcagatttgtaccttagatgcatgggtcatgaataaatgtgaacttgtgttcctgttgcgcaaccacaacaaccaatttcgcagcagcagcagcagcagcagcaacaacaacaacaacagatccttcaacaaattttgcaacaacaactgattccatgcagggatgttgtattgcaacaacacagcatagcgcatggaagctcacaagttttgcaacaaagtacttaccagctggtgcaacanattgtgttgtcagcagctgtggcagatccccgagcagtcgcggtgccaagccatccacaatggttgttcatgctattattctgcatcaacaacaacaacaacaacaacaacaacaacaacaacaacaacaacaacaaccgttgagccaggtctgcttccaacagtctcaacaacaatatccatcaggccagggctccttccagccatctcagcaaaacccacaggcccaggggctctgtccagcctcaacaactggccccagtttgagggaaataagggaaccttagcgct

SEQ ID NO: 26218 - DNA, 337 bp, Triticum aestivum
  Clone ID: PAT_TA_26218
tcgagcggccgcccgggcaggtccagccgccgtcctcccaacaacactcgagcggccgcccgggcaggtcacaactagcagcgctgctgcaggaggcggcaatctccttgggggactcgtctcagtcgtcaatactgtcgtaggaggagcgtcttcgacgacctcatcggcccgtgcaaccactaccactgcgaagtctggcctgtccggactgttaggaggatgagagagaatttgggaaggattttatgaatgaaagaatgtttggcgttcagggtcggttgcagttctgctctcttggatagattttctttgtacctcggccgcgaccacgcta

SEQ ID NO: 26219 - DNA, 401 bp, Triticum aestivum
  unsure (1)..(401): unsure at all n locations
  Clone ID: PAT_TA_26219
tagcgtggtcgcggccgaggtactgaaactagcgtatataatagttattacacctattacgtatatcacgcttgtaaagtagaagtacgctttaggtaataagggaagtattagtctaagtataccatagaggctaagcttcaacactatacctgccaatattatgctaccacctaatggagattcaacatgggccttcaataatcaagtatttaagaagattgtaggggttttaacagcaaaagctataactattcctgttctatggtatagttgagttataaagttaaagttggttttatacagtgcatcaaaatctgtagtagatgaaattgtataagcgaatttttttatttccttagacttacaccgcacaaactnnnnnnnnnnnngcgnnngaa

SEQ ID NO: 26220 - DNA, 211 bp, Triticum aestivum
  Clone ID: PAT_TA_26220
tcggccggccccccgcccaggtactaattgtgttattaacttctctcttattaagcagagagttgtttaacttactctataggctatgtatgaattcagccggtccctctaatagttctggaggagctacaggtggaaatactgggggtggaggcggctcagggccagggggtcagccacctcacagtacctcggccgcgcccccgctcga

SEQ ID NO: 26221 - DNA, 367 bp, Triticum aestivum
  unsure (1)..(367): unsure at all n locations
  Clone ID: PAT_TA_26221
ggccgacaagttccaatttaacccaattacatacaccacctcttacgcggtcgcgccccacgtcccgcaagatcccaagcgtcaggccaatttgacaaaccgcagtccctgcgccaaacactcttacgcagcacatgtccaatccagtggacatgacagctcgcaagagtgcccttcactgataaggcaagcggacagcgaaaggaaagcgacaggctggtaaaagctgaaaagaagaatcaaaaatcaaagcggcaacacacacaagacaaggaaaggagattttgccgtcaaggcagtggtgatcactgcggcccacccattcgaccccagatcccggccgctccggcgtgcggacgtgatggan

SEQ ID NO: 26222 - DNA, 672 bp, Triticum aestivum
  unsure (1)..(672): unsure at all n locations
  Clone ID: PAT_TA_26222
tagcgtggtcgcggccgaggtactccacgcatgcggcagacgatcaatctggagtttcccgaccttgacttccaccggattccattttgagcatcagccagatccagaattcgatttgactccctatttcatgcctccccaaagtgcagtgcttttgttctccacgaccaggaattcctcgtgttcaatgccatcactctctattgcgagcgcatcgagctccaaagatcctcgttcggtcgagcagcttgcgccaaaaggatcgtgcttggcggtctcccgttccatcacaaaatctttcccatttgtgacgatcgattcattcactctctctccgctggccttggcagagcaactactcgcttgcatttggcgagtagtctttgttggcggctcttttccgagacgacgtagtgggactcccgcggagccatcgggagcatcgtggccatgagggtttcctcgattgatgatgaggaggacgaggaagaggagcgcatgctgctggttgaggagtttttgcggtggtttgggaggtggatnnnnagttgcattttggtgtggtttgtcaaatagtgatcgtattgcttggttggatggtgtgcttgttgagatgttgcacagcgtggttgattgagtgtattgaagttgtatatagatcaactagtcnnn

SEQ ID NO: 26223 - DNA, 1917 bp, Triticum aestivum
  unsure (1)..(1917): unsure at all n locations
  Clone ID: PAT_TA_26223
cttttttcattctctgtttcaagttcatatgttcaaaaagacttcatgtagaacagactatatgaagcaaatacctgtgcaatctgttacactaaaaacctagccaggtcccgctttatgcgatatgcaggtacgtgcgtactaccttaccacactgtagtcacgtatgtaatgggactagtagctagataaaacatcccctcctccttgacaaaaaaagacgctggtgactaaaatgtttggagaagaccctccatcaaacctttactcaagaatggtattattaaataagcctccataaaccacctcgccttctatcgacatctcaacatttatccgaatttacctcacacgtcgcttggccaccatcatccaccaccttgtccgggatggcgtttctagtcgtccaatgtgatataagcgatcggcagctgcatcacatcaatcacctgatgcgcgatggccgtctcgaacaattcttgatacttgatctcaccaacatctcggcgtcctccgtcttcctgctcgaggataatgacctcgcatcgcatgtctggcggctccgcctcttgcgccgacagcgtcacgtcgacataacacctggagcatggcggcatggtcccttggcttggccgcacactgtacttgttcgggttgatctctatgttgaatgcgatgaagccacccgtcttgttggtcagctgcaggcagcacgacgcctccttcccttgctcaaaggggaaccgcagctccatggtcggatccaccgacagaatgttggtgtcacagctcctctggacagtgaggtcttttgacacatcaaaagctagtgacattgctttaagcttagcttccagttgatccagttcatggacgatgtccttgatacatggccttttgtttctgtcctcgtccacacacctaagtgcaatcccaacacatgaagtcactcctaggatgtctatttcgtgtgaggaatgtcctgtcttttcctgcaactttttcgtccagttttcactgacaagctggataaacttttccgggggcatttcggaacaccggatgtagttcttctccccggccaatatttttataattatgacgcccaaactgaacacgtcaaacttctttgatataaagccaccttttatgtactccggtggcacgaacccgagtgttccatcgcgcatctctgtttgtcgcgtttttgttgaagcaacgagtcgtgacaaaccaagatctccaattttgggcgtcatactttcatccaacaaaatattaccaggcttcaagtccagatggaaaataggttttccctgtgaggtgtgaaggtgatctagtccctcacaagtccctttgataatctggaaacatgtgggccactcaagcccgcaagattcatcttgaatgtgtttatcgaggcttccgccgtgcatatattcgaagcagagcactcgctccatctctttagcgaagataagctcccccttgtgctccatgtatttcttgcaagactggtggcagtagccaattagccgcacaacatttatgtggcgtatgttacgacggacggaactcgttgtcgaattgcttatcatcgagtccctgcagttgacgaagcttcttcaccgcaatttcttccccttcatgggtcgccctgtaaacaactccgtatccaccgctgccaactatctgatcctctgcaaagttgtttgtgatggcttcgatatcctggagcttaaaatccatgttgctgatatctcccacccggcaggcttactggacgatcctcttctttttcttcctgacctgacctggtgaagaaggagcgaatggaaggccgaaggcgacgatggagcggagcggagcggagcagagttggttgntcggcggcggccaagatgagcctcgtgccga

SEQ ID NO: 26224 - DNA, 443 bp, Triticum aestivum
  Clone ID: PAT_TA_26224
tagcgtggtcgcggccgaggtacgacttcacctcttggatgccttacttattcggagcgctctgggttctgaccctgtgcggcttcatgaccatgttcttcccgcaaacaaagggggttgagcttggttatggtatcgctgcgcgcgttgatcttcagtgcatacattcttgtggacacgcagctcattatgcgccactaccacgtcgaggaggagattgccgctgcgatcagcttgtatctcgatgtgctcaacctgttcctcgctatcctgaggattctcaacagccaccagaacaactagacgacagacgttgttggccggcactttagattggatcaagaatgtgaatacatgcggcgtttctgaaggattttgggtcggagctgtggaataagacagcggggaggtattagatatcatgtggtcactcaaggattgtc

SEQ ID NO: 26225 - DNA, 274 bp, Triticum aestivum
  unsure (1)..(274): unsure at all n locations
  Clone ID: PAT_TA_26225
tagcgtggtcgcggccgaggtacgcggacacggcgacgtcggtgccgattttcttatgcgcggcgttgtatattgtcatggcgattacggcggcttgttttccgtttgagccgatggggatgaggagttcgtaggccgaggagaagatggagtaggctgtgttttgataagatgggcatggtggtctggatgagctcatgcattcgctgaagatctggagaacagaactgctatcaagctagacggaagtacctnnnncngggcgnnngctcga

SEQ ID NO: 26226 - DNA, 501 bp, Triticum aestivum
  unsure (1)..(501): unsure at all n locations
  Clone ID: PAT_TA_26226
tagcgtggtcgcggccgaggtacccgccaactgtgccggaagatggcgtgagccgacagaaagcagtgcgaccggaggacgtccgcatggcgagtggatataccagcagaaaggcgggtgtatcggaaaggccgagcttaggtcgaaacaccagtagctattacggagcgggtgtcagggcgtgagaggaggatgaaggcaccgagagattgaagcatttacactggcgttgaaccccgacaagggatgaggatataggcatcacagcacgggatggcgattgaattggcatggcatggcacactccacatactgcatgggagggggactatcggttcgtgaatgagcaaggcgagggtctgggaggtggatggtaggatggatgaattggagtaggtggttgaatcaatcgactcttctcggcacggatggcagcactcgggcttttacggctggctgatagaaatctttgcagtaacgagtgtaatgatcaatgagnnn

SEQ ID NO: 26227 - DNA, 1936 bp, Triticum aestivum
  Clone ID: PAT_TA_26227
gcatacatatcattttctcaaacatcaatttcaagatgaccgaatatgaacatgtacatgacccccaaaagtaaataaaaatcttgttcttgccaataaatacaaacacctgcgaccagatcacaaattgctcatctagatgctgagccggattacatgttcaaggaactagacaaatgcagcaaacaaaatcctctcaagtgtccaaaacaaaaattagtggccaccatgaaatcacattgcttgactgcgcaatatactaactaaagctcaataatcactccgaattgtgcatgtgcattggacttattcccttggagtatggaggcatggagcagactaggcctccaccttcctgtagaagatgctcatcgcatcgctgtacagggccactgaattggagagcacagcaagcacaatcatggttacagctaaaaccttgtcgcgcttggttgcaatcccataagaatccctcagtatgatcatggcaggaaagatgaaaccaatcaggacagcagctgtagcaccggtgaactggaacgcatcccagatgcttggtatgaagttggcagcaagataaatcacagcgaggagtgagacggtgataatgataaaccttcggttgtcatgagaaatgtgccttgaggtggggaagaggagtccatccaggttgagcctaagggcaaagaagactatagggaagaccagcatgacatggactacatagctcactctgactatatcattgaagacagagctgaatggaatatgaaggtcagagtcaaaattagcgagcacatcggagagggtaccctcgccgaagagtaaatatgcaaagaagcttgttgcaacataaacacttgaacagagagccaatgaagttcgcacaattggcttagtctgacttctatcttccggacgcgtggcgatgctgtgaacattgtagtggcaaatgtaggcagtgaccaagaaccggcacagcttgtaaagagttcccagatggaattgcgttccatgtttagccccgaggtgttccggcccccccgccctccgctggtcctctccggggttgtgcccctccccctggcctggcaccaacttcccactcccaggcccactgccggtgccgatggcgtgcgcaccgtctccgcccgctgcgccctcccctggcgagccatctctttagcccggcgggcaagcagaacaactgcgcgagaattccagaaatgaggcccaaaccacccctcaaagataccccggtgatgaacaccagttgtagatgttcccgatagcacatcaccgatgataatcatgtatacaatcatgacgccaacgttgtttatgaccacagatgcttgcagcacaatcctcccccattgaccaaaagagtcacccatcagccagccataggatgtaatcttggcctggtggctgcacctgaccatcatgtcaattgatgcctcagtgagcaatgccacaaggatgatcatcaaaataccagggataatgcctagcatcttgatacttgctggcagggccataattccagcccccacgatggttgtcgacagattgaaaactgcacccgagaaagacgctccattgaactcatggatcccatcttcctcttccgccttgaccgggagaagtggcgtggtctcatccctcttttccttgtgtgcagactggttttcactaggtgatgcatccccaatccccatttgtttcaagtactttcaacctcctctacagaatcccaactgtcgctcggccaacaacccgaacacgaagagagcggagacgaagaaaatcgcggcagaagactttggcgggtgcgcgcgcgtgtgtagacggagttgtccccccccctcccacccccggcggccttcttatattgacgaatgccgcgtgcggtgcggtgccgcgcctccgctta

SEQ ID NO: 26228 - DNA, 700 bp, Triticum aestivum
  Clone ID: PAT_TA_26228
aattccaacatatactactaagaacaaatcatcgcatgccaacagatcgagaaccattcctagatggggagtacagataacaaagtaaaccagagaggataagaactgcagaacagccacatattttgattggctaccagcatggatcgatctgcaaccacaggagaactcaagcagcaaaaccaacaactcaagccacaagcaaaaggcaacaaagacaacaaaccattctcttcaggagatcagaaaccaataagataatttttcggttgtagagaggttttttcggttgtaggatgtcccatcaagactcaaccaacacagcaaccttcgaatcttaaagatactcagaaataaatctgaatgttcaaattgtctccataagataatttatatgttgaacaaattgcaatgaattggaaaggtgtagggtttagaagatcttcaaacagataactccacatcagggtggacctaaataagtcaattaggacctgcaaccaccttcccattaaacagctaaataatgcatcaaaacagttaggggctaggataagcctgcttggctgggagagatcagttaggcaacgacaccagttccagatagcgaactatattatctctcatccatgtcaatatctgcaaggacacatagttaccaagggcagagaaaaccaaaacagtgaggggataggataag

SEQ ID NO: 26229 - DNA, 987 bp, Triticum aestivum
  unsure (1)..(987): unsure at all n locations
  Clone ID: PAT_TA_26229
natccgaaggggcattccatagtgcnattgaggaacgtgngctnttgtatacccatggangggtttctcagggatagtgtacccggtttccgtagagtttaaagaggcatgatntatagatcctatgggattgccccccgggccgcccgccgcctcccgccgttttttttttttttttcttatatcacctccttttatttcaaaatgaaaacgacgtacagtggcttcaaaagtgtggcacacacagaagattgtgtgctcacacatggatatggggagaatggaagtactcaacagccatgataacaacgtacgagattgatgaccaaattaacatcttgttaggaaagcaaacgatgtggcccggtgcaggaggcagcaccctccaccgttgatgcaaggagaccgacttatcaccctcttgcttcatttggccctgcctcgcacttttggaggcagtcccccttgtcatgtatgtggcggcacatgaaggaacagaattctgggtcgtaacccagctggactggggcggcgtccgcttgcttctttttctcttcgacttcccgtcctgcgcgctccgtcggcatcgccagtagcccagctcctcctcctcctcctcctcctcttgcttctacctcttgctcccgtcaatccgccggccccgcgaggagcccaagtcctccccctctggcttcttctccttttaacccactccggcaccgtttgacgcaggcgtcgatgtcctccttgggctcatggcggcagcgctcgtagcaggtaggtggggcagctattcctccgatttccttttctccttctctcctccctgggctccgacgacgagcagggctacgcctaagactacgcatgacacaacaacggtggcgctgcttctcttattagaacccatacccatagctagctaggtggctggctgctccttagctaactagtttgtggtgtgtgcgaaacgctgggtcgaccggg

SEQ ID NO: 26230 - DNA, 300 bp, Triticum aestivum
  Clone ID: PAT_TA_26230
tcggccggccccccgcccaggtaccctcctctcggacgcttcgccgtgcgcgacatgcgtcaaaccgtcgccgtgggtgttattaagtccgttgccaagtcggcgaacacaggcgggaaagtcacgaaggccgccgtcaaggctggtgtgaagaagtagccttatcgctacgatcccgattctctcaggcggatgatggagaaagattgttgaggcgctgcggccatgggccagtatcaagcttagcagtgagcacagcaatgaaacgaaatgaagttttcctttgtgaaaaaaaaaaaa

SEQ ID NO: 26231 - DNA, 647 bp, Triticum aestivum
  Clone ID: PAT_TA_26231
gttacagtgttgatatattcaacgcggccggccgcccgcgcccgtacccagttccttgccagttcataacaattggggatggttcaaagaatcctaactatgacgacattattagtaggattgccaccaatgcccttgatgcagctgtaggtgactttgctattgtgagaaatagaacgaagattgcagaattcacacagccttatatcgaagcagggcttgtgattgtagcgccagtgagaaaagcaaattcaaatgcctgggctttctttaaacctttcacactggagatgtggtgtgtaacaggcactcttttcatttttgtgggagtggttgtttggattcttgaacatcggtctaatgaggagtttcgaggctctccacgacgacaaatcctgacaatattttggttcagtttctcaacgatgttctttgcacacagggagaacaccgtaagtgctcttgggcgtttcgtgctgataatatggttgtttgtcgtgctgatcatcaattcaagttacactgctagcttgacgtcgatcctcacagtaccgcggccgccacctcgcttaactggactcgacaatttggttgctagcgctttacctatcggatacccggctggaaaatttgtccgaaattacctg

SEQ ID NO: 26232 - DNA, 1753 bp, Triticum aestivum
  Clone ID: PAT_TA_26232
ttcccacggttagggaaattaggaaaccaaagaaagatgtgtatgttaaaaacaagatacttacggcaggcctagacgtccgcagtctgcaaaaatgtgcgtggccttacaagtttatgtatgatcgataaaagatgtgaatactgttgagaaaatttctacaaatgtgtcgtgttatgcaagtgtcattctgaaagacaatgcatcaatgaacgctcctaatgttgccagttgtgcaaaggaaatggcagatacatgaccaccaatgtccgaagttgttcctggggtgattagtaagaaacaaaacgaggatgttattgatatggaaaaatctgatgatgttgtggaagaatgtcagcgtcttccgcagtctgtttcgcggcagactgaaaaaatcactgtcattcgcggtgttcgtactagatacgtgagacgtagtgttactgctgaagtgcgatcttatctctactctgaaatgatgcactggtgggatgcttcaaattcaaccggagagtttatcggaagatgatttgcagagatatgcctttttttttccttaaaatctgtctgtccttgataggcgcttggactagccagttttgtctctttgctcgattaactcatgagtaactgttgatgtctttctagaactagttgtgaacatttcagaactaagtcatcctaatatacttgcgcttgtgggatactgtgcggagtttgagcagcggctacttgtctacgagcattgtagtaagatgactctacatgacgaactccattatgttgatgaacccagcaacgcattgtcatggaatgctcgtctccaagttgctgtggaagcagcaaaggcattacaatatcttcatgatggccgtcaaccaccacttgtacatcaaaattttgaaccatctgttgttctccttaatagcactttggcagtccaaatttccgagtgtggacttgcatcgctgtctcagttatctggcagtttgcatgccttgttccattatgaagccccagaagtgcatgaatccagatcattcagtgatcgaagcgacgtttacagctttggcgtcgttatgttggaacttctaacaggacgtgaaccttatgacaggttcccgtccacgtgctgagcaacatctggtgcgatgggcctctactcaactttatgatattgatgccatatcaaagatggtagatcctttgattagaggacaatgttctgaaaaggctttgtcgcgttttgctgatgtcattggcagctgtattcagcctgagccagaattcaggccaccaatgtccgaagttgtccaagccctaactcgtatggtcagcgacgcgacaaaggcttccatgtaagtggcttcctgagacgaggaagaatgtcgaagcctgtcacagaaaattcaagtaggcctgatgagcgtgccgttaggagagcttcttgacagattcatggttccagtgatatttgcttacttgcaaagatgtctttgatcggcggtgatgcagtagtaggatggttcaattcaaccggtgaatttatcggctggtgatgtgcagaggtctgcatttcattttcctgtagaagctgtttgtccttgataggcccttagactagccaacaatgtgtctctggtcgattcatgcttgtgaaacttgtacctatctgattgccagtttgccatgttatttaaccggtgagtttatgggctggtgatgtgcagaggtctgcatttcattttcctgt

SEQ ID NO: 26233 - DNA, 1274 bp, Triticum aestivum
  Clone ID: PAT_TA_26233
ttttttttttttttttttttttgaaaaataatactgtctcttcctttatatgaatatatggactcagtattacattattacatctcaacttgatacaacagaacagtggcatactgcagtatatacatgtcaatgatccagtacataaaacatgacggtctacatgaagtgagaaatgtaacggaagtaataacagagtagaacactaaaatttgatcagtttctcgttcttgagccataaaagcatctcagcaagaccttcagtcaagtttcttggattgtagcctagttccctttttgctttctcacatgaatacgcccattgatgtctaataacacgcactgtagggtaactgataagagggagctttccagtgatgcgggaaatgaaaactgaaatccatccatatatttcaatctcgagcggccgcccgggcaggtacggggcctttgtgtttgtgatattagcagccatactgaaaatatgcatgaatgacaagttttcgccggtgagcagatatctttctcccactctgcccttctccatagctgctatgtgcccactaacaacatcgtcgacatggcaaaatgattctctatcatacccatctccaatgtagccaggtagacggccacctcggccgcgaccacgctagcgggaaacaaggtttccagttgtaagttttccaggaccatagatgactcctggatagacaatggttattggcaccccctctgctgctgcctgcaatgcgattctatctgcaagaacctttgatttctcatactccgtgcaaaatgttttccctttgtgcatctgtgtctcatctgcgacataaccatctgttgggccaagtgcgaagaacgacgacgtgtatatgatcttctttactgtcggcgttctcttggccgctgttaacacattctcaagccctctcacattgacggccgtgaagacggaggggtcggggagccatggctcgacggaggcggcggcgtggaagacggcgtcgcgcccgtcgaaggccgcggcgagggagtccgcgtcgccgacgtcgccgtaggcgagctcgacggcgtcgggcaggccggacgcgtcgccggtgcggcgcacgaacgcccgcacgtcgtgccccgcccccgccagcgccgcgcacaggcgcccgcccaggtaccccgtcgcgcccgtcaccaccaccctcatgtcggccggtcgccgccgacacgccgcggcactcggaagccgatccaaccactgccagctcgtgccgaat

SEQ ID NO: 26234 - DNA, 564 bp, Triticum aestivum
  Clone ID: PAT_TA_26234
aagacgaaatgctacagccaattggattacgagagtaaataccaaggccttacaaattaggaagcatggtacaaaagaattgaatgagaaagctttgagaaattattaatcaggtcaaaatcgaatgacccaattttaattgaaaatctcaattaaatgtgagctctaaactagggggcttagtgttatagaggatatagcagaaaagggggaacaaatagctagcaactgaacccctcttagatgcccggatggagggttaaggcccaaaacgaactttgccctagttgtgtaccatgagcttggccctggcatggccggcctcgaccctgtactggtcaccaatgcccaagtgccccataagcagccacagcaccgtgagcagctcccccccctggctgagctgcttggcgtggaagttgcccctgcacttgcccgccgcgtagcacatcatctccacccacaccccggccaccagcctccaccgcttcctaacctccatcccgcgcagctgccctgccagccggcacgcgtcgaacagcaccgacttgctccggtccccct

SEQ ID NO: 26235 - DNA, 2095 bp, Triticum aestivum
  Clone ID: PAT_TA_26235
tttttttttttttttttttttctgccaaaaaaattactgcattccccagcttaattaaaactaactcagcattcaaggtatacaagtcattcacaggtgtgaacatttttacaaggcataactcagcactaatgcacaacagcaatggcgacaagcaaacagagaacaaaacttgccagcgccggtattacagtaccaattggtagcgagtcaattgctaggtactgatcttgcaaggcagcaacttggtccaggttttggacgacaggggtcttctagtgctgatcctgcctcattatcttagtcactataccgacagcgatcgtgcttccagacgaccttaagaatgcccttccaagagctcggcatttcgagaattcctcgacacagaccgcttgatctagcgtaacctgcacaacagcattctgctttgatttaagaaaccgcggtgctgttttacttggcttgcctgtcttgtcaagcaacgccacgattttcgttactcttgcagcttccttcacatgatgtatgtgaaactccacctgataaccaatgagaattgggatggcgatgtccaacactcgaatcttaagctccaagtagttggctacaggcacagggaaaccagggtgacaaagaatcccgccaggtattattcgactaccatcaattccctgtaaaataactgctacattgtcaccagctctcgctatgctgcatgaactagagtctcgttcaatggttttcactgtcgccacttcctcacaaggtaaaaccaagacctttgaaccatttcgaatagcgccagtttctaattttccaaaagctgccagttgtcctgtcgactgagatttgataacatcacatataggaagaatgaggggctttgaaacatcccgagaaggaagctgcaagcaatctatagcatccaagagacacgacccttgataccaggaggtaaaacgagcatctgaaggagatttaatcaaattctggttctctacagcactaagaggaatccaggtaacagctgaatcccggaagttgcatgaccgcagaaaactaccaagtcgtaccttgatgaactccagcctatcttttgagtacccaatagcatccatcttgttgactgcaacaataagttgctcaacaccaaagcttctaataagctgagcatgctcctttgtctgcccaacacttttccctccttccccatccataccagattcaaaagaaccagttgatgcatcaaccacaagaatagctgcatcagcctgtgttgcaccagatatcaaatttggcacgaaatctttgtggccaggagagtcaagcaaaactacacggtatttcttggtctccaaataggcgacagccactgtcattgtgacacctcttgccctttcttcagtactctcatccatggcccatgcataagcaaatgacccctttcctttttccttagcctccttctcatttttgtgcatatctcttttcgatatcttccctaataggtgtagcaatctcccagagagtgttgacttgccagaatcaacatgacccactattgcaaggtttagttggctcagcaccccggactcctgatcagctagcatccacccctcaggcttatactcttcaggtaaaggctgtgcaacattgacattattcctttcgatacttagctggcttatgtcagaagaaagtgtctccatggaacccttattctgagcagaactgctagccctactactaccctggtcctcctttagctgaaaatgatcagcattcaattgaggtgtcctctcgattggcacattattgtcagagattaccggttgtttcttttttccagtgcttgatgagctaccaacagacgccaactgtgtggaattgactttatcatgagatgtgctagcatactttctctcagaatcaccgtcaaagtttgtaatagaagtcttcactggcatcttggtagaatcagagtttgacagagcagatgtcccagaattgtttgatattccattgacagattctttgatcgaaacatccttgccagatttgacgaaagattcccggaaaaccctcgtgccga

SEQ ID NO: 26236 - DNA, 221 bp, Triticum aestivum
  Clone ID: PAT_TA_26236
tagcgtggtcgcggccgaggtactttaagaactatagatgttaaagaattaattgcttatagttctgtatcacatgcagcagtttacctattaggtgtattcagtaacactatacagggaatagaaggtggaatcgtgttgggattagcccatggtttcgtttcttcaggtttatttatatgtgcaggtggtgtattgtacctgcccgggcggccgctcga

SEQ ID NO: 26237 - DNA, 680 bp, Triticum aestivum
  unsure (1)..(680): unsure at all n locations
  Clone ID: PAT_TA_26237
tgggtatgggttccacaaagcatggcgttgtgtggtgcgccggcctgctcgtcgccgggcttctcctcgtggcggctgaggcagatttatgctccaaggactgccatggcaagacccatttcttgggctgcgtcggtcggtgcagatctcagcttgaggttgcacggccgacgaactgcatcgccctctgccatggcaagccgagcttcattgcctgctgcaatggctaccggtatgcccgacgagcgcccatgcaactgcgttggcccggtggggaatccacaaggcatgaagaagaagcaggcggaggagcagttggtgtcctgaaggcgccggccccggcgccgtgtgaagtggtctgccgtgaccgggtgggctgggtggagtacgagcgctgcctcgatcgctgccgatggggagcgtttgtccaacgagcgctgcttcttcatcttaagcttaccggcagggaatcggcgacacatgaagaagcaagaggaggaggaggagcagttgatgttctcgcggcggcgctgtcgtccttctgcggcgactactgccgagcggaagaacccaacgtcgactacaggtactgcgtccgccggntgtgagtttggacccaggcgggcctcctccattgccggcggggaaccaaaggccaacaagaagaaggagaaggaagc

SEQ ID NO: 26238 - DNA, 368 bp, Triticum aestivum
  Clone ID: PAT_TA_26238
ttcgagcggccgcccgggcaggtaccagccgagcatgtcaaccacaaaggtcgtcgcgcccgccgcgatgatgcaggtcttcgcagtcgcagcgttctttgtgttgggagacacgggatcgaagtcctcagccaagagccagaaggcgccagccaggaggccgaacgatggggtgaggaacaggaagatcaagaagaataccaggttggtgcggagggcgaggatcatgtagagaaagcagagaacacccatgaagaccaggaagaatgcaaaactagcgttgaagccacgagtctcgagaccatttccagggaaagtatcagcagtggggtcaccgtaagcaccgtacctcggccgcgaccacgcta

SEQ ID NO: 26239 - DNA, 581 bp, Triticum aestivum
  unsure (1)..(581): unsure at all n locations
  Clone ID: PAT_TA_26239
cggncgcgtgggtccggccgcgtggggcgggacatcaaggacccggagcacccctactcgctggagcagctcagcgtgctctcccaggagtccgtctccgtcgacgacaagctcggccacatccagataaccttcaccccaactgtgcaacactgcactatggccacagtgattggcctgtgcctcaggcttaagttgatgcaaaactttcctccgcatttcaagattgacataaaagttgctccaggatctcttgctaatgaagaatcagtaaacaaacagctgaacgacaaggagagagtcgcggcggccttggagaaccccaacctccggcagttggtggacgattgcctctgctcagatcatccatcctcatattagctcgtccctgatgcctcacaacctgtctgttgtacagcaataataagcaggcattttttgtgttttgcccaatactgtacctgaaattcgagaaaaggcactatagctggtcatgtatgtgccattcttttgtgttaggtgtacgctgctactccctggaatatcagcaatgcttttttttcaaaanaaaaannanaaaa

SEQ ID NO: 26240 - DNA, 570 bp, Triticum aestivum
  Clone ID: PAT_TA_26240
ttcgagcggccgcccgggcaggtacttactctgttacttttattatttatatatatacctggtgaatgatttaatatagttagtgttttaactgtaataatatttagagcctaatgacaagtatgacatttttcttaattttcgtgcctatactagctatagttttattgacattaaatcttatccttgcacctcataatccctatgaggagaaagacagtgcattcgagtgcggctttcattcattcttaggtcagaatagaagtgagtttagtatttcgttttttattttcgctttactatttcttttatttgaccttgaaatactgttggtttaccctttcgtggtaagtgcatacgttaacggtatatttggtttaattgttatgcttatatttttcttagtgcttactttgggatttgcctttgagttgggtaagaacgcgctgtctattgaaagcagacagactcataatagttaatttttaaatgagaaagccactatacaaaactaatgttaaaatacaaaataccgttagaggtataagtacctcggccgcgaccacgcta

SEQ ID NO: 26241 - DNA, 875 bp, Triticum aestivum
  unsure (1)..(875): unsure at all n locations
  Clone ID: PAT_TA_26241
ggttaatatatggnaaaagnatggagggctcgctgctatgctgctagcatactatctgttatcaaatggttgggctacaagaacaaattcaccgctatatagctttggaagtgaaccactggagaaggctacagaaactaccgggatgaaggaaatggttctgccaattactgctggaattttatcagctttgaggagagtattggctcggcgagtctctctcaagaatcaactcaaaaggcgacttcatgcgataactgttgcttctgctacatgttttctttttccatttgcaatgtgggatacaattctaggttcaacatctgacagcatagttaaaatgcaacttccaagctgggcatatttgagtactgttttgttcggaatggtgcttatattctatgttgataatgttgctgaggaaagcttgcatctggtcttttcttctccaaggcacttagtggtttcaacaggttgcatcattattttggagatattatacaaaatggatttctcccttcctggtttgctgctttgttccgtgattttgggatttggtattttggaagcaacctccttggaccgatcaaaaaaaaggccattggaggcacatgaaccgtcaaatggatcacttcacaatcagttgcggatttcagaacttccaatgtagaatgaggcttgtatatattaatttcgggcgtaattagacaagtcttgaacgttatagagaactgcctttatttgcatgtgttgcaaatgtatgcttatctagtcatttggcctgggacgcgaggggttgtcatatgttgatttcgatcaggggaaaatagttagagaagttttgacttataacagtccaaccgagnaatgtttcc

SEQ ID NO: 26242 - DNA, 160 bp, Triticum aestivum
  Clone ID: PAT_TA_26242
tagcgtggtcgcggccgaggtacagcaaaacgtataacaggacgcgggtgttacaagatggaaggaactaaacaggaatgagtaattgcagttcataagaagtatttcatcctgttatctcttctcatggcgcgataccttgcccgggcggccgctcgaa

SEQ ID NO: 26243 - DNA, 515 bp, Triticum aestivum
  Clone ID: PAT_TA_26243
tagcgtggtcgcggccgaggtacgatgagtctttcatcaatcccgagtccctggtaaatctccctggctaatatacatacatctcccattctgttcgaattgcacaaccaagtctgccaagtcgtgtctctgtaagaattccatgtcttgagctcccgcctgccatgcagctcgcctcttcccaaacgccagggttaacacccaaagtcgtagcctcccctatcgacacccactacatcccgccaaactcagctcaactcgtcctcctcgtcttaatcgtcacagcaccctcatctccactactactatcctcatcctcctcctcctcctccagctctcctctcatgcctcctcgcgcagcccactcccggccaccaccctcaactccactcctctgcctatcacccaacgtcaacctcctccccatccccaactcttcctcctcatcgtcatcaccatcatcaagcggaacccgaaccttcgcctcagtcgtacctgcccgggcggccgctcga

SEQ ID NO: 26244 - DNA, 260 bp, Triticum aestivum
  Clone ID: PAT_TA_26244
cgtcgtaataataggtcgacattcgctatcatcatcacgctacgctaggtaatattacaagaatcggggtatagttttggaaaacaatcatcgaaagatccgtccacccatccttcctgagagcagcaccctcattattcgttcctgttcatcgtctttgcttttgctttcttcttcaattcttcggcgtctctggcagcggcttgtcgtttccgcttgcgctctcgccttgtctcaacacctcggccgcgaccacgcta

SEQ ID NO: 26245 - DNA, 353 bp, Triticum aestivum
  unsure (1)..(353): unsure at all n locations
  Clone ID: PAT_TA_26245
tcgagcggccgccgggcaggtacctgactgtcatgtctggatctactttgtcggtcttggacaatgcaatttttgagcttcgcagcggcaaattaaaaagaaatcccagtataacctgattgaggaaatccagatacttctaacttcttatgacgctcggttacagcaaaggagatctctcatatcacagcatgctaatctcttataacttccttggtctacttcaggattctccagctactctctaaaaaaacttgtcatgccatggacataataataagaatcatgtttcctctcgctctggctctggctctgcttctgccacctcggccgcgaccacgctaatcaannnn

SEQ ID NO: 26246 - DNA, 531 bp, Triticum aestivum
  unsure (1)..(531): unsure at all n locations
  Clone ID: PAT_TA_26246
tagcgtggtcgcggccgaggtatggtcgcggcctggtcccggccggggcgagcaatggtcgcagccagaatggcggaggatcgagcaacggtcgcagccagaaccagggaggccagaccaatggccgtagccagagccagggaggacagaccaatggccgtaaccaaaaccgcggaggacagaatggctccggtgaagacgaagaaaacaacaacggtggctcgagcaacggccgtagccagagtcgtggaggacagaatggtcgtagccagaaccagaaccgtggaggacagaatggctctggtgataacgaagagaacaacaacaacggtggttcgagcaatggctctggtgacgatggggacagcaatgatggttcggacggcggctccaagaaggagtagaacttcgctggaagtcttgcttaggatgaaatgtatgccggcagctgtgacgatgacggggattcggatgaggtttcactatggttaacgaacgattttcagtacctgcccgggccgccgctcgaan

SEQ ID NO: 26247 - DNA, 938 bp, Triticum aestivum
  unsure (1)..(938): unsure at all n locations
  Clone ID: PAT_TA_26247
ncaagcagcgaagggaaggaggaggcatatccccatctcccaccgaccattgacattcgcgcccggccgccgtcggatcaaccgccgctccccctccccctcccgcgggatcccgccggcgatgggcttcttccgccggatcgccggcatcttcggcggctccagggacgacgccgaccaccaccacgacgccggcggcggcggcggcggcggcggggacgtcccgcacgagaaggtggccgctgccgccgccgcggcggcggcctccgggcacgctactaggcgcggattcagcgtccaggtgcccgtgccggtcgaccggccggcggccgggcccgtgctggcgccctgccccgcgggagacggcggcgtccagggtttccggtggtatacaaggaggttaaggattgacgaagacggcgacgtcgccgacgagttcttggacgaggtcctccccgaaagctcgaacaacagcgacgcgagcccagctggaaggttccaggtgaaatacaacacgagaccaaccgctctagcgatgaggaagcaaacggtcgccgtagacggcgacatccgccattgtgtggagcatcaagggcagctccagtgggtgtgagggtgtaaacgcaagcctgggttctagcgcgccttcggctgccgcctcgagaactgtcatccactccccctccggcccgaggagcaaaggagctttaccttgtgcccctcaccgtctggagcctctgaggagtgggtctggtttgcaccattctcagttgagtgtgttgggatcaggcctggtttcatggctgatcagatcccttgtaccactattagtagctgtacattgttggacagtgagtggaaagcagacaaagctgaattggtgaaggggggacgtgtactttcaaatagagcaaccaactaaacccttgaactgaaaa

SEQ ID NO: 26248 - DNA, 692 bp, Triticum aestivum
  Clone ID: PAT_TA_26248
catgatgcatctaggagctttgccctatgctataaaacatcttggattatctgcaccagtatacgcaacagaacctgtgtttaggcttggccttttaaccatgtatgattattttctatctcgatggcaagttgcagactttgacttgttttctttggatgatattgatgccgcgttccagaatgttgtgagactgaaatattcacaaaatcaccttcttaacgataaaggtgaaggaatagttattgcgccacatgtgtcgggccatcttttggggggtacagtatggaagataacaaaagatggagaggatgtcgtctatgctgttgactttaaccaccgaaaagagaggcatttgaatggtactacccttggatcttttgtacggccagctgttttgattactgatgcttacaatgccttgaacaatcaggtctacaaaaggcagcaggatcaagatttcattgattcaatgttgaaagttctatcaagtggcggtagcgtattactgcctgttgacacagctggtagagtgctagaacttcttttaataatggagcagtactgggctcaacgacatttggactatcctatctattttctgacaaatgtttctactagtactgttgattttgtcaagagttttcttgaatggatgagtgattcgatctcaaagtcttttgaacacacta

SEQ ID NO: 26249 - DNA, 361 bp, Triticum aestivum
  Clone ID: PAT_TA_26249
ttcgagcggccgcccgggcaggtacaatcatgatgcatgtatgccaaagcatgaatcacgtccaacacaatatttacccgccttttccagtccaattcaattgcccttttgttggttctaagtgtttccgccaagtttcctctctccatgtattcatagataagaaatctgccttggcttgaggagcaatacccaaatagttttacgatgtttcgatgtcgaatctgcaccaatgccccgatctcgcgattgaacattgactcattgacgccatactcatcttctattgtgcgtatcttcttcactgcaaatatttcacatgttgcaagtctagctttgtacctcggccgcgaccacgcta

SEQ ID NO: 26250 - DNA, 896 bp, Triticum aestivum
  unsure (1)..(896): unsure at all n locations
  Clone ID: PAT_TA_26250
atctcataanaatttagcaagcacatctcatggattttttttgtgagtaagcacaactcatggttcttctaaaagtgttaacaatctcaccagtatcagtgtgtctcacttggtgcctgcttctggtgtgcaggagtattcaagtgctgaaatagacctctgttaattttccttttgatattcttcttgggtcatcaagtgaatcattgtggttccactagtctccatttatgtgaacaaagagtttcatacactaaaaatatacatgccatgtaagtaaggcagattattatgaaagaccttcaaaagcttaaaaaggaagaaaaaggccccaagttcaaatttcagagtctgctgtggacaaaagtgatgacttctcaacattgtcaagattcgcagctgcactacatatgattcagcagttattgttcctcgcaaaaaaaaaagttattgttcgcattacattacactgtcaagttgtgtagctcgagacatccttctatcgccgtagtaggtgaaatggcattttcattgtctgaattttacaccctaaatatgtaaactccgtgaattacatcatgttaatgctgagtaatttttctaacaagctcttttatttctcagtgatgtgaagcttgggcgaatagatcaatacgatggtgtgtaagacaagtaaggatgacggcactcaaaaccgttgaatcaaaaatcaaggctgcaaagctgggggatagcagtgggtgatgctgcacacatcgacggctgcaacagaaccggcagctgtctgcactcgagtgccatgtacgctacaggtgcaggctaagcaccttgtggccggagacagaacaatgcgatctactatgttcttgtggaagttgaattatttttcccgaatg

SEQ ID NO: 26251 - DNA, 275 bp, Triticum aestivum
  Clone ID: PAT_TA_26251
tagcgtggtcgcggccgaggtacgaatagctggtgtgagttgtcattgttagacatgaattactcgacatgtgttgtaacaatgatgattgttggatttctcatggttgaattaatcattgatcaacctctgcattgagccaatgattataaccatcagataaaaacaatattcatctttggaagtgctcatccgttatgagccaatggctatatcacatcttaacaaggagaactttgtgaagcaaatggtacctgcccgggcggccgctcgaa

SEQ ID NO: 26252 - DNA, 440 bp, Triticum aestivum
  unsure (1)..(440): unsure at all n locations
  Clone ID: PAT_TA_26252
aaaaaatcaaaatgctttttttcatcaacagctgcttgtaagttgccaaatggcacagttgcagcacaggcaatgtccacactgcatgactatgacattggggggggcccttttttctgtaatttcagttgcatcatcaactcaggattcatgacccctctgttttcaagggactatatgaacattctttggcctatgtatctccatttgccagccaaactggcttttcggggtcaaaccaacagctgcgtttcaagttcgccacgcgggcgatttctcctgatcgaaattcttttcccaccaagtaacattcttgtatcctcttctgaggaattcaagctggctgcctacctttttttgcaaaccgaaaactctcaatagttcatccttggcctgccccaaagtgaaccgaaaccnnnnccgggcggncgnnnnannnn

SEQ ID NO: 26253 - DNA, 298 bp, Triticum aestivum
  unsure (1)..(298): unsure at all n locations
  Clone ID: PAT_TA_26253
nnttagcgtggtcgcggccgaggtacacacttccatcctccaataccacatcacatctacgagtcctctgaagcggcggcaccggtgataatctcgacaagttcgccagtaatgacggcctgtcgagttcggttgtagagaatctggaatttgtcgatcatgtcgccggcgttctttgaggcgttgtccatggcgttgcggcgggcggaaatttcgcatgcgtgaccctccgcgagagcccagtagagagagttggccagagcgtattcgcggagacctgcccgggcggccgctcgaa

SEQ ID NO: 26254 - DNA, 350 bp, Triticum aestivum
  unsure (1)..(350): unsure at all n locations
  Clone ID: PAT_TA_26254
tagcgtggtcgcggccgaggtcgtccgatcacggctggatacagaatcctctccgctatgcagtccgatcacggctggatacagaatcctctccgctatgcattcattcgcggccgaaccaaacaaaacgcgtattctggaggaaatatcagaggcaaagcttcccgacactgaaaatcgaaaacgatacaacgtggaaccaaacgcctcccatatttcttcagttccacttggaaaacatagattgattatgtatcaataanaccatgtgttagtcaagacaaaaatatcgatgtaaagctcaggtttgttaagttgtttggttgtacctgcccgggcggccgctcgaa

SEQ ID NO: 26255 - DNA, 311 bp, Triticum aestivum
  Clone ID: PAT_TA_26255
ttttttttttttgttcagacagttgattcttaactatggcaagaaggcgttcgaaagctggccttcattgctccatcaatccgcccatcgccacaacatctccggatctaccactcacgagcaagtattgcaagtttcgcaagcagcgccggttcgggctccatctccgtctccaaaagtcccgaatccatagtcgaccaaaccgcgatcgaccttttcctctcctctggttcgccgccggtcgttgcgccgtgctgcaacgtgcgggaacagacttgtcgaattagcacctgcccgggcggccgctccga

SEQ ID NO: 26256 - DNA, 588 bp, Triticum aestivum
  Clone ID: PAT_TA_26256
cggcatgagccacgaagccctcaccaaccaccgagcacgcgcgccgatggcgggcacaaccaccaccagcggcggcggcgggggagcggctcaggggggccgccgggcgctggggctgctggcgagcgcggcgaagcggaaggacgggttcgtgcagctgctgctgatgtcgggcatcctcatgatgagcctgcggtccctgagccagaagcaccgcgtccgcgacctcgccaacgacgccgccgagctcagcctcgaggcaggagcacatctcccaccgcatgcgcgagcttcaggacgagctcgaccgcgaggccggcgcccgacccctcgggcgcgttcgcctcccacctccgacgcatcttcgccgctcaccctcccacccccgccgccgcccccgcccccgccaccgacgaccactagctccctcgtctccgttcagatcgtggcggcgcgccttgttcttcgacggcttcgtccctgtttactctttgtgatctcggttcttgccttgtgtagatgcttctgaaccatggccgtgcacgccatgtgtttgtggaaatgccgggaaggggctgccggattgta

SEQ ID NO: 26257 - DNA, 212 bp, Triticum aestivum
  Clone ID: PAT_TA_26257
ttttttttttttgacaatttgtaaaatcatttctggcgtatatagcagcagttgtctcgatctctttcccccgacatccacctgcatcttcccgcgggaggatgcggcactcttctctgctccttactgattccagagcaagcaccttgcgagcggaaagctgtacaattcgcggcccgcctgcatttcgacctgcccgggcggccgctcga

SEQ ID NO: 26258 - DNA, 525 bp, Triticum aestivum
  unsure (1)..(525): unsure at all n locations
  Clone ID: PAT_TA_26258
tagcgtggtcgcggccgaggtacgagtaatgagatagatgattggacnntacgagtgagttgagagtgggatggtcttgttcgatgtgaccgatgaggaaagatacctcacttctgccctccaccccacagtctgaccagcggtccacctctcccaaatacagggtcgaactccggcacaggcactccttcagtcttcgcagtaatctccttcgttgtatccagatcagtcttgcagaagttattgtcccacttcggagagcctttgggataaactccgacatactcgtagtcgggactgctcgctacattccggtgcgcaactcccgcggcgtgaacggcgatgtcgccggcggagagggagaatgtcacgcctggagaggtggaaggggagtcgagggttcctacgccgtagagacattctgtctcgccacttagcacagcatagcactcatgcgtgtttgagtggaaatgtgcggtcgggtagtgcttgaacacgccgnnccctgcccgggcnnnnnntcga

SEQ ID NO: 26259 - DNA, 505 bp, Triticum aestivum
  Clone ID: PAT_TA_26259
tcgagcggccgcccgggcaggtacagttagttcttcgcaactgccgcaagtgcatgcagtccggggagtgtagcacgtccctcagcctcttccacacttgtagatcgcggcaactccttgctgactgacaagaataaatgccctctgtgatctctagcaatcacgccagcccagctttgaccgctgtcggcgtcgaaagcagcatctgaatttaatttagcaacttcgctcgtcgatcggcgctgtccactgtatgcatttgttcgttgatatacaaggcttaggattggataagtagcccgtccccttgcctgagctcgttgacagttccactcgagaactgcgccattcctcctcataactttccaataacaacgctgaattcagaattggttctttcccactttggatgctatcatcatgcaaagtccagcatctccacagcggaatataatcctgaaacaacaaaagataaagaaatgacacctcggccgcgaccacgcta

SEQ ID NO: 26260 - DNA, 1995 bp, Triticum aestivum
  unsure (1)..(1995): unsure at all n locations
  Clone ID: PAT_TA_26260
ccacgcgtccggtccgcgtcattgagacggctgacggcgtcccacgcgaggcggatggccgcccgccgatgttctcgccggcgcaggaggcgctcctcatggtgcaccggcggatcctggagacgcagcctgacgacggggatgaggacggcgagtacgggcccaggggcaaggacgcccgggaccggggtaaggtgaccacccggctcatcgtgccacggcagcatgtggggtgcctgcttggcaagggtggcaagatcatcgagcagatgaggtccgagaccaagacgcacatcaggatcctgcctcgcgagcagaacatgcctcgatgtgtatcgttgtcggaggaggttgtgcaggttgttggagaaggaaattgtgttaaaaaggctgtagcgattatctctgaccgtttaaaggaaagcttacaccgtgatcgtggtccctttcttcgtggacgaaattcacccgagcatcgtatttctcaggctgatgaatacctgggtggtggtcagcagatgcctgcatttgaagaaccttatccccgatttgatcaaattagaaataatggtagcatggagccaccaggatatgagtttgattcaaatggtagcaagttcaatgaacatccagagattccattcgatgaaatcatatttcgaatcctttgcccgaatgacaaggctagcagtttggttggatcacgagatggaataatagatatgttacaggctgaagttggtgttgatgttaggcttactgatcttattgctggatctgacgaaaggactctaatcattacatcaagagagggcccagaccatgagctttttccagctcaagaagcattgctgcacatccaaacctttatcgtggatcttggccctgacaaggataacattatcacaacgaggttacttgtcccttcaagtgaaattgcttnttgaaggggaagggatggatcattatctgatatacagagacaaactagcgcaaatatacagatattaccaagagaagaacttccttcttgcgccctgggaatctgatgagctcatacagatggtaggagagatccgagctgctccgaatgctctcatgcaagtaacttcaaaactacgaattacatataccgtgagatgtctgctcctatccaaatgggcagccttaatgtacatggatccatttctccagcaaaaggctcacctcgactatatgctggaaatgaccttccaatgcctatctaccaacaagcaccacaaatggcaacttcgtggcactcaaaggatagtggacttagtgcaagtggatcgtttgagcaagggagcagcattaatgatgatataagacaaactaatacaaagcgatttgctgtccccctagtgactagaagcacattagaagttgtcataccccagagtgcagttgcaagcctcagcatgagagctggaagcaagcttgcccaaataagcgagatgtctggtgcgtccgtcacgctcgctgaagataggcctggagtcatggaaaaggttgttagaatatccggtacccccgagcaggctgacaaagctcagagcttgctccaggggttcatacttagcatccaagacgacattccttcgggctaatggagccattgccacgtcttcccgtcgcatgcttaataggcgccgattgtctaattcttgtttccaggaatcgcctgtgtactttagatggaatgcactccagttgtatgcaactaccctgatgaagccctgtgtctttattgtaaagtgttcgtgtatgatattctctgatctttacctattcaagctgttatgttgtattacaaatgtacttcgtttttttcacattaagtagcctaagaaacacggtggagattgtttctacactctttcgatttgtacgactacatccttccgctgatgctaacaattgtagattgggtgcttcgtcgtcncaatgtaacctgagataggtaccttctatgtc

SEQ ID NO: 26261 - DNA, 505 bp, Triticum aestivum
  Clone ID: PAT_TA_26261
ccgcaacggctcctccgcatgccggggctcgcccacccgccgtcgcgacggttggaggagcccatcgccccatccggcgcccggcggccctgccggcaaccagcaagcctttacatcactggccatggaatccctgaaatggaggacaagctttgtgctgtaaatctggtggaccgcgtagaagtctttgacggccagtgaaatgctggttcgtgctacttttcccaccagcgagcccagattgaggatcactccgacatggaactcgtctgctttgccggtggtggtgttctgagctacgccgggatcgacaaggagcaagaggaagaggaagaggattgctcggggagttctctccattccgtggtgctgagatgcactgcattgcaccctcttatgtaggattccgcttgttgaagacttttcggcttaataatggtgacaatggtgacatggtgtcactggtcaaactgaaagttgcaaggcaaatccgctcagctgtgac

SEQ ID NO: 26262 - DNA, 605 bp, Triticum aestivum
  Clone ID: PAT_TA_26262
accgcaacgggtcctcctcatgccgcgctgaggggttcgcccacccgccgtctcgacggatggaggagcccatccggcgcccggcgagcctggcggcaaccggcaagacacatacctgctgatgcagcctttacatcacttgccatggaatccctgaaatggagtgtcagctttgtgctgtaattctggtggaccgcgtagaagtcttggacggccagtgaaatgctggttcgtgccacttttcccaccagcgagcccagattgaggatcactccgacatggaactcgtctgctttgccggtggtgttctgagctacgccgggatcgacaaggagcaagagcaagaggaagaggattgctcggggtgttctctccattccgtggggcaccgcaagttttagattctttggtgctgagatgcactgcattgcaccctcttatgtaggattccgcttgttgaagacttttcggcttaacaattgtgtcactggtcaaactgaaagttgcaaggcaaatccgctcagctgtgacagattagttgtctctagcatctcctcgtcttgtatcgtcctgcgctgggtctccctttgttgaaaactttcggg

SEQ ID NO: 26263 - DNA, 672 bp, Triticum aestivum
  unsure (1)..(672): unsure at all n locations
  Clone ID: PAT_TA_26263
ttcgagcggccgcccgggcaggtaccaagtatattacactagacatttgcgcttctgttttacctctcgcctccaatcttcttgaaagcggatatgacagacatttgaacgttgccttggcgatgatccttaaccttgtcaaaagcttccgtgcatcaatcttttctactttgtcgtctactccaccagcctgtgtagacctcgaagcagagcaccggttggaacgctgcagtatatgctttcaagagctggaaaagataaatgcaagtctcatctccttgacaaggcgagaaggcaaggttgggagatcagcacgggagctgagcctcctccttcaggatatcttcaagacaccaagcagtgtataaatgcagaaatttcaccctttttcttttgtacatgaaatacgtagcgacgtaggattaacagctacgatgacagaagaaatatacgggaagtagatacaagtagggcaaaatgcatgtcattttccgatagagatacgcaacatccagtttgaggttaactggctgaagagcagctgctgcagcagagtggtggcatacaggaaaccaaagcttgatatattcttttcgctccttgtctctgtgactgtggatcaatgaacaactgtatatgacaccttcagctctcagctctgcatccaaaaan

SEQ ID NO: 26264 - DNA, 355 bp, Triticum aestivum
  Clone ID: PAT_TA_26264
tagcgtggtcgcggccgaggtaccagcaatacctggcagcgaaggcgctgaaaagccaaagctggcggttccacaagcaatatcagacttggttccagcgccacgaggagcccaagaacattacggaagagttcgagcaggggacctatcggttcttcgactatgagtccacgtggatgaaccgccgcaaggcagatttcaaattcgcgtataagttcctcgaagatgatctctgatttgccaggcgtccctccgtttggtcggcagggtgatggacacgaatttctgatcggaacacaggttgggttggaaggggagcgaggtttaccagtacctgcccgggcggccgctcgaa

SEQ ID NO: 26265 - DNA, 468 bp, Triticum aestivum
  Clone ID: PAT_TA_26265
tcgagcggccgcccgggcaggtctggccgcggcgccagccattcttccgacgtgctgtcaccacgttcgagtatgcacaacccctcaagtaacagccatggcagcacctccgctccatctctccaacacgaacaaagcgtctgcagcgtctccagcacaacagtgccactgaacgaggatgttgccaacaccgtgccacctctaaacggtatcaagatcttcatcatccacatcaaagacacgctaaaagatgggccgcacgtgagtgagcggattctcgcggagttacaggagcacgaggcgaggctgcaggaaatgggacatggattggggtgtgaatttgtgatttcgcagagtggtgagagttattggttttgatggaaagagtgcgaagggactggcgctggcgtcggtgagtgtacggtcttgaaagttgattcttcttgtacctcggccgcgaccacgcta

SEQ ID NO: 26266 - DNA, 346 bp, Triticum aestivum
  Clone ID: PAT_TA_26266
ttcggccggccccccgcccaggtacgcgatacatcatcgacgaccttttcctctctcatcgctcttccatcctccctctgaaaacatgctactcatacaattcatcatgattcatactccataccgccaacgccattcgactccgacatctctcaacacctacgacgacttggggcagctggcacaagcgcacttgccagcctcacaaggacacttgccctcgttaccgccgcagttgcacttggtcttctcctgacctccgatggtcaccttctccatctcggcctgctcgggggtgacatcgctcgtctccgccccgggcgccccctcggccgcgaccacgcta

SEQ ID NO: 26267 - DNA, 558 bp, Triticum aestivum
  Clone ID: PAT_TA_26267
tcgagcggccgcccgggcaggtgtcctccaaaaccaccctccgcacaaccaaaccctcaacccaagagacgaatcggtcccgaaatttcaatacctcccgcacccgcaaacaagtcaacgactcctcccccattgactttacttttttccctttcatcttctcctccccttcctcctcctccgaggaaatgaacctcacgacagcggtgcaagtccccgtcctcccctcaacctcctctcgcaccgccatttcgcgactcgagcagacggggcaaggaggaggaggggaggttgtggatgtggtgaaaatgggggcggaagtttatgccgttgcgcccgactcgattatcctcccgctttcggatcatacttcgccttcggacgagtatatgcacattgactttcgcgggttggcggataaagtcgtggatgggttggatgggttggtgaaggatgttgttggtgggggaggaaagactgtggcggaggcgaaagtttaggttggtgagatggatgggatgggagagatggggagtacctcggccgcgaccacgctaa

SEQ ID NO: 26268 - DNA, 450 bp, Triticum aestivum
  unsure (1)..(450): unsure at all n locations
  Clone ID: PAT_TA_26268
ccaccaaatggaaaaaaaattatgggcctgggccaaaaccanacccccggttggatttcccccccggcccccttccccaccccgggccggaacccccttattactaaggaattcccggccccccggcgggccaccctttgggaaaaccccccaccccgggggagccaaacttgggttttttttaagggcccccaaaaaacttgggggaaacaagggcaaaactggttcccgggggaaaatggtatcccctcacaattccccacaaaaaaaacaaccggaaaccaaaaagggaaaacccggggggcccaaagggggggccaaccccccttaattgggggggccccaccggccccttttcaagggggaaacccggcgggcccactggattaaagaaaccgcccaccccccgggaaaagggggttgggtattggggcccttttccctttctcg

SEQ ID NO: 26269 - DNA, 397 bp, Triticum aestivum
  unsure (1)..(397): unsure at all n locations
  Clone ID: PAT_TA_26269
tagcgtggtcgcggccgaggtgggcgttgaatgatttgggagcaggaaaggataagggatgtggaaaggaggatttcccgaaggtgtataggttgattgaggcgctgccggaagtgaagccggaggttttgagcggtgatgaggcgcataaggcgattcgggagaatgagtattctgccagtggaccgacgagtgtgatgaaggatgaggcgttggggctggaggctgggacgcaggtgacgattgagagctttgattcgacacctggagcccacatccaagccggcaaactggtcggaaccagcatcgacgaggtggtgatcgaagtcaccgacggcattcgtctacatttccccaagatcggatacatcgtacctnnnnnnncggccgcgcgcga

SEQ ID NO: 26270 - DNA, 284 bp, Triticum aestivum
  Clone ID: PAT_TA_26270
aattcgattagcgtggtcgcggccgaggtacatccagaaccgcatgctggagtttgccgcgctacacaagattgagccgattatcgagaagttcccgatgaccgaggagggtatcaacgaggctatggacaagcttggcgaaggcaacattcgctaccgcggtgtgttcactgcgcagtagagcgatgttcaggagaaatatgttgatgacgacggatatgttggcttcccagtagccgcagagccagtgaccgcaaagtgtacctgcccgggcggccgctcga

SEQ ID NO: 26271 - DNA, 402 bp, Triticum aestivum
  Clone ID: PAT_TA_26271
tcgagcggccgcccgggcaggtatcgatcacggcgacctcgatccatccgggtgtgattatcacagacctttatgcttcgcagcagaagacaaacatcgtcatgaagatgttcctcccgatcatgaagatggccaccttggacgtcccgggcggagcgaagaacaccttgtgggccccgacgactccggacaaggccacagtcagagagtctcattactggaagccagtgggaagcaagagtggaggcagtttctggtatgctcagaagaccgaacccgccaaggaactgtgggagtggacggaagagcagctcaagaagaatggatactagaagtgcactggaagcagccttgacgatgtagtaatgagcgatttatccggcgggggggaaaaaaaaaaaa

SEQ ID NO: 26272 - DNA, 530 bp, Triticum aestivum
  Clone ID: PAT_TA_26272
catggaaactttcttttagcaaacagaagcaaagcaaacaatgccggcagtgccgagtagccgaccattcttttatttgggaaaaaaaaacgagctggctaagctcaatacaacaaaggcaaatgggcagtcctattcgacggcaatcttgctaccggtgccacggcgaagatggatgtcgtcgtgcttcttgcgctgttcctgcttgatcctgttcccgacgtcgccagggtgcccaccggactggcactggcgcacacaggctgtgtacttcgcggggaagtcccgagcatgccattcgcagtagggctcgcacgggtcggtattcgccggctgcgctcctgcagcagcctcatgttgcgccaccgcagccggctggatcccattcccgtagtcataggcgagccggccatgaccagcgtggcactcctcgacgcaatcgaagaactgtccgggcctgggaaagtaacgagtttgctccatgcagtagtcatcgcacgggtcggtgtttttcatcgcctgtgctcctg

SEQ ID NO: 26273 - DNA, 249 bp, Triticum aestivum
  Clone ID: PAT_TA_26273
tcgagcggccgcccgggcaggtacaatcccgcgacgcaggcgagggggttcacaaaggcgcaggcggatggcgcgaggagtaagaagatgcggtccgactatgccttgcaggacattgaacagaaagtcgagagcagattctagacgtggcgatgatgggttcgtgatgtgggataattgggaaagaacgatcacaggacatgtagcattgaagtgaatgagattttttgaactccgaaaaaaaaaaaa

SEQ ID NO: 26274 - DNA, 1754 bp, Triticum aestivum
  unsure (1)..(1754): unsure at all n locations
  Clone ID: PAT_TA_26274
gcattcgccccgagcccttccccccgctcgccacccacaaggtcgtgtcttacataaggcgtgtggtgatgccgctcgaggtaattcttaccagctacaagaggcttgttgtgaaggactctgctgttaatgctatctgctatggtgccaagcttatgattcctgggttgctccggtgtcagagtgacattggtggtggggtaagtcgttggtctcgtggcgacgcagggagaggaaattgccattggagtagcgcaaataacgaggtgaggatgtcgctccagagagtgtggaggttgagaagagtgcgaagaaaaaggagaagaaaaagaagcaaaaaagatgcataggaggcacaataggtagagatagtagtttacattggcttgtcatgttatttggttgcagttatgtgggagcttgaactacctgttttatttgctttgtaccccttgcaaccgtctatggtttgggtaggtagcgactgatgcactatcttcagctgccccccattcaacgccgaaatgctatggtaattagggagagttccctttaaatttggacaatcagccatgtgattgcagtatctgttagctggttttgcagggaagtttgttttcatcacaggggaagtgttccaagggcctccgctcatctcggcggtcaagcgccagctcagggtgcggaccatttatgagagcaagctgctggagcatgacgccgagcgccaccttgccgtgttctggatctcctgcgaggccggaacctatgtccggacgctctgtgtgcaccttgggctgctcctgggtgttggtgcgcatatgcaggagcttcgccgtgtgcggtcaggtattctgggagagcaggacaacatggtcaccatgcacgatgtgatggatgccatgtgggcgcttgacaaccacaaggatgagtcttacataaggcgtgtggttatgccgcttgaggtaattcttactagctacaagaggcttgttgtgaaggactctgctgttaatgctatctgctatggtgccaagcttatgattcctgggttgctccggtttgagaatgacattgatgttggggaagaggttgttctcatgactaccaagggggaggcgattgccattggtatcgctgagatgcctactgctgttatggcaacttgcgaccatggtgctgtagcgaagatcaagagggtggtgatggacagggacacatacccaaggaagtggggacttggtccggtggcacttaagaagaagaagatgatagccgatggcctccttgataagcatgggaagccaactgacaagaccccggctgagtggcttcgaaatgtggtgcttcctactggtggcgatgcaatgattgctagcattgcagctgctcctgagcctgagaaggtaaaggtcgaacaacaggatgtggtgccaagtcaggaggtcaaggagaagaaaaagaggaagactgatgaggatgatgtaactgcttccacacctgcaaagaagatgaaggttgaggaggtcactgaggcagtggaaggggagaagagtgagaagaagaagaagaaaaagaaagataagggagaaccaggatcagctgtttcagaggcagtgaaggaagagaagagcagtctgtnctgatgaggagaagggcggcagcgagaagaaaaagaagaagaagaagagcaaggaaggtggtgatgatgttgctccagagagtgcggaagttagaagagnanaanaaaaagg

SEQ ID NO: 26275 - DNA, 963 bp, Triticum aestivum
  Clone ID: PAT_TA_26275
taggggcctttttttttttttttggagaacaatcagaatagtagtccttgatattttcacatcttcacaattttattacaaacagacattcacagtttcccttcccctccctccctttccttcacctgcgcacttaaacgaacatacagcggtgttaatcaggctacagagtacaagctgattggcacctatgcggaagccacgcaaaacaagttcaaacaagcagcaatcgatccatgacaacgatggcatgcagcaacgacgaccacgacgacgactgacaactaggtgcgttacggttgaaccgagacagagagacaaacagagaggagggagagggtgggacggggcaccggcatagcgagtgccgggcctaagcgtcggccgccttcttggcgggggacttcctgggagacttggtcgtgcctgccttgggctccttggaagccgccgcagcggccttcttgggaagcagcacggggttgatgttgggcaggacgcctccgtaggcgatggtgacgccggccagcagcttcccgagctcctcgtcgttgcggatcgcgagcagcacgtgccgcgggatgatccggttcttcttgttgtcccgcgccgcgttccccgccagctcgaggagctcggcggcgaggtactcgaggacggcggcgaggtagacgggggcgccggagccgacgcgcttggcgtagcgcccgtgcttgaggtagcgcccgatgcggcccacggggaactggaggccggccttgacggagcgcgagacggacttcttcttggggccgccgccgccggcccggcgcccggccttcttcggcgccttcgctcccgtctccatcgccgatcccgagctccgaagcttctctcctccttcgctctgctttttcgcccccttttctctcccccgtcgcactcggggttttttttagccacgcgtgggttgtgcggtggggg

SEQ ID NO: 26276 - DNA, 474 bp, Triticum aestivum
  Clone ID: PAT_TA_26276
tttcgagcggccgcccgggcaggtcgagaccaaccaaatcaaaatgcatcgtcgacatgtctgctctgcaagcggtcttcaacatgccgaacgtcttcagcaagtcgaagtccggacacaaacgacatgcgatgggtggttcgctgccgctgaacttcctacgacaggccgagcgggaatctaccgccgagcaaagtcgtcccatctcgactgcagggtcatggttgaggaactcgaagatgacgaagatggatgcttgagtctgacactgtttcttttgctgtttctttagtgatgtttactgcgacgcaatagatggaccggctggctggctagccgccttggcaccttgtttttcttttgtacgagatggatgatatacccaggtagaacggcgttgattttagagataccactccgcatttgggagacgaatatgctgtaagctattgtacctcggccgcgaccacgcta

SEQ ID NO: 26277 - DNA, 282 bp, Triticum aestivum
  Clone ID: PAT_TA_26277
tcgagcggccgcccgggcaggtggtcgatgagccatatgacccaaagaacttcaaggtgcctgagaaggagttcagcttggaggaggtcgcaaagcacaacaagaaggaggacctgtggatcgcagtcaagggtatcgtcatggatgtcaccaactgggttgacgagcatcccggcggtcctcaggcgctgttcagccacatgggcaaggacgcttcagaggagtttgagatgatgcacgatgatgaggttattcccaagtacctcggccgcgaccacgcta

SEQ ID NO: 26278 - DNA, 183 bp, Triticum aestivum
  Clone ID: PAT_TA_26278
ttcgagcggccgcccgggcaggtacatactttgaccagtaaaagcgacccgtgatcatggccggcgcgcgctcacgggctcctattcacgggtgcagtttcttgtcatgttccttcagagaaaagaatgacgtgggtgacacgaccatggtttattcgtcggacctcggccgcgaccacgcta

SEQ ID NO: 26279 - DNA, 1097 bp, Triticum aestivum
  unsure (1)..(1097): unsure at all n locations
  Clone ID: PAT_TA_26279
agaatttacagttccaaggtttgcccancatccataatgttccttatgtatgctaagctttcactgtttcaattccaccacaccaaaattatccattcctgcgtgtaaagggggccgttttttttttggaaacagagctgcagtgccatttcccccatccttatgatttacagagaagacagagttgtccttataactaactaacccaaacatccaatgtacacttcgtaactaaccctatccaaccttccagatgtacactccgatttcaaccttgtacatttcaaggctatagacctaagaaacgtgaaacgcggtcggcaagattggcgatgacgaacccagaaaatacctggacagaaccaaaaatgtagactgctgaataatgtcgaccgtggatgaccatgtcagcaaccatcgctagtggaattgtgagcgacatgcctaacgtggccaccaagggattagtccaaacaacagaaagagcccagaagtagtctgatagcacgctcccaatgaggccatttgccagcaccacttcatccactttagctgagtggggcattgtaaactttggctcaatgccaagtgcagttaatggccagacaagccaccagagaagacaaagactgaaaagtccgagaaaaccaaacagtttttggacatcaaccttttctgatccttctcctccagcaaactttttgagaagcacagtgaaaagaccatatgacatagctgacataagaccaaacatgtcacctagaagagtcctctgtgtggcccctgaattgcttacttctgattcatctgttgcccaagtctggcccatagttgtcattgccacnccagccatgctaacaaaaacggcaataactttggcagcatttatggaatcttggccaagtagcacaccgatgaaaagggtgaagagtcccgaagttgaagatagtacagtagtgcttgcgacactagttcttgcaagtgcagcatttgacaaatactantgtgacaaaccatatgggacaaagatacagtccataaattgcaatctgccttggtggaaagctgttgctccttcaaaacctcaccctcacatt

SEQ ID NO: 26280 - DNA, 419 bp, Triticum aestivum
  Clone ID: PAT_TA_26280
tcgagcggccgcccgggcaggtacttccatccgccatgctttgtcggctgtgaagctgggcgttgacttcctttccattgacggcttcgaatgcgccggccacgtcggcgaaacggacatcaccaacctgattctcctctcccgctcccgccaggtgatgcccattcccttcatcgcatcgggaggtttctgcgacggctacggactcgcggcagcgttgaatctgggagctgagggaatcaacatgggaacgaggttcatgtgcacgatcgaagcgcccattcaccacaacatcaaggtggccattaccaaggctcaggagacggatacacagttggtattgaggaagtggaggaatacatcgagattgttcaagaacaaggtctctagcgaggcgtacctcggccgcgaccacgcta

SEQ ID NO: 26281 - DNA, 345 bp, Triticum aestivum
  unsure (1)..(345): unsure at all n locations
  Clone ID: PAT_TA_26281
cgcggnnaattcgattagcgtggtcgcggccgaggtacactgccatccagccgatggacgtggaagcctttttcctcaactacctcgctttcttcgtcgtcgtgttcttttatctcgtcgggtatgcgtggaagcgcggccgatggattaaaatccacgagattgatattgactcggggaggagggcgattgattatgaggcgtttgaggcggagaagttgaggacgaagaatcacggtgcttttaggaggtttatggggaagatgttttagagatggttttgttgtgttttttttgttggaggtgggggaagatgtgttgtacctgccncgggcggccgctcga

SEQ ID NO: 26282 - DNA, 178 bp, Triticum aestivum
  Clone ID: PAT_TA_26282
cggtgctaaggaatgaattatgtatctgaatattcgttaaggacaggtcgtgatcgagtaacgtcgtaatgcgaagccaaaatatctctgcaggcgatcaatctgatgatctactgggcctcctccacagcagcctcctcgcgaccggcccggccgggcccccgccgcgaccacgcta

SEQ ID NO: 26283 - DNA, 362 bp, Triticum aestivum
  Clone ID: PAT_TA_26283
tagcgtgggcccggccgacgtgtaagcctcaggagcgatttttgtcccgtatttgaaagcttccggtttctatttgcagggaaggactgaatttgtctatcaagaccaaagaaaaatgaccatatctggtagtctcacaggtgcactgaatctccatggaccggaatcaatcaaaatatcttatgacaacatggagaagaaaacgacaaatgaaaaggacgtcgctgttgagtgatacaacttgagataatggttgttggacagattatatgccaaagcatacgattccttctgcgagtctaaaatatctcgactgttagagttgtgttgactatgatgtacctgcccgggcggccgctcga

SEQ ID NO: 26284 - DNA, 345 bp, Triticum aestivum
  Clone ID: PAT_TA_26284
tagcgtggtcgcggccgaggtacatcaatcacatggctgccccgaactaaactataagcctgaattcgtcacatccaagttgcacatggcctgatgatgttaagtgaccacaagataacagttaggagcctctgtaaagcatatatcgccaaggattaaccagcaacaatggacatgctctacatcacagaccacacacatagcttctatagccaatactcttgaacttcagccgagcctgaggggccgtcagtcagggctactggacggagaagacggcgccgtcattcaacggcagcaagctgaagcagcgcccgttctcgacctgcccgggcggccgctcga

SEQ ID NO: 26285 - DNA, 673 bp, Triticum aestivum
  unsure (1)..(673): unsure at all n locations
  Clone ID: PAT_TA_26285
aattcgattagcgtggtcgcggccgaggtacctcttgaaaaagtagattcaggagagatcaggctcgaaatagaggcaataccaaatgatcacaacgacagcctgaagagatcaagcagtaaagttgaagctggctggatcgagctagtaataattgaagccagggatcttgttgctgctgatcttagaggaactagtgatccttatgtcagggtgcaatatgggaacaagaagaagcgaaccaaggtcatttacaagacgctggctccaaactggaaccagacatttgagtttgcggaaaccggagagcccatgatcctgcatgtcaaggaccataacgcggtccttccaaccgccagcataggcaactgcaccgttgaatacagcatgctttctccgaatcaacccgccgacaaatggataccgctgcaaggagtgcggagcggagaaatccatgtgaagatcacccggagggtcgcaaactcggaaaagaaaaccagcctgctgacagatgcgtccgccctcggcaaaggacacaagatatcagcacagatgagagacagcctgaagaaatgctcgggcttggtggacgacggcggcgatgcggaggcgctgtcgttggccctgacnganntggagagcgtccangacgagcaggatttgtacctgcccg

SEQ ID NO: 26286 - DNA, 464 bp, Triticum aestivum
  Clone ID: PAT_TA_26286
tcgagcggccgcccgggcaggtcttctcgatgtgcgtctttgctattggcacctacgccgtcaactccatcatcctcggctgggtctcggcaacatgtggtcagaccaaggagaagaaagcctcatccttggctatcgtcaatactatcgccaacgtgtccttcatctggactccatacttgtggccggacagcgacgaaccgaactacccgatcgctatgggctccagcgctggcttctcggtgatcacggctggtcttgcttgggtgatgaagttctggctaatgcgcatcaatcgccgtatgaggcagaccgaggacgagaggacgctggcttttgcttactagagagcattgcgcggacttgcatgactgaatttatgatgatgatcgaggacgtttgagactcctccatgatgaaacactagtattgaaaattaagaaatcctgaccaaaaaaaaaaaa

SEQ ID NO: 26287 - DNA, 409 bp, Triticum aestivum
  Clone ID: PAT_TA_26287
tcgagcggccgcccgggcaggtactggtaggcagctcgatgtgtcaacccgcccaaggagatcaccacggcggatcgtgctggtgcgggtatcttgagtgcgttggtgctggttggtatccttggaggtgcttggtggatggtggcataaggaagacgaggcgatggggcagagacagatggacacagacgattgcaatgaacaggttggatgggatgggttgggacgggctgaagggaggatgacactggcatccttgtcggtcccataattggcgtttctgggctgctttctgagggtggctcgattattgagtcttgggcttgtatgctgtgactgctacagatcgatgagagttatacatattgtttttttgtcacagtcccctttccttgcgcaaaaaaaaaaa

SEQ ID NO: 26288 - DNA, 613 bp, Triticum aestivum
  unsure (1)..(613): unsure at all n locations
  Clone ID: PAT_TA_26288
tcgagcggccgcccgggcaggtactggccgtgagccnnagtatgcagcaccatggacggaggcgtggaccaaatcaatgggacgcctacgtcggaactgccttgctcctcctcctcctcatgttcaagccgccagcagccaaatcacaccccaaagtagaatctgaattcctgagagcactactccatcgagcttcgagcgcaaagaggccatcgaggtctcttccgcgagctacaagattgtcatcgcttgctccaggctttcaattccatgtgggcgcgtttcgccattctctccaggtcggcgcaagatcatcatgccgtgactttcgtctccgactctatgactgcccgccgacccaaaagtaggagttacccaagaaatccactagtcgacctctcccgatcctgctcctgtctcctccctccgtccaccgtcctcttgcctctgtcgaaattcggaacgccgggaactcaagcgcccacccaaatcgttccatcgttcaacaaagtcacttgaccgtccacctgtggatccaacccccaatatccatatcttttcgttcatccgggttcatcgccgggaaagtagtacctcggccgcgnnnacgcta

SEQ ID NO: 26289 - DNA, 610 bp, Triticum aestivum
  Clone ID: PAT_TA_26289
tagcgtggtcgcggccgaggtacagggactcagaatttccgtagctattttacaagccagaaaagctagtttagaagtagcagctcatgcagagggagcacggcttagagcgcttatagcttctggtaatgagggacgtcctcttaaccttacaagtttggcaaatatcgctagggaagaagaatctgtaatggcggagatatccagacttactactcttcttaacaatgcaacttcttctctaccagagtaaaagcaaaagctaatataattgtttcttgcttttgcagaatactggattatctgcactcatgatggcatttttactgttatacgttgcataacctcaataacattacatataactatatgttagccttattattaataaaaaaaaccggcccaagacggccgctcgttaacaaagaaatggtttcgcagggctcgcataatatatgaataaatagcactaattattatacgctaggggagtattaagggtttgtttgctgatgcaacagttatggctacaatattactgtggaaggtttgattccttatacaaccaccccacaataagagtattgtacctgcccgggcggccgctcga

SEQ ID NO: 26290 - DNA, 1050 bp, Triticum aestivum
  Clone ID: PAT_TA_26290
caacatatgtgcagcaggcaacatgacacagaaattttatttcaccacagacaaaaactatcaaacactaattccccctttgcaagatcaattctaacactgaaacaaaatcatcaaatactatttcccttttttgtactattgaagacccaaaaccaaaattttattttcatgacattgttgggtagccaaaattatgttttcgttacactgatgtttaggatagtttcccattattattcataaaatctgcaagattgataagacgttatgacaactgtacctacagttgcattctgcccaacgaccaaacagtcactgaattcttacccctcatcgatacacgctaccatttaactcagacctcaaacatgacgcggaacctggtagcaacagagcggatatgatgacagcaccctagagcgacggccaaatgtagctcaggtgtggatgatggagaacgtagcgctgagactgctgggggttcttccagaggaagaatcgggggaggccaggtgggcagggttcgcatcaggagccgagacaaggggtatgacttagtatcgtagggaagcggtttcctaagttggtgcttgcttactggttggcgaggagctccgtaagggcataagatgtgtagctccttggcttgcccaatgcattagagaagggactgaaggccatccatgttgttgaaagacgagttggtgggtaccaaaggcaccacggagagcaaatggagcgtctctcaggggtgcgaagccgggtgttgctgtgatacttgtccattccttcctccgcgttgctgcgcggagcggaagctcggtgaagatttggggacgaacgagacgacggcgacggagacgtcggctgcttcccttccgtaccgcttggttggacgaaggaagatgcgcgggcccggaccccggctaatcacgcgcggaatccaaggatctcaagaagatcctttgatcttttctacggggtctgacgctcagtggaacgaaaactcacgttaagggattttggtcatgagattatcaaaaagga

SEQ ID NO: 26291 - DNA, 856 bp, Triticum aestivum
  Clone ID: PAT_TA_26291
aaattggatccttttaaatctttttttttttttttttttttttttttttttttttttttttttttttttttttttttttttttttttttttttttttttttggcatccccaggattaatttacgttagcgaggcagtttccacttgtctattcaccagtcggtttgtacaacacacaacaatggtgcagcacttgacctctacaacaagaagaattgtgaataaaggagctcgcggatcttgtagtactcctcgcactgcgggccctagaccccaatctccttagcgatggacaaggtgttcaataagaaaaggtacagctggcatccccaggattaatttacgttagcgaggcagtttccacttgtctattcaccagtcggtttgtacaacacaacaatggtgcagcgcttgacctctacaacaagaagaattgtgaataaaggagctcgcggatcttgtagtagtcctcgcacagcggaccctcgaccacaatctgctgagaacccgtgctacccttttggttagaatcgccaatcttgcgcacggtgatgtactccccacaccgtagagcacccccagcaaactcaacctgtaaacctttatttgctaggaattgcttgaaatcggccaatttcagatcacccacaagaactgacttgtgggctgctggagttgatgaggggggtagcaaagtgagcttctcatccacctttccaacccctgaatcaacccatgcaatttcatgctcacccaacttcttagaaatgacattgctcattaacttctcggaaagttgtaccttgtaagcacataaatctgatgttacatcaattgtttcttctatttcctcgtgc

SEQ ID NO: 26292 - DNA, 340 bp, Triticum aestivum
  Clone ID: PAT_TA_26292
tagcgtggtcgcggccgaggttcaccctccctcgccgtcgcacaccgacgaccgtgaatgcggacgcgatatcaacctgtcgaaaggcatggctgcacgcgatcatcgccagcgcggagtgtttctttgtatttagtttttctgggccaaactggcaggtccttgggattggcgtttcaacaatcatgggctcggcttcgcaacacgtcgccttgagccttgattggggcatggatggatggatgggaactttcgatgttatcagtgctgaaccaaatcatttcgacttacaatcgatacaacaccacaacgtattgcactatgttccaaaaaaaaaaaa

SEQ ID NO: 26293 - DNA, 628 bp, Triticum aestivum
  unsure (1)..(628): unsure at all n locations
  Clone ID: PAT_TA_26293
tagcgtggtcgcggccgaggtcgagcccagcaccgatccacattccagcgaagcagctatacacgatccactgcccacgactcgccatccaatccaccaaccaacacgattccaaaccccgatccaacgcatcacatttccgacatgcctcataatcgaagatcacgaccacacacacccccgatacccatcatcatagtttggaacccttcgttcactccatgccaccactgcacgaagataacacattcaacacctcactcccccatccgggatacccaaattcgcccaccatccatattccgtatcccggcgttttggctttttgtttttgctcatcgagggactttcgcctcagtgcgcgctatgtccgcgtttatgcctcatagttcagaggctaggagataacacggatgattacgagattgtcgtggaacagtctgttaccgattgaatgagtcgaatgggcaagcggcgcggctggctagcctgcaagtgggaaatctggactgtagcaccctgtgcgcgcacgctttgtgtctgttacgcgagtgttgttgatagatgcccccgaatgacaggtgttctgaacttcgaaaaaaannncnnncncgggcnnnnnnnncnn

SEQ ID NO: 26294 - DNA, 433 bp, Triticum aestivum
  Clone ID: PAT_TA_26294
tcgagcggccgcccgggcaggtcttgtatgagaccgacctcgcaccgcaatgcctcattgccggcgagggtgtgcttcgcagctacggctacaagtctggcgagacgggcaagtgggtcggtatcatgatcggcatcatcgccggctaccggatattgggatggctcacgctttaccttcgcaagacctgatcgatgagatcggtcgtcttacgcatgttgctatgtcacgttttcatttctgttttaatttgtttagcgcgcacgaggccgaccccatggaggcgtcgccagaaagaaactgctcgtcagcacggagcggtcaaagactgagaggaaagaagtctgggcacaggtgtagatttctcacatggaaagcggagttcaggtggtgggacagccaacaaaggcgtacctcggccgcgaccacgcta

SEQ ID NO: 26295 - DNA, 709 bp, Triticum aestivum
  unsure (1)..(709): unsure at all n locations
  Clone ID: PAT_TA_26295
agatagaatgcacttatncagaatggaaagnaacgattgtgtgcgtcttgttacatgtgagaggacgttggttattcaaggccaagaggcagagctgtcactttgtatcctgtgtttcctgcaccttatttctttcatagggaaacttatgactgatgaaacctggtcggttgcagattgcaaaccgacaccggatcgcctcgcgtcgcatccaaggatgctcctctatacatgtccaccaccttatttgtcagaaaccatgggtggtcggccttctatagccgacgaagccgaaacctcgatcgagcactctagcacttgaggtcatttcatgtcgacgggtgttagcttctcctaacgaattgggagctgactgggtgcacatcttctgttgagttccctgcacaccctttgtcctcaccagtttactgttaggcgttcgaagctaaaattaaataagttggctaacattcatcttcagcggaagctttcacggtcttgcgataacgcggaaaaagcattcgcttgatcttcttttcagctgaacgttcagataacgcctgggcattgaatgaaaatcgaactgtccgggcttccatgccagggccggcgctgccgtcgatgccggggcccccggcgcccacctggccagcgtccgctactcgagcgccccgtgccccggctacggggggnccttggggccatggtn

SEQ ID NO: 26296 - DNA, 236 bp, Triticum aestivum
  unsure (1)..(236): unsure at all n locations
  Clone ID: PAT_TA_26296
cnncagggcaaaaggttttgttcgcgcaacattaactggggggtatcatgccatgatgtatcccgctcataaaattctctaccgcctcttgcttaagcctggggctccctggcccttgccttgtccgacgcgcccttgacgtaccgggagagatcgacgaccgaaacctggaacgggaactcgagcgaggcgagcaggatagcaaagaaaatgtacctcccccgccgccccgccaa

SEQ ID NO: 26297 - DNA, 316 bp, Triticum aestivum
  Clone ID: PAT_TA_26297
tagcgcggtcgcccccgagggacgccattgcctgcatcgcctacctcgtcgtcatctggatgtttggttgtccacggacgccagtctgccagcggcaagggcaacaaggttggtggcttctacgcttccatcggtgccttcaccctcatcctctggaccatctacccaatcatctggggagtggctgacggctctcacatcttggacgttgacgaggagatcatctcctacgctgttctcgacatcctcgccaagcccgtcttcggtgcctggttgttgttcacccacagccgtacctgcccgggcggccgctcga

SEQ ID NO: 26298 - DNA, 391 bp, Triticum aestivum
  unsure (1)..(391): unsure at all n locations
  Clone ID: PAT_TA_26298
tcgagcggccgcccgggcnaggtactgaaggctgactccagagttttcgttgtcgaagccgcagtccttatcggtgtagaactggcacacgtcgccgtagctgctgctgagggaagtgatgttcttgtcgtatgacttgccggtcttcccgtcggtgttgaagtcgtagtagttcacgcactgtccgggagcagctccgaagacgaggcattctccacggaaaccctgcgtgcggcacatgagcacgaagagatattttgggacatgatgttgctccttgtcgtcgcgggcttcggcgtccttcgtgaagaggaggttcttcacgtcgttgctgaggaacttctccttggcttcctttggaatgtcatcgacctcggccgcgaccacgcta

SEQ ID NO: 26299 - DNA, 474 bp, Triticum aestivum
  Clone ID: PAT_TA_26299
ttcgagcggccgcccgggcaggtaccaccagtattcgcacccacattctccggcggaatgctcaaatccgccaacttcaaattctccaagccatgcacactaagcgtatgatcaaccacacccttcttctccctcggcgccatcttgcacgttcccaacgagtgccaagtcgtcgacacgatctcgcgaaccttctgctcaatcgcagcatcgtcttctttcgtatacgggatcctctcatcgttgttcttggacaatggcccgtcggccttctcgacgacagcggctttcgatccctcggggaacttggggtggttgatggccagttctccacggaaaatgggcatgcgacgccacatttcgcgggacagcttgtaggcccagatatgtttcttgacgtcgttgtcgccttcgtctttgagccagccggtttcgaagtcgggcttgtcggccacctcggccgcgaccacgcta

SEQ ID NO: 26300 - DNA, 502 bp, Triticum aestivum
  Clone ID: PAT_TA_26300
aggatctggaaaacgccacctaccacgcatgttcattggattaagacacacgcccgcacgcccggcgagtcgagagacaatgccagcatgctccaattgggatgcaacttattcatcagattacatcaactagaccaggaacctaaaaacagggcgagctagctagagcagggagagagcagggagattggacagagctaagctgattacagatctagagccagggagaaataggtagatgaccggtcgcgctgaatttgggattactttgtggactgccctcacgttcggccgcccgcaccactgatcacactgataatgaatcacgctgtgctggaggattctggttgctgctcttatgcgtcatggcaacatgctgtaagcttgcagatgtgccttgggtcttcttaccttgacaaacggtgcatgatagtatcatatggattgcaaagtagctcagcacggcgatgatgagcgtgaccacaatcacagacgtcttcca

SEQ ID NO: 26301 - DNA, 320 bp, Triticum aestivum
  Clone ID: PAT_TA_26301
tagcgtggtcgcggccgaggtacggaccgcgcaatcatctgggaggatcggccggccgcctcgccgaactcgaatctcatcgagcgaagctcagaggacaacgcaacttgccggaccgcctatccgtgccgccaatatttctcgggaggttgcatgcacgcttctttgctgcatgaactcatccccatgatgatcaacgatgtatgatatgatattttattttgggacaaggagtcgaagtttttcttattcctcggagttcggattgtcggaaaagcacgggaagcaagagatgtacctgcccgggcggccgcgcgcga

SEQ ID NO: 26302 - DNA, 893 bp, Triticum aestivum
  Clone ID: PAT_TA_26302
cgtccggcccgacccacttaacacccccaccctcctcctcctccatcccctattccccaccctccgcccgccccctcctcctccgcatcccattcgcccccaaatcggtcgagtaaaccctagctaaaccccgacctccgccgacggcgagcgagatgaacttcaagggcgccaggatgccgagcgcgccggcgggcgcgggcgcgctggtcaagctcgggctggtgggcggcaccgtgctctacctcggcaaccagaccctttacaacgtctagggaggccaccgggccatcggcttcaaccgccttgaggggatcaaggacaaggtctaccccgagggggctcacattggtatcccctgcgcgtccgggcccatcatctacgacgtccgcgcgcgacccaacctcgtcgagagcacctccgggagccgggatctccagatggtgagaattggtcttcgtgttcttacacgacccatgccagagagactaccaactatgtacaggaccctgggggagaactacaatgagagagtgctgccttcaatcattcatgaaacactcaaagctgtggttgcccaatacaatgccagtcagctaatcacacagagagaggctgtgagcagggagatcaggaagattctgacagagagggcgaagaacttcaacatcgctctggatgatgtgtccattaccagtctcagctttggtaaggagttcactcatgccattgaagccaaacaggttgctgctcaggaagctgagcgtgccaagttcattgttgagaaggctgagcaagacaagaaaagtgcaattatcagggcacagggagaggcaaagagtgcagagctgattggtaatgccattgccaacaaccctgctttcgtggcgctc

SEQ ID NO: 26303 - DNA, 1400 bp, Triticum aestivum
  Clone ID: PAT_TA_26303
gggggcgcacgcgtgtgcgcggttctcggtgcgggagggtgagcaaggtgcccccgcctccgcccgcctcctcctccgcgcaccccattctcccccaaatcggccgagtaaaccctagctaaaccccccggcgccggcgagcgagatgaacttcaagggcgccaggatgccgagcgcgccggcgggcgcgggcgcgctggtcaagctcgggctgctgggaggcgcggcgctctacctcggcaacaagaccctctacaacgtcgagggaggccaccgggccatcgtcttcaaccgcctcgaggggatcaaggacaaggtctaccccgaggggactcacatcgtcatcccctggttcgagaggcccatcatctacgacgtccgcgcgcgacccaacctcgtcgagagcacctccgggagccgggatctccagatggtgagaattggtcttcgtgttctgacacgacctatgccagagagactaccaactatgtacaggaccctgggggagaactataatgagagagtattgccttcaatcattcatgaaaccctcaaagctgtggttgcccagtacaatgccagtcagctaatcacacaaagagaggctgtgagctcaggcgtgacaggcaagattctggacagagcaaggacgaagaacttcaacaacgctctggcaggaggtgtccaatacaagtcagatcttggaatattctgatacgatcatgccaaggactccaaactggttctggatgatgtgaccatagcgagccaaatccatttgttgagaaggatgcgcaagattgagaaaagtgcagttgccagggcggaaggtgaaggcaaaagagtgattatcgtgaatggggaatacgataagaaacaagccttcattaggtgccgcgcagagaggcaaagccgtccagaggtgagctcgcaatgccgattgccaccaaccctggtttttgtggcactcaggcggcttgcagccgccacggagattcccccacatcccatcgcagcctccaacgacatggtgtcgctcgactcgggtgacctgctgcttgggcgccagtcgcttatgatgtggaacaacaacaacaagaaatgagaccgtctctgtcacgcatgttgtggttgccgccagtcttgtctacattggaagaagagtacttttgagaggaacgaacgcttagtttctagcattcccgacccgaaaacaagaaagacgcccttgctactgtgaattatttgtgcacttttcaagtgaacctgtcagctgctaccgctgtgcgtagcttataacgtctgggcggttatgtggtgattatattggccttttcatgttaaaaaaaaaaaaaaaaaaaaaaacaaaaagaaaaaaaaaaaaaaaaaaaaaaaaaaaa

SEQ ID NO: 26304 - DNA, 258 bp, Triticum aestivum
  Clone ID: PAT_TA_26304
ttcggccggccccccgcccaggtacagtgttaccgctgactcctttcttcgccgcgcctcgcattgcctagggtataaagctggatggggtgggtggtgggatgtgtttgtgtccaagagagagaacgatcaaagccgattctccttctgcatcatcatcttcgcgatttcctccgcttatgcgacggcacgctcctcctcgcgaccgcgcacggaagtgtcctcctcgtcatcgtacctcccccgccgcccccccga

SEQ ID NO: 26305 - DNA, 326 bp, Triticum aestivum
  Clone ID: PAT_TA_26305
tcgagcggccgcccgggcaggtacatgtagtagacgtgagcaggtgcggcggtggagttctatagctctatatatgtgatgttgagcatgacgatcgacttgctaacaataacatgcccctcgggcgttcacttgattcccggtttagagagtgttaatgcaacacagacccgtggcagggatgaacggcagccgtgttcgttcctcgacgatgtttacatttgtaaagaaaacagcccgaagcgcaaatgaacagggatcatttatcgctgattgcgattaaaaaaaaaaggaaaaaaaaaacctcggccgcgaccacgctaaaa

SEQ ID NO: 26306 - DNA, 583 bp, Triticum aestivum
  unsure (1)..(583): unsure at all n locations
  Clone ID: PAT_TA_26306
gtggnattctcgagagagtcaaaagaccgactccaacggaggtggacacaggtaccgaaacctcgctagtatctacgttgatgccagccagcttgttagctcggggaattcgctggtagaagccgaggcgaagattagccagagggattggataacctacgatctcctcgtcatcttgcacgccggtctcggcaacctggacagggtgaaggacatatggaaatcgatgcagatgactgcccagaggatgactagtcggaactatgtctgcgtgctctctgcctatctgatgtgcgggcagctgaaggatgccgcggaggtcgtcgaccagtggcagcgatcgaaactcccagagtttgacgtctccgcctgcaacaggctgtttgatgcccttctggctgccggcttcacggacacggcggatagctttagagagctgatgttgcagaagagctgtatactgtcgagcagggctagcgcgtgctcctgagtggcatgttatgctctgtcgcgaacagctgcctgctgctgtgttatggacctatggtacgcggctaatcgactccggaacagtttatgcttt

SEQ ID NO: 26307 - DNA, 1541 bp, Triticum aestivum
  Clone ID: PAT_TA_26307
ggcacgagattcgcctcgccgctcggcatcttgcccgccttcgccacctcggtctcggcccccgcgcgcggaaatggagctcggcctcgcctcctcccgcggcccggccggcccctcgctcgccgtcgccgggcggcggccgcggccctcgctctcgccgccgctgccctgccccctttcgcttcagatacagactcgcggttactcgatgccgactctccatcacaaggcccataccacagtaggatgccaggcttctgtagcagccaaatacatggaaacacctgacatagtcgatctggactgggaaaaccttggcttcggccttgtcgataccgactttatgtacatggccaaatgcgggacagatggaaacttttccagtggagaaatcgtgccttttggacccatagcactaagcccgtctgctggagtcttaaattatggacagggactgtttgagggcctaaaagcatataggaaaactgatgggtctgtcctattattccgtccggaggagaatgccataaggatgaaaaatggttcagataggatgtgcatgcctgcaccgactgttgagcaatttgtggatgcagtgaagcaaactgttctggcaaataaaagatgggtgcctcctaccggtaaaggttccttgtatatcaggccgctactaattggaagcggggctattcttggtcttgcacctgctcctgagtacaccttccttatttatgtctcccctgttggaaattatttcaaggaaggtttagctcctattaacttgattattgaagataactttcaccgtgcggcccctggtggaactggaggcgtgaaaactattggaaactatgcctcggtgttgaaagcacagagaactgcaaaggacaaaggatattctgatgtcctctatttggatgccgttcacaacaaatatctggaagaagtttcttcatgcaatattttcgttgtgaagggcaatgctatttccactccagcaatagaaggaacgatattgcctggtatcacaaggaaaagtatcatcgaagttgccgagagcaaaggctacaaggtggaggaacgccatgtgtctgtagatgaactgcttgatgcagacgaagttttctgcacaggaacagctgttgtggtttcacccgtggggagcattacctataaggggaaaagggtagaatacgatggcaaccaaggagtcggcgtggtgtcacagcagctatacacctcgctgacaagcctccagatgggtcacacagaggatcggatgggctggaccatgcaactgaattaagtatcgcatcaccgatcttggctcgacagatttccagaacactgctatggcagatgaattaaactcttcaactgggacctaggggaagctaatatgtaattctcttgtttaccatcaactaggatcttgcaaaaatggtcagtctagctgggcagctagcgagacttcctgaacacggcacaagaatatgtgtttatcctctgatttcttttttcagaataataaacgttactcc

SEQ ID NO: 26308 - DNA, 397 bp, Triticum aestivum
  unsure (1)..(397): unsure at all n locations
  Clone ID: PAT_TA_26308
tcgagcggccgcccgggcaggtcaggcatacgagctccagcagaagaccgaccttgccgctgaggccaaggctgttctcgactcatgggtgcgctacgagggccaggtcaaggccagacaacagaaggagctcgcagagtccgtcattgccaagattgagaaggacctcgagaaccccaaggtcctcgaccagatcctcaggcaggcggtgtcagatgttgaacgtatcgtcgcgcagaaatagatcacgtgactgagaagtcttcggtgagagtggccgaactcgcattgtaaatacctagacatttgcgaaaggcggtcaaatgaaatgggtcctttttgttgtccaaaaaaaaaaatannnngtntgaacaaaacctcggccgcgaccacgcta

SEQ ID NO: 26309 - DNA, 439 bp, Triticum aestivum
  unsure (1)..(439): unsure at all n locations
  Clone ID: PAT_TA_26309
tcgagcggccgcccgcgcaggcacactgttgggcnntcaggagcaacactctatccgaccacgggcagcagtgcggactttgcgactgatattgcgaaggcgaagtatgcgtatgctatcgagctgagagacaagggccagaatggatttgtgctgccgccggatcagattgtgccgactgggcaggaagtgctggcgggtgtgaaggttcttcttaaggggctctgatgagatacgggcgctatatgaatataggtcctggggaagtgcttgaactcagttctagccccttcccataagctcccacattggccaatctggaccagcacgatatcccggatcgaagtggagttggaagacatcaagaggaatgccgaaatcaagcaacccaagtgtctctaaaacttctttcttaacctcatcccaaaaaaaaaaaaaa

SEQ ID NO: 26310 - DNA, 1415 bp, Triticum aestivum
  Clone ID: PAT_TA_26310
ctcgtggataagtaccggatctcagactacgccatgatggttaggaacacgatacacgagataagcaaaatagagggtgtgatggaggaggcagtgaagggcagccaagcgacctggtgcaagcagctgcgcacgctgaccaagcgctcctacatcaacatgtaccgtgacttcggctactacaggctgcgcatcatcatctacgtcctgatggccatctgcctcggcaccatctactacgacgtcggcaacggctacaccgcgatccaggcgcgcgcctcgtgcggcggcttcgtctccggcttcatgacgttcatgtccatcggcggcttcccctccttcatcgaggagatgaaggtcttctccctcgagcggcagaacggccactacggcgtcgccgcctacatcatctccaacttcctctcgtccatgcccttcctgttgaccatgtcctgggccagcgcctccatcacatactggatggtcaagttccggccaggattcagctacttcgccttcttcgccctcaacctctatggcggcgtctccgtcatcgagagcctcatgatgatcatctccgcccttgtgcccaacttcctcatgggcctcatccttggcgccggcgtcattgggatcatgatgttgacgtctggattcttccggctccttccggaacttcccaagattttctggaaatacccagtgtcctacattgtctacggctcttggggtttgaagggtgcatactagaacgacctgctcgggctggagtacgagccgatgacgccgggagtcgagaagctgactggcgagttcatcatcaccaacatgatggggctgagcgtcagctactccaaagtggctagacctagccatgatcttcattctcctcctcgcctaccgcatcaccttcttcttcgtcctcaaggtcaaggaggccgccgcgccctacctccgcgtcgcctacacgcggttcaccgtgaagcgccttgagcggcgggcgtccttcagggagtcgctggccatgacgtccttgtccaagcggcacaacgcgccgcaccccatggccatgcaggaggggctcaactcccccatgcagcagtactgactggccaatgtcaatgagtaccaggagcagccgccccggcagttgagttgatcattactacagcaagaagatagccgtccgtgacatgcgtctgtcacgattacttgtgtatgcgtttccacttgttagttttgcttgcaggcttgcggcttcgctggaagcttcaaggttcataaacatacggatagtgcattctttaaaagtttggttttactgtaagaagtcgccgcaaccaatacagatacgagataatattacgcctcattgtttttcaacttcgttatacacaagactgactggaaaaaaa

SEQ ID NO: 26311 - DNA, 1316 bp, Triticum aestivum
  Clone ID: PAT_TA_26311
gcccggccgctgcctgcgcaaaggagaaccgaggagaaagatccggacgatacgagctcagctcccgtcgcatcgcaccgcatcgccccggcgacacccgcccgctgccctccctcgtcctcagctctcccgaatcgcgtcgccggcggccgagaggccattggattcgtggcgttggcgagcgtggtcgccaggaggggaggggcggcggcggcggcggcgactgttcgcgggatgagcttcggcggcgccagctccgtcgcggccggtgggaagcggccgttcgagtacgggaggacgcatgtggtgaggcccaagggcgcgcacaaggccaccatcgtctggctccacggcctcggcgacaatggagccagctggtctcaactgttggaaactcttccccttgcctaatataaaatggatctgcccaactgcacctacgaggcctgtggcaatttttggtggattcccatctaactgcatggtttgatgttgctgatctttcagaagattctcctgatgatgttgaggggctggattcctcagctgcacatgttgcaaatttattgtctaccgaacctgcagacatcaagcttggcgttggtggctttagtatgggtgctgctactgcgctttactccggtacttgctttgctcatggaaaatatggaaatggcaactccttaccctgtgaacctaagtgtggctgttggtctcagttgcatggctcccatgaatgccaggtcattgaagaacaaaattgagagctcacaggaggctgcacagaaggcttcatcattacctcttatgctttgtcatggaaaagctgatgatgtggtcctctacaaacatggagagagatctgctgatgcacttaagtcaaccgggtttgcaaatgtggaattcaagtcctacagcagactcgggcactataccgttccagaggagatggacgaagtcgtcaagtggcttacggcaagcttggaactcggcagttcctcgtcaacttgatcgaatgaagagatgccttgagaaaggctcggtgtagcggcgtctaaataataagtacctgtggttgtgccgaattgagtgataaaatggctgggttgccaacttgggctttgggtatacggtcatgtcttagcttggcgtttcatatgcggacatgcctcgctgaatcttggtactattgagatttccatatatttggtatgtgtttccatccaaagtcagagacattgtgatcagtttggttttggttaccaatgatatttttgtttcaaaaaaaaaaaaaaaaaaaatttcacttgtgcacc

SEQ ID NO: 26312 - DNA, 648 bp, Triticum aestivum
  Clone ID: PAT_TA_26312
gcgttcgcaacaaccacacacgtacactacttagcacgagctttctagtagctagccctgcgtaagtacgtaaccgtgcgcgtcttcaacctcctcaccgcggcggccccggcggagatgtcgccaagaaagacgatcctcgtcgcgttcttgctcctggtggctatgtcgaccaccgtgctgacttccgtcgacgccgcaaggaggctggggcttgagccggaggagcagtacagcgcgaccgtccccgcgacgtcggcgaggcttcacgagagggcgaggtcgctgatcacgacgtggatggcgcagctcacggcagggccgagccctagaggccctgggcactaatgagaccgaggtgcaagaaacaacccgagagagagtattcctatacttaagtttgtacttttcccttgcattaccatgtgtagtgttacgtacgttcctacatgttactcttttgatcggtacatgtgtacgaacaataatacggaggctagcttccacgcctccacacggcggtcatgtgatgatcttttccgcaacgtcgcccggagtaattgcacgatcaatataaggtcgattgcttctcagtctaatcttgaattcttgatagtagatgtaatgaagttgagtatattttacttt

SEQ ID NO: 26313 - DNA, 646 bp, Triticum aestivum
  Clone ID: PAT_TA_26313
taccatttcagctacaccactccagatcgcagcaggcaggaactgctccaaaacaagacccctctccggagtgagcattggcctttcatgagaatagacggcaaggatgtgagggtggccaccccaagaaccccaaaggccccaaaacatggccctcggccttcacgtttcaagctgcttgacgtgaagccgatcacagccgttcttttcccagattcgttgccttcaaaaaagcgccgtctgcggcgtctgatgccgccaggattgccaaggcctgtacccaaagccgcagcctctcccagagttttactatacgaggaagagctttgcgaagcggtggcgcagaataagcttctatgaagccccaaaagaagtggtctggttgcgatggattgacatcgcttctcatgcctcatctcataatgtatatatagtgtttatcatttatgtcatgtctctgggtatgcttttttttcttctttttgcccggtggcacctgtgtgtcatcttggataatcatggtcagattaggctgttttaggttagtcattagcctgtcatactctcctgcgcataaggaccaaagtctggtttattccctggttttgtatacactatagtagcggttgaatatcttggaaggata

SEQ ID NO: 26314 - DNA, 281 bp, Triticum aestivum
  unsure (1)..(281): unsure at all n locations
  Clone ID: PAT_TA_26314
tcgagcggccgcccgcgcaggtggaggctgctgcgcccgacgccgcacccgctgaggcgngctggcgagagcgccatggaggaggtcgactaaattgctgccctgtcatgaggatggagtagcaaggaaaagttgagctctttttgtgttatgtgttcacggctttcaacgcgcatgaagtgtgctgggtttccaggatccacaaagcaggcgtttttgtgactgatgacggatgtggggaagcgtgagacgtgcattgtacctcggccgcgaccacgcta

SEQ ID NO: 26315 - DNA, 486 bp, Triticum aestivum
  unsure (1)..(486): unsure at all n locations
  Clone ID: PAT_TA_26315
ttttttttttttgttttggaacgatggtttggagtgtattctacttcataactcaattgagcacaggaatagtccaagccgaggaatgaccacgatatgtctagcaatcgtcatgccatacatgctgtcccaaaagagggcgcatgctcaagcaaagccatgccaatgtggttgtgtccaagcgacggtctgtatctcccgggtatgtatccaattaggtcatcccatcatgcaccacatcatatcaacagctcttttctttggccatgcgcaaaaacgaaacgtcgagacaacagcgctcaactcttaaaaggcagacgcattacgctcagccttctccgagtcgatgacgatgctacccttgcgctcgtcgacgatgccctgggacgaggcgaaggcctcggccgccacccccctggcggaagtgcgtggcgaggtctcctccatcatgcgnncgacctgctctagggacagtccctacctnnn

SEQ ID NO: 26316 - DNA, 912 bp, Triticum aestivum
  unsure (1)..(912): unsure at all n locations
  Clone ID: PAT_TA_26316
gttctggnaaagnaaaaactgttccggtccgccgccgccgccccgcccgcccgcccgccccgtgcttcatcggctcatcgctgcccgaattcttcggcggagcaacgcgatccctgcacgctctcatcgctcccgcgctgccgcagaagatccattttctgaaattggcgctgagtcgtgcacacaacgatttcttcttcaagtggcaatggatcccaagggtcttgacagcgataagtcggcgagtaggctctatgtgggcaatctggattttaggatatcagagtctgacgttatcaagatgttctccccctatggaaagatcatagctgaggatttcctgttgcatacgcgtggcccgaagcgaggcgagcctcgtggttatgcctttgttcagtacactaccaaagagtgagcatgcaggaagctcagttggcaaaggagaagatgaatggcaagttggtctgtggacgtcctgtggtggttcacctagcgagcgagaagtgtttcctagattccggtaattcacaaagagcactgaaagataagaaactggcaggtggttcgggaagcaaatcagcacaaactgatcgtgctgcaaagatatctgcgataaaaaacaagttgaagtctctggagaatgatggctgtagcacaaagagaccaagacttaacccagatgacttgaaaagcactggagaacaatttgataagaagctttgaagtgaacttagtcagcgcatgtgaacagtgccctattatgttggttgcagttgtaatactctagctttattaagttagacagactaaaggtgtaacatttcacagttcactggatttgtacaacagtttgcattaatcaccattgccaagtaacagttaagtcttaatggagaaaccaccctccaatgt

SEQ ID NO: 26317 - DNA, 565 bp, Triticum aestivum
  Clone ID: PAT_TA_26317
ctcacgcgtccgatccagccggcgagtaggagtctgaatcgttgctcctttcacaacgtcgtccgatgaatcgctggagcagtccacacaacatgcacatgcggccatcgacgactccctatgcagtgcacttgcaggcgccgactcttccatcttcaaaattcgttggtagccaccggagatggtctagtccaggtcggctgggtggccccggggttcacactttgttcacaatggtttgtgcagtgcgcttggttttgtggccagtagctattggatttttattgtaaaataatcgttgaagtgcttctgggtctggatgtcgcagccgtgcagtctggtagtgccccattgccccattgcagtttggtattacttttcttgcagataggtgtctcagtgtagtttggctcgatcggcaatgcagttcgtctggttcgtggatgcaggtttctgtgtgttaaataatgatatgtgtagattgcagggacttgttttgtaagaaaatgttacccgagatgcagttcattttaaaattcctttgtggttcattttgtaaaaaaaa

SEQ ID NO: 26318 - DNA, 577 bp, Triticum aestivum
  unsure (1)..(577): unsure at all n locations
  Clone ID: PAT_TA_26318
nntntgaaataaattcaatgatcaaataacatagtaattcacaacgtatgtggcatacagtttttgactatacactgagaatatgatatgttaagtatcgtctaggagcccatgctcactgtcttcactggtctgatgtccatcatcacttctcctctgctctgatgtccatagacgatgatggaggtcttgtatccatgctctaggttctgaccacacgagcataacggtgaactctcatttatgttgccccctttgacattctccctcgtgctctcttgccctgccatgtctagcgccgcctgcccgctcaccaacatatctaacaattcctcaaaagttcaaggatgacacggaatttaaaacatggtgataacaaatttagcccacggattggaaggaagaaatgatttccccccatgacatgctgtccaacctagctcagaaatgtggagaataggtccaagatgtcccagtgcagtttgctattgagaattgagatcctttccttcaacaatccaaatcagtctctataagaataattagagaaatgctaacctcggccgcgaccacgcta

SEQ ID NO: 26319 - DNA, 179 bp, Triticum aestivum
  Clone ID: PAT_TA_26319
tagcgtggtcgcggccgaggtacagacacctcaagagcatccaagagacctgccgcctgacaagggtgattgtgaagactgtagggctgaactatggagtggacaagggcaacactcagatcttcctgcatcccattctcatcagaaaaaaaattgtacctgcccgggcggccgctcga

SEQ ID NO: 26320 - DNA, 565 bp, Triticum aestivum
  Clone ID: PAT_TA_26320
ttcgagcggccgcccgggcaggtaccgctgcctgaaccggtgcctcctcccaatcttgaacctctcgtcgaactggctcgtgccgcaccaccagtagcagaggcgcctccaccaacgttgcgggtttcggtaaccttgttcgtggtgtcattgttcttccagtcggtgggttgcagaagctgcagcgggagagtgccaaagtcgggcaccttcttcgtgatcttcaacacgatcacagggccaacgatgagggcgatgaagaggacgaacatggtgaagtagaggatggcgtagcgcaccacgcggcgtttgcgaagcttcgattgcttgagcgagtagatcggtgggcgaatttgacggctaggcctcaaccagaagagcatgactgagtggaacttgtcgatgtatgggatcaagatcgcgggcaacatgaagaagagcagcatgtgaccaaggcagaagtctgcggcaaagaatcccatctcggtgatcttgcagaggaactcacggcctggctgggacattgtgtgccagcccagagcgtacctcggccgcgaccacgcta

SEQ ID NO: 26321 - DNA, 1061 bp, Triticum aestivum
  unsure (1)..(1061): unsure at all n locations
  Clone ID: PAT_TA_26321
ccccggcgaccacctctagctaccgtagcttagctgagcttcctagctgtagccatggccaagtatttccagagtgctcctgttagcaatgaagcattgaagcacaaggagattctgttggacggcctgtacatgcaccaggaccttgacggatcaccaaatcagaaccagaaaactatagtgaatcctaacctccctctgcagtttggctgcaccgtggctaatgactggaccatatatgatggccttggccccgataagaagcttgttgcgcgtgcacaagggccacatatgggggcaggagtagccaaaggaagctggttcatatgtttcaacatggtgttcgtcgacgacaggtttgcgggttccagccttaaggtgctcggacattttgaagagccggtagaaggtgagtgggcaatccttggcgggacaggagagtttgcctatgcacaaggtgtggtcaccttcaagaaactccaggacggaagcactagggtcagacagcttcagatacgtgccatctgcctcagctttccatcgtcactttcaatgcctacgaagatggggccatggggtggaaatggaggctccattcaagacatcaccacaggaaccccgatgcgcctgcaaagtgtgacactcagcagcgagagcagctgggattgtctctcttgcatttacttatattgacaaacttggaaagaggcgcaacgaaggcccctggggtcctgacaaagggaacagtcaaaccatcgagttcggacctaaagaatatgtgacggaaatatcagggacaattgacaatgtcatatcgtcacttgttatcacgacaaacatcaaaaagtatggaccgtttgggcatgaagaagggcaaccgtttcagcgccgccgtgccagaaaacacatgtgtggtgggatcctttgccaggaccgggatccctcttcctgccgttggcctcggccacgggcccatcggggttggcgctggctttagtgctgcttccaagcaatcanttaaggaaatgtgttgtcaattgttcacatacaggaaggcagct

SEQ ID NO: 26322 - DNA, 205 bp, Triticum aestivum
  Clone ID: PAT_TA_26322
tcgagcggccgcccgggcaggttgaacaagtcgcccttttagttttgaaaattagcgcctttcattagttcagaagtatggaattataggagctcttgtctttcgaataaattgcacatcagtgctgaacttgttagtcctagcttggtcgtgcatgcaatgcaataataaaatagttcctctagtttgatgcaaaaaaaaaaaa

SEQ ID NO: 26323 - DNA, 1277 bp, Triticum aestivum
  Clone ID: PAT_TA_26323
cctccggcgacgccccccccagcgagttcgacgacgagttcgacgaatttgacgacgacgaagattacgacgacgagggcttcgaagacgactactacgacgaccccaagatgatgatgaagcagatggccatgccgccgaacgccggcgggggcgacaagaagggcgccggcaatggtgggaagaagggcggtggaggaaacgagatccctgtgcagatcaaggggaacggcaacaacggcagcggcaagaaaaacgcgggtaacaagcagcagcaccaagggggcaagggggccgccaacggcaacggccgcggtaagaacggaggcggtggtgggcagccgaacaacggggagggaggaggagcgcaaccgccggggaaaaagggcggcagccaccagcgggcgagcccaaccacgactgcagcgacgaggacccgcataccgccgcggcagtgtgagagatggagccctaacccgccgcgcatcgcttgaaggaagaccatgatgaatctggcaatggacccgcatggggcaacaacaagtcccatctagacccgttctgcttgattaattgagcttctacatttaccagggtgatttcaagctaaaaaagaacaagagttgtgagacttgcttgaaggcgattgtaggtgcggcggccggctaccccatggcgcagcagcagtacatgcaactgatccagcagcagcaacagcagcagcagatggcaatgctgcagcagcagcagcagcaacaacaacaaatgatgatgatgaacggcggccacggcggcggcgcgggagggtacccgcagatgggctacgggccagggtacgggcgcccgccgatgggctcgtacccaatgccaaccgcctatgcgatgccgccgcagccaccagcgggggagccttacaactacttcagcgacgaggaccccaacagctgctcggtgatgtgagagatggatcgcgccaccgccgctcatgttcatggttggaaggaagaccatgatgaatctggcagtggcaatgacatggggcaacaacaagtcccatctagatcgtttcttcttgattaatttagcttctacattttcgccttttatttcaagctaaaaaagaacaagagttgtgagacttgcttgaaggcgattgtaggtacagtaattatctatagatgtcataagagatgaatgctccatgctgttacagttgaagaacaatgtgattgactgatggtagatcaatgaacagtatgcaaaataaaaaaaaaaaa

SEQ ID NO: 26324 - DNA, 1339 bp, Triticum aestivum
  Clone ID: PAT_TA_26324
agcacacctacacacttatcccctcataggtttgctcacaaaaaaacatcccgctacccgcagtacggaagtacccaaatccataatatgtgcaaacctttagttctaactctttgtaataacatttctcatctcttgtttctgccaaccccattaaacccacatactacttccaaaaaataaactcatcaaaccgcccgcaacatgaagcttcccgtaatttcccttccaagcaaaagtatgagcaaaaagctctcagggaccatcgcaacggcagcacatacgggcacccatctcactcgaccatcggcggactttacaaaaatcaaaagtcccaggaaatgtaagccaaacaagcagcacaaccaaacagattacgaattttttttctatcacagtagtaaaatcattgaatttaaatcagccttgatgataaatatatatacattcacacaattaggatagacacagcccaataaaaacctgcctaatctttactaaatgttaacatattacatctcccgaaaacctaaacttccagaaatttctcatcaagcaaaagtgtaagaaaaaaaatcattgacaccatagcaacggcagatcctacagcaaccaaaacacccgactgtgaagacctggaaaaaaataagatgccaggaaatccaatccaacagcaaccaaaccgcccgattagaaacacctagcaacaaaccccaagaaccctagctcatgacaggaagaggaagaacagaagccatggactgaagcagtaggagcagatgaggcagtgggagaagatctagcaactaaccccacgaaccccagctcgcgacaggaagaggatgagcagaggacattgactgaaacagagagaggagcgagtgactgacagaagatgaggaggaagaggataagatgagaggggcagcataaacttcagagtatgttgtttctgtcatctgcattcagcacaaaatctaacgcactacacaacatccatctaaagcacagcactaagtcttcttccttcctttcccttcgccgacatcgcacgactcaactgccgccatggacgcaggaacaaacctcagatttgttctgacctctttgtagttcttctgctcacatttcttccttccaaagtccttctccagtcggccaaacatccactacagaaaaactggaaaaatggatgagttctcatttttcacagatctgtcaagaaggacaaaacgaagaaaagaaaaaaggggagagaagaacctgtttcacgtgtcagaactaggtagttaaagcagaataccacccagaaaatcaaaagatatataaacaatgcgtg

SEQ ID NO: 26325 - DNA, 156 bp, Triticum aestivum
  Clone ID: PAT_TA_26325
tcccgagcccgccgggcaggtggacagggcgttcacgaccgagacgcccacgccgtgcaggccgcccgaaacctgggtgaggagttctggtcgaacttaccgcccgcgtgcagctgggtcatgatgacctcggccgcgcacccacgctacacgcta

SEQ ID NO: 26326 - DNA, 209 bp, Triticum aestivum
  Clone ID: PAT_TA_26326
cccggcgggtcgcggccgaggtggctgcgcttgggagcagcagatcgagctgcggcatgactatggtggtgatagacagtgtcgcgcacggcggagtggaaaggatggctactaggaggagtgagcagtagggaggaaggataacgccagaagcgacctgcccgggcggccgccccgggacaggtacctcggccgacaaaccacgctaa

SEQ ID NO: 26327 - DNA, 867 bp, Triticum aestivum
  Clone ID: PAT_TA_26327
tgacggtgttgttgagtgtcgctgtttgtgagagctctatcccagagtggtcgaccttgcagggcggccgcgaattcatctaggagattgactaggttcttagatcgcgggcggccgctcgcgatctagaactagtcaatcgaattcccgcggccgccgtggcggccgggagcatgcgacgtcgggcctcgatttcgccctatggtgggtcgtatataagggcagggggttggcgggggggggggggctgagctgggtgtttgtgcggtgttaaagtgtataggatcgaggctggctcggtgggtgtgtgccgtttgtgcgcagcgtgcctggctgctcgtgtgcatctagcttgatatgtattttaagttttttgactctcctcctcacacttataatccattttaatatgtacacagcacgaacaagcgacaaccgcccgccgcggcgtcacggacgaccgcagcggtcgctgtgaggggtgtgtggtgtgtcgctttatctatattttgatatatttacatcacacacatcaactcaaacacactgctactgctacttgtcgcactagattgtgtgtttctgtgtttctgcatctctctttttttctccatatctctcactatccgtcctcacatcgggggctgctggcggagtgcttcgactcgttaatatagtgcttgtatttatttcatatatacataacatatcaccatacaatttatgtcttaactctatcacatccttagtcttatttgtcattttgaacgtacctatccgcggggggtggtcgtgtcaattgcgccaccatcatcataataatacacatcaacaaatatctacacttcattgattttttttatttaa

SEQ ID NO: 26328 - DNA, 868 bp, Triticum aestivum
  Clone ID: PAT_TA_26328
ggcgcgttgctgtgagctctcccatatggtcgacctgcaggcggccgcactagtgattggaatggggggtgtgggtaagacaagaataaaaaatcatgtataatcccaggttacacttagtatccaaccggacagtctcgactattttcaggtctggcaaattcgatccgagcctttttccccactttgcatcgaagttcattacttgtccaacacgtaaagtcctaatcacgaactaacattattcatgctcttacagcacgcagcatcaatgtgtccattttctacatacattaaattttaccctttttccaaatgcctagcgcaactacgatcactttgatattaatataggactccgaagtactacgtcttaccaaccccacccataatcccgcggccatggcggccgggagcatgcgacgtcgggcccaattcgccctatagggagcccgtattaacctttcggggcctgctttcccaatcccgtctcccctcctcccctgcgttgttcccctccccgctgttcctgtgccttgtctccagccgccctcacaatcatctccttcgcgtgcggagcgcttcctaactctttttcttgtgcccccgtgtctgcgacggcccgtcggcgtcccgcatcccaccaccccacccctctccccacccctcacgctcaccacccgcgtgtgatcataataattaataatttttttattattttttatttgtttttgatccatatccttaacaactaaagaatttatttttctttctattttcatttatttcaatttgtgttattttatttagaatgtgttcataacttcaacaggcgatctcgtgttcgaacatgttatcattatatttt

SEQ ID NO: 26329 - DNA, 701 bp, Triticum aestivum
  Clone ID: PAT_TA_26329
caactgcggcggcgggagctctcccatatggtcgacctgcaggcggccgcactagtgattggaatggggggggtaggaaagacggtggatcagctagagcctgtgcagtcgatgttgaaggctgtgcactcgacaatggaagggcaaaagtaacagaagcctggttggcgtctccggactgctgaaccactggttccctccctgtggctccacacgtgaggcactctggctagttgagatatttcccgtgctcaaagtcctgctcctccttgcccgtgggcctcagtggcacatcctcgtcgtcgtctggaagttcaataacattgggcggagctgcaaaaagattcaatcacaagagttcagtcgaccgtcaagatggttgataaagtaaagacaaaatagcaagagttatacccgcgctggaggtgactgcgtcttccatctcctcatcatcatttttataaacagaagtcccagaggtagcagcactgcaaatttcaaaattcactcggtcaggccttccgaggtgagtcgaccaaagatcaaatcatgctaaactaagaagtcgaattcaaagattacccagaagcaatggggacagccactttgatattaggcaaggccttccgaggtcttgcctacaccccccattccaatcccgcggccatggcggccgggagcatgcgacgtcgggcaattca

SEQ ID NO: 26330 - DNA, 673 bp, Triticum aestivum
  Clone ID: PAT_TA_26330
ctccatacgcccgtggggagctctcccatatggtcgacctgcaggcggccgcactagtgattggaatggaaggcgtgggaaaaacatggtactatccactattcaactgcttcggattactctgataaccagactgttgttgttgattcccctgaccattctgcttgattacgaccaccctgaatggccttggcccctgaaaactggaatttgagccgccacctctgtaacccggaccgtgagagccggatcctgaaccaccattcaggccatgactattctagaaaagatgggaatccctgaactctttcacgataaacaatccttccacaagtgggcggatggcttctcgggtgttctgtgcttcggacatggctgatccattattgcctcgaggttgagttttaccaactccgcccattccaatcccgcggccatggcggccgggagcatgcgacgtcgggcccaattcgccctatgggagcccttattaactttcttttttaattaaccaacattcttccctttccctggtgtgtgtggttgggttttttttgtcgtttgttttattaaatcttgaatattatctctcacttcacacatctcaccaccctctcatatactcttccttgtcgactttttttttgttttttgttttttctccccaccactt

SEQ ID NO: 26331 - DNA, 698 bp, Triticum aestivum
  Clone ID: PAT_TA_26331
gcgcgttgcgggagctctcccaatatggtcgaccgtgcagccggccgcacctagtgattggaatgggtggggtggggaagacggaaggttttgcgcgttggttgtatcgaatttccctttctaatagcatacacaaatagataagaaaggtacgacgatgataaaggtaaatggaaaaccttttgatttacctttaccatcagttctgtcttatctctgtgcctcctctagccatttcataattggatatcgtcattcaaatctgttatgacaactgtttggtaagcagggattcgaatcaaacaataaataccaactctaagtgtgatggatagtacctggtgcctaatttcatggtatctttcttggcgcctaccacgggtaaaacccctccttcttttgggaggaaatcaaatgagtaaaggtcttaccaactcctcccattccaatcccgcggccatggcggccgggagcatgcgacgtcgggcccaattcgccctattgggggcgcggttttaaccttttcgtgtgctatatttaccttttatttttctttttctccgtttttggtgctcaaagtcgcttgtgagtgagggggggcatgaatggcataacggcagcaccgcaaaattatctatatatattttattatatatcattttgtagactgtaggccgcggtaggggtgtgggtcaaat

SEQ ID NO: 26332 - DNA, 363 bp, Triticum aestivum
  Clone ID: PAT_TA_26332
acggtaccagcaacgccgacacaacccgccatcgcagtatgttcgccgatgtggcagttgtgaccgatctgaatctgattatccagtttgacgccattttctatgatggtgtcagccagcgcgccacgatcaatactggtgttggcaccaatttcgccctcatcaccaatcaatacccgaccggtttgtggaattttgattccaggcaccacgctcctttcgcaaaagccaaatccatcggccacctatcaccgcaccggaatggataatcgcgccgctcgaccccatcacgctattcgcgtcattgctggcttgggcgtcaattaaggaaccatcaccgatggtgacggcacgaccctacaa

SEQ ID NO: 26333 - DNA, 504 bp, Triticum aestivum
  unsure (1)..(504): unsure at all n locations
  Clone ID: PAT_TA_26333
cactgtngaaaacaggcaatcattttacttgtttattctttttttacactcttgggaagcttgagcatgaataatgcttcaagaaacatccaaaaggaagatgaactacaaaaagagaagcttttctagaaaagtaaattaagctcaaaataacaacctgttgggcgctgtaaaacccaactgtaaggttaataataagtattggctagcttttatgtccgcaggtccgtgtctttactgcccaagcaggagaccacttccatgattgttggcctcctgaactgattttggttgacacacctgcaagcggcttcaaaaactttcaagtattgcctcttcatacctgttttctcgaagtggttggatccagggacctcaaatcctgcttgccctcggacctcaactggtggaacccatgggggacaaagttccttttgttggaggaccaaaactggggacaagggccgccttccttgtggagcaagctncaaagcaagaaactan

SEQ ID NO: 26334 - DNA, 636 bp, Triticum aestivum
  unsure (1)..(636): unsure at all n locations
  Clone ID: PAT_TA_26334
annacccnctggaaggnttcnnaaggntagttgnancccgtttncngtcgagttaaagagncanggcggntatacgancantaggtgtttggttttttttttttttttttttttttgttggtggtacggagaagctttattcaggtcacgagcttattgtcgtaattcttacagaagctgagtgcgtgcacgcctagccaagtacgatgaccctgcacaatcttatacgcacataaggcacgcaggcaggcacgaacgggcgcggatggcggccgcccgggcggctcagttagccctggcgaggaagctctccttgcgctcgtggaactcgccggtgcaggtgttgaagtcctcctcgaccctggtctcgcgcaccacgacgccgtggccgccgtggtgaccgtggtggtggtggtggtgcgccggcgcgtgacaccgtgtcgacctcctcgaatttctccttgacgacgtgctgctggacgccgccgccgtagcggccgaagccgccggccggggccaccgacctcacctcctccgagcagtagtccacctcctggaagtaggccattggtgaatggtgatgcttggtgtttgttctagtgcctgtgcgcagtgcgttcaaccctcgtgccgaat

SEQ ID NO: 26335 - DNA, 776 bp, Triticum aestivum
  Clone ID: PAT_TA_26335
gaattcactaagtgattagcgtggtcgcggccgaggtgagagaactagtctcgagtttttttttttttttttcgagcattgaagtattatgccatttattatgcgtacttgttgtcgtgattcatacgttacacaatcttgtgagtacacaagattttacaaccagagtacacaaaagaaatataaggacggtgcttctcatccttttacatatcacatccttctgctaccaacaagagtacacaaaagaaatataaggacggtgcttctcatccttttacatattacatccttctgctaccaacatgagtttgtaccatgagagtacacttgtaatgagaaagagagagagagttccaagcagaacacgctataatcgaggttgatattccatgagaacacactgtgtgttcctcccacatccatcttgcttgtctcggatcatgagtgctccaaacaacaggacaattgtcgcaaaaaggaacagtggtgacaaccgcagcttctccgcccagctaggtgtgtatgtcaccgcgacataagaaaggaaaacaagatagacgcacgcgagggcgattgctgttttcatgcaccaaactgaaatgatctcggagatatctcccagtctccaggccgccgccggcttcaacttcccttgtcccgcgccaccggaagtccggcagcctttcatcagcaaaggttccatctctttttcgtgttcttcggggaggtgcagaggaatggtctgtgaatgatccgtaggaagaagagccagg

SEQ ID NO: 26336 - DNA, 684 bp, Triticum aestivum
  Clone ID: PAT_TA_26336
tttcccacacttactcaactatgcaggagcccccaatggcatgtggttgcacacggagtttctagcatgaataatcttatgatccctttgagcttggtggcagtcccttaggagatcactccgggccccgggatttccaaaaataaaacggacaacactgggttccccaggtgccgcaatccacccagatgtgtattaaagttgccaccttaagttgaccattaattaacaagctcacatctgtcatggattcactcaaacccaaaccacgtctacgagcatagcatagcaatataagcaacgtaatagtaactcccaaggtttggatgcagggcaataggttcctacctcatcaactacttcccaatacccacatgttatcaatcctacccatgcaatgtttgagggtgaaactaatgcataaaaactgggtatgaaagggatatgatcaaagtgtgaacttgccttgtacagttgatgaagatgattcgcactcaaaactcttcatagttctactcgtcacactccggtcaatctatcgtaagcaagcaatagtaaccacacataagcaatcactcaaaagatcggaaagaacgaagaatacgattcggaaaacaacaaaaccaagcaaataactcttgcaacatagaacaatttctaacagtaccaaaattgggtgaattt

SEQ ID NO: 26337 - DNA, 519 bp, Triticum aestivum
  Clone ID: PAT_TA_26337
acgaactagccatattatttcataagtgggttgcactggccaggttcccatctcacacacaatcaaatcacattcataatcaaatattccaaacaagagaacatgtgaaactcgtcaaatgacactagattagtgtactacaatttctgtagactattacaacctaggtataccagctattacaatattacagtcaaatagaacagacaactctttgctgagtagcacttcacggcttcacgcttttcttcacgtcttcgcacttccaactttcttaggcctggagctccggagaggaggttgtagtcgaagccgcacacaggcgccgccaccaccgtcaccctctagaggagacgctgccgcttcatcgacggactcatctccagaatcctttatattccagattgttttaacgccgccaaaacagaaacgccgctgatatcatcgtccagaatttttcatgcccagaattttttttggaaggatcagtctgcaaacataaatcagggcatgcccatt

SEQ ID NO: 26338 - DNA, 902 bp, Triticum aestivum
  Clone ID: PAT_TA_26338
acacgtcaggctgccgctgctggtgcgggcggttcgacgagctgccacggcggcaaagcggtagggaggagcggcggcggccgggcgaggccgatggtgaaggccgtgttcgtgttcgggagctcgctggtggacaacggcaacaacaacttcctcaacagcaccggcgtgcgcgccgactacctgccctacggcgtcgacttcccgctcggcccctccggccgcttctccaacggccgcaacaccatcgacgcgctcggggagcttctccgcctcccccgcggcggccgcatcccgccgttcgccgacccgggcaccaggggccgcgccgcgctgcacggcgtcaacttcgcgtccggcggctctggcatcctcgaccgtaccggccaggacaccggcaaggtgttgagcctgaaccagcaaatcagcaacttcgaggcagtgactctccccgaccttcgggcaacggcagccaacattcgcgggatgaagggccatgatttcttgcacgattgcttcctgcccaagagcctattcgtgatcggtacaggcggcaacgactacctgctcaactactaccagcccagaaatacagccaggccccaattgtcagacttcacacgctcactcatcaccgagctctcggcccatcttcagaggctgtatgctctgggggcgaggaagtttgtgatcttctccatccagcccatggggtgcaccccggtggtgagggcgtccctcaacgtcaccggcgcgggctgcgtcgagccggtgaacggcgcggcgctcctcttcaacggcgagctcaggtcgctcgtcgacgccgcgggaccgcgcatgcccggcgcgagcttctccgtcgtcgactcctacaagatcatcaaggacctgctagaccaccc

SEQ ID NO: 26339 - DNA, 659 bp, Triticum aestivum
  Clone ID: PAT_TA_26339
gccgctttcggtttttgcaattcgtgggtacaaaaataccatgatttgtccatcatctcctcctagaatagcaaagacactactctgagattctcgcgaacaaaatttctattactgtattacaatagcactacgttttccccggcgaacaaaatttctattactgtattacaatagctctacgctgagattcaggaacagagatggtctgtttatttgacacaagattaagccttcaaattcataatgcaaactgcatatgcaggggttgggcaaatctggggccggtcgagacagctgctttattctttcagtgatgatggctgtccagaagaaagcctatccgacctcgccttgttagctcgctccacgtaatcttgatgggagtcatgctttgcccctcgggtcatgaagtaccagggcaccccgaaaatggcggcgaagatggcgatgcctgcgactacgtgcttcttctcgccgctgtacaggtagtggtctatccgggcgcggaaccccccgccgctggaactggcgccctcgcctcccatcaccgccgccgccgccgccgcctgtgtgctgtggcgtgggaagttggtgcgtgcgtgcgactgcgaggggacgaaggattctctaacttggcagagccaagtcacagatat

SEQ ID NO: 26340 - DNA, 1546 bp, Triticum aestivum
  Clone ID: PAT_TA_26340
gcacgaggagcatcccaatccaatggctgggctgatgaatttcaaacacagcataatgctaatgcaaattcttgggcagatcagtttgtgcatgaagagctttcacaaggggccgataattgggttagtgagttctctagtgaacagaatcagagtgggctcaaagagaagtgtcgatgagttctccaaattgaatatggatgattgggcagaggagttcagtggaggagcttttggtgagagctctgctgatccatgggcagatgagtttcaaaaccaactgtcagcttccaaaagttctggcgcttctcgaggggtttatgttttttccgagatgaacccatatgttggtcaccctaatccaatgcaggaagggcaggagctctttcggaagggcctcttaagtgaagctgctcttgctctggaggctgaagttttaaagaaccctgataatgctgaaggttggaggttgcttggagtaacacatgctgaaaatgatgatgaccagcaggccatagctgcaatgctgcgtgcccaggaggccaatcctaccaacttggaagttcttcttgctcttggtgtcagtcacacaaacgagttggaacagggagaagcattaagatatctttcgagatggcttcagaatcatccaaagtatggagctctcgccgctccccaccaaactgattcaccatatggtccagatgttggtagattgtttaatgaagctgctcagatgtcgcctgaggatgctgatgtccacatagttctgggtgtcttgtacaacttatcaagagaatatgataaagctatagcttcatttaagacggcactacagctgaaaccacaagactattctctctggaacaagctcggtgcgacccaagcaaacagcatccagagtgctgatgccgtactggcataccagcaggctctagatttgaagcccaactacgtccgtgcatgggctaatatgggaattagctatgccaaccagggtctgtacgaggattccattcggtactatgtaagggcggtttccatgaatccaaaagcagacaatgcctggcagtacttgagaatttcacttggtaacgcttcacgcagtgatatgattgctgcatgtgattcccgcaaccttgatgtccttcagaaagagtttcccctctgagtccaaacattctagacattaggaggtctccaccatgaaagggtagaaggaaactagcaaaatgggatggtttccgtggctgcatattctggaatgcgaaggagaaacaaacacaaattggcggtcattgtgttactgtatttttctgtttactgtaagctaattgatctctgtttgccgagatgtcgaatgtatagaaagccagattaccagccaatttgtagatgtaaaatcccatggcagaaacaatgattgcaaccgggggatagaacatgtaattctgtatacaaggaggtacaaatgaataaaaaggcggtcgttgaatggaacatgtttttcagttcttgtgccgcacaataagataatggttattgc

SEQ ID NO: 26341 - DNA, 563 bp, Triticum aestivum
  Clone ID: PAT_TA_26341
ctgccagaaacgcctgggcggaggaaaataggcgcggaacacgcgaggatggatgctgtataaaccatgagttggagaaaaaaaatgattcttcagtttgagaaccggcgccgagagagagagggagagccgagaagaggaaggccgggatatttattatattaattaaagaaaaaaaagggcaagttagttaggtggtgccacagaatgcaattgctcccttcatcatcatcatcatcatcataatgtgatcagagctgagacctgatcgatggcaaatattagtacgtagatcagtactcctgcttacacaagtccagtaatgagatgcctcggttgcttcgcttcaaaaaaaacaaacaacaaaaaaaaaaaaaaagatgaaaaaaaggtaaaaaagttacaaaaaggaataatagaaaaatgtaaaataaagccacaataatcattcaaaatagacggttcagctagcatgaatgcttcagtcgattatagataccttggagacctagcacacaatcaggtattacagatacgacggtaacgtatcagcatccccaaag

SEQ ID NO: 26342 - DNA, 1134 bp, Triticum aestivum
  unsure (1)..(1134): unsure at all n locations
  Clone ID: PAT_TA_26342
gcaccagctccgctcccacgcgcgcctcgttcagctgctcgcccgcgacgacgtccccgtcgccgccgccttccgccgcgcgcgcctccgcaaggaccccaacgcccacttcctcctcgccgtcaatctccaggtccccggccggccggacgcctacagctcggtcttctacttcgcggcggaggcgcccatcccgccggactccctgctcgggcgcttcgtccacggcgacgacgcctaccgcaacgcccgcgttcagctcggcaaccgcctcctcgggggtccctggcgcgtccccgccaccggcggcgactacggggagtgccttctgcgccgcgcgctcacgtcccgttgagacagggtcggcgacgaactcgagatcgacgtggacatcggcagctcggcgatcgccactgccgtcctgcttctggcgctgggcgcggtcacctcggtgaccatcgacatgggcttccttgtcgagtcccagtccgaggaggagctgcccgaaaagcgcttcggcgcggtgcgcatcgcacagatggagatgggttcggccaagtacgttgagacggcgtctgatgagcccgagaccgacggcaaggtagcaccggcggtcgatgttggatagacgaggggggcgaaaaaaagacgccaccggtattgaacctgcgactagaagaaaaaaacgaggcgaggtcgggaattggttgccacagaatgcaatgcatgctccattcatcatcatcatcatcatcatcataatgtgatcagaactgagacctgatcgatggcaaatattagtacttagatcagtactcctgcttacacaagtccagtaatgagatgcctcggttgcttcgcttctgctgttaggttatgccgccatagaatgcaatgcacgctcccttcatcatcttcatcatcatcactaatgtgatcagagctgagacctgatcgatggcaaatattactagtagatcagtactcctgcttacattgttggtcagtccggtaatgagatagatgcctcggctgcttccgcttcgatcatttacatctctggaaagcctcacgtttccttttttccccttccgtgccgccgccgtcnaaaaaanaaaaggnttgaaaaaaaaa

SEQ ID NO: 26343 - DNA, 631 bp, Triticum aestivum
  unsure (1)..(631): unsure at all n locations
  Clone ID: PAT_TA_26343
ggnacgaagctgaacagncggaggtggactgcgagtcgctcaagcgctgctgcgagacgctgaccgaggagaaccgccggctgcagcgggaggtgcaggagctgcgcgcgctcaagctgctcgccccgccggcgccgcacctctacatgcgcgcgccgccgcccaccacgctcaccatgtgcccctcctgcgagcgcgtcgcgccctccggcaagccggccgtcgacgagagccgcgccgccatggtgacccgggccgtgccgaccgggccgtggggccccgtcccggtgatgcccgtgttcctgggcaggccggcccagaggtcatgatgaactaattggtgtgtcatgtcatgcgttagtgagttgggagcttaccatccagtggccctacttgatggagtatctataggaagaacaggcatagtaactaggatagctggcgaaagagaggaagtaactagggataggatcctgttttcttttgtttataagtaagtacatgcatgtttagtttgaacttagaaacttttggtgttccgtttgttcacccaacaagtagttgtcctgtgtacaagtgatgcaatgggttttagtacttctgcatacaaattaaggtgttgtcttgttgt

SEQ ID NO: 26344 - DNA, 558 bp, Triticum aestivum
  unsure (1)..(558): unsure at all n locations
  Clone ID: PAT_TA_26344
cccggngtcgaccccacgcgtccgtggnaacctacgcgcgccggnacgagggagcgcgtctgccgccggcgggctgcgccgtgcggccggcccgaatcccatcagtagctggatagggcttcccaccaacccgtggcaagtcctcaacggagcaggccgcacccgattccgccgtcggaggggctcgatctcgccggtggaccgcctcttccacaacaaggtgcgcagccgccagtccaagcgcgcctccagatccagttcatggcgcacgaactacgaggctggccgacgacagcgactccggccgagaggtgcagatatttccaagagttgtcaaccagtcttcatctgcaagagagcgacagcagtaggtggagtccattggctcagtcttgcaccgcatggggagaagaaacttgagcgcaaaattcggtttctgcgcaagctctgttttccttctcagcaacaggctctgtaagggactggtacacagaggatggacctagtatgttgtaatcacttttgcaccatccttctctggcttaaatttgctgaagg

SEQ ID NO: 26345 - DNA, 831 bp, Triticum aestivum
  Clone ID: PAT_TA_26345
aaacgttgtaaattgattctattgtggatgaactaggtcccatgctagcatcttatggatttaatcatcatggaaccgaggtcctgtacagtgggctttttggcaccgagctgcaatttgagattttcattggacctgtttactaccaacgccttcgtcatatggtctcagacaaatttcaggttcgcaccacaggtcgtatagaccaagtaacgaaacagccaataggaggaaggaaacacggcggagggattcggtttggtgagatggagcgtgacgcgctccttgctcacggcgcttcatatctcttgcacgacaggctccatacctgctcggactatcacgtagcggacgtgtgctccctttgcggaagcctcctgtcggcgacggtaataaagtcggacacgcagaagaaatccaaacgccacttgctgggtgtcaacacggtgaggcctgcaaagaacttcgcgtgccaggcctgccagacaaacaaagggatggagacggtggcgatgccgtacgtcttcaggtatctggcggccgagctggcggctatgaacataaagctggatctccggctcagcaacaggagagaagctcctcccagcaacgaatcttgctagcaggaacaaggaaaggagaagcatatgcaggacattctttgttaagtggaaaaagagtatctatctcgtcccatttttggatcttgcttagagggggagattttgcgtgttgtattgttgtacaaaaaaaacatccaatggataatttgaagtatacattccttgctttgtactccgtatctgacatggttagttattactcagtatc

SEQ ID NO: 26346 - DNA, 1463 bp, Triticum aestivum
  Clone ID: PAT_TA_26346
gcgcggccgcctccaccgccgccgccccgtctcgccggcctcgcatgtgcaggccttgacttggtggctgcctcggctgtagacatggccaaaagggagtttgttcacagttgtggcctgacattgatatgccgttctctgcaaataccggcatgaggccagatctctgccccagtcctcctgcgcctcctgcccgcttgccgggggcacggcctatggagtccattccagcaaaggctggaagtgtacatgggaagttcttccatagctgcagccttttgcaagctcagtcaaagaggacggtgaaaatcgttgtaaatatcattctattgtggatgaactaggtcccatgctagcatcttatggatttaatcatcatggaaccgaggtcctgtacagtgggctttttggcaccgagctgcaatttgagattttcattggacctgtttactaccaacgccttcgtcatatggtctcagacaaatttcaggttcgcaccacaggtcgtatagctgcaataacgaaacagccaataggaggaaggaaacacggcggagggattcggttcggtgagatggagcgtgacgcgctccttgctcacggcgcttcatatctcttgcacgacaggctccatacctgctcggactatcacgtagcggacgtgtgctccctttgcgggagtctcctgtcggcgacggtaataaattcggacacgcagaagaaatccaagcgccacatgctgggcctcaacacggtgaggcctcctgtgcactgcgcgtgccggcaccgagcttcaatttgagatttgcagtcggccgcgttgccgcccgccctctcgtcatatggtctcagacaaatttcaggttcgcaccacaggtcgtatagaccaagtaacgaaacagccaataggaggaaggaaacacggcggagggattcggttcggtgagatggagcgtgacgcgctccttgctcacggcgcttcatatctcttgcacgacaggctccaacctgctcggactatcactggcggcgtgtgctccctttgcggagtctccttcggcgacggtaataaattcggacacgcagaagaaatccaagcgccacatgctgggcctcaacacggtgaggcccgcgaagaactttgcgtgccaggcctgccagacaaacaaagggatggagacggtggcgatgccgtacgtcttcaggtatctggcggccgagctggcggctatgaacataaagttggatctacggctcagcaacaggagagaagctcctccgagcaacgaatcttgctagcaggaacaaggaaaggagaagcatatgcatctagccgtggcgtggcgcggtgcagaatattctgcttagttaagtggaaaaatagtatctatgtcgtcccatttttggatcttgtttagaggggcagattttgcgcgttgtattgtgtataaaaaaacatccaa

SEQ ID NO: 26347 - DNA, 1084 bp, Triticum aestivum
  Clone ID: PAT_TA_26347
cagcaaaggagaaaacaagagtgcagttggtgcttctgaacgcctcgttgctggtggtttggctggtgcaatagcacaaacagcaatttatcccatagatttagtaaagacgaggctgcagactttctcttgcgagagtggtaaagttcctagtcttggtacattatcaagggatatattgaagcatgaagggcctcgagcattctatagaggtcttgttccatctttgcttggtattgtcccttacgctggaattgatcttgctgtatacgagactttgaaagatgcctccaggacatatatcataaaggacaccgaacctggtcctctagtacaattgggttgtggcactgtctctggagctctgggagcaacatgtgtttaccctttacaggttattagaacaagactgcaagctcaacaagccaattcagaggctgcatataaaggaatgtctgatgtgttctggagaaccctacggcacgaaggcgtttctggattctacaaaggaatcctaccgaatctccttaaagtggtgcctgctgcaagtattacctatctagtttatgaggcgatgaagaaaaatctgtctcttgattaaattctggaattgttttgcaaatcggccattattattggcatggctgactgtagagataatgacgacacatgaatttactggttaaagagctcctttttttgacgcgaaagatggtgccttcaggatagaactgaaagctattgccctcctacttgttaaatgaaaacaaagagattatcatgagatctttgttttcatttaacaagtaggatagcaatagctttcagttctatcctgaaggcaccatctttcgcgtcaaaaaaaggagctctttaaccagaaaaatctgtctcttgattaaattctggaattgttttgcaaatcggccattattattggcatggctgactgtacagataatgacgacacatgaatttactggttaaagagctcctttttttgacagccttgatgatctcatgataatctctttgttttcatttaacaagtaggatagcaatagctttcagttctacctcgtgc

SEQ ID NO: 26348 - DNA, 685 bp, Triticum aestivum
  Clone ID: PAT_TA_26348
ccccgcgtccgcggccgcgtgggtttcggccaccgccgcccctttctccacaaaatcaacatcgccttgagtggggttccccgtgagacactgcggatgagaagcgcgctggtggtgcccctcccttgctgattaaccgccgcctctttctccagcaaatccacatcgcctccctgcccgttgccggaacgggatagggacgtggtggtgagggagagagggggattgactgggcggcgccacgtcgcagtgtttgaggtggctagatgagggcgggcagggtaaactcgtctcccgccatggaacagtccacggagccgtcgtcctgattccttggtccccgctgatgccaagcgagaagagaagctcggcttgtggcggcggcggcgggcatcactggagcgacgacgcagcaggtcggaggaggaagcactagactctactaaaaaattaggtgttcatagtcacataatgtttcatagttttgctacaaaactgtaacttatgaacttatgctcgctcaacgctcatacaaatctgttcatgcatgtgtgtctgttgaattaattaattacaagctagtggctgacaagcgtgtagatgcatgttatcagcaattcagcatcgatctatctgaataatgagctggaatattatctcggaataagagcactgtgagtttatt

SEQ ID NO: 26349 - DNA, 395 bp, Triticum aestivum
  Clone ID: PAT_TA_26349
caacaatcgccctccctccgagcgttccatgccgtcgtcgtccgcctcaccatccctccatggctcgccgcggcggcttcttcgggtatgacccgtatgactactactacccgacctcctacggctacgacgcctacccgtactatagccccgccgctgccgatcccttcttcctggacgcccagcctctcgtcacggagcggctgcgccccgcccgccggagggccccggcgcggcacgacggcggcttcttccctggcttcggcgccgccgagccggccgcgcggaccatggcgcgtcccaggcccagcagcgggtccccgaagagcagcccggactgctttgaggtggaggtcacgggccccgagcccgactcgccgcccgcgattccaaag

SEQ ID NO: 26350 - DNA, 1151 bp, Triticum aestivum
  Clone ID: PAT_TA_26350
gcgatccggtttctttgcatatttgaggagcaccatggagtcatctttcatattctgtgggagatggttgcgagctctgatacctatttaaaaaccagtgctgcagctttactgaaagcacttgtaccctatgttggcgtgaaagttgcatcgactcatgttttgccagcactcattactcttggttctgatcaaaactcggctgtaaaatatgctagtatagatgcattaggagctgttgctcagcatttcaaaagtgacatggttgttgacaagatacatattcaaatggatgcctttcttgaagatggatcacacgaagctactatttcggtcattcgtgcacttgcagtagctgtgccgcattcaacagatagactacgtgatgggcttttaaccaagatatttagacttacaagtgccccacctactgaaaatgatattgaacggcgtcgtgaaagagcaaatgtattctgtgaagcgctgcgtgctttggatgctacagatcttcctgctacaagtgtacgtgatctacttttgccctctatacagaacttgttaaaagatgtggatgctctagaccctgcacacaaggaggcactagaagttataggccgggaaaggtccggaggtacgctggagagcatcggcaaggcaatgggggcacaccttgggatcgcgacctctgtcagcagtttcttcggcgagagcagtctgcttgggaagaaagagggtggagagcagcacgaccctgctgctgcttctgttcctccccaggtgggcttacaaactcagcaggagaacacgaggtttggtcgcataatgaggggtggatttggagacatgttgcgaggcaaagcaaagggcggtgatgaacccagctgatattatcaacgttgtcaatcaatacaatattttccaagcttgatttcggtcgtcacagcatgaataagttaatgtagaacaacatgtttgttcattgtttgtacttcgtagtgagatggtatccatgaggatgctgcgctttccctagctaagcgatccaaaactaacgaggtgtaatctcagaccaaacatgttatatacgtacatgaaggtagcaagtggacagtttctgggtcgacaaaaaaaaaaaaaaaaaaaaaaaaaaa

SEQ ID NO: 26351 - DNA, 524 bp, Triticum aestivum
  Clone ID: PAT_TA_26351
ctctccgcggctcccaactcctgaccaccccgcacccctccggctttcacgcgagtcggcgtccccgttcaaccggaccgggtggccttgcgttccaacccattcgggcgtccgcccacgcgtccgcggacgcgtggttccaaaccagcccttggacgccccttgtgacagcaacagcatgcctaagataaagacaagccgcgtcgaatatcctgaaggatgggtgcttattgaacccacaatccgtgagctggatgccaaaatgagagaagctgaaaacgatacacatgacgggaagaggaagtgtgaagcactctggccaattttccgcatttctcatcaaagaagccgttacatttatgatcttttctataaaaggaaggaaatatcaaaggagctgtatgagttctgcctggaccagggttatgcagaccgtaatctgattgcaaagtggaaaaagccgggttacgagcgcctctgctgcctccgctgcatccagacccgagaccacaactttgcgacga

SEQ ID NO: 26352 - DNA, 836 bp, Triticum aestivum
  Clone ID: PAT_TA_26352
cgtccgtccgactcagcgccgccgccgtcgcgtaaccactgccccgccggcgcccccacgcctcccccggggttcccaaccccgtcgcccccccgcccctcccgcttttcacccgagcgccggccacccccgtccccgctccgccgcactgcgtcgcccttccgtccgaccctccgtccgcgatttcggccatcatttccgtcgtgacagcattcctaacgagccgtcggacagcgactgcgaccctaagggaaagatacttaacgaaccctctatccgagagctggaggtcaatgtgagagcaacccaaaacgacactgatgacgggaagagaaagtgagaagcactctggccaattttccgcatttctcatcaaagaagccgttacatttatgatcttttctataaaaggaaggagatatcaaaggagctgtatgagttctgcctggaccagggttatgcagaccgtaatctgattgcaaagtggaaaaagccgggttacgagcgcctctgctgcctcagctgcatccagacccgagaccacaacttttcgacgacgtgcgtgtgccgggtccccaagcatctgagggaggagcaggtgatcgaatgcgtccactgtggctgcaagggatgtgcccgcggcgattaactgactagttatgtgtattcatcatgtgtcgccgaatccatggtggctctaagccaagcactctagatgtttcttaagcgtgttctctggtaaagaacagatcgtcctgtaatgtcagctcgtgacctggcactttctcctacctcttgatgtgtgcgtgcaacctcttatccagtttcccgacaga

SEQ ID NO: 26353 - DNA, 874 bp, Triticum aestivum
  Clone ID: PAT_TA_26353
cgtgttcgacaagccagtctacgacgacgatatctttgacggggtccccggtgtgaagagctcctcggtgcgctacgacgacgtctttgcgggcaaccacgcgccggcccctgcagacgacgacctgctcgctggtttcggaaccaagtcagtggctagggaggtgccggaagataagtggaagcccgggccagcagccgcctcagcggggtttgatgatttgtttgcggggattggcaggagcagcccggtgaagcaaaggcaaactgctggtgccgaagaaaagagggtgcctacatctcagccagctagcatggcaagcgacccttttgtttcttttgaaacaacttctacttcagcccgtcaatcctctgggatattctcggatcccttggatgaattgggtaggcattcaaaatctcaagtaaaaactgctgctgacagtggtctatttgaggattctagcgcattcaatcaggtccccaaatcagaacctttgtttaccacaaatttgagtgatgactctaaaggtagcaacggatcaaccaaggtccgagactcgagccctgtgcaaaattttccgaaaagaaagtcagcccaacaaccttctgtggaggacttcgaaaatatttttccacagtcacagtctgccaaatattctgatgttcatgttgatagtggtgctccaggttccgagaaatacagtgggaatggtatggatgaccggtcaccaagatcagatgagtctgaggatgagatatggcttacagtttctgagattcccctcttcacacagccaacgagtgccccaccaccttcaagaccaccaccatctcttgcaattaagcaaaaaccgcatggatcaagagcaaaa

SEQ ID NO: 26354 - DNA, 572 bp, Triticum aestivum
  Clone ID: PAT_TA_26354
gcccgccgccgctctccgcgctcccgcgctgggtggtgccgcaatggacggcggctccggctcctccttccaggccgtagcggcggccgccgccatggagatggaggagtacctcaactggaagaagaacgcgccggtgctctacgacctcgtcatgggccaccggagctgcttttcgtccacggcgggcacacggccaagatctcggagctgtcgtggaaccccagcgagaagtgggtggtggccagcgtggcggaggacaacgtgctgcagatctgggagatggccgagagcatatacagcgacgacaacagcaacaacgccaacagcgcctcgtgcctgtccacataagaagacgccgccaaccaacttcttccctgatgtgtggacgatggccgatggggacatggctcgttcgtagtctttgggtggacgagtcgcgtgcggtttacttgtagtgcctcgtgcggtttcgtcgcttaattagcagctgctgctatcgtttggcgcctagatcctgtagacatggatggatggagaagtgactctggaatatttgtacgtccttgccg

SEQ ID NO: 26355 - DNA, 471 bp, Triticum aestivum
  Clone ID: PAT_TA_26355
aaaaccatccatatatgatttactacccaccttagtggtggccgttggttgggcgatcggacggcgatgtcccgtcggtcctggcagcggtggtggccatgacgaccgagtacaagagctgccctgcctgcctctccacctcttccctcaccggcgtgcgcgcttcgccgccatcagccgcacttcatcgtcccccacgcccgccggcggtggtgtcttttccttttcctttgcctttgcctcctccgacgccctgtccgcggccatctggggcaggcccaggctctgcgtcagcgacggcattggcagcgggtcatcgacagcagcactacccgctccatgcacggcggccggcggcgtcccgttcatcaccacgacctgttcctgctgttgcgtcttggctctcgcggccgatccggacgacgacgaggaggaggcggcggcacgcgcggcggcggcggcggccatggc

SEQ ID NO: 26356 - DNA, 455 bp, Triticum aestivum
  Clone ID: PAT_TA_26356
tgctcatgtacctgtccgacgtcaagatgggcgacgagaccgtcttcccctccccccacgccgagtcgttgcagcccaaagacgacacatggtcagagtgtgcacgaagtgggtacgcagtgaaacctgtgaagggcgtcgcggtgctcttcttcagcctgcaccccaacgggacgacggacccggacagcctgcacgggagctgccccgtgatcgacggcgagaagtggtcggcgaccaagtggatccacgtccgacccttcgacagccgccctcgcgtgccgtccaccgccggatgcggggacgagaacgatctctgccctcggtgggctgccaatggcgagtgcgccaagaaccctcgctacatggtcggaacccccggcaaccccggcttctgccggaagagctgcaacgcgtgcaccggtacactgtagatttggaaattgtaatggcag

SEQ ID NO: 26357 - DNA, 641 bp, Triticum aestivum
  unsure (1)..(641): unsure at all n locations
  Clone ID: PAT_TA_26357
caccaggagagagagagagagagagagagagagagagagagagagagagagagagagagagagagagagagagagagagagagaggtctccagccagaagcgcgagcgcctctccagtcctcctcttgctcgtcgtcctcgccgccggggcaagcgcggcaccgctcaccatcacgaaccgtgccacttacggtgtggccggcggtggcgctcgtgctccaccaagggggcggcggcaccgagctccacccaggggccagcttggagcctcgacacgccggtgatcggctcccagtacatatgggggcgcacggggctgctccttcgaccgggccggcaaggggcggtgccagaccggcgactgcggtggcagcttcgctgacttgcgggggcaacccggcggtgccggtgacnattgcccaangtgtcccgtgcttccaagggcaaactttttccctacgggggtnacnttccacccttaaanggggntttnaacccttgcccaatgggacccttnaaagtggcaatttttccggggnaaaccccntcttcccncttttccccnnaaaaagggtntttgnttttcccnaaacnttttttttccccaacccccttttaccccaaaaaaaaaaatcttttca

SEQ ID NO: 26358 - DNA, 815 bp, Triticum aestivum
  Clone ID: PAT_TA_26358
cgtccgcgacgagtgaggctggatggactgcgtcgggaacgggataggcacgagcggaattcggcaaacccaaaaccgttatcgcctccgccattgactcttctctcgaatccaaagcgcacggcacaaaaatcttcccggtggtgatgccgcttgtggaatcgcctcaatggcgccggaaggccaccgatttcttctcttcatctagcttcaagctgaagcaggcagggcaatctgcaggggataatatagctgatgttgccggtaaggttggaacagtggtgaagagtcggtgggctatcttccaggatgctagacagcgaccgccacaaccaggagatactgtgcaggagcgcttcatctctgctgctgccaacactggagtgattctgaggaagggcatttcagagacaaaggagaaggtcgcggtgggaaaggttaaagttgaagaggctgccaaaaaaactgcggacaaaagcaaaactattttgaacaatattgaacgctggcagaagggagttgcgagcaatgatgtttttggtgttcctgttgaagccactgtacaacgggagcaatctggtaaagctgtgcctctgatactggtgaggtgtgcagaccacttggttatatcaggcttgagtaatgagtacttgttcaaatctgaaggcgacagaaaagttcttcagcaactagtttcactttacaaatgaggattcggcgcatctttgcctgatggtgttagccctattgatgtagctgcactgatcaagtgctaccttgccagcatccccgaaccgcttacacatttgctcttt

SEQ ID NO: 26359 - DNA, 1574 bp, Triticum aestivum
  Clone ID: PAT_TA_26359
gctggattgcgggcgggatagggattctcggcggcctagtcctctccctttccctccccatcaccttggtcttcctcctcgattcgatccgaacccatccgattcggaagagaggtggtgatgccgcttgtggaatcgcctcaatggcgccggaaggccaccgatttcttctcttcatctagcttcaagctgaagcaggcagggcaatctgcaggggataatatagctgatgttgccggtaaggttggaacagtggtgaagagtcggtgggctatcttccaggatgctagacagcgaccgccaccaccaggagatactgtgcaggagcgcttcatctctgctgctgccaacactggagtgattctgaggaagggcatttcagagacaaaggagaaggtcgcggtgggaaaggtcaaagttgaagaggctgccaaaaaaactgcggacaaaagcaaaactattttgaacaatattgaacgctggcagaagggagttgcgagcaatgacgtttttggtgttcctgttgaagccactgtacaacgggagcaatctggtaaagctgtgcctctgatactggtgaggtgtgcagaccacttggttatatcaggcttgagtaatgagtacttgttcaaatctgaaggcggcagaaaagttcttcagcaactagtttcactttacaatgaggattcgggtgcatctttgcctgatggtgttagccctattgatgtagctgcactgatcaagtgctaccttgccagcatccccgaaccgcttacaacatttgctctttatgatgagcttaaagatgcgagggttagcattgatgatcttaagaacatactgaagaagcttccaaatgtgaactacatgacactagaatttgttacagcattgctactaagagtaagccgtaaatcagcactcaacaagatggactctcgtacccttgctgtggagttcgcacctttgatcatatggcagcaaggggattctggaacagatttgcggaatcatctcagattcacactgaaaccacctccaaaaattgtggacacgacgacaagtaccactacatgggacttgctagatgaggatgatgtggatgcttcgtcgcaaatccccttggacgatggttcgcctccagactatggtgctattgaggtgatccagtgcttgattgagcatcacaatcccatattcacggatgcaaacgagactgtatggagatgacctgacctggccggctcctctttagatttctgtggtatttagctcgtgctatgtacaagttccaggtagtaggatggagtggagtgccgcgaataagtctagtctcggggacaagcattttggtccaaactttttttgtcttgttttgtgggagtaaaagtaggaactgtatatattaattgtccacatggcagagttgtcttgtgggatttgcctcgacatggctcgtcaataatgtaccatgattcttgtgctgtatgtcactacttgggttgtagacaaattgctggacgtggacgcatttgctaaattcacttcaggtaattaccaatctaaaaaaaaac

SEQ ID NO: 26360 - DNA, 742 bp, Triticum aestivum
  Clone ID: PAT_TA_26360
ttctaatgatgccaagttcctacagtacaagttgcaaaaaaggatagccaatatccaatttgactaaccttgggtacatcataacttttggcacctggaagtatggagtgaagtgaaggcggccacgcgcggccaggtgccgcccgtggtgagcgtgccgcccccgccgtgggtacatttttcctcggagaatttcattcacctcaaccatggtcaagatatccatttccatcttcgacggctcactacaacttcaaagcatacagcacgaacccttaatcatattgtctatgggtgtggttcatgggagaaccacatagcataatcagctagtcacagagatgtcacaatagctggattgttaaagagagctgcactaggtcttctggccttcgctgcgagtgagctcaactttgtgaatctggagctttttcactggcattaactgtttcacaagcaactgcagtaactgagttggtgtcagagttgacatctggaatttgatcaggcttctcctcctgcatctcgacatcatggctaccaggcagctcctccgcttctgcgtcagccatctcttcatcaccatcacctcctgcatactgtgttccattgggcactgcagcaggatgctctaccggcctttcaggctctacagcaacagaacctgtgttttctgtgatcacgcggccctctgaatttggcccatggagcagtaggggtaggggttcagtacacttagtta

SEQ ID NO: 26361 - DNA, 1737 bp, Triticum aestivum
  Clone ID: PAT_TA_26361
agtctccagctttcgcataccctgcgccaccaaatcactgttgggtcatctcgacccagctgcctgcctggtcccttcctggttgtcagttcctctcgggcattcaggctgccgcactcgccccctggggctccccctcggcctctcgcgggtcgctctgtcccacccgggggggccccagggctacagtggtagtggccttggccttgccatttgcaggaggtttgttacgcgcttggggcggcacgcctggctggtctgggtcggagccggccgtcgctgcgcgcccgcatccggcatgcgcgcgcggcggagcctgctgcgcccgcccccgtccgcggcgccggtcccctctcgcgtgcccttattcttgaagtagtccatgcgtgcacgcgatttactaatggagcaaaatgttgccctggatttagctcgacgagaggctgaaatggccatccgtgctcggaatgatttcctagctgttatgaatcatgaaatgcgaacaccaatgaatgcaatcatagctctttcatccttgctcttggaaactgaactcacccctgagcagcgtttaatggtggaaacagtattgaaaagcagcaatcttctagcaacacttatcaatgatgtgttggatctttccaaacttgaggatcgcagccttgaactggagatcagagcattcaatcttcatgctgttttcaaagaggtgatgggtttcatcagaccaattgcagctatcaagaggctgtctatgtcggttatgttaacgccagatttaccattatgtgctattggcgacgaaaagaggctaatgcaaactatcctaaatatctccggtaatgctgttaagttcaccaaggagggccacattacacttctagcttccgttctcaagcctgattctttaagagagttcagaaccccagatttccatccagctgcaagtgatgaccatttctatttgaaggttcagctaaaggatacaggctgtggcattagtcctcaggatctaccccatgtattcacaaaatttgctcaaactcagcctggaggtaaccaaggatacagtggtagtggccttggccttgccatttgcaggaggtttgttactctgatgggagggcacatctggctggacagtgaaggagctggaagaggctgcacggctacattcatcatcaggctcggcgtatccgacaacaccgacgcatatcagcagcagctggcccctcttgcctggccaggcagtgcaaatgtcgaatctgccggtccgaaggcgcttcacgaggagacgtggccgccgtcttccctgaagcctcgttaccagagaagtgtatgagctagtgtaaactaccgacggcgccgcatcaagtagggagtcgtagctagttttgttccccctctaattttgtgcctagtgttgctgtagctggcatatattgtacaaataatgtgtatagcaaatgggacttcagattgcagttaagttcctgggtgcagcaccaactcgctgcgttcagtagcatatgcggtcagccaatttgcatatttcgggtgcgcgtgagcccggttatatcagagcgaagctactctccgtggaaaccatgtgtaaaagtttcgatgaattctatagtatgtatacagtggaggtgataatctgtagatctgtaaaaatgttctagatcaaactcatcttgttaggaagatatatagagaaaaataataatataggtg

SEQ ID NO: 26362 - DNA, 1901 bp, Triticum aestivum
  unsure (1)..(1901): unsure at all n locations
  Clone ID: PAT_TA_26362
ccccctccagccctatccccccgcgcagggcccgggctcccccctggccgcgggccaggtcccgtccgcccgcccgcgcgccgcccccgccgccggcgaagggcccgaggagggtgtccggctcgcggtcctcgtcgggctcctcccagcggaaggagtggctctaccgacagcgcgagcgctcgctctcccgctaccccaaggcgcaggtagaaagaaactcgtgctcccgggggttctcccctcccgccgcactttccagttcacctcgactatcacaaggtcgatcaccttcacccgccctcaaaaaagggtcaccatcaaggaaaggccgctcatcatctcccccaccgaagaaagcttcacctcctaggaaagcatctcctcctcctcagtcggttgtactacatgttgatcatctatcccgaaatgtgaatgaggctcatttgaaggagatatttggaaattttggtgaagtggtgaatgtggagctatcaatggacaaatttgttaatctccctcgtgggtatggatacatcgagttcaagaagaggactgatgctgagaaggctcttctttacatggatggtgggcaaattgatggaaatgttgtcaagttgaagttcacactgccaccacgccaaagggcttcttcacctttaaagccacctcctcctccccccaaaagagatgctcctcagaatgataaagttgctattggtgctgaaaaggatgctccgcagcggcctgggggatcagcatctccacgaaagaagccaccttctcctccgcgaaagaggtctcctccaaacagaagggctgagtcaccccggcgtccacccaatccatctccaaggcgtcgtgctgagtctcctattcgtcgtcgaccagatctttcccctgttaggcgtggtgacagaagaccaggatctccaattagaagacgttctccttcacctagaaggcataggtcaccaatgcggaggggtcgtggcagcttatcaccacgcagacgctccccggggcctcctaggcgctcacctgggcctcccagacggcggtcaccaccaccaaggaggttgaggagccctccgagaaggccaccaccaccaccttcgcgccgtcacagccgctcccctcctcctcgccgccctcttcactcccgctccagatcaatttctcctcgtagcaagggccggggaccaccattggggcgtggaaggtcagaattcgtcctattctgcatcacccagtcctccaagaaagggacctagaagggtgtcaaggagccgcagccctagaaggcctccaagaggaaggagtggctctagcgacagcgggagcagcagctcttccccaaccccaaggcgcaggtagaaagaaactgggtgacgtgtgtgggttcctgggcaggtaaaaaactttctcttctctctcgactatcactatggattgcatctgcatgtgtcttgctgtgagctcaagtcaagaggtgttccatcctgaggggccggaccacgaggtgctccacatgcctgctggcattccgcttgtactcacaaagagatactgtttgaggacgacccgtgtgtttgatgatttgcctgtacggaagttacttttcnatttataattcctnacttgtttcnnccaaanaaaaaaaccnntcaagggggggggcccgtaccaattntccctanaggagcccattacnccccaaangctncttttaaactcctgacgggaaacctgggtnccaanttatncctngaaaaatccccttcncaannggggtatacnaaaaggcncacgntgccttcaaaattccacctaatgnaatggaacccctttnggcattacccgggttttggtnccaagtcctaanttaagcttaccccctt

SEQ ID NO: 26363 - DNA, 1080 bp, Triticum aestivum
  Clone ID: PAT_TA_26363
acgggagctccggaccgactgctcagcagtcggcccgaatgtcgggggctacacccagcgggtgcgctgacgcgcccccacgaaaaagaagacaaagtagtcgccggaagatccggcccgactgctcaacagtcggcccgaatctcgggggctacacccagcgggtgcgcttacgcgcgcccgcgaattttttttttctaaatttcatttatgtctattccattaaagccatctctcaaatatacttgagtcgacgccaagaaaggcttctatcaatgtatcatcagtatcaatcactacatgacaccacacaacagatatgctgctgtcagcagtcctctctaaatagacactgcaattatcgtataagtacatcattgctgctgtcagcagtgctctctaaatagacactgcaattatcatgtacatcattgctgctgcaatgaaccattaagaattatttaaaatctagcctaccatctgcgttgtcgtcaacagagggttgaggcggagttacaaaatctgtatgagaaaccgagggattgtccgagtcagcgacatctttgttatcttcagagctgtcagaagcagctgagatggcgtcacctgattctgaatgtgttctgtccacatatgcttcaggtaaggagctctcggccacgtcagcatcgccgttatgccgagcaatcagatcctctcttctgtagtaatgttgcatgaccctgttgcaggcccccccgggcagcagccgggctcatccggtgacgtcgcactctggtggtggggtggggctcgacctcagggatatctgggccccgtgatggaacgtgcggtgccatccctctgggtatgttccccggctatcgcgctctcaatctcgggggtccggtgaaagttcctgcactgcccccctcttgtggtcctcccccgtcgccctccgcccctggcccgggagtttaagtcgatggtctctgattcgctctcacttccatcatgtgacatctgacgaacatgatgagacgtgcttggcgcaccatcgactcgaatagtaccttggtgattggatgaaatagcggccgc

SEQ ID NO: 26364 - DNA, 1397 bp, Triticum aestivum
  unsure (1)..(1397): unsure at all n locations
  Clone ID: PAT_TA_26364
nnnnnnnnnnnnnntttttttttttttttttttttttttttttttgggaaacgttaatcacaccaacaattttatacacaaaaccatgccaagttcaagtatttaatacatttgccaaattactttactatatgctcctttaactacaacacttcccatttctgcacatctcttgtttactcaaattctcacagaacactgaaaatctaagtacaaaatacagttacggagatgaaaacatatgctcattattattgactataagatggtaatctcagccttgaatatacccgacaggggctgcaatcgccacttttgtataatggcaatcttggcattgaacttacccgctaggcgctgcaatggctatatcctcaatactacttttgtcgaacattatctctgtaggtttcaaacacccacgaatgaattcctgcccaagttgcgcccgctcattgtctccaaaaccaaacacgatacctttatttgtcactgcaacagtatggtatagtccagtgcttatctgagagacataatgaccagacaggctgtcgagaacgcgaggctgcatcactttgtcagatgatccgcggtcaggaaaccctaaactcccaaagcccatccatccaaatgcaaaaactgagccttcatcagtgagaacaaaggtctttctctttcttgcgcatacctgtacaccaacttgacccttcaggccggcaatcaattctgggctagttttatcattttcatcaccatgacctaatgctccacagtagcctctaccccatgtatagacatatcccagcgcatcaagagctacagcatgctcatctccagcggatacacggacaacaagaatgttcctcctcttaaatgattggattgcacgtggaagaagttcattgtgctgatccccatgtccaagacagaagttagtacaagacccaaaagaataaactgtcccatcatcagtcacagcaaatgtatagcttgcaccagctgcaacctgcaccactggactgggacctttgaataattcaacaatctttggagcagccctgtctgtagtgtcaccatgaccaagctggccatgtgtgttacttccacatgtatacactagccccttccttgtaagtatcacagtgaaacttagaccagtagcaacctgcttgcaggaaattcctttaagggctagtatttgggttggccgaaatatggttcgccccacatccccatgaccgcagcaagctgatgaattatctccacaggtgaacacctccccagactctgtaacgaaagcagcatggttgtgaaaggcggatatattaacaacacgggcaagcgacgggaaggaaacccgactgaatgccacacactgtgtagtatcaggaccatgt

SEQ ID NO: 26365 - DNA, 1008 bp, Triticum aestivum
  Clone ID: PAT_TA_26365
ccgttccccacggacggtctgatgttctctttccgcccggtaggtcaacgtgccgcccggagacctccgcgccacattgcaccctttcggttaagggcctcccttccttgctgcggctgcctttcccccgcccgccccctcccctgactagggttgtccacggccccactcccctgggccccaccatccttcgatccccccccagcgcgactcggcgggtatgggacttcgcccatctccccggcatgccacggacctgggggcgtgcagccatacccacctctattttcgcccaacggtgctgtttctaatgcccccccccggacgctccactgaatctcaacgatcagctgagggcaattccgcaaaccagggagtataaggcagaccccttcattccttcagtgcagataacagtcactttccgattatctatgtcatacgacaatgtcatgttcttctcgtcagtaagaaagatcatgttgcaatccggatgaactgcaaacatcgcataagaatctccatcttcgcgctgattccttccgaacagctccaaaacattaatagtgtgttgtagggtccactttccagtaccataatcctcaaggacccaaatatagagttggcagtcatgagaattatctatcttccatgcatacaagcgtccttgagactgcccaacatcacagatttttgacgagtcgcctggcattgtaatgaccctccaaactttcccctcagcatcgactgtggctattttatgaccaatgctacgcaaatggatagtgccattcaggaaggcctgggtgtacctgctatgaataatggtaggatccggtgaccacccactctgcagatgagtccaccgtccagtttccgacgagtagattgccacttgcgcagaaccgtcgacactaaacgtattgggccggggcgcaaacaccacaaagcgggatggaacagcagcgtcgaagcctaggaaagggattggatcgccgtctggatatc

SEQ ID NO: 26366 - DNA, 764 bp, Triticum aestivum
  Clone ID: PAT_TA_26366
aggggcctttttttttttttttttactccgaagtagtacaacaacagtggattgccatttattcatcaatatactaggagtagtatgtatacagagcgccaaactcccaaaagcatacacaagtactacaaaactagtaatacatcacagcacaacgggcggccaagattgatcgatcagaattcagaagcgacgcgccagcctccagaaccacgccacaatcccattctcattgtcctcgtcgtctgaatccgagtcgctgtcggtgtccgagtcctcgccgggccgctcctgttccggcccgtgctcctccccctcgctcttcaacgctggatggccctggccgccgaaggacggcgactcgtcggagaccgccacgtcgtctccgccgccgcaccggatgatctgggggcgctggcgggccgggtgaaccaccatctcctcctcctctgttatcatggagtggactttggtcgggttggccgcctcggcagccgccaactgcttggccagaagcggctcggcggtggccaggaggtcaacggcttcgggtaccacctgcgtcggaagctcgacggggaggcgcgccgggacagagccgacgaggaggcagcagacgagcacgaagagggcagcggcggcgccggtgcgcgccatgggtgttgctcgtggtggcgcgtggtcagtgtggtgatggaatggaagcgtggaagagggaataagatgggctgggagctatgcagaagagtcgcaacccggccggc

SEQ ID NO: 26367 - DNA, 883 bp, Triticum aestivum
  unsure (1)..(883): unsure at all n locations
  Clone ID: PAT_TA_26367
ntgcatctcccaaatgnggtgttttttttttttttctacaacaacagtggattgccatttattcatcaatatactaggagtagtatgtatacagagcgccaaactcccaaaagcatacacaagtactacaaaactagtaatacatcacagcacaacgggcggccaagattgatcgatcagatttcagattcgacaataacaccggattgccatttattcatctactattatgtacagagcgccaaactcgcaaaagcatacacaaatacagaactagtagtatatcacagcacaatgagcggccaagattgatcgatcagaagcgacgcgccagcctccagaaccacgccacgatcccgtcctcactgtcctcgtcgtctgaatccgagtcgctatcggtgtccgagaaagagtcctcgccgggccgctcctgttccggcccgtgctcctccagcatctcgctcttcaacgctggatggccctggccgccgaaggccagcgactcgtcggagaccgccacgtcgtcgccgccgcaccggatgatctgggggggctggcgggccgggtgaacctccatctcctcctccgctgttatggagtggactttggtcgggtcggccgcctcggcagccgccaactgcttggccagaagcggctcggcggcggccacgcggtcaacggcgacgggtactacttgcgtcggaagctcgacggggcggcgcgccgggacagagcccacgaggaggcagcagacgagcacgaagagggcagcggcgccgccggtgcgcgccatcggtgttgctcgtggtggcgcgtgatcagcgtggtggtggaatggaagcgtgcaagggaataagctgggctgggggctatgcaaaagagt

SEQ ID NO: 26368 - DNA, 1243 bp, Triticum aestivum
  Clone ID: PAT_TA_26368
cccgctcacatccgtcaccgtgtgtgaatttggtgtatccgtctgtctactgcatactctgcatgtgtttgcttaccttacggtaaataagtatcaccagtgtgagaacggcgtttcggtgcccgggtgccccatctacccaccaatggcgctcgtatgcagtcggccagcctccctcctactcatcgcggctcttctctccgccgcaaccttccttgccgtcccggccgcggccacggggaagaccggccaggtggccgtgttctggggtaggaacaagaacgaggggtccctccgggaggcctgcgacaccggcacctacaccatcgccatcatctccttcctcgacgtcttcggccgcggcaactaccacctcgacctgtctggccacgacgtctccgccgtcggcgccgacatcaagcactgccagtccaagaacatactcgtcttcctctccatcgggggcttcggcaaccagtactccctgcccaccgcccagtccgcggcggacgtcgccgactacatctggaacgcctacatgctcggcacccgcaagggcgtctaccgcccgttcggcgacgccttcgtcgatggcatcgacttcttcatcgagaacggcgcgccggccaactacgacgagctggccaagcggctctggaacttcaacaaggacttccgcggcaggacgccggtgcagctgacggccacgccgcggtgcggctacccggaccggcacgtggagtgggcgctcgccacggggctcgtcggacgcatcttcgtcaggttctacgacgacgccgactgcgccgccaactggcagcgacagtgggacaagtggacggcggcgtacccgtcggcgcagatctacctcgggctgccggcgtcggagcagaaggtcggttacgttcacccaaagaacctctactacagcgtcatacaggtggcgcagaaggcggccaactacggcggcgtcatggtgtgggaacgctacgaggacaagcggaccaactatagcagctacgctatccaatgggcttgagcctccgtcgctcacatcgtcaccgtgtgtgaatttggtgtatccgtctgtgtactgcatactcctctgcatgtgtttgcttaccttacggtaaataagtatcaccagtgtgcagttgtgtgctttatacaataataaagtgagacctctgtgaaggtttggattaaaaaaaaaactggagactagttcctcgtgccgaattcg

SEQ ID NO: 26369 - DNA, 535 bp, Triticum aestivum
  Clone ID: PAT_TA_26369
ccggccgggccgggaatcgtcccagaccgtctctgtttctcacctcatggccagatctgcggcgctgctgctgctgctgctcgctcttctcctggtctgctcgggggccgcgtcggcagccgccgcggcgggcagaatcaagagcaaggctgctgctcggtcagcgagggcggaggcggaggcggggtgccgggatctggcgacgcgcggcaagtgcgtggcgagcggcggcgggggcaggtgccggtggtgccgcagcgaggcgctcgacgacatgtgcttcggcgcagcggaggcgtggcggctcccgaagcaggtcttctcctgcgaccagcccgccggcgccgcgcacgccaggagatagcgtcgacgccgatgccttccccgggatgggagggatcgttgtactattctactcgctggttgtgagatttaccgagtgttcgcgcattgtactgtcgtgttactcatcaactcatgtatacgtaattggttttatcgaaacgaggctgatcgcggccgaatttattagctg

SEQ ID NO: 26370 - DNA, 646 bp, Triticum aestivum
  unsure (1)..(646): unsure at all n locations
  Clone ID: PAT_TA_26370
gcgtttcgaatttcagactcccctctgactgatacggtgatacccaatcgtcccagagacccanaccgtctctgtttctcacctcatggccagatctgcggcgctgctgctgctgcttctcgctcttctcctggcgtgctcgggggccgcgacggcagccgccgcggcgggcagaatcaagagcaaggctgctgctcggtcagcgagggcggaggcggaggcggggtgccgggatctggcgacgcgcggcaagtgtgtggcgagcggcggcgggggcaggtgccggtggtgccgcagcgacgcgctcgacgacatgtgcttcggcgcagcggaggcgtggcggctcccgaagcaggtcttctcctgcgaccagcccgccggcgccgcgcacgccaggagatagcgccggcgccgctgctctgctttcgacgccttcccctggttgggaggggtcgttgtattctactcgctggatgtgggatttaccgagtgttcggtgttcgtgcgttgtactgtcgtgttactcatgtatacgtacttgattttatcgaaacggggctgatcgcggccgaatttattatacgtacttgattttatcgaaacggggctgatcgcggccgaatttattaaaaaaaaaaaaaaaaaa

SEQ ID NO: 26371 - DNA, 508 bp, Triticum aestivum
  Clone ID: PAT_TA_26371
cggacgcgtgggcggacgcgtggggtgatggacaaggacagtgtcagcatggaggaggatgaaatgccacgaatagtggaacaaggacaagcagaggataaaatgccagaagctgtggaacaaacgcaagaagaggcagtagagcaacaaatgcggctgcggtggctgcaagacttgtttgtagcggcagacagataccatctgcagcgcctcaagttcatctgtgagaagcagttgtccgagcacatgtgtgtgagctcggtggtgtccactctccttctatccaagcagcaccactgcgacggactgaagcaggcgtgcctgaagtttatccaagttctatctcccttgcgtttgcagacactgatggcgactactggctgggggcatgtagccacgacctacccctctgttttgttcgagctcattgccatgcttgctgcaaaccagcggagataacactctgtatatggtacgcgtgttccttaatcaagtgacattgttttgc

SEQ ID NO: 26372 - DNA, 1420 bp, Triticum aestivum
  unsure (1)..(1420): unsure at all n locations
  Clone ID: PAT_TA_26372
gccggccgggtccgaatacccccacccactcatcagtcctctcttcctccttcaccccatcatgaaagaccagagcttaagagctcagcagctcgcagcaatggagccgcatgcccagtccaagcccatcccgctgatgacgccgtacaagatgggctcctcgctcgacctcgcccaccggggggtgctggcgccgctgacgcggcagcgctcctacggcaacatgcccgcagccgcacgccgccgtctactacggccagcgcgccacgcccggcggcatgctcatcgccgaggccacgggggtctccgacacggcgcaggggtacaccgacaccccgggccctccgggacggtcggagcacggcggcagcctcgcgccgcgtcgtcgacgcggtgcacgccgagggcgccctcttcttctgccagctctggcacgtcgggcgggtgtcccgctacggctgccagcccggcggcgccgcgccggggtccagcacccagacgatggccggcccgcaggttggccacgacggcaccaccgaggagttctcgccgccggtgaggctggccgctgcaggagatccccatgaaggtcgacgactgcgggaagcctgcacggaacgccatcaaggccggcttcgtcgcccatggagccccacggccacgacgagtaccccatcgagcagtgacaagagtggggggaacattgacaagcggtgtgactttgcgctcgacgcggtagatgttgtcgctacggaggtgggggggcggcgtgtgtgccaacggccctcgcccctcacccggttacatgtccgcctcccgcgcttcatcgcccaccctcgaccgccacgactccaccacccacgcgctcgacctcaacatggccaccaagctcaacgaccacaacatcctctacctccatatgatagagccccgtatggccctctgttgacggccggcgggaggtcccgcaccggctgctgccctacagagaggccttcaaagggcacctttatcagcggaatggcgggtatgaccgggaaacgagggggacagggcggtcggtctcgggggtaccccgacctcgtctcagtttgggcggctcttccattgcaaaccccagacctaccaaagcggctaagagctcaaccgcgccgcttgaacaagtacaataggttgacgttctacatctccgatcccgtcgtcggctacaccgactacccgtttcttccttgatgtatcattcaaccatgaataatgattggtccatatattgccatgtgaaattcaaatggaaccttttcttttcaaaaaaaaaaaaaaaaaaaaaatacaatgtggatggcgattgtcgaatttacgcaagtataaatatcgaaattcgaaatgttaaattttgaaagataattngaaaaaaaaaaaa

SEQ ID NO: 26373 - DNA, 475 bp, Triticum aestivum
  Clone ID: PAT_TA_26373
aaaaactgaccaattttgtttcgatatttacatctctttagtttaggaaggacagtgtcatggccatggcactcttaggactctttgacgatgacaactcaatcaaacaaacttattaaaccaagaaactcttaggaccctgttctgttgtggcttttgagtgctcttgcagtctcctagttgttgcattcctgatcatcatcttgctccgggtgtgcaaagtggagcttgaggcggccgtcctcccggcaggcgtggagcagctcccgcgacggtatcctcacctcccgcagcaccagccggccgcccccacgctgcgccctcaggtactgccacggcttcccggcggcgccgatcaccgatatgggcggcgggaacaccctcttgccgccccttgcctttgccggcgccggcgtctcctcttggtcgtcgtcagagtgcccctgctgctgagtcttgcagtcttcaatgtcgt

SEQ ID NO: 26374 - DNA, 1028 bp, Triticum aestivum
  unsure (1)..(1028): unsure at all n locations
  Clone ID: PAT_TA_26374
ggaccccttaaggctgccacgaggcgctngaatgcctgtgatcagtcttgaagtaggtggggctttctgcagatcccacttcaagtgctcgttggggagaaccatagccttgttgcgcaggtctcggagttggaggagcagctgggagctcttgagcagaagacctgtggcttgcagcgtgccagggatggcgcctcctgtaagtgaccactttgaattgaactcagcgtggtcctgccttttagtttgatgtgtctggatgggggtattgtaatttcttccatgtgtagcccccggggatgctgcagccctccgtcaagaattggatgaggcctccaggagctagagataatgttgtcctccaaatcacatttggaggctacccttcaacaggagcaggatgtatgtcgcgccctttgtaatgactcagaggagaataaggaccgtcggggtttgatccagcgtgatctggaggccacggagaagaaattgacgcagcagggtgacgtggcctgggtggccgaatagaagctccgctgccagagatccagaacgatgatgcggaggcctggatccaagacgtcgcggcggtggctgagaagatgaggaccgcccttaaggttgtcgttggtactttacaccgcgatggtctcctgctgaagtctaacattgagactgtcctggatctgctcggggaagtatcctgatcatccagaggactagatctactccacggcctttgaaggagctcgccaagtttgcgctggtgtgagggcgcatcatcctaacttgaacttgtggtctctggtgaggcctctgtcggggagtcctaatccgcagcaattcctcattgaagaggccaagtatgtcgcgggagtgtgtcccctacaaaacattattaagagacgccccaagcctgacagtcctacatagtagagtttgtatgcaagattatgatgtactatgttgtagtaccgctactggttgtttttaattgacctgtcattgttgtgtcgtgcaatgtcttt

SEQ ID NO: 26375 - DNA, 1772 bp, Triticum aestivum
  Clone ID: PAT_TA_26375
gcctccccaccggcccaaatccccatcccccgcgaccggccgcccgacccgctcaccaggagcgagtccctctccgggcagcagcagatgggggcgacggacgaggcggaggtggcggcggcggaaggggcggcggcggggtgccgcgcgcgggcggcgctgctgggcgcgtacgagctgggccgcacgctcggggaaggcaacttcggcaaggtgaagcacgcgcggcaccgcgccaccggggagcacttcgccgtgaagatcctggaccgcggcagggtgctctccctccgcggcgccgacgaccaggtccgcagggagatcgccacgctcaccatgctcgcgcaccccaacgtcgtccgcctccacgaggttgctgctagcaaaacaaagatctatatggtgcttgagtttgtcaatggaggcgaactttttgacaggattgcaataaagagaaagctatctgaacgagaaggaaggaggctttttcagcagctaattgatggtgtgagctattgccatggaaagggtgtctaccacagggacctcaagcctgaaaacgttcttattgaccggaaaggcaacatcaagatctctgattttggtctcagtgctttaccacaacatctcgggcaagttgccccaatgatggattgctgcatacaacctgtggtagccccaactatattgctcctgaggttctgcagaacagaggttacgacggatcattgtcggatatctggtcttgtggagtaattctttacataatgcttgtaggacaccttccgtttggtgaccgaaatatggttgttctttatcagaagattttcaagggtgacactcagatcccggagtggctttcccccggtgcacaaaaccttcttcgtcgaattcttgaaccaaatccgatgaagaggattaacatggcagagatcaaactacacgaatggtttcagaaagactatattcctgctgctccatatgatgacgatgatgaagatgtacggcttggtgcaattctacctatcaaacagcaaattagtgaagcacccggcgacaagagtactcatcagatgaacgcttttcagctgatcggaatggcatcttcccttgatctttcaggtttatttgaggaagagggagtgtcccagagaaagatcaggttcacatcagcacatccaccgaaggatttgttcgacaagattgaagtgtccgcgacgcagtcagggttccatgttcagagagcacatagcaagctcaaaataacgggcaattgcaatggaccgaacaaccccacaccattcttagtctgtgccgaggtttttgtgcttggcccctctctgcatgttgtggagcttaggaagtcccatggtgacactgcagtgtacagacagctctgcgataggatctcgagtgatctggggattgacaagattttcgggatgggctcgctcttcgacgacaacctccctggcttcgacagcagagccgcgacaccactggttgccttgtgatgagtgttgtgctgtaggtaccccaactgacatgatgttgtaggacgctaggatcatagctgtttattgattggaaatgacgatgatggtgtaaggattaggatcgtacagtgtacagaactacatacatatagtcgagtggtgaaactgactatcagcgacatcatcatcggtgggagggcggcgctagcggcgctcagcggggtcagcgttgtttgcgcgtttgcgccaaagcccttggcctttataaagtcgcca

SEQ ID NO: 26376 - DNA, 1090 bp, Triticum aestivum
  unsure (1)..(1090): unsure at all n locations
  Clone ID: PAT_TA_26376
cccagcgtccngatttttattgcaatcgcaaactctgtttgccccttccttgatccaatctttcgttcttgctgctccacatcgcatccacctgccgacgcggcgcccccaacccatgaaccttcacctgcttgttgaccttctcgcaaagtccacctcgaccttcctggggtctggctcgcagggtgcacgcaatctcgtcctagccagctgctgctgggtgaacctccaccggcctgaagatgcaagagcaaaaacagagggagatatagagcatgtgtagtatatggactactcgcacgcgctgccacggactgctccgcccagcgcccccacaccccgcgtgtcgcctgcatgccacaccgtagccacctctcccacaagttgatgaagaggtctgtctctctttcctcccctgctaccgtcctgtgcggcagtgtacgcgactacttgagggaacgaagcccgtcctcccagcaccggcagtctccctgcaccctgcaaaaaattaaaataaatcgcaagatcagaatcaagaaaccatgaagttcaaaagacaacaaagggacaacaatgttgatggcgattgaagaaggatcccggaaatattattattgggatcataggccaagttttatgcacggtgtgagaggattccaggaattgttctgaagcggtcgatggctttcgagagatgcaatcatatctcacaagtttccagggggttcaagatcatttatataagaaggaaatgtcaaaggttcagagggcagcacacttaaaaatactggtgaaaaatctgaacatgtgtagtgcaatcatgggaaaaagcttgaatttttatggcctgacctctgttgatctctcctatagtttttgttatgggttcttcattgagtggtacaactgaacatatccacgggagatccatgctatggtacagatttgtgaaattactttgtactatttagtattatttcattgtgggtaatgggcgcatgacttcatgtgttcactatttattttttgcttgatttgtagccaaattatttattaatattgtgattcgagtgccttgtgcatggatgtc

SEQ ID NO: 26377 - DNA, 483 bp, Triticum aestivum
  unsure (1)..(483): unsure at all n locations
  Clone ID: PAT_TA_26377
gccggccgggctgcggaaaagcggaagcgtggggcagtagtaccagcaagcaaaccacatcaccggttccagctttcagatacatacaggtcttcgattttttccgcggagatgggtgacgccaagtcgtcgtggccggagctgctgggggcgccgtccgaggtggcgaagcagaagatcctcagtgaccgcccggacgtgcgcgtgttcgtggtgcccgtcggcaacaacgtcaccggcgacttcaacgacaagcgcgtccgcgtcttcgtcaacacccgcggcgacgtcgccagggtccccaacatcggctaggacggtcacgctccattacgcatgtaatatatgctagtgtgctcggcatgcatgcatcgtcatggttcatgttagccaagattattatgtattgtacgcgtacgcacctatatgttcatccttatgttgtatctccattgcaataaagttcactgattgtggccccna

SEQ ID NO: 26378 - DNA, 793 bp, Triticum aestivum
  Clone ID: PAT_TA_26378
cttgacctgaaactgaaagaagccgcgcagactggtccgccacttcacggaaattcccccaggcaatacttctacatatatatacgccgcccgcctccattccggtgttcctagtttccactcatccgccgccgcacccgaatccccgccccacgaagcttccaaaagcgaggtcatgcttcaggctctggtcatggtgaaagcgtgacaaaactggcaagcccgggccgaggaccagatcgcgttggaggagcacaggctctccaccggagacgacacgaggatgttgctcaagctgcaagacacggagaagaagattgtgatgctgaaggaacaggtggacagactagaggcccacgagaaggagctgtcggtgacgacggaggtcctgaggatgcaaagcaagaccttcaagatcggcctcttcggtctcctccagctgatcatgctgtgcctttccctcaagatgttcttcgcccaggactctgcccgcttcgacgatctcgtaccgacatgatggctaactagttagcggttgttttagtctgtatgtatgtaaattcggttgattgatttgcgtcgtgttaggtctaattcactgtgccacgttgtgaaagtgtaacacgtctgaaactacgcgtgtcctgctgtaaattatctgtgtgcatatatatatggtatatctaggtttgcctgacccgtcaacgttgatgagttggagaccgagcttgagagccaccttcaggacaaaaatcgaagccgagattcagtgtctggtcatggtgaaagcaag

SEQ ID NO: 26379 - DNA, 854 bp, Triticum aestivum
  Clone ID: PAT_TA_26379
cagatccacatcccaaaccgcgcggcgcagcaatggcggtgcgcccgagcctcgcgtacttcccctccgacaacgcgctcctcgactcctcgggcctaccgtggggcgtcgccgtcacgcccttctcttccaccgatgagcgcggctcctctccggtcaccggcgacgagggcgacctcatccctcgctgcacgtcctgcttcgcctatttcagcaccctttgctcgctgcaccgctggtcgtggacgtgtcccatctgctcggaagacaacgacctctccgccgacgccgccgcgcgctacgcgcgggacggcagccacgacccgcccgagttacgctccgcctttgtcgacctcctcctcccgggggaggagggtgaggcagcggctgcgacgacgcccgtgtacgtggcagcgatcgacttatcctcttctgaggagtttttggagctagtcaaaagtgctcttctggcagctcttgaagctctttctccaggatcattatttgggattttaacatttagcagcaagataggactatatgatgttcaaggtccaataccaattgtgaaaaacgtttttatccctcctgattctgacggcaccttgcacgtggaccttaaagatgtcatgccattttgttcatttttggctcctgttggcactttcaaagaccacatcgctgaagcactagaaacaattaaaccaatagcttcctgggaaagggcaacaactgcatcacaagttcaagatcacgcattgcatcatacccgtgggtttggggtagcaattgatgctcttgtcaactacctaagtgtggaaaatggacctacctttgaacttggtagtgtattt

SEQ ID NO: 26380 - DNA, 694 bp, Triticum aestivum
  Clone ID: PAT_TA_26380
ggagagaagatcatagcatagacaccgagcagaatgagggtggcggtggttggtggcggcgtgagtgggctggcggcggcgcacgagcttgccgccagcggcggagacggcgtgcgcgtgaccctgtacgaggaggaggcctccctcggggggcacgccaggacggtggccgtcgatgacggcgccggctgcgtcaagctcgacctcggcttcatggtcttcaaccaggtaacatattcccacatgatggagtggttagaagggctcggtgttgagatggagaggtcggacatgtctttctcagtgagctcacaatcgaaaggcggcggcggaggatgtgagtggggcaatggcaacggtatcccgggcctcttggcgcaaaagaccaacatactgaaacccagtttttggcgcatggtccgtgagatactcaagttcaagaatgatgctctgacgtacctggaggaccatgaacacaaccctgatctggaccataatgagacattggggcagttcattcagtcgcacggatattccccatcgtttcaagaggcttatcttattccagtctgcacaggcatgtggtcatgttcaccacaagacgttttgagcctgtctgctttcttcgtgctgtcattttgccgaaacaatgaccttcttcagctgtttcctcacacccagttgcccactgtca

SEQ ID NO: 26381 - DNA, 731 bp, Triticum aestivum
  Clone ID: PAT_TA_26381
ggcacgagatctgagatgctcgtggaaattgttagctcatttggccagttagctgcataccactttgtttgtaacgaggacctgggtgggcgatgtgcatttcttgagtatattgatcactccattacaaacaaggcatgtgctggcctcaacgggatgaagcttggtgggtgcatcctaactgctgttcagggttttcccaatcctgtcgaggttcgcaatgaagcttccccattttatggtattcctgatagtgccaaagcgcttcttgaagaaccaacaaatgtcctgcagctaaaaaatgtgtttgcccaagaagaatttttggcactttcaaaacctgagctggaggaaatattggaagacgtacgcatggagtgtgcaaggtttggagcagtcaaatccataaatattgtaagagtatcctgctagcagtgacagcattactgaggatgtcctagttgagcccaaagatgagccagtaaagcttgagccctctgaatgtcgtgccaatgataactgtgtggagactggggcagattgctctttaccaagtaggagcatagtagttccgtccaaccctgtggaaattacaggtgctgagtgccaggatcacaaagagcttgacacacttcgtgaatgtgatgggtctgcggcggcagatcagtataccgacctagatgacatccatgctagagctgctggccccacagtggatcaacaaacagaga

SEQ ID NO: 26382 - DNA, 618 bp, Triticum aestivum
  Clone ID: PAT_TA_26382
gtgttaactgcaacaacacgttaacaaaagagcgtgtcccggggatacgcagtgatacgttaataatgttagcaatcagaccggcggcgcctgctcaggaaccgcgcaccaaaccggtcgtcctacacgcaaagggcatgcaccaagatcaaaccccccgcatgcgcgtgtcctgataccctatggaaaatcagaacaggcaacaccccaagatacaaaaccaccagagaaaaaaaaagatcttttggtcagccgcatcatcctgtcatcttcttgcctcttgtcgtcaggggcccaatcaatcagccaaacgaggggatcccgtatctccagccgttggaggaccgccgggcggggggctgctgcggcgcgaagctgagcccgaacatctccctcaggacctgcccgggctcctggagcccgatcagcttggccaccaaggacgcgctctccctcacgtgctccaggtccctgctctctgtccacagccggcgagccacctgcagcttcctcttcttggagtccagcgacacgctccggcgggcctcctgctgcttcctctcctccgcggccagccgctcccgcctctgcctcgccatgtggttcctctcctccaag

SEQ ID NO: 26383 - DNA, 537 bp, Triticum aestivum
  unsure (1)..(537): unsure at all n locations
  Clone ID: PAT_TA_26383
cctgccccacccaccagcgcgcaaccaaaccagagcgagcgaacgacttgcctctcccctgctccctccccgtgccgaccccgctcgctcccaccccagccatggcaatggacgacgtcgccttcgccgcgggctcctcctcgtccgccatggacgcgctcgccgcctnctcctccgccgccgcccccgccgacccctcgcacggctggcagaaggtcacctacgccaagcgcagcagccgcaagcccgccgccgtggccccggccgcggccgcggcgcccgggctgggcaagcccggcggcgtcttcgagggcctcgacaagcgctcgcaggagcgccaccgcgcgatccaggccgcccgggacgccgcggccggctacgactccgacgacgccaacgcccgcgtcccctggggctcccgntcctccgacgagggctccgactcggacggggcggccaaggaccgcccccaggccgaggcgcccaagaagcccaagaagcccaaggtgaagaaacccaaggtcacggtcgcccgac

SEQ ID NO: 26384 - DNA, 569 bp, Triticum aestivum
  Clone ID: PAT_TA_26384
taggggccttttttttttttttttttaaaaggggcacaatcacggcattcttgcaaataagacaccaggatttacttcactgcaacagggcacggttacatcaggaacacaacattcgacaccaaactaccaccaccacaccaccagcaaacaagccgctacgaggaacggaaagcctagccgccgaagccgtagagggtgcggccctggcgcttgagcgcgtagaccacgtccatggcggtgacggtcttgcggcgcgcatgctccgtgtaggtgacggcgtcgcggatgacgttctcgaggaagatcttgagcacgccgcgggtctcctcgtagatgagccccgagatgcgcttcacgccgccccgacgcgccagccgccggatcgccggcttcgtgatgccctggatgttgtcgcgcagcaccttcctgtgccgcttcgctccgcccttgccgagccccttgccgcccttgccgcgcccagacatctccgctgctctctctctctctctctttcccggggacgaagatggatttggggatttgttttcgttcccgaaccggccggc

SEQ ID NO: 26385 - DNA, 1200 bp, Triticum aestivum
  Clone ID: PAT_TA_26385
taggggccttttttttttttttttggaagagaagcgcacgcatttctggcattggattaaaaggggcacaatcacggcattcttgaaataagacaccaggatttacttcactgcaacagggcacggttacatcaggaacacaacattcggcaccaaactaccaacaccaacaggatgaacaggcactccctccgtaaacaagccgccacgaggaaaggaaagcctagccgccgaagccgtagagggtgcggccctggcgcttgagcgcgtagacgacgtccatggcggtgacggtcttgcggcgcgcgtgctccgtgtaggtgacggcgtcgcggatgacgttctcgaggaagatcttgagcacgccgcgggtctcctcgtagatgagccccgagatgcgcttcacgccgccccggcgcgccagccgccggatcgccggcttcgtgatgccctggatgttgtcgcgcagcaccttcctgtgccgcttcgcgccgcccttgcccagccccttgccgcccttgccgcgcccagacatctccgccgctctctctcttcctttcccgggcacgaagatggatttggggattttgttttctgttgctgtgtagtttttttatgcattggattcaaaggggcacaatcactgcattcttgcaaataagacaccaggatttacttcactgcaacaggcactgttacatcaggaacacaacattcgacaccaaacaccgccaggatgcacaggcactccgtaaacaagccgctacgaggaaaggaaagcctagccgccgaagccgtagagggtgcggccctggcgcttgagcgcgtagacaacgtccatggcggtgacggtcttgcggcgcgcgtgctccgtgtaggtgacggcgtcgcggatgacgttctcgaggaagatcttgagcacgccgcgggtctcctcgtagatgagccccgagatgcgcttcacgccgccccgacgcgccagccgccggatcgccggcttcgtgatgccctggatgttgtcgcgcagcaccttcctgtgccgcttcgccccgcccttgccgagccccttgccgcccttgccgcgcccagacatctcggctgctctctctctctctttctttcccggggacgaagatggatttggggattttgttttctgtcgcctgaaattgatgttttttttttcccgacccggccggc

SEQ ID NO: 26386 - DNA, 1706 bp, Triticum aestivum
  Clone ID: PAT_TA_26386
gagcttagcatcaatattactaataatactgtacaatttctgcatcaatcaaacagagggccaatcccatgcatatcaaaaccagatctatcggaaaatccgatagatattaagttgcactacaaagagggcaaattacaacaaggaggaatgaatcacagctgatgcaatatcttgtatacccgggtatgttacaagggaaaagccaacatggaaatgcagagtaaaggtcctacgcatgtattctcttcgaacatgttgccttccatccaatgctagctgctcatctcctctgtatcagcaagcacaaactctgtgtacaggttcttcaatgctatcacaaccgtcataataagggggcctaatattgcaccctcgagagcattgggaaataatgtcatgccaccgattatgctaaggccagtcagatacccattgtacccaggtatatcctcctgaatgaccgtggttccataatccatgatcacgaggtgtatcactgtaaccataaccgcaaggacatatctcccttccgtcagcagttgtgctgcggcaaataccgaggacagccatgctggtagtattggaaaaagtgcactgatgattgtaaacacagttgctgtgtacacaaaatgcaccttgaagaacttgagcaacagccatgtcaggcatccttggaatatagcaatcttggcagtggctaacaagacactgctaatggcatggtctataacctcgacgcaacgctcctttacttgtttggacaccggtaagaggtcaatgacctgctccgttgccccgctaccctcaacagtgatgaggtagtacagcacccacataaagaccatcagctgtgacacaaaattgagcacctctgctgcaccggagagaatgcggagagcaatggatagcatcaaattggcactaccaccgagcacagaggtgccgctagatagcagactcttcgcaatctccgtgccctgcaaagccaggtccttggccttcaccactagatcctcccttgtgattaacagctccctgaagaacgagtccagctccctgtagatctccagccactccctgttcttcacacgcagcgtaatggcctgcagctttagcgagtaccgcggccgcccccacgcgatgagctccttgctcttggcaccagatgggactgattggctgatcaagaagtgcttgaatccactagtgaaatcagtaaggttgtattgtacagccaattggtctacctgctcccagacggtttcgacgagcttccctgagtactgctccaccaagcccgggatgtcattgtcgtcaagcaacttcttgaggccaatcttttcggagtagttgccattttcgacgtgggacttgagggacatgacggcgtccttgccctcgaggccgatcttgtaggagaagaagacgctgccccctaggaagccagcaatcatgccaagcatgaggccgacggcgacgagggtcctgaggtggcggaggatgccgccggtgaggaggagcccgcgggaggatggtgttcgaccggagatgcgggaggaggcggcacgggggatgaaagaggagggcttgggagaggcggcgtagaaggcgagggagacgccgagcgggagcagcgcggcggcggtgccgaggcgctcgagcaggaggaggaagaagaaggatgaggcgaaccaacgcaggct

SEQ ID NO: 26387 - DNA, 865 bp, Triticum aestivum
  unsure (1)..(865): unsure at all n locations
  Clone ID: PAT_TA_26387
tgcggccgccctctcgcccctgctcaccggtctactcaacttcctccactagcgcagctccatctgcatccatccatggcgtccgtgaagatccccggccgccgcttggcccgtgtcgctggggtgttcccactttgcttccccccactagctagctaagctccatctgcatccatctatccatcctcccatggcgtccgtgaagctcgccgccgtcctcttggcgtgcgccgcgctcatggcgacggcggcggcgtacgcgccgtaccggccggagcccgagccctgcaagacgcaggccatgtacttcaagaactgcctcctcctcgtgagcgagtgcgagaagtgctgcacgggcgtggctggccgaccccgcgtgctactgcgaggttgggagccgggacggcgttgatcgactgcgcgcccggccaccagctgcagccgcgccgactagaagatcaagatcgccgagatgaacctctcctggattgaagaacctcaagtgcaagcatgcgtgatggccggtacgggtaccttagctgcagcttcctactacaagtatatctcgtctctcgtttgtgtgtccatctccgaatgttgatgttggactttgtcgtctggctttgttcccactattgatgttggttaagtagtgtcgtacgtccctatgttaactttgggattaactacatggtgctttgatcctaaaactatccacatcatcgttggggtacgctccaacaatgtatcccttccaatcaagaatacttctcaanaaaaanggtaaaangggtgtattntgaacaaaaancatttgggtacnccactcttcgggaaataacatatattctccaaaaaaaaaaaa

SEQ ID NO: 26388 - DNA, 1064 bp, Triticum aestivum
  unsure (1)..(1064): unsure at all n locations
  Clone ID: PAT_TA_26388
gcgggaacaacaagaatgatagacacaaagctctcctggcgatggcggtcgggatctcgcagatgcagaatgtggacgtgatggctcgtaagttcctgaatgagagctacacggtcatgctattccattatgacgggaacgtggatgggtggcgtagcctcgagtggagcgataaggccatccacatagttgcgcccaaccaaactaaatggtggtttgctaagcgttttctgcaccctagtgttgtggctatctacgatttcatatttttatgggacgaagaccttggggtggaaaattttgatccgaggaggtatattgatataatggtttccgaaggcttagaaatcacgcaacctgcattggatcctgatctatcaacagatattcaccaccgcatcacaatccgcaacaagatgacaaaagtgcataggagagtatatgacaatcgttcaagcatgaactgttctgatgatagtaaaggacctccatgcacagggtgggtcgagggcatggcaccagttttttctcgtgctgcctgganatgtgtatggcatctaatacagaacgacttgattcatggatggggccttgacatgaagcttggttactgtgcccagggtgatcgagctgagaaggtcggtgtaattgacagtgagtatgtcgtccatcaagggataccatcattaggaggaccatcagataccagcaagttacctcgaagatctttggatttacggacacacattagaagacagtcgtcagcggagctggagaagttcaaagagcggtgggaaaaagccgtaagagaagatgacgagtggatggatccttttgacgcctgattactttggaagaaacacctgacatgaagatacaaggcccaccatacatgggtggatgcgtccacattcatcatggcggttggagtcgagatcatgtgggcctcatagcgaaaacagttagttatatagccttacaggcattttgctgactaacacacaccaccccgccctcaagagctggaagaagaagcgggaacgtcgtcgcgctaatacacggag

SEQ ID NO: 26389 - DNA, 1041 bp, Triticum aestivum
  Clone ID: PAT_TA_26389
cttccctactcaccagctgacggcggcgccgcacgaaaggaacgaagcgcctctcgctcccgctcgccgccgcctccggcgccgctgcaggtcagggcatacagaggctaaagtcaaccttaaaatggaggatgctaacgcagtagtagattggaatgttgacattattggcccagatggtggtagcggcgcttgccgcaaattggcaaaaactgaagaccctgatgccacagagtgttcaagttcctttggggacacactatctggatctcaggatgatgcaaagccttcagagattagtgacattgaagtagactcaccattctgccgttatcctcataatggtgatgctgctgcactcttggatgcagctgctgctgacaatttggatagattattgaaaaagaaaaaagtgaccgatcattggagaagctatatcagcccattaatgtggagatgccaatggttagagctgcggatgaaagacttgcaatctcaagtatccagatatgacagggagcttgcagtacttaaacatgagaaagagttacagacaaaaatgattgagttggactgttcctcgtcgagatcagtgcccttctcttctcattgctgcaggaagactatgaagaggaagaagagaaagagaaatgaggagaaaatcaatgctccctcatacatcgcaacccacaccatattgtcttattatgaaaaagagaaaacggaaggtgatggccattctattgacgacattggaaacttagcagatgacagcacaaaaggaaataatgacgctgactggctactcggtaatggagacgatgctactgtcgagcagattcttgtaagcattcagtctgttcaagacagagtctgtagtctgagatcagatctcaagaaagcaatggccaagaagagtaaggggcttctccttaaagtcaacacacaggtcaacggcgcacagagctctaattgctcacatggaaaaggcaaagttgctgaaatgcctgaaatatcacctcaagatgcatcggattgtga

SEQ ID NO: 26390 - DNA, 578 bp, Triticum aestivum
  unsure (1)..(578): unsure at all n locations
  Clone ID: PAT_TA_26390
ggggagtccggcttggntgtcggctcgggtcgcccgtttccggcggagcccgtggagagcgtcccccgccccccggcgggcgacgggtnccttccccgatcctcatggggccgcgtgggtggcccacaattcaattgaatacagctttttctaccaatgtttgaaggattccaagcaccaccggtcgatgttttccgaacttatacgtatttctttttgtgtacgtatacatatttaccccaattactgacttattattccattgtagcatgaatgggtgcttacatgtccataagggcgaacgatttacgaggcaaaggtgacgacaggcccggcgacgttgttgctgcggaacttggagacggcgcaatccgtggagaaaagactggacgaaagatatttcggcgcgccgcccatgatgggcatcttggcgctgatgtccaccttgttgacatactccggctggtaagtctggccgagcacgccgtcgacgcttttggtgagggaatggaacttgaagccgaggtcaaggtgcacgaggctgtcgctcccggtcttgccgtagttgtggatccggg

SEQ ID NO: 26391 - DNA, 468 bp, Triticum aestivum
  Clone ID: PAT_TA_26391
gggaaatatgacagggcgatgattactaagctttaattaaccatgttttcacacaattttcgttacctaagatccatcaaatgcacctaatacattggcgggtattaaatatgtactccatgactaacagttacacaacaaaatcatgttgactcaacaatatcataacacatgggaatggctgcttgctgagcctatgcggggctgcagctgctgttctgttgctgtatgggctttcctttccggtgaacatgggcacgtcattctgcaggcatgtaaaaatttcactagatagtaattttttcactcgagcagaagtagtcacaagcagtcataacggaaagctcgcccaccagatttttaaaaagctacagaagttaccataagaggagatatctgcatgatatgtactcagccatcagaaaaacttgagccaatacctaaataaactgtttgtgtcaattatga

SEQ ID NO: 26392 - DNA, 410 bp, Triticum aestivum
  Clone ID: PAT_TA_26392
aggaggaggaggaggtggtggtccagcttccccgcggcggcgccgcgcccgccccgccgaccggacccccccgccccccccctccgccgcgccccccccccccccgccgccgcggcgcccgcgctcgggcccgccccccgggctcaagaacctcggcaacacctgctacctcaacagcgtgctccagtgcctcgcctccacgcctccgctcgccagcttctgcctcgcctcccgccactccaatctatgcaaaaaggtgttccccaacagggacaaggagtgcgccttctgcgtgctggagcggcagattgtgcggcagcttcgggcggaggcaggggctctggactcgccggggaaggtcctccgcagcctgccgctctttgccgagcacttccggtgggggcgccagg

SEQ ID NO: 26393 - DNA, 640 bp, Triticum aestivum
  Clone ID: PAT_TA_26393
ccccccctaggattttccctttttttttttaacagaaagcagcagcctgttgaatggtaccaaaggagtctgggcagattcgatgaacaaatagaactacaaactggatccaactgcaatcagtgtccagaacacgcaaagccgtacagattcacacagcaggggaagcaaggagtttcgatgacacaaatggagataagggtggcagcagggggactcaaacgttcagcagctacagctagtacggtttcttcatggggaagacgaaggaaacaagacctgcattgcctttctaatatgcgatgcacggtttggtttcctccttcaattcccgcggggtagtataccgttaccgcaggctttactcacttggccatcatgaccttgacgaactcctcgtagttgatctggccatcgccatcgacgtcggcctcgcggatcatctcatcgacctcctcgtcggtcagcttctcgccgaggttggtcatcacgtggcggagctccgccgcagagatgaagccgttctggtccttgtcgaacaccctgaacgcctccttgagctcctcctcggagtcggtgtccttcatcttgcgggccatgaggttgaggaactccgggaagtcgatggtgccgttgccgt

SEQ ID NO: 26394 - DNA, 428 bp, Triticum aestivum
  Clone ID: PAT_TA_26394
cgcacggagggtgtcttcttccgagaggggggggggagaggccagagaccaagggaagcttcgccgaggatggccgccgtccctccgccggagaccgcgctctcctccgcggcggacggctcggatgacgaggatggggaccagtgccgcatctgccgcttccccgccgaggcggatcgccctctgcgccgcccctgcgcctgcagcggcagcatcaggtttcgtccacgacgactgcctcctccgatggctcgccaccagccgccaatcccggtgcgaggtgtgcagccgcgagatcaccatcagccctttctacgctccaaacgcccctgcgaggctgcccctttccgaattcatgctcggcttggccaacaaggtcatgggttgggttatcgtgctgctctccctcgtcgtcacggtcctagtct

SEQ ID NO: 26395 - DNA, 1098 bp, Triticum aestivum
  unsure (1)..(1098): unsure at all n locations
  Clone ID: PAT_TA_26395
gcgcggcgtaatacggacgcacttgggggccgggccccccccgggcccccttttttttttttttttttttgagagcgtgaaaagttctattttatgtcagaaaagtgggtgcaagttctccacatttcttctgatcgtcatgcttgaattacatagcattccactacaaaggacctggatatgcccggcgaaagcccaggaaagccgaatgatactctaactaatcaaaagacttcgaccaatctgcttatttatcggcaaatgtaacccatgcacgccgcagagctgccgcacgtggcgacggcacacgcctactccatgatgagattgacggcctcccagggctccacgttgccgtcctccagccccaggaacgcctccaggccgggacatgcgctcccgcaggctgtctgtgccgccgccgccgccgctagccgggaccggaaggggagacgaagacgcggagctctcctctgcagcgacccaccgacgcttcttgggcgcccccggcccctccaacggccgcggccgcttgcggcgcgcccaccgcgggcgggaagttgagcttggccttcggcccgcggatatcgcgcgccgcgacgtcgtaggcgcgcgcggcctcctccgcggtggcgtacgtgcccagccagacgcgcgcgcccttcgtggggtcccggatctccgcagcccagcggccccatggccggcgcctgatcccacggtacgccgtcttccgccccggcgccagcggtttctccttcacctccccaccggcgaggatggagccggggacgtcggcggaggagccatccgggcggcgggccccggccgggacgaagtcggcgataacagctccgccgcacatttcctagctaaccacgttctcctcttactcagagtctttggaattggcagctacctcggcacagaggaattaagcagatgacagacgttctcttcttcctttggttttatctggtgccgaattcctgcagcccgggggatccactagttctagagcggccgccaccgcgggtggagctccagcttttgttccctttagtagggtggggttcaaccttggggtctgcaactcnc

SEQ ID NO: 26396 - DNA, 300 bp, Triticum aestivum
  Clone ID: PAT_TA_26396
tgtcagtaagctcacaagtcacaacgcagtagcggcaaggtggtagtaagaggaggcacagtttttgaaccctccatctccaaagtgtttgagcctattggcacgaggaagaaatggtacactgctctgtttctgctcatgaccttgtgtctgcatgtttagtttccttgctttccagaacatctgtgtgtgaacaatggagaaattagattctgagcacgaacaaaatcttcagagatgttgtttggttaaggattagagtgaacatttgaaacccctgaggctttcattttcaatttt

SEQ ID NO: 26397 - DNA, 854 bp, Triticum aestivum
  Clone ID: PAT_TA_26397
cccagccgtccgattcctcatgctacatgtagactgacaaaaaccctaccaggatcatcatcaacttcccggcgcgaccgcatggacgaagatagattccggcgctgcagcaccaagacggcgaggcgtcgtctgcgcagcctcctcgtcctcgccgcagactacctcaagtacctcttcatgaaccggcgccgactcctccgcagggtggcgaggcgtacccacgccgtcctctcctcctaccacggcaaaagcaacaagcgtctgccgccatactaccctcctcgcgcgttaatggagcacgagttctcgtgtagcaacagccctagccccgtgttcctcgcggccaagaggctccactcacggctgaagtggggtgccgccgccggcgctgccgtctcttcctgctttggcgccaccgttggggcctcgtacgggtcgccgccggcgacagaggaggacgatgtggttgaggaggaagatgaggctgatgggttggcctgctacgaacttgagcctgacgtggactacagggcggaggagttcatcagtatgttctatgagcagctcagggcgcagaactttcctccggttttgcaacgctcgccatgacgcgcgacgctgagacatgagagctgagagatcgagggcgcgcgtacgtcaggtacgtgtcaagaggagaggagtacgttcttactttcgatgaggaaggacaggccagcttgtatcactttattttgatttctacatgagtgtttgtgacttgtaactaagtgtactacgtacacatgtgggctacggatatacctattgagtacaaataaatgttagatgcgatgaaatttggtttcaat

SEQ ID NO: 26398 - DNA, 409 bp, Triticum aestivum
  Clone ID: PAT_TA_26398
tgacttctgagagtcgggagagccaacaaccaaaagagaccaaaagagaccaatgccgccgccgccgccgccgccgcagggagcaatggccaccggcgccgccaaccaccccctcccctgctccgtcggccgtccgaaggggacgaaccagcggcgcagacccgcctccctctccgtgcgcgcgtccagcgacgccaacaccgtgacgctgctggactacggcgcgggcaacgtccgcagcgtgcgcaacgcaatccgccacctcggcttcaacatccgcgacgtgcggagccccgaggacatcctcgccgccgaccgcctcgtattccccggagtcggagctttcggttccgccatggacgtcctcaaccgtacaggcatggccgacgcgcttcgcgagtacatccgc

SEQ ID NO: 26399 - DNA, 1048 bp, Triticum aestivum
  Clone ID: PAT_TA_26399
ctttgcctttcaagctatggatatttgaacatatgcgtacacggggacacggatgagctgaggccatggtgcaaagcaaaactgccccttttgtatagttttattcagagtcactactggggagttggtttcttgagatactttcaagtcaagcagctgcccaactttcttttggcttcaccagtactatctcttgcagtttattctatagttcactacacaaaattgcttcagcaactcttccaatcaactagcatacacgagcagataattgccattgttgacgggaggttagttgaagcacatgaaagctcagatgttgccacagtgttgaagagtgaaatttctaccggactacataacaaaaagcaagggaacactgaggttaagaagagaaaatctgtcgcagccagcgctgcttcagcagcatctttagatggcaatatatcaacaggccgaatggtgggagataatgaggatgagtgccccttgctaggggcactcttcctttcattttacatctgacattcatgacatttaccgccttcttcgtgatgcacgtccaggtgtcaacgcggtttctgtctgccagcccccccatctactgggccgcttcgcgcattttggctcctgcaaggggcggctcttgcaagagatggggatacttcatcatcgtttacttcattgcttatattcttctcggcagtttgctcttccccaacttctacccattcacatgagaacagctgctgtcacgcccacacgaattgtatgagcttagcctggaggttctccttggcggaatgttcctgtacagttggtgtatctctttccttttgttccctcaaaccacggccatagaattgaggagtgcattctggaggtttttctttctgggagatctgaatcatatgctccatttcctaggtagcactaggtcacatgccatgttattttgacaccttgagaaaataatacttcctccgttcggaaatactgaactacatatggatgtataccggatgtattttagagtgtaaaaaaaaaa

SEQ ID NO: 26400 - DNA, 863 bp, Triticum aestivum
  unsure (1)..(863): unsure at all n locations
  Clone ID: PAT_TA_26400
gggtgacggagagaggccgggggaggcaacaggaagggtctggcgccgaggagctgaggatcggcagcggcaacgtgttcgcggcgctcgagacgctcaagaagaagaagaagaagccggcggcggccgagaagaagcaggcgccgttggtgngaaaagccagaggtgttctgggcgcccgcgccgctcacggccaagtcctgggccgacgttgaggacgatgacgatgatgactacttcgccaccaccgcgccgctgtgccccgtccgggagtcccaggggggcgacgctgatgccggccatgaggacgacattgaacaggaaattgagagtgaagatgatagccttgatgatgaggttgatgctgctgctgaggatgaacatgaagcaggagatgctgtcctctctgagccggcagttcagaaagctgtagctccactagtacctcctaaagatacagaaagacagctctccaagaaggagctaaagaaaaaggagttggaagagcttgatgctgtattggctgagttgggaatctcacatgaatcaagtaatgctactcaagatgaaacaaatgacaagaatggtacgtgtcaggctgctgatggagggaaaaaggaagatgcatccgctcctctggagagtaagacctccaagaagaagaaagctaagaaagacaagtcctcaaaggaggcagaagaaacactggatcagaacaatgtggtcgacggtgctgctagtgtggaacctgatgaagatgttgcttcagtggatgtcaaggagcgcataaagaaggtagcatcaatgaagaaaaagaagtcgagcaaagagatggacgcagcagcaaagattgcagcatctga

SEQ ID NO: 26401 - DNA, 881 bp, Triticum aestivum
  Clone ID: PAT_TA_26401
tcggcccgccggccgcggaggtacctcctaaagatacctgaaagacagcctctccaagaaggagttaaagaaaaaggagttggaagagcttgatgctgtattggctgagttgggaagtgcatacgaatcaagtaatgctactcaagatgaaacaaatgacaaggaaggtatgggccaggctgctgaagcagggaaaaaggaagatgcatccgctcctctggagagtaagacctccaagaagaagaaagctaagaaagacaagtcttcaaaggaggcagaagaaacactggatcagaacaatgtggtcgacattgctgctggtgtagaacctgatgaagatgttgcttcagtggatgtcaaggagcgcataaagaaagtagcatcaatgaagaaaaagaaatcgagcaaagagatggacgcagcagcaaagattgcagcatctgaggcggccgctaggagagcaaagcttgtggcagcgaagaagaaagacaagaaccactataatcagcagcccctgcggtgaattactgctcagattatgcaattccttagatactgtgcgcctccactaggaggaggccaccctctggtgcgcatcttggaattctctatagatggacttgttgtgtgctgagctctgaattgttcatgacagaaacccttttgaatactccctccggtggctgaaatacttgtcatgcgaaatggctagacatattttagttctagatacacccatctttatccatttatgcgacatgttttttcggaccgagggagtacatggtaaatgtgggtacttcgtactaaaaaaaaaatagcacaaattccggtcttctctatagatggacttgtggtgtacctcggccgcgaccacgcta

SEQ ID NO: 26402 - DNA, 798 bp, Triticum aestivum
  Clone ID: PAT_TA_26402
ttgatttctagtgacgacggtcattcagcccatagcaaatatatgccgcagctcatctgttagtgatcatgtttacacaatggcaactcttgccgaccaagactcaagaatattattcttcaaggaagctttccaagacgatgatctaccgcagcatgtggatgacctcggctccgcagcgctcaagaaatgtgatggccttccccttgctcttgttgccaccgccaggttcttgcaaagcgcaggtaatccaacacccatgaaatgggcaaaattatgtgccgacctgggtacacatctggagagtgatgagctatttgcaagaatgaggcgtgtgcttgtgcagagctacaccagccttgatacccaggttgccaggacattcttgctctatttgggtacctacccaagtggtcgtcctatcaagaaatcaagcttgttaaggagatggttagcagaagggttgtccccagtagacaatacatgtagtgatgttgatgctgccattagcaatttcgataagcttgttgaccggagtatcatccagccaacggatgccagcggtaacagcacagaggtgaagacatgccatacccatggcatgatgcgggagtttgtcctgcgcaagtccatgtccgacaactttgttaccgtgttgtacaatgggcagtctaacccatccatacccagtaacatccgccggcttgctctgcatcatgcaaggcccagagaagtgcaaggtttaactcttgtccggtcactgacaatcttgggagaggcgcacccatctgtcctgga

SEQ ID NO: 26403 - DNA, 692 bp, Triticum aestivum
  Clone ID: PAT_TA_26403
gcaacgttctagccagcccagcccgctcgcaaagtaggactagtctccctggaaatgtgaggaccatgccgaatgttctcgggcgatctattgcttggcctcgtagatatgtaaaacttctttctgatcacgtttatttctgcagctgtaggtcaaattgcatcctactgataatcctatgtatatatgcagatggagatttatcacaaggttatgcagaagcaaccatgaaagccggtagtagtccccacatctacacggcattgcagattgttagaaggttgtatccacaagtttcaagaggcgtgttttgtgagttgaacagatcttctactagcatatgtttctaactaaaactagatcccttattttgcacttttgcctgtgatgtaatagtggtcttaagaatgtacgtatgtatgcctatgtgtacatgtaggcattctggatggttgtgcttttggctatcctgtaatgctggacgtgtatgcctatgtgtgcatgtaggcaggcgatggagctttgttcttttggttgtcccgtagtactactgggaatgtacgtatgtatgcctatgtgtacatgtagacattctggatggttgtgcttttggctatcctgtaatgctggacgtgtatgcctatgtgtgcatgtaggcaggcgatggagctttgttctttggttgtcccgta

SEQ ID NO: 26404 - DNA, 745 bp, Triticum aestivum
  Clone ID: PAT_TA_26404
ccatctagttagcctatactcacttgcggtgattttgtcttgtttcccttcccaatttgagcggcgagatcttggaggcagagaggagagggccatggcgatttgagtggttagctctgccgctgatctccggagagcgagcctgtggttggcgtccttcccctacccctgttgcttctcctgcaagcgcgtcgaggaagaggggaagtcgacacatggtgattccgcggcggtatctcatctgctaccgttaatttcgcgccgctcctcctgttgctgtggtgttctccgagccctgtgtctcccttcttcccccaacgagccatgaatgtggtgtcttcacatttaagtatatggagatattcacaccaagaactcagatggcaaactttttctccagtgcagacattccaaatcttaggatcagatatgcgaatgacatgttttgcagccccatgaacagttgtgacaagtctttcgtaactggtttctatcgtgatggagaagcaatgccgggtgaggttaaacatgtgtgcggtcctagcacaaatggtggctgagttctttttttagtagcatgtaatctgaacaaagtagcatgcaatctgagcatatcagtatttttgatttagtagtggtctgtatgttttttcattttgattgtagtgtcatgtctttatgcctgtaactctgcagtacgtatttcgagcagatttttgattctatatcaagggccctttttgtt

SEQ ID NO: 26405 - DNA, 417 bp, Triticum aestivum
  Clone ID: PAT_TA_26405
cccacgagtattttttttttttttttttttattacccctctttggttcatttgaagagaaattgcagtgaatattattcaacatgtaaactgcatcccaatggatgaacaacgttgcttgctgtttacatcataaagtttgccaaggcctcgcttgttatccagatgtcataatacgcggtcaagacgctcttacaacgcatacgccttcactacatatgaggccttctgcacctattataacactagtataattatcagtgctgcacaggttgcattctccattcctgctccactccttgaccgcccagcaaagcaatggaccaaaacattgcctccagagcttatagcttcatctatgaaaccaaagcattcatcagaatgctttaacagatcagtgtctgggatatcaagtact

SEQ ID NO: 26406 - DNA, 994 bp, Triticum aestivum
  unsure (1)..(994): unsure at all n locations
  Clone ID: PAT_TA_26406
ccgcgcccgtagcccgacagccatagcaaaaagctcatagccagcaagcagtcacccatctaccatggcgaggcttcagctttcccgccgtagcggcctgcgccgtcctcctcgccctcgccgccccctccctcgccggcgaccccgaccatgctccaggacctctgcctcgccgacctgaaatcctcgatcaagctgaacggcttcccgtgcaaggcggacatcaccgcggacgacttcttcttcgcgggtctcaagaaggccggcaacaccaacaacccggcggggtccaacgtcagcggcggcaaacgtacagttcattcccagggggtgaacacgcttggcgtgtccatggcgcgcatcgactacgcgccgggaggccagaacccgccgcacacccacccgcgcgccacggagatcatcttcgtccttgagggagtcctcgaggtgggcttcatcaccaccgccaacaagctcttcaccaagaccatcaccgtcggagacgtgttcgtcttcccagcgtgggctcgtgcacttccagcaaaacaggggacatggccccgcctccgtcatcgccggcttcaacagccagctccagggcacccaagccatcgccaccacgctcttcgctgccgcgccgccagtgcctagcgacgtgctggccaaggccttccgggtcggtaccgaagacatcgacgccgtcaaggccaagtttaagtagtgtgggtgcctccgcagttggcaaatctccatccgtttcggaagaataacggtgtgttcattgctgactaaatgatactcaagcgagctgtaacgtgcagttgatttgttgatgtgtatgttccatttgattgtcttgaaaataatacaaaattgtttctcattcaaaaaaaaaaaaaaaaaaagtccctggctccattcgcctaaacgatctatagccgctcatggcgtcgttaaactctgactggaaaanctgggttaccactatcnctgn

SEQ ID NO: 26407 - DNA, 1103 bp, Triticum aestivum
  Clone ID: PAT_TA_26407
tcgaacttccacaacgcccggagcccccctcgtaacgcggccccgttcgccttgcggccgtctcgatcgtcggctcgattcgacgccgccattcgatttgggcgcggaatccgggcggggggacctgtgcgcgcgggcggagggcatcgagcggagcagccatgagcgaggtgttcgagggctacgagcgccagtactgcgaggaatccgcctccctctcccgcaagtggcccgccgcctccgctctcgatggagagaagaagaagcagaggctctccgagatccagtccggcgtgcaggaagctgaatcgctgattcggaggatggacctggaggctaggaatacgccgccgagcgtgaaagcgggtttgctagctaagctgcgggagtacaaatctgaccttaacaacctcaagagcgagctcaagaggatctcggcgcccaatgccaggcaaactacaaagggaggagctccttgaatctggcatggctgacacacttgcggtgtccactgatcagcgaggaaggttgatgatgacaactgaaagactgaatcagtccactggacagaattaaaagagagccgaagaactatgctggagacagaagaacttggtgtgtcgattcttcaggaccttcatcaacaacggcagtcactactgcatgctcacgatactttgcatggggttgatgataacgttggaaagagtaagaaaatcctgtcggcaatgtcgaagaggatggacaggaacaagtggatcattggtggaatcatttcagctcttgttgtggccatccttatcatactctactttaagctcgctcactgagccagccaggtaggtcctccaaattgtatgtgttcagtaattgtgtgataaggttgtctgaacgctgtacattggacgacacggattgttcctcggaagttcattggttccccaaacatgtttataaatatttgatgagtggttcattggcatgtcatgtatagcaacactcgtgtcaggaggtcagttgtgcccgaccattttatgatgtaaaactgttcagaaaaaacaaaagtgaaaaagaagatcgcctgtgtttatacaaaaaaaaaa

SEQ ID NO: 26408 - DNA, 631 bp, Triticum aestivum
  Clone ID: PAT_TA_26408
gccggccgggatccgggacgactcctcgcggagacaaccaaacaacctcgtacagcgcaggcgatcgatcggcgcggccatggagaagccgccgatcccgagcatcatctccaccgtcacctactgctgcggggcgtgcgggtacgacctgaggctgagctcgctggcgcgggacacggcgggcggcgctggcgcgaggcggcggtgcgtgggcgcggcggaggtggtgttcgacgccatcgacgacgcgcgcttcggccacctggaggagttccggtggctggacgtgcgcgcctgcctccccttctcgcgccgcacgcgcctgctctgccgcaagtgcggcgcccgcctcggctacggctacgacgacaccgccgccgccgaccgcccgccgcgctaccacatcaagatccgggccctccagcccgcccccggtcccgcctgcggcgccgtccgatccgtgatctgagatcctgccgtattctttgattgcctgtgcatgcagccgcatctgtctctctctcctttcaatcgaatctcctccaaagtcgctcgcttggaccccaagcaaggaatgaaacagactggttgattgatcgggatcgaaaaaaaaaaaaaaaaaaggccccta

SEQ ID NO: 26409 - DNA, 1074 bp, Triticum aestivum
  Clone ID: PAT_TA_26409
ctcgtgctcgagacggcggcgggcggcggggggacgggtttcgcctccgccactctctcaccagtaccatctctccaacggttcacacacaagccagcaaacatggcggttggaaagaacaagagactctccaagggcaagaagggcctcaagaagaagacggtcgaccccttctcccgaaaggactggtactcaatcaaggcccctaaccctttcaacgttcgagatgtcggcaagaccctcgtgaaccgaaccaccggtctcaagaacgccaacgacgctctcaagggccgtatcctcgaggtctctctggccgatctccagaaggatgaggaccactccttccgcaaggtccgcctccgtgtcgacgaggtccagggcaagaactgcttgactgctttccacggtctcgacttcacctccgacaagctccgatcccttgtccgcaagtggcaaactctgattgaggccaacgtcactgtcaagactaccgacgactacctcatccgccttttcgccatcggtttcaccaagcgacgaggaaaccaggtcaagaagaccacctacgccgcctcttctcagatccgagccattcgacgcaagatgaccgacatcatccagcgtgaggcttcaagctgcactctcacccagcttacctccaagctcattcccgaggtcattggccgcgagattgagaagtccacccagggcatctaccctctccagaacgtccacatccgaaaggtcaagcttctcaaggctcccaagttcgaccttggtgccttgatggctctgcacggcgagtcaggtaccgacgaccagggccagaaggttgagcgtgagttcaaggagcgtgtccttgaggaggtttaaaaggattattttggcaggttggcgcggggtaggcaataggggcctcgcggcgaataaactcatccctaccaatttttttcggtcgtccaaatggcgtagcatcacaaaagggagctcggggatttgttcatgttcctttgaatggtaaaaacaaacgttcagtcaacacgccgaatgatttatgacatgtgattcgttacg

SEQ ID NO: 26410 - DNA, 405 bp, Triticum aestivum
  Clone ID: PAT_TA_26410
gttcggcgacgggccggtgcgcgtcgaggagggaggagctggagaagtggatggcggcgtacccgcagagccgcgtcctcgtcggcgtcgtcgcgtcgccggaggctgacagggacggctacgtgtcgcacaaggatctctactacgacgtgctgcagttcatcaacaagctgcccaactatgggggcatcatggtctggaacaggtactgggacaagaagaccggatggacggctggtaatgagcctggtctcctggatcaggttctgtgatggacggctggtaattaaccagaccttgatccattttcactttgatcactgatcacttcactggattcatgcacgagctactactaagtaccgtgcacaaataaagtctgtaatgtcatgtgacgtgcatgca

SEQ ID NO: 26411 - DNA, 648 bp, Triticum aestivum
  Clone ID: PAT_TA_26411
ttttttttttgttgcctttccgctgcttttattgggctatactactggaaatctataccgtgggccttgcataccaaggccctgccagcgatccagtctcaggttatactcatgttattactcgagctttcttacacgaaatttgtcgtgaccagatgaaccaaaccacctggaaagcaacaggggccccccaccaggacgcattcccctactcgggacacatttggtatgaaggggcaaagcgttttcggctgcagcttcctttgctgcagacggaccgctccggcggacaacccttcggacatccccaaacatcttctcgaatggtctttcttgaagcaggtcttgtgctcatccatggacgcgtggatgaactcgtcgatgtgttctttcacgtcttcaaggaaggtaacatcatcatcagttttcttcttccggcatgtacgtcatggcagggttcttaggagcagctgggctagagaaccgtctagtctcgggtattaccggaataccatgtcaatgacttggttgagctccgaggatcgtcggcggaagggcggaggcgcggctgcctcgagaccgacggagagggggagaggaggaaagaagttgccggagatttggctttcggtttttcctcgtgccgaa

SEQ ID NO: 26412 - DNA, 462 bp, Triticum aestivum
  Clone ID: PAT_TA_26412
gcccccccacgagtatttttttttttttttttatgcaactgaacgacagatgattaagaaatgtgcagcacagtggacatatattacacaacattatatggtgcactacaatggttggaatttggaaataagtaccaactactgaactgaaatggacaggatattaagtacatatgaagggtggaataacagagttcttcgtgtcctacaagtagcatagcgctaatttattattacaaccaccatgcctggtaatagtagattaaagagtgctaaggtctctgccctgtgcagagagagagggagggagtgaaggggggcctggacctaaccatggtagtgacactgagaagtaatgacatctacatgagtggggtgacccaagacaacaaaaattcatctatgggtccattgtgttaatgagttacacaacaattgcttggtaactcaaaagccttcttt

SEQ ID NO: 26413 - DNA, 409 bp, Triticum aestivum
  Clone ID: PAT_TA_26413
cttgcaaaggaaatcgtttgctcagcttaataggtcattaacttaggtctgttacaagtaaataaatcctagtggtgacacaacataaaagtacgaacaacggggaagccaccaaaccgacacgagagcaaagaggactaaatcatgttgatgaatggtcatcaaccaataagcagcatatgagaatgctgtgccattagcaagtcacagcctgtactgcctggacgtgttgatggtgtctagaggaacaagatcttgggacgacgagttgggtgattctttgctgcttctttccacttattttttgtttcatcgcccacttcgcgatgcagagaaatctcctcaagatgtcgaaaggagtggactgctgacgtgctgaaagcccacgcgtccgcccacgcgtccaaga

SEQ ID NO: 26414 - DNA, 730 bp, Triticum aestivum
  unsure (1)..(730): unsure at all n locations
  Clone ID: PAT_TA_26414
ttttttttttttggaantatacnccgagagcntattagttgattggatcgaattgcccaaatacatgcaacagacagagtaaacttatttattacagcaggaagtcaccatatttcttgcaaagaaaatcgtttgctcacacttaacaggtcattaacttcgatccgttacaaataaataaatcctagtggtgacacaacataaaagtacaaacggcgtggaagccaccaaatcgacatgagagcaaagagactaaattattcgacgcatttgatcatgttgatgaatgtccatcaaccaataagcagcatacgataatgctttgccattagcaagtcgcagcctgcactgcctggatgtgttgatgttgtctagagaaacaatatcttggggcgtcgacctgggaggttctttgctgcttctttccactcattttttgtttcatctcccacatcacgatggagagcaatctcgtcaagatgcccaagggaatggaccgctgacgtgccggaaatagagccagccagatctttgcatagcagttgcatcgacctgaggcgtggtaaagctccctcttggatttccagctgaccaatcatggatttcaccagaatggataggcgtaccaggctcttaagtgtaccttttgtgatgacgagcctgccgaggctagttgcaaccagcttcaggtgcgccaggccaggcactttgctcagggtagcaagaaaat

SEQ ID NO: 26415 - DNA, 1091 bp, Triticum aestivum
  Clone ID: PAT_TA_26415
atgcaaagctagtcgcaacggttttcagcaagagtttgaacagcatttctctagtacaattatatagctcaaagacacaaaatcttctcttcttacaaaggtcacactgtactacggtagctacccagctcacttcaagcctccagctacaacagccccatcgccacacacattcatgaagatggccaagttacacagcaactacgctacctcagacagtcttgtatacattccacggttacaaaaaagttgcattttacagtttgagtacacgagcagctgctgctgggttcacaaacagatgcaggattggcggccacagtagccgctcactcgaggccgtaatcctcgccaaagtatttgtcgaccagcccattggccatgttcctcatcgcctcgttctcgtggaactggaacctctccatggcctcgatgccatcccccctctccacaagctgtggaccctgtccattgggataccccctcatcaccagttccaggaactgaagtccaagtcttgcgctctctatatcagcagacctgaccaaatttatgaatcctggaagggctccaccatttatgatcgagactagatgttcggtgattatgttcgggggctcggtacttcctgctggtacaacacacagattgcccagggtgtaagctgcttccttgcgaatgtcaaactgtgcactcgtgaggaggtgtattagtgaaggcgtcgcctcactggtaaaaatcaatttcttgtgctcaaagctgcctgctgctatatttgacaatgcccatgaagcctcctttctgagaaccctattgtcactcttcaaacattttatgagacttgataaagcttgatctgtgatgctgtttccaacaattaggattgaatcaaccatgtattcatccccggctacaagattccctaaaccacgaagcaccggaatgagcaactgcaagttctcagatgccagcaggcgtccaatcagcaactgaggcacatgacttcgtactattaagctgatagctttttctgaaagtgctgaaagatataccactacccatgccacctcagttgctaactcttcgtccgc

SEQ ID NO: 26416 - DNA, 787 bp, Triticum aestivum
  Clone ID: PAT_TA_26416
gcgatctagaactagtggtatatacttctttttaccacttttactttttctcagtggattcatgcatgcttctcctcataggtttcccttagttcagtacttaatttttttggtgtatactttctcctcatcagagtatacgtacaacaagatagaaagaaacctatactgttgatcgatactgaaatatcatatggaagatagccctctcttctataccccattgcgaaaagtagtatactatcaattgaaaacacaccatatactcctttcggacaatgaggatacactgatcgttattgccagtatcataggtatatactctgagaatagttgtatatatcccatttgaaaaaaaaatatgtatatactccttgagcacactgatcatttaaacctttttacataagattgtccgtctagatacaataactaattagtattttaataacttaaattgcatggcttgatcgtctgcttgagtcttctcttatgtatgagtgcaccgtgtgtgggttagtttttttgggtcttctaattctctgcggtaatttgcatctatatttgtgctaattggcaaggtgcatgaataatgatttatctaagttttttgcttaatggaaaggccttttcagttaaaaaaaccctactgatttgatcaacagaacatgcttctgtttttaaatagctgaatttctacttatttaattgactattgtggtgtcaagatccaatagccttgctattagttaatgctctatttatattttcttccaaaaaaaaaaaa

SEQ ID NO: 26417 - DNA, 913 bp, Triticum aestivum
  Clone ID: PAT_TA_26417
ggagcacacagcaggagagaggataccactgtgctagctagctggattttgggagacagtgcgtttgtgtgtgcgtgcgatgatggaggcgcacatggagcgggcgctgcaggagggggtgacggaggcggagcgggcggcgctggaggggacggtgcgggcgcaccacaccttcccggggcgggtgccgggggccacctgcacgtcgctggtggcgcagcgcgtggcggcgccggtgcgcgcggtgtggcccatcgtgcgcagcttcggcaacccgcagcggtacaagcacttcgtgcgcacctgcgcgctcgcggccggcgacggggccagcgtcggcagcgtccgcgaggtcaccgtcgtgtccggcctcccggcgtccaccagcaccgagcgcctcgagatcctggacgacgaccgccacatcctcagcttcagcgtcgtcggcggggagcaccgcctccgcaactaccgctccgtcacctccgtcaccgagttccagccgggcccctactgcgtcgtcgtcgagtcctacgtcgtcgacgtgcccgacggcaacaccgaggaggacaccaggatgttcaccgacaccgtcgtcaagctcaacctccagaagctcgcctccgtcgccgaggagaccgcggcggcgcctggctcccggcggcgcgactagaagagatgagaccagaagagcgctcccggcagttcgtggtgggaccgcgcaacctggcgtggtggcggcggccggacggccccgtggttgttagttggagttggagtactctgctatttcgccccccttttccttttctgtttgttttcttcgccctttttccgttggtgtcgaaaagagccttcggcgtgagcaagcagcctccttttcttgtgtattatcatcatctttgttcttttc

SEQ ID NO: 26418 - DNA, 565 bp, Triticum aestivum
  Clone ID: PAT_TA_26418
tatatatataatatatataatatatatagggatagggatagggatagggatagggaaagattgatgacaaaaaaaagtggagaaacaatccttcctttaatattaggtaaagataaaaaaatttacggcaagttatattcgtcgaggatggcaaatctagttagcgagcttggcaagtccgcctcatttcttttttgcagcttcttttttaacgaaacgcagttttcttttaggtgcaacgcaaaacgaaaagagaaaatgtgacgacgtacgaaaaggcggatgggcgtacgaaaaatcattgatgacaaaaaagtggagaaacaatcctccctttaatattaggtaaagataaagatttttacggcaagttatattcgttgaggatggcaaatctagttggcgagcttggcaagtccgcctcatttcttttttgtcagaaagtgttggagatatgccctagaggcaatcatgtgatgatgatatttccatatgtattcatgggtcttttgtattgtccttgaacatcatcaatgatatgtatcaataagtatgtgactaaaaa

SEQ ID NO: 26419 - DNA, 471 bp, Triticum aestivum
  Clone ID: PAT_TA_26419
ggggagaggagcggtggcaagaatggtcttgcccagggccagggaagtgatgcttctcggatcaaggaggccatggagcttgctacccagatagcttcaatgaagctaaacttcaatgcttctcgggtcaaggagatcaaagtctactaattatatggcgttacctaagagaagtctctttggtccatggagcttgctacccagatagcttctatgcttcttgggccaaggagatcaaagtctactaattatcgttatctaatatctttaagagaagtctccttagtggctccttgatggtcgtgctcgcctttctacctctaattgtgatacatgaacataaaattaatcatgaaaattgaccagaagcagtgtctgtttagacaacagggtgttgtttaagggcctcagttgtgttaatacggttcgttcatcaaattgagtgaaaatggtgaaattgctttatcaatc

SEQ ID NO: 26420 - DNA, 998 bp, Triticum aestivum
  Clone ID: PAT_TA_26420
gtccgatttcttcccaaatccccaacctggcggctgcaggcgtcacacggcgcaggctctcggcgctcctcctctcctcccgtgcgacaccccgtcgcctcctcctcctcaccggcgccgccgcctctgcgtcctcagcccacctctctccgtgggcgccgccgtcgcgaggggcgaagacggcgctgccgggaaggcccgggtactctccgctcaacgacccgtccccgaactggagcaaccggccgcccaaggagaccatcttgctggatggctgcgactacgagcactggctcatcgtcatggagttccccgccgaccccaagccctccgaggaagatatggtagccgcctacgtcaagaccctcaccgctgtgctcggaagtgaggaggaggcaaagaagaagatctactcagtatgcactacaacttacacagggtttggtgcgttgatttcggaggagttatcatacaaagttaaaggattgccgggagttctttgggtattacctgattcatatttggatgtgcctaacaaggattatggaggtgatctctttgtagatggcaaagtcattcataggccacaatttcagttcactgagaggcagcaggtaaggagtaggcctcgtccccgctatgataggcgacgagagactatgcaggttgaacgaagagaaactatgcagagaggtccttcagtacaagagcacaggccttcattttctcagcaggttcctcacaataatgggcagcatgaaatcgtaccgccaggaaggaactaacttcattctacattagtatggataatgatgttgggagttacccttctcttttccttattcatgtggatatactgaactttgttttgcattgtagcaacaaaaagtagaaaagaccgctttgtgcaatgtcatgatttggtgcttttcaaagcttctttttatgcaaacgaggaagggaatgaaatcaataaaaaaaaataatgcaaatttata

SEQ ID NO: 26421 - DNA, 1476 bp, Triticum aestivum
  Clone ID: PAT_TA_26421
gcaggtgtgtcggctctgacgacacatggcggcgcggcattggatcagagccctcccgccgtcccgcccggctcctaaccgacgagaccctagcactcatcgactctcagctggtctccgcatggccccgctgccgatggccgccgccggcggggccgtgcccgggcccagttccagccggccgcggccggcggtggcccggggcgcccgcgccgggcgcggcgcgccccggccgggctggcccactctgcgccgcgatgctgctgagcgtcggccgcgctgctcctgtgtggctcgccgcgctcgccggcgtcacggctcgccggccagctgcccgccgcgtggcctcgtccgcacgtgccggccacccagaccgacggtaggacacggcgcccagggaccaccaggcagccgggggcccgagtccgctgtctccggagaagacgtcgggcgcccggcgaccgcccacttccacggcggcatgcttcgtgcggacgccggcggcaacgcgttcccgtggagcaatgccacgctccggtggccgcgcgccggcggcacactcggcggcccctcgcatggtgctggacaccaagacaggaagcaacctccttcagtggccggtggaggaggtggagacgctccggaccaactccactgaccttggcggcgtcaccattgaccgcggctccgtctttccactcagccttcaccgcgccacccaactagacatcgaggccacattccgcctcgacccgctagacatcgccgtcaccaacgaggccgatgtcggctacaattgcagcaccagcggtggcacgactggacggggcacgcttggtcccttcggcctcctcgtgctcgctgatgccaggcgccatggtggtgatatggagcggaccggcgtctatttctatgtcgccaggggcctcgacggcggctctgcgcacacacttctgccatgatgagacacgctcatctcgtgccaacgatattgtcaagaggggcgtaggccatatccgtgccggtactcaatggcgaggagctgtccgtgagggtgctggtggatcattcgatcgttgagagctttgcgatgggtgggaggttgacggcaacatcacgagtgtacccaacggaggccatctacgccaacgccggggtgtacctcttcaacaatgccaccagcgcccgggtcaccaccaccaggctcgtcgtccacgagatggactcttcctacaaccaagcctacatggcctcattgtaaaaagaaaatggaaaaaaaattattttgtttagaaaaaagtgatagatagcatattgtacgcatgtttttacacaaaggaagatctctcatttcttcgttgcaacttttctgcgttgtctgatcgatctccaccaagtttttttttctcatttctgcattctaccaatggccaccaagataactttatacaaattttgaattcaaattcttttaag

SEQ ID NO: 26422 - DNA, 1627 bp, Triticum aestivum
  Clone ID: PAT_TA_26422
aacccggacagtgccatctggggcaacaagatcgcgtgggggcacgccgcctcccgcgacttggtccggtggcgccacctccccgtggcaacgtcccctgaccaatggtacgacatcaatggcgtttggtcaggctctgccaccgtcctccccgacggccgcatcgtcatgctctacaccggctccaccaacgcatcgggtttccaggtccaatgcctcgctttccccaccgacccctccgaccctttgctcatcaactggaccaagtatgagaacaacccggtgatgtacccgccaccgggcgtcggggacaaggacttcagggacccaaccactgcgtggtttgatggctccgacgacacatggcgactcgtaatcggctccaaggatgatcaccatgccggtatggtgatgacgtacaagacgaaggatttcatcgactacgagcttgtccctggcctgcttcaccgtgtaccagggacggggatgtgggagtgcatcgacttgtacccggttggcggcgttaggggcatcgacatgacggaggcagtggccgcggcgtccaacaacggcggtggtgatgttttgcacgtgatgaaggagagctccgatgatgaccgacacgactactacgcgctgggaaggtatgacgcggcgatgaacacatggacgccgctacgccgaggccgatgtcggcgacatggggctgacctacgactagttctacgtgtccaagaccttcgacggcggcctgcgcacacacttctgccatgacgagacgcgctcatctcattccaacgatattgtcaagagggtcgtaggcactattgcccccgtgccgaatggcgaggagtttgcgatgagggtgccactggcccactccatgggcgtgccctttccaagcgccggggtggtggacggcgacttcaccggtctacccctcggaggccatctacgccaacgccggcgtctacctcttcaactacgccaacagcgcccgcgtctccgtcacaaaccccctcgtccacggggtggactcctcctccaagcaggcctccaacggctcagtgtaaaacgtgagtgcaaacatggctttttgtattgttaacatatgatcgatagcacggtggttgaaggctacgtcaccggaagacccgacgcaggcaatccacgcttgcgccgggctggacctctccaacactgcccccggggctcggggcaccacccccagcctcgtcatccacgagagggactcgtcctaccaccaagcctacatggcctcatgggaaaaagaaaagggaaaatgtattttctgttgagaaaaaagtgatcgatagcatatcgtccgcatgtttttacacaggggaggttctctcactgcgtcggtgctcaacagcgaggacctgtcagtgacgattctggcggaccactccatcatagagagcgttgcctcggccgggacgtccccggctacgatccatcaaagaagcgacgcgtgctgtgggggtgggtcggtgagaccgactccgagcacgctgatgtcgccaagggatgggcctccctgcaggtacttgacattttcatcatcttcttcaagtgattgattaatacctccattaattgattc

SEQ ID NO: 26423 - DNA, 2430 bp, Triticum aestivum
  Clone ID: PAT_TA_26423
ccccgcgttcggtgcgccgttcccctctccctctcgtgacggctgcgcgcttgaacccccaaccccgcacacactcccgccgcccctgccgtcccgcggccgcggcggcccctgccgaacctgcacctccagttggcggactagtggccgaggggcgtcccggcgagatgaagtacgtcctggtgaccggcggcgtggtgagcggcctcgctaagcgcgtgcccgccggcagctccgccgcccccctcgtgccccgcggccgccgcgcgccctccctcgccatcggtcctgtccctaacgctgccgcccgtgccatcgcccctggcggtccccgcggtgtgtttgttctagatgatggtggcgaggtggacttggatctcggaagctatgagaggtttctagacattaagctgacacgggacaacaacataactactgggaaagatctaccagtctgttattaataaagaaagagagggagaatacctgggaaagactgtgcaggttgtcccacacattacaaatgctatacaagattggattgagcgtgttgcaatggttcctgttgatggccaggagggacctgccgatgtctgtgttatagaactgggtggcactataggggatattgaatccatgccatttattgaagctctaggtcaattctcctatcgtgttggtgctggtaatttctgtttggtacatgtcagtctggttccggtattgaatgttgtcggtgagcagaaaactaagccaactcaacacagtgtacgtggtctgagaggacttggtctcacgccaaatatgctagcttgtcgcagtactaaggagctagaggaaaatgtgaaagaaaaactctcccagttttgtcatgtgccggctgctaatattttcaccctatatgatgtttcgaacatttggcatattcctttgctgttacgggaccagaaagcacacaatgctattcttaaagttctgaatcttgaaagcgttgcccaggagccgaagttggatgaatgggtggcaagggctactttatatgacaccctacaggatgaagtgaggattgccatggttggaaagtacactggtctgtctgattcgtacctttctgtgttaaaggcacttttgcatgcttctgtctcttgccacaaaaaacttgttgtagattgggttgcttccactgatcttgaggattcaactgcttctgaggcgcctgatgcttacaaagcagcatggactttattgaagggcgctgatggcgttttagtgcccggtggctttggagacagaggtgttaaagggaaaatgatggctgctaagtatgcccgtgaaaacaatgtcccctatcttggtatatgccttggcatgcagcttgctgttgtagagtttgcgcgccatgttatgaaattccctgatgcggacagcacagaatttaatcccaatacgaagaccccatgtgttatttttatgccggccggggcaaaaacacatatgggtgggaccatgcgccttggatcgaggagaacatttttcaaggttactgactgcaaatccgccaagctctatggtgatgtcaactacgtacatgagaggcatcggcacagatatgaggtaaatcctgatatggtgccagcatttgaaaatgctggacttcagtttgttggcaaggacgagactggacagagaatggagatcattgaaatacctgatcaccggttcttcgtcggtgtccaattccatccggagttcaacgtcaacgccttcaaaaccttcacctccatttgtcggactaatcgccgcagcatgcgggcaactggaccaggtgtctgcaggacagcgtgcaatggccatgtggttgcggctaaacacaagctcggcgacagcttctcgacacccctagtacaccagaacgggcacgcgcagaagcaagccaatggtggtgtagcaaatggaacctgccatgccaacggcaatggcagtacccatggttagcgcgccgcgggtttcgccaaggggatcatctcgcctgtcttctgtggtcctcatcgtcccgtcgactgcgacaacggctgagcaacttatcagcagggccggcggccctacaagaagggcgacggtcagagcctaggaaaaaaaatagaggactagcattttatacatgagcacctttgtatagtattaggttctgtgctgatatgcagccgaatgtttttgatccttgcgtgtggactaaataataagctagacatcttagaaggttttagttgtcgagacagagcccgggtggttgggtgtgtactttgatttcctttaagaaacttatggttactgtttcttcccagttaattcccagtttctttctctgtttatagtttgtagagctaactaagataagcttctttgcattcaaattaaaagttttgggtc

SEQ ID NO: 26424 - DNA, 1406 bp, Triticum aestivum
  Clone ID: PAT_TA_26424
gcgccgcgcgtccccccctccaccccccgcgcgccgcgcgttcagccaaccgtccccggcgccggcggccggcgaggatgggtcgcgacaagtcccggaggctctcgggcagccgagacttccggcagcggctggtgctggcgacgctgacctccacccccatcaccatcagggacatccgcgccggcgaggggggcctccgcccgcacgagatgtccctcctccgcctcctcgacaaggtctcggaccagcacgtcatcgacgtcaacgacacagggacgaaggtcgggtacaagcccggggtggtccttggcgggaaggacctggagcacgactgcggggtgcaccgcgggatcggctacttcatcgagccgctcattctgctcgggctcttcgccaggtcgcccttgtccattcggctcaaaggaatcacgaacgatacaaaggatccttctgtggatactttccggatggttacgttgcatatgctcaagcattttggcgttcctcttgagggactggagctcaaaattgaaaaccggggagctcctcctcgtggtggtggtgaagtgcttcttcgagttcccaatataaacagtacattaaaggcagttaatgggattgatgaaggaatggtaaagaggataagaggtcagcaggctatggcgtatcagtggttgctgagcccacaacaggctgtctgatttctgcagatgctactgtgagttatcccaatgttgatgaagtgagtgaacaatctaagaagcctgagctaatgtctccagaggatcttggtgagcaagttgcatcgatgctgctagaagaggtggctcacggaggagttgttgactcaacacatcagggccttctgttcatgctgtgcgctctatgcccgcctgatgtgtcaaaggttcgcgtgggacagctgacaccgcacgctatagaatcacttcgaaacatcaaggagttccttgatgtcaagttcatcatcaagcccgacccgaactcaaacacggtcactctaaaatgtgttggtgcgggagtgaagaatcttgctcggaagatttcataaacagaactatcatgaacctcatctaggatggaaaacagtgttttggaaccgcaacacaagaattttcaacttttgttgcaagtgtgtcgtagatcttcttccctgtagtagttttgatgtaagctagttgatccagaatggatttatgtaccctcctgagaaaacatgggtgtgagctttccatttgagatcacacatttgatgtgcttttacttcttactagcctggaacatctagcaacttgtgactacaaatcgagcatgccattatactcttgtcaaaaggtctattatgaaaggtaatgaaaaagaagatgaagctagcaaaaaaaaaa

SEQ ID NO: 26425 - DNA, 752 bp, Triticum aestivum
  Clone ID: PAT_TA_26425
tcttccgcaccgacggcgtcgacgaggagcacgtcgtccagctggtcgacaccttccctggccagtccatcgacttcttcggcgcgctgcgtgcccgggtctacgacgacgaggtccgacggtgggtgagcgagaccggcgtcgagaacatcgccaggaagctcgtcaactccaaggagggcccgcccacgttcgagcagcccaagataacgatcgagaagctcttggagtacggacacatgctggtggcggagcaggagaacgtcaagcgtgtgcagcttgctgacaagtacctcaacgaggctgctcttggtgaagccaacgaggacgccatgaagactggctccttcttcaagtagaaagcaactcttgctattgctagctaggcgcgaggccggcataggatcgaggagggcgccaccaaaatgcattggagctaacgaacagcgaggggcgatcatggcagctctgccactacatcttctaaacttgccatttttattatccctgatccatgtattactcttaatttgtacgtactacaatacgggatctggccaagcgcgatatatagctgggcatgcaaagtttttgtcgatgttttttttttttttgaaagaaacaaggtagaagggctagctgcctgttaaattaaaaacaaggtgagccaagactagcagaacaaggctgtacaaaaaaaaaactacacaaagtgtgccaaagaagaactctcagggtcggccttatatatc

SEQ ID NO: 26426 - DNA, 741 bp, Triticum aestivum
  unsure (1)..(741): unsure at all n locations
  Clone ID: PAT_TA_26426
tcggcacgaggagttgatccgttatgttatgaggctctcgaatgccttgttgataactacatgttaacgtgcgaggaagaatctgagttattggcctctctgaaattcgggaaagaagacgggtggctgtcagcattctactcatgtttgattaggaagcatgaaaaagaatatgtagtggaagcaaaattcaaggaacttgaacgcgaatcttgcagtatttctccaagttctggtcaaatgatgaaaaataacatcgatgttttggcttgcaaagctgaatactaccatcagagtggagaataccaaaaatgttttgagctcacatctgttttacttgaaagggatccgtttcatttaaaatgcacattagtgcatttggctgctgctatggagcttgggcattccaatgatctttatctcttgtcatgcaatttagtgaaggactatcctcaaaaagctatttcctggtttgctgtggggtgctattactactgcattaagaagtatgatcaagctaggagatactttggcaaagctacagggttagatggcacattccctcctgcttggtttggtactggtattgcttatgctgctcaagaggagggtgaccaggcaatggctgcatttaggacagcagctagactatttcctggatgtcatctcccaactttatacatgggtatgcaatacgtgcgaatgcataatttcaaacttgcggnagcagttcttcatgca

SEQ ID NO: 26427 - DNA, 968 bp, Triticum aestivum
  unsure (1)..(968): unsure at all n locations
  Clone ID: PAT_TA_26427
cggncgcgtgggcgacgacttcgcccgcgtcgcgcaggacgaagggcggcacttcgcggtgctctccgcgcggctccgggagctggggtcgcactacggcgcgctccccgcgcacgacggcctctgggactcggccatgcgcacctcgcactgcctcctcgcccgcctggctgtcgagcactgcgtccacgaggccaggggattagatgtccttccaaccaccatatcaagattccgctctggtggggatgaagaaacagccaaactgcttgaagacatcatttatccagaagagataacacactgtgcagctggcgttagatggtttagatacttgtgcctccggtccctccccagtgatccaattgcacctccagttccgcagcctaaatcccaatgctctgagctgctggaaggtaggacaggtgacgataataagacttctcaagcggtgcatgatggattggcagataagccgacagaagatattaatagccatgacgaggcggttcaacaagtgggcgatggactggcaaggtgcagcctaggcgacgccgatgaaatggcaatcattgagagattccacagcatcgttagagagcatttccgaggacccctgaaggcccccttcaatgcggaggctaggaaggcagctggatttgggcctgcctggtatgaacccctggcggtgaaggaggttgagacacaagcaatcgagcaaagtgagtagtgtttgtgctgttttccctgttatactggtagggcagaagacacaaaatgggtgccacacctttagttcaatcaggttttggtgttcctttcttgctagcagagactggtgaactggtgatcctgtttgttttggcattggcaaactgcatgaaatgtacgtgactaaccgaagtcaaannccaagagagtgtacgtgaactttcnactgaatttttgatgtttcaggtacttgattt

SEQ ID NO: 26428 - DNA, 896 bp, Triticum aestivum
  Clone ID: PAT_TA_26428
cccagtagtactaataacactttggtttccctaagcttcaatttagttttgttttcgcattacttcttttcctatgggttggagtgggagctatgatattctcttttcacgatatgattatctgaaagatactaagcaaacaattatttttaatacacataggatagggacatgagttttaacttcctctggttgtgaggagataataaagaagctgagagatcgactgtttgagaagcgggttcaggagatcaaagccaacaacaacctaggctttgaaaaagatgtttacaatgaaaaactgaggaagttgtgatggactgaaagatttgcttgaagcaaaggcatccacctgggatatatatggctagaagctacagcgagcaactgcttcttttcagctgctaatgagatatttatgtgttcataggttatgcccttgttggtaagtttgtgagtaaggtgtcgtttgaggggagtgcatcggggcatcgggcggtcgtatgagaagaagtgcgttcagctgaggacccatgatgccaacggtgcagagccgttcaccatcgagaggatcagggctgccattaggaccttcgaggcgaagctcaacatctccgccgcctttctcgacgaaatctcccaaaggctcattgccgcttgcgataactcatagcgctcctctccttgccgagcggttgaagggaggcatcagaggcatgccgccgccgccagcgctgaaacgtgcagcaatttctattgttgtatgttatgttgccatgcaacaagatgcttttgttgatggtattatattgatgtgtgttacctgtgatgtgatgaaacactgatgagattttaggttcttactcatgtgatgcatcaacataataagtttatga

SEQ ID NO: 26429 - DNA, 989 bp, Triticum aestivum
  Clone ID: PAT_TA_26429
cacgcacgcgcatccatctctcccgatcccgtcgcactaaccctgccccctccatcctcgcgagatcaacgcctccctgccgccagcgcctgttcctggccggatccgccagcctcgtcccttccccgctcgtccttcaggcagcaaactccggcgaccccatcgcccgttcctccctccacgctcgcctcctcttgtttggatcgagcaggatcccttcccgagtggagcgctcgtttcagccgtcggctgcgagctgcaggtcaccggagcagctccaggcagctacctcgcacgctggggaccctcctctaccgcgccatgctccttccccgagctccacctcgccgtccttctacacatcgtcgccgaagacccctgccccgtgtaccatcctgttgctgccgctggacatggagtatgcatcgtcacgtccgtttcgtcgatgtcaagcccaagagggcgccaagataccaagtaccacgacgtcgacgaccatcaagttcaactacatcgactatgatcggcgacgacccggaacatctacggagtgtgtacgagtactgtcgccgaagacccgggtagcaaaaatgtcaagtacctatgaccgaagaacgccaagtacctctccgaaaaatgaacatgtaccactacgtacggaggcatcggatccgtcaagttccactatgagatgtacaactatcgtcgaccccgaagacctcggattcaccaagttcccacgacgacccgtgtaacccgtcggatcgccaagttcgattaccgtcgcaaccatgtacaactacttccactaccgccgatgaaggtcgttgagtgaacaaactatcgacgacgtgtacgactactccgtgaacgtgtaccactaccgctgctcgaacgtctacagaacatgtaccgtcgacccgtggacgtcaagttccttgttttgaccccgggtcgacggtacatgttctactagttctagatcgcga

SEQ ID NO: 26430 - DNA, 1137 bp, Triticum aestivum
  Clone ID: PAT_TA_26430
caaggcttgaggcatccggaatttgagaccaaagcagtcttgtttctctgcagcagccgacgctgctgatgcccgagccccaccaaatccaccaacccccgcccccgcccccgcctccaaccgatccaaaccccgttgcctccacggctgcaaatgcccggcgcaatccggccccgctgccgctgccgttgcctttgccggagatcgcggtgccgccggtgcagccgaagatgatcataaaggggatgctgggccggtacgagcggtggaaccccgtgcacccgacggcgggcgccttctggggcgtcgggctggggttcggctgcggcgtcgggtggggcccggggtttgggcccgaggtcatcggctacgtcggcgccggatgcggcgtcggcttcagcgtcggcatcacgctcgccggtgtcggcgtcgggctgccacagcacggcatcatcaggaaccactaccacggtggaggttttgcaagcaatgtcccattcgaatcagcaaggttttacctcttgaccatgctaaaaggtatggtatgggatgccatcagttatgcgagcaacgtcgcagctatgaggaaagaatctcgacagaagcttttaagatgtcaggagaaccctcaagtttcaggaggatttgatctgcccaagctggggaaaggaatgtccagcagcttccgatcaacgatggagtgtatcaaggccttcacaaatcagcattggcctccataggcagcacccaagtaaactgaagattgataaaccgagctttgtgtgcaaaccacccacccgggatcaaagcctgggtagtggtacccctttcactgagtgacaatcgggtagtcggatgcaggtggctcgtatggcgtccaccacagggttgacgtcccttttaatgaagaattaaggacttgtactttatgaataagaacccccatagcacatatttcttcatcatatgtttgtggcatgagcaagtttaaatttttatggttataaggggaaacaattccagctgaagaacatgctagcctgtaatctagctagtgatgaatcgatgtgtaactataacaatgatgttcatccatgcacttcgcagaatcttgtattgtgaaatgaaactccattc

SEQ ID NO: 26431 - DNA, 995 bp, Triticum aestivum
  unsure (1)..(995): unsure at all n locations
  Clone ID: PAT_TA_26431
agcctgcgccgagtcagtgcatgtgtctgatgtcctcgaaccagcattcgacttggagaagacatattttggaggtgaaggttcagatattcagaaagaattgcatgaagggtctactcttgtcacgagagagtacatggcggttgatcccgccccttgtgccgagccgacagacgtgtctttaacagaacaaaatcgtggagctttgtgcatggattcactagcagcaatagagcaattcatgaccgcctcgccggaggaagaaccacaatgctctagccccattgcgttatccccatggggtgaatctggttactatcaaggtgatgctgttgattctggactagggggggtccaagatgacacaatcaatgaaatgtggtcattgctgtcaccgacgcctactccccaaaatttatctggggttaaatccgaggcggaaggtggtgcccatgttgtcaacgcggcaactgttgcccaaggagagtacgactttttccaaagagatccaacaccaggggtgcattggggactgactgagcangtgaaaccaaaagcaactgctgcatcagcatcaccgatagatgtgaatgtgagcacaggagcatttggctggcaaccatcanccagtgagagatcaaatgctgcatcagcatcaccgatagatgtgaatgtgagcacaggancatttggctggcaaccatcaactgacnaganatcaaacncggnaccccatggagcacttgctacaatccaaacatntacttaanctatngancancancangancancatnctttnttanaaacctctcacaagcancannancacccttttttaaaaanctnttaannancaccantnnaacnannaatccnccnnnttnnnatncttcttaatttnnaaaggggccctaangaanttnnnnancntncnttttgnnaacnaannncccnaanaanctttnaaacccncccccnttnnnnaattnncc

SEQ ID NO: 26432 - DNA, 520 bp, Triticum aestivum
  Clone ID: PAT_TA_26432
cccccaaccatctgatccatccaagatcgtcgtgctccttctgaaaagtgtcgatcgaagcggatacttagctagctaggcgatggccccgagcgcgtcgatgctgttcctgagctaccaccagctgcaccacggccccgccgacgcgccgcacgtcgacaaggatggcgccggcgcgggcaccggcggcttcaggttcggcttcggtaatgtcttcttctccctcggcgtcctggcgccgaagcggcgggatgcggcggtgcacgacgggaagcagagggcgcgtcaggccggcggcgaggaggaggaggaggagcccgcgacgctggcgagcaagttcgatgaggccgtgcggctcagctgctggtcgtcctgaagcttatcttaatttccgcgtgctcctgtagcttctgcctctttgactgtgcaagcatgtgctgtgccgatcgttgacaatggcaggatatgtgtagataaaatgtgactgtgcatatgaatttcctttctttctttctgtgtg

SEQ ID NO: 26433 - DNA, 728 bp, Triticum aestivum
  unsure (1)..(728): unsure at all n locations
  Clone ID: PAT_TA_26433
attccatccccttccaacctgatcctacccaacatacccaacccaatccaatctgatccaatccaagatcgtcgtgctccttctgaaaagtgtcgatcgaagcggatcatacacctagctaagcgatggccccgagcgcgtcgatgctgtttctgagctaccaccagctccaccacggccccgccgacgcgccgcacgtcgacaaggatggcgccggcggcttccggttcggccttggcaatgtcttcttctccctccggcgtcctggcgccgaagcggcgggatgcggcggtgcacgacgggaagcaagagggcgcgtcaagcgcggcaggccggggaggaaggaggagcccggcggacgcctggcgagcaagtccgatgagaccgtgcggttcagctgctgggcctcctgcaatcttatcttacttgaattccggcgtgcccttttaccttctgcttcgttcggcagtgcaagcatgtgccgtaccgatatgtgacagtggaaatatattcgtatataaaatgtggatgtgcataagaatttcctttttttctttttgtgttaaatcctgggtaaaactgttttctgaaaaaaaccgatctgaagatatcgccaaagggctcatagncctaaggcgtcgttaaagtctacnggaaacctggttncaantancctgaaanccctttcagngtaaacaangcnacattcctcaattcacangganggg

SEQ ID NO: 26434 - DNA, 594 bp, Triticum aestivum
  Clone ID: PAT_TA_26434
attccctgtccctgatccggttgtggaactagatgctgattttaaggtatcattgcgaagacatgatagctcatcattttccaccactatcattccgaaaccttagtcggagtttaagggtttcaggaaatgatatgttctcacaaccaatattggcccgtaggtttagtgtgtgcgaccctgttaacataggattcaggccgagcgattttgatggaaatttcaagtgtatcggatcaccagttgatgagtatattgaggagggtacaagtaatggagcatatttttcaccattcccatatggttatggtacttaaacacctatggaagaagatgaagagcagccaaatacttctaggtgtccaggtattgtttggttgccagcaaacagatggttggcagatttctcacattttgggtaccaggcatcgccccggtgaactccgaggccaccatctgccatctccggggggtaccctgccgctgctgttccgttggcggcgccgcgtgcttgtgtcccctccgctcgggggcgtccgccttaaacttctaaattataaactagatatcatgttcagcgtaattcggcactaa

SEQ ID NO: 26435 - DNA, 798 bp, Triticum aestivum
  unsure (1)..(798): unsure at all n locations
  Clone ID: PAT_TA_26435
gaggatcactcccagtttcaccggctaagcttaagctccctcgtgatctcaaaaaccatctttttttcctctttccacctcgtgcttaccgacggggtccctccctgccatggagtccgtcggcgtcgcccctgcccccgcggcggtggcggtggcggagcagaagatgaagcttctcgagccgaggaaggagcccctcgcctccgccgccgccgccgccgccaaggcgccgtgcaagtgggcgatgaagaagaagctcgtgggcggcgacgccggctacgtgctcgaggacgtgccccacctcaccgactacatgcccgagctcccgacgtacccgaatcccctccaggacaaccctgcctactcggtcgtcaagcagtacttcgtcaacacggacgacaccgtcacgcaaaagattgttgttcgtaagaacagtgcgagaggcacccacttccggcgcgccgggccgcggcagagggtgtacttccagcccgacgacgtgaacgcggccatcgtcacctgcggcggcctttgccccgggctcaacacggtcatccgcgagctcgtgtgcgggttgtacgacatgtacggtgtcaccagcgtcgtgggcatagagggtggatacaagggtttctattctcgaaacaccgttacattgacacccaagtcagtgaatgacatccacaagagaggggggaccattcttggaacttcaagggtggacatgacactgccaaaantgtggatagccttcaggaccgtggcattcaccaggtctacatcattggaggtgatggt

SEQ ID NO: 26436 - DNA, 598 bp, Triticum aestivum
  Clone ID: PAT_TA_26436
acacatcaacttttggtgtgatggcaacgccactaatccattcaggtgcaaggtacccgggagttcctctcgttgtagtcagtactcggctaaattcccttcccaatagctttgccatcccaaagtctgcaactttgggaattagtgaatcatcaagaagtatgttttctggcttaatatcacagtgtatgatgcagtctcgacagctctcatgcaagtaggctaaacctctagcaacccccagggctatctgatatctaatagtccaactcaatatcattgaattgtttcgaaatagatggacatcaagagagcgatttgacatgtgttcataaacaagcaacctcttggaaccctcacaacaaaaaccgacaagcttaactaaattgacgtgttggacagctccaattgagctcacttcagctctgaattgcttctctccttgataagcaccgtcaagccttttcactgctatagctaccgagccatttaaaaaacccttgaatacagaaccaaaactgcctgcccccaacttatctgtgaattttgttgtggcttgttgtaaatcagtgtatctaaatgcaatgattctattgca

SEQ ID NO: 26437 - DNA, 635 bp, Triticum aestivum
  unsure (1)..(635): unsure at all n locations
  Clone ID: PAT_TA_26437
agctgtgtcactggccctccttccctccggagctctctcctcttgctccgacccaacaacaggtgagaacagtttgcgctagtagggtttcgcccttccgtttctaagggaaacaggttggagctcaagacgccgcaaagcccaagatgttcggtttctctcgtcgccggatgaagctgggaaggttgaagggtcatctgcatgatcctttccatggccctcggagtcctgcccatcccaccaagcggtccagtcacctcactggagaagaaccagtggttacgtcagtgagtggccgtcctgacgaccttgcttggtgttgctcctctgatacttttgacctcaatggccgtgcatttgaaagctcagagaactgggcagtattgtcaacggacggggataaaccgagtcctcgttttgatcatgcagcagccatggtagggagcaaaatgattgtcttcggtggagattccggtaatcatttgctggatgatacaaagatattaagcttagacaagcttacatgggattctgtggcttctaaggttcgtgtatcaccaggtggnacgtcgtgcgcagtttcgaccatgcaaaggacattgcctggttccatgggacaagactgtcattcttgt

SEQ ID NO: 26438 - DNA, 518 bp, Triticum aestivum
  Clone ID: PAT_TA_26438
cactggcttgcggacgcatgtccacgcagctggcgctgccagcctgactggtgggttcgcaaaagttgaagaaaataaaacaacacaaaaataaaaaggctggaatatccttcccttcatactccatcataatctactcaggattaatttcaatgctcaaaacaaatcagaaatatcttggaaaatttcacatatgcttctacttacataatataactctgtgaaaatgtccaagccttttcaggagtatttgactgtcctttttcagatttgaattcaaatatgccccgagtttgggtttgaactgtaacccggtgatatgaaattctgaaattcattaatcttttactagagtttgtaaagaacacatgactctaacatatagcatggagtatgacttagacatgccaaactattttaaaaaattgtttgtaaataactcttggtttggatcagttttttgcgtcttggaaaacatgtatcatcacgaaccatctatctatcatcaattcgtatgt

SEQ ID NO: 26439 - DNA, 1339 bp, Triticum aestivum
  unsure (1)..(1339): unsure at all n locations
  Clone ID: PAT_TA_26439
cggggtcggggcgcgggctcaggtctggggtgcgcgcgctcgggccggcgtgggtgcgggcggacgccctgctcccgtcccacaaggagcagaaggtggagctctgctcgaagatgaccgagctgcaggaaaggctctcggcgcaggtgcccaacatcttgtaggatctactccacaagctcgctacaaggcgcaatttgctagggctaaggtagctagcaaattggtgttgtcaagggattcacaggaaaagatttcgtcgcacgtgctagggtctttgcagaatgttacgttgattcgggcgtcatgcccctctgtttgcctccctggcttctcagtgttcgaagaacattgcagtactcaaacagttctggctctccctgtgtttcagaatcaggatctgacatttatatcaagagagaggtcatacagaagttgagacagcacctcaggagacgtgatgagatgatcatggagatgcaagcacagatagctgatcttaagaactctctcagcatcgaggagacgcagaccgccaatttgcagtcccagctggatggtgccaatcgagatctgttcgaatccgacagggagatccagcagctaaggaagatcatcgcagatcattgtgtggctgaagcactctcccgcgacaagcccttgcaagctggaaactggcaaccagatgccgccaatgggcatgctaatggctatgctgatagcagcatcgatgaccctgagctgcactgtattggtattgagaagaggaacggcgaggcagagagggtggagatgctcaagagagaggtcggcgagctgaaggaggtcatcgaagggaaggacttcctgctccagagctacaaggagcagaaggtggagctctgctcgaagatgagagagctgcaggaaaggctctcggcacaggtgcccaacatcttgtaggatctactcgtcaacctcgctaaggcgcagtttgcaagggctaatgtagctagcaaattggtgtcgtcaagggattcacaggaaaagatttcgtcgcacgtgctagggtctttgcagaatgtttacattgatttgtttctttcctctcagtttctgtcattggttgctcagtgtcagaaaaagggcttagttttttctttttcagttgctagggctaaggtagctttagattgaacttggatgagtgttgtacaggtatttcggtcttgaggcgtgatcatgtaatgtgccccctcttttagctcagcgtggtttacgccggtgtggcttcgaatatgtggatgcttacatttctgaagtttgctttgctagacannnnannnnnnnnnnnnnnnnn

SEQ ID NO: 26440 - DNA, 740 bp, Triticum aestivum
  unsure (1)..(740): unsure at all n locations
  Clone ID: PAT_TA_26440
gctcggnagcggcgtaaaccccgcgtactgcatctccaaggccgccgtgattggcgccgtccgggcgttggccggggagctggggagttcgtcaggaatggcgccaaggtcatcctcaccgacatccaggacgacctcggccacgccgtggccgccgagctcggccccgacgcttcctacgcccgctgcgacgtgaccgacgaggcgcagattgccgccgccgtcgacctcgcagtggcacgccacggccggcttgacgtcctgcacaaccacgccggggtcaccgggaggatgagtttggagtccgtcgcatcgctcgacctggccgacttcgaccgcacgccatcgcgacgccgttcgggctgcgcgggatggcagagctgctgccggagacgagcgaggaggagctgaggcggatggtggcgacggccatgaacgagatgggcgggagtgttctggaggtggaggacatcgcgcgggcggccgtgtacctggcgtccgacgaggccaagtatgtcaacgggcacaacctcgtcgtcgatggcgggtttaccgtggggaagctgattcacatgccggatccggtgagcagtgcgtgacaggcatggcaatgaaagcgatggagatgacgcaaacatgccctagttcccctagctacaagtattgtggtacagagggagtagtattgaaatacccatcgtccccagcatgcgcaataaataagggcccgtattttattt

SEQ ID NO: 26441 - DNA, 428 bp, Triticum aestivum
  Clone ID: PAT_TA_26441
cccctcgagtatttttttttgtcttttttaattaaccgttgtaatagctgaaattattaatgtagatagacattatgccagcaaaagcactgatctaattcaccggcagctggccagccgtaaagaattaggagataagttactccacacagtctggttcagaagatcgccgccaggcataacatcttctcatgcctaccatctacatactccagaaaatccaatctactggagattactatttacagctttgtgagcgatttagacattcctctagtgaaacgcaaggaatgcaactgatggaaagctgacaccagaaatcaaagaactctcagttgagttagaaaggccgcgcacaagtccagaaagaggagctgtggcccactgactctttgcaaatcgaggaggtatttctccgtccctggttt

SEQ ID NO: 26442 - DNA, 1047 bp, Triticum aestivum
  Clone ID: PAT_TA_26442
ggacggaccctcctcggctgtattcaattcctcttcataagtctccgatcggatctcccggccgacgcaccagcgccgacgatggagccccagccgcccacgtccacggaggaggaggcggcggcggggtcgacgacccctcggtttaggctcgggaagcagtcgtccctggcgcccaaccgcggcggcggcggcggtgaaaacggcgctgaggcgtcgggagaggccgccggcgtcgccagtttccagatgatgtacctggcccacgagggcaacgcggaggggatacgcgagctcctcgacgccggcgccgaccccaacttccgcgactccgacggccgcacggcgttgcatatctccgcctgcgagggccacgccgaggtcgtcgagctgctgctcgaccgcggcgcggaggccgtcgtcgaggaccagtggggaagcacgcctttggcagatgcgatgcattaccagaatcatgatgttatcaagatcttggagaagcatggctcgaaccataaggttgctcctatgcatgttaacagcgatcgtgatgttcctgaatacgagattgatccggacgaacttgacttcacaaatggcaaagatttagctaagggtacatttcggaaagcaacatggaggggcattctggttgctgttaaaaagctggatgatgatgtacttactgacgagaacaaagtacaggcattcagagatgagcttgacgttctgcaactaatacggcatccaaatgtcgttcaatttctgggtgctgtaacacaaaccaacccaatgatgattgtcatggaatttatgccgaagggtgatttgcgcaaacacttgaataggaaaggagctctggaacctttatatgcagttaaattagctcttgatattgcaagaggaatgagttacttacatgagcataaaccccaagctatcatccaccgtgaccttgagccttcaaacatattgagggatgataccggacatttgaaggtggcagattttgatttgtgtaagatgctaaagtggagaagaaaagtc

SEQ ID NO: 26443 - DNA, 1199 bp, Triticum aestivum
  unsure (1)..(1199): unsure at all n locations
  Clone ID: PAT_TA_26443
ggcacgaggaaaaaacagcagctaggcaggcagctaagaagctaagctaagtgctcagtgaaaatggtgtccgtcagcttcaagatccatggagccgttgccgctctcctcctcggctccctcattctctgttccggtgcgtccatggaccagccggctgcttacaagcacgtcgctccagctccgacgccggcgccggcgccgatccagccggtgatcatcgtccagggtctcatctactgcaagtcctgcaacctccgcggctacaacgccggcatggacgcctcgcctctcgccaacgcgacggcgaagctggtgtgctacgggagcaagggcgggtaccgggtgctgaacatgacgagcacggcgacggacgagagcggctacttcctggtgatggtgtacgacctggccatgttcagccggcgcagctgccgggtgtacctccgcacctcgcccacgccgctctgcgacgcgcccttcctcccggccgacgcctcgctggggatcgtcctcaagagggaggaggtgaggccgtcgtcgccggcgggcgtgcgcggcgtctacagcgccaggaccgcgctcatgtacgcgccgcgcaagggcggcaagtgccccgcctacaactactgaggagtgaggacggacacgcacacgcccgcacgtgatgagatgggcaagtgttgtgggtcgccgtggtatggtatgaccacgaacgtagtcggggactcggaggcaataataagcaaagattgttgtcgcgtaggtttgggtcgttctagttggtttgggtctagtttgtaatccatcgagtacttgttgtggttcgaacttgaagttgtttccatgttgatccgtaaatttgaaataaaactcaaatnagtcnctctctctnattttggcagcctgtgntctttgtgtaacanancaatcntctccttgtnantanatgttccctcttttgcntcaaaacaanaaaaattgcttttgtcctccacgtaattattctatggaagattggtagtttctatgtgtatacactacattactgatcttatancantcttagttgaancatgatatgtccaatttgtaangggaacatgatacactgaatactaggttgaagcatnataggcaatttgtacctgactatcaatcangctaaaacnatcanaggttcatctaaagatcacgtg

SEQ ID NO: 26444 - DNA, 624 bp, Triticum aestivum
  unsure (1)..(624): unsure at all n locations
  Clone ID: PAT_TA_26444
atttatgggagaaaggattggcattcgtatgctaaagccgtctgaatgtcgagaggacgtgngaaatctattatggataatactggtcttgccagcgttagtgccctactctgataaggctgctgcagtctgaaccattcattgtctggcacgcgtgcgcagacgatacactgacgatcgcacaagcacatcagcgtgtacaacaggtatttgatgaagaatttgaggcagaacaatgtgaaccttgctaaagtgcacaacattaggcagtttctttgggtcgacggagaatgtgcctttcacaaaaagagcttcaaggagcttgtgtggcaaaataagccgcgagcaagcggctgatgatgttagttaaacgatggaggtgattgtggagcttggttcaaaggatcctcacttcacatatcatgtgcaggcagataaggaggggaggataaacgcactcatgtgggtaaatggggacagtagtctggtgcaaaaaagactagcttattcttaaattttctgtctctatactgaatttggtgtgtaccgataaatcatgtagcgtgtgagatccatcatgcagtttaactgctaaaattatgttatgcatatgccctgaagctg

SEQ ID NO: 26445 - DNA, 777 bp, Triticum aestivum
  Clone ID: PAT_TA_26445
ccagtaccagatccacaagccagcagaaaggaagaagatgatgagcaccaaggccctcaccctcggcgcggtcgtcgtcctcgccatcgccatggcgggcgcgcacgccgagcagtgcggccacgcggccgacggcatggagtgcccaaacaacctctgctgcagcgcgtgggggtactgcggcatggacgccaactactgcggcgacggctgccagagcggcgcctgctacgagcccaaacgctgcggcgcccaggccgaggggaacgcggtgacgtgccccaacaaccactgctgcagcggcaacgggtactgcggctacggccaggagtactgcggcgacggctgccagaacgggccatgccgcgccaacatcaagtgcagcgccgacaagccgtgcctgagcaacttctgctgcagcaagtacggatactgcgggctcggcgtcgagttctgcggccagggctgccagagcggcgcctgccatgacgccgttggcgccgccgccctgccgctcagctccatagtgcaggggtgatcttgaactgcgcatggctacaagtattgcgacgggatcaggtgaggagatgagttgtggcaatgtcgatcgttgccacgtcttcttcaccggctagtttgcgttttcctcgtctttacaatcgttcccatcatgcatgcacgcatgcatgattagcgttcgggaaccacaaataatgcgtgtggcgccatgcgccgtctttgtaacctttgtaatccaataaatctgaatctcgttgc

SEQ ID NO: 26446 - DNA, 669 bp, Triticum aestivum
  Clone ID: PAT_TA_26446
tcttcgggaacatggtgctctgggctttcccaaggcttcaggtccgggacatcctgaactcgagctacggcagcgtgatcggcgtcatccgcgacgccgtggcgcgcatcaacgacgagtacgtgcagtccttcgtggacttcggcggagtggcggacgcgaacggggaggagctcgtcgcgacggcggccgctgccggcacgatgttctgcccggacgcagaggtggacagctggctgggattcaggttccaccagctcgattttggcaccggcgcaccgtccgctttcgtcccgccggacttgcctttcgaggggctcatgatcttcatgccgtcgcgcaaggcgaacggcggcgtcgacctcttcatggccgtcgccgaggagcacgtcgcggcgttcgagcagatctgctactcgttagactgatcgacccgccaggggcaagttggaatcgcttgcattcatggatgcttgtcattagaaacggtcacgtttattactacgaaacaattgcactggaactatgcagtgtatgtacagtatgtagatgttacctgtaaaatcacctgcacttgagttgttagccaaaaccgtggaggttgacctgtataagtagttcggtcatctaagaataaaaatatttacgagaaaaaaaaaaaaaaaaaaa

SEQ ID NO: 26447 - DNA, 518 bp, Triticum aestivum
  unsure (1)..(518): unsure at all n locations
  Clone ID: PAT_TA_26447
ccccgntctggcagcggcacgcgtggctacaggcggccgagtcgcacgccgcgcgcgcccatcaccaggccaccgcggcggcggaggacgcgctccagatgagcgccgccgtcttcttggagtcctggtacgccacggccatcctgggctgcacctgaacatccagcctcttccgatcatggtaccacattggtgctgcagcgtggtcgacctttgtttctgcacgagacttctagtagttcttaccgctagtgattttgtctgcggataaacatctcgttttgttcgtcggtgtgattcttcgtcgaactcctgaaactcctgatcgttgagaatgttagctagatagaatagatgcacatttggtctgcttctgctagttttgatgtttgccgtcttgcgttttcgacaagagattttgtctgtagaaaagcatatcggcggctgttcatctactgtttggactaaagaatcctcaagtcctcctgataaatgtttggatgttagatggttcatgc

SEQ ID NO: 26448 - DNA, 476 bp, Triticum aestivum
  Clone ID: PAT_TA_26448
agaccggcaacgacaggcaagggcgacgcctgccatcccagcaagaggcagcacctccgcctcccgctggccctacactgttgcaccactccttcatcccgcccccagccgcgctcgcggaaccacatgcctgattctggccgtggccacgcccggcgactcgcgcgcgccgtgcagcgcgaggtcggctccatcccatgcgctcggggatcctgctcggcatcctggataccttcccgacgccgtgcgtgcctggatgcccggatctggacaaggaggggatccggtggtgcaccccaacgtcgacggcttctcttcgccatagagctcctcaacctgcaggacaccttccaaccctcccttctacttatgcatctgaaattttcctataatgcattcaatatctatacagtatggtcaatctttttaatcttaaggcaaactgctgtccaaaaaaaaaaaaaaaaaaaacacac

SEQ ID NO: 26449 - DNA, 733 bp, Triticum aestivum
  Clone ID: PAT_TA_26449
ctcctccccccttgaatcctttgcgtgagaaaaccagctgagaactggtgatgagaggcggcaagagcagcgtcaagaccatggcagtgatgcttgcagttgtgggtcttgtggccctgcagcaaacacagcgagtgcaagctagcgtgtgttgctgtttagacctggcggtccctgtgtactatacatgccgcggctcttctggtaccatgtcacagtgttgccctacgtgtggtggctatgtatcagtcggtggatgcaggcccccatatgtccccatatctggctaccgcacaacaaccgtcaactactgcaaggtggggtgcacggcttccgtgtgcaacaaattaattccatctgttattggcagtggcaacgaaggaaaagatgccatggaacgttgtaccagtggatgtcatgatctgtgcaccaagagcagcactgacattgcaaaagtccacaatgcttaactagttaagccatggaactagatgtcaaaagccggccaaggcgtgtttatgttatgttcaataattgggtgtcacatccaatatcagtaggatgtcaaatgttacttgtgatacaaatttactatttccaataaggttaatgagatgtgcaatgcatcttcctaggaggattatgctgctcatcatctcatctgaatgtttatgttgtatccttggcttatgacatgatgacttcatgctcttaatgaaatgtagtttttgtg

SEQ ID NO: 26450 - DNA, 583 bp, Triticum aestivum
  Clone ID: PAT_TA_26450
atgctcaccgtcggcggccgcttccagggcggagctcccccatggcgacggccccggccacgctcgcgtctggcgtctccgccggcctccagcagcggcgccggcgactccgaaaagccagacctttgctcgtggagaggtaccgggacggcgccgccaagaggtatatgttggacggcgactctaagctgcaagttcagtgggagaagcatgatgaatcttcaacgaacactgtcgaagatgaaaatgcaaattcttcgattccccgggctgttagtgattttgtacttccagcaggttttccagaatctgtttcggatgattacctgcaatacatgctgttgcaattccccacaaacgtgacaggatggatctgtcacacattggttacatcaagtcttctgaagatgggtatcaaaagatggcataggagcttttggacgtcttcttattggtggacgatttggaacactttttgatgatgacccaaagaagtggcggatgtatgctgatttcattgggagtgctggaagcatctttgatctcaccactcctctctatcctggttacttccttccacttg

SEQ ID NO: 26451 - DNA, 1069 bp, Triticum aestivum
  unsure (1)..(1069): unsure at all n locations
  Clone ID: PAT_TA_26451
tccggtgaagggcaggggaagaccaaaggtgccgcccatcgacgcgtcggaaaatcccctgggtcagcctggccagcaccagcgcccctgatggcgcagaaacaacatccagaacgttctcaagaccaacatgtcgatgccactggccgaggtggtcatctgcaacacttccatggagttggagcccgacgctctggctctgctccccaacgcgctgcctctcggcccgctggtggcacccacgtcgaggccggccgggcacttcttgcccgaagacctcgccagcctcacctggctcgacgcgcagcccgccggctccgtcgtctacgtggccttcaggagctccggcttcctggacgcgacgcagttccaagagctctccgacgggctcgcgctctccggccggccgttcctgtgggtggtccgcccaaagttcacgaccggacccgggcaggatcggttcgacctcaacgcgttcaagcgccgcgtggaggggcaggggctggtcgtgggctgggcgccgcagcagcgcgtgctctcgcacccggccgtggcctgcttcgtgtcgcactgcgggtggaactcgaccgtggagggcgtgctgcacggcgtgtcgttcctgtgctggccctacttcgccgaccagttctgcaaccagagctatgtgtgcaacgtgtggggcaccggcgccaagctccggcgagacgagcgaggggtcgtctcgaaggaggaggtccagaggaaggtcgcgcggctgctcggagacggggaggtcaaggcgagggcggcgacgtggaaggaggtcgcgtgtggcagcattcgggagggtgggtcctcgcatgggaatttgctcaagcttgtcagcttgctgagacaacaatgatggcacggcctactttgacaaaggatctcgctgccagtgcgagcgcgcgagaggcattttgaccgcggcaggcggcacgcacgacgtcggccggccggccaccgcaaaaaataaataaaagcattcggttgacacttcaaaaaaaagggggggcccggtacccanttcgccctanagtggctgtat

SEQ ID NO: 26452 - DNA, 510 bp, Triticum aestivum
  Clone ID: PAT_TA_26452
ccctagcctccgccccccctcgaatccgcatcgtccagggcggggagggacaggcgctggctggaggacgatctattatgttggcaacctccctggggtccggcgggagagggaggtggaggacctcttctacatatggcgccgtattgttgatattgacctgaaggttcctccaaggccgcctggatgcgcttttgttgagtttgaagatcctcgtgacgccgaagatgcctgtgctggaagggatgggtacaactttgatggaaatcgtctaagagtggaacctgctcatggtgggagaggtagtggtggcccctctcatgatcgttctagcagctttggtggtggtggtggtggcggcggcggtggtgtgcgccggggtgtctcgattcccacgttctgccgtcgttctggtttcttgccctgccttcttctgcatcctggcacgatatgaaggaccatatgcgaaaggctggtgatgtttgtttcgcagaagtgtatcatgaaggc

SEQ ID NO: 26453 - DNA, 1439 bp, Triticum aestivum
  Clone ID: PAT_TA_26453
ccagccccccgggcccccacaacacgtacgcccgtcccccgctgctggggcgcgcagccactctcgcgctgagcaggaccaattcatcagtcctcccggcgccagccagcggccctgtctccgccgcccgcgagcaagccaagaagcacgggagcgccggccgtcgggcagcagcagcggcttcgtccatggcgacgggggatggagcggaggggactggcagaagaggggtcccttccctgctcgccggcggcggaaccgggcaggaggagcatatcgcctccgacgtcacccagctgatagggtggacgccgctgaacgagctgaagcggatctccgggagggagagggtgggtgaccggatcgtcggcaagctcgaggcctagcagcccctctgctacgtcaaaggccgcagagctcaaaggatgattgacgattgtggacaggactggcgtatttcccacaagtgttaattttgtggtagagctgatgatcattgatctgggccttgggtagggtttggttgctgtgatgaaaggctagtgttccctggatgagcagaccgggttgagatacatgggtgctgagttgttcataaccgatccggcagctgggttgacagtgactgttgaaacacttgagtttccgggaatagaagagagggtcgaacagctccataaagaattcccgaacgtacaagttcttgatccgttcataaagccagcaaaacccgatgctcacatgggaacggctggaacggtggatgtatttgttgaaggttgacgctgaggaggtattggatgcggggttgggaacaattggtagaggcaaaatccaactgtaatgatcatagatgtagaacctgcagagggaccagatatgtgtggtgcggaccgagggtccagttatttcaggtggggagccaggaaagcattgaatccagggaataggaccaggattattacctgagatcttagacacctcgatcatcgatcagacggtaaccgtgaccaccgaggaagcaatgacgaatgcctggaggttggcaatggaagaaggcctgctggtgggcatatcttgtggggcaaacctggcagcttgcttgaaggtcgcagcaagagaagagaacaaggggaagatgattgtgaccatgttcccgagcgggggcgagagatacatgaactctgacctctttgcagctgtaagagaggagtgtattgccatgaccttttgatctcacatgctacaaatgaatgaatgcctatgaatgtgttactagataatcatgccacaacggcactaagaaagaacatgaatttttctatctacaagggatcatgaattgttgttagtcattgaatgcatgtattaccatatcatctgatgccacagcggcaccaaaacagaacatctattttgtgaaaaaaaaaaaaaaaaaa

SEQ ID NO: 26454 - DNA, 303 bp, Triticum aestivum
  Clone ID: PAT_TA_26454
tgttgtgtaccaacaatgctgttagcacagtgtgatctctaagggaggaacattagctagcaggaccaaaactctggaagcaagaaagataatgagggaaatcagactcctctggtgactggaacgagaacgctgggtcagcaagtggtggaatgccgcaagctaagccgtggatcagaagaggaaaatctatttggtccgtggctcgtgaaatctgcttttccgtcgaatggctggaggcacgaattggatgcagagctatggctcttctcccccaaggccccaacgcgggcggcatttgga

SEQ ID NO: 26455 - DNA, 629 bp, Triticum aestivum
  Clone ID: PAT_TA_26455
ggcggtgcccgccgatatccggcgagccgtcggcgagggcacgacccgcgacctcccttccaccacctctctccttctcgccttcctcgacgacctccctctattccaccaggtcatcggcgagctggccgacccggagctcgcgctgtgccgcaaggacaaggggagggcagcggagctgaagggccggggcaatgcctgcttctccaggagggaggtcgagcaagcccttgggttctattcacaggcgctgcgttacgcaccgattagttctgatggcactggtgatatcttggtacctgcattatatgtcaaccgtgcctccactatgcataaattgggcctcctggaagagtgtctgcgggattgcgacagggccatctctgtttcacctaattatgcgaaggcatggtacaggaggggaatggtaaatgcatcgttgaagaattattcatctgccatgcatgatctagaggttgcattgagcatggaagtaacttcttctgggaagagcaacatagaacaagagttgaagttgatattgttaaagcctcaatgtgtgaacaaagttggaagatcaagcagtgattgcaaggatgcaagattggcacatacagcagatgcacata

SEQ ID NO: 26456 - DNA, 1140 bp, Triticum aestivum
  unsure (1)..(1140): unsure at all n locations
  Clone ID: PAT_TA_26456
gtggagtacggggcaggggacgagggcttcttcgctgtgtacgacgggcacggcgggtcgcgcgtggcggaggcgtgccggctgcggatgcacctggtgctcgcggaggaggtgcggcttcgtcgtctgcagcccgggggcggagggcagggtcaggacgaggacgacgagaacgtcacgcggtggaaggaggccatgacggcctgcttcgcccgggtggacggcgaggtcggcgtcgacgacgggaccgacgccggcgagcnagacggtggggtccaccgccgtcgtggccgtcgtgggcccgcgccgcatcgtcgtcgcgaactgcggcgactcccgcgccgtgctctcccgcggcggcgtccccgtgccgctctccgccgaccacaagccagaccgacctgacgaaatggaaagagtagaagcagctggtggcaaggtcattaactggaatggataccgtatcctgggagtgctcgcaacttcgaggtcaatcggagactattacctgaaaccatatgtgatagcggaaccagaagttaccgtcatggaccggacggacaaagacgagttcctcatactagcaagcgacggcctgtgggatgtggtgtccaatgatatcgcctgcaagatcgcgagaaattgcctaagtgggcgtgcggcctccaagtaccccgagtccgtctccgggagcacggcggccgacgccgcggcgctgctggtggagctcgccatggcacgcggcagcaaggacaacatcagcgtcgtcgtggtcgagttgcggcgactgaagagtaggacagcggcggtgatcaaagaaaaccgcaggtggtagtagtgataatgtaagggtggccggctggataggatgtcagattattcgagcatggcgagagagagagagagagagagagaaagaaagaatttgcggctgttcgctgggatggttgtagttaagagggctcagggacggtgtggccgtgctgccgttgagttgagtgtgctatttgtagccgtgctgccgttgtattgcgttgcgttggttctttagttcttctatatatggtgactgacgttcggggcgaagcggcaagaagcataagctgctttcgtcagttctgatttgatcaaaatttttcc

SEQ ID NO: 26457 - DNA, 960 bp, Triticum aestivum
  unsure (1)..(960): unsure at all n locations
  Clone ID: PAT_TA_26457
aaggnattcaggggcagaagtagaatcagcacaactacaggatcccctcaacaaataaaaattaccaacacccacaatagatctgaaactcggtagaacacacttaaaagagggggaacaccactgcattgctcaatcaggagaaaacaaactggtcgtcgcaaagagagagagataacaaaactggaaacctgtaaaatgtaaactcaatgggaataaaacaacaatctccaagttcggaagaaaagaaccttaaacgagggaaaactgaatatatacaaccaaaccacctcttaaagtcgtaatatcactgatcagcgtaaaacaaactgcaaaatccctatagaatggaacaacacacaggaggggaaaaaaccagcggttgcttataagtcgcgagaaagccccctggttaacctcgatccacagaacttttgtgttctaagaaaaaggcccctccgggctgaacacgtggctcaagttgtagactggtgtcctttgttgctctatccggagaatagcagtccacaccaggctgcactctaaccgatctttcacgggtaaatctgggaaaacctcccatgctctgctcgttgccaaactgcactctaactgatctttcacgggtaactctgcgaagacctcccatgctccgctcgttgctagcatcattgtgcccggcgctgcaaagggaacccatgctattgagaagaagacttttccttcaaccaatccactcggaacgacagaatccaccgattgcttatatccctggttatcggacgatccttcggcggagacctcgaggagattgcttcgcgcgcgcacggtgttaggctcgaatttagggttcgagagtagaaagggggtttgagggtagaggaggagcaggctgggggatctggaaggagacggccacacccacacctacacccacaccggtcccccgnccgaattcct

SEQ ID NO: 26458 - DNA, 1056 bp, Triticum aestivum
  unsure (1)..(1056): unsure at all n locations
  Clone ID: PAT_TA_26458
ttcggcacgaggcgtcgacggccactctggcgactgggtgggcgtcgactgggacggcggcgccggcggccgccacgacggctcgctcgccggccgccgctacttcgccgccgcgggcgaccgctccgcctccttcgcgcgcccctccgcactcagcgccgggatcgcgctccccgacgcgctccgcctccgctaccgcgtcgacgacttcaccaaggaggaggaagatgaaatgtacgtgttctcgacgagccagaagcgcgtatcggtggaattggtcgggacgaacaaggtccgggacaagctgaagaactttgatgagctgctgtgtgcgtctgtttcattcatgggagtaagctccgccggatcgccagaggaactacaggggttggttccaaatctcaggcaacttgatttaacaggaaatctcatttctcagtggcaagatatattctctctgtgtcaagctctgccatctctggaagttctcgatctgacaaacaataccatggagaatgactttgtagaaagtccattgctgaagaatattcgtgttttggttctcaacaactgtggtgtaacctgggaactgattgaaaagcttaaagttccatttgcatgtctcactgacctccacctaatatggaacaagctgaacataatcacgaccccagttggaaactttgtgcaaggtttcgatacactgcggctcttaaatttggaagacaatcacattgtttcatgggatgaaatggtaaaactttcttatttaagaagcttggaacagctccatttgaacaagaacaagataaagcatgtaagatacccatataatcttccatcatcagggcctcttggtgatgtagctgttccggccttcgaaaaattgcaagtccttttattaggatctaatgaaatagaagactttccttctgtggattcacttaacctctttccaagtttaatggacgtcaggatttctgataatcctatagctgatcctgccaaggaggtgctcctcgatttgtgcttgttgctcgactagnaaatgttaaa

SEQ ID NO: 26459 - DNA, 1166 bp, Triticum aestivum
  Clone ID: PAT_TA_26459
tccggtgggccctccgagggccctctctgcctcctatccggggccgcccccgccccctcttacttcgcgcccccatctctccccgtagtcgcctccaccaccgacaccccagcccccgaccccgctcggctcggccccctctccgatgcgggccggtgcgggggcccgccgccgccgccgcgccgcccccggcccgcacggccccgtccacgcggcccgttcatgtgctgggccccgcgcccgccccccgcagtgagtcgacccacctagagccgtgtccgacacgcccccatccacctgacccacccccccgtgatcgccggcccttcttgctctgtgctccccatgagggagagggacccgcaccgccgctcctcctccactgcgagctctctttcagcctcggttcgattagaggccggacagggagccccttctcaccccttcaccggatgcgaggcaaacgagaccccttgccaccagatccgagtgcccattgccccctcctgcttgccagagcctccagggaatcgtggacgccggcggccgtcggatttggcttccaccgtgccagtagccacggcatccatggatcaccgtccggatctgcaccaccaccggtgcctcgtcgcacacctgtccgccgccaggggccgaggaggagaccaggcggcctccatatctcctctccgtccggcgaccatcgccgtgcagctcggcggcatgtgtgatgcggttcagtgctggtgcacgccggcgcgaccacaccatctccagcgcacacggctcccttcaagcgtgcggttcatttgcgaggtccctgaccgtgacattgaagtgcatctagatacctcgagcagtgtacgacacgccctcatgcagctcatccacgggcaccggcaaaaaaattgaaaaggcttgattgagctccgatggtgaaaaagtgggcgacgggcgaccacacgagggcgctgggagacatgtgcagtttggcagcgagctcctcctcacgtctatagtacagcatgcatcacactttgcatctttgtagtttggaacccggcatgttgcaacttcatattgtgcagcaaaaaatttattctagtggggttaactttgtaaaacagagacggaaaataaaaacatgagaagttcgtttacttttt

SEQ ID NO: 26460 - DNA, 947 bp, Triticum aestivum
  Clone ID: PAT_TA_26460
ggcagcgagctccagttgccgccgaatctgacgctccaaccgcgggcgctgcagctcattgagtccatccgtgcccaggtgcacgccgcctgcggacccgtcgtctcctgcgccgacatcacggccctcgccacccgcgatgccgttgccttctccgggggtcagggctacgacgtgccgctcggcaggctcgacagcctcgcgccggcgccgagctcggccgtcttcgatctcccccaggccagctccaacgcctccacgctcatcgacgtcttcgatacccgcaacctcgacaatgtcgacctcgtcgcgctctcaggtggccacaccatcgggaagggccactgcagctccttctccaaccgcttctccgaggactccgacttcgtccgaagcctcgcctccaactgctccagcgacttcaaccggctgcaggacctcgacgtcaccaccccggacgtgttcgacatcaagtacttcaccaacctgcaacagggaaagggggtgttcacctccgaccagaagctcaccgcggactggcgcaccgaatgggttgtcaacggctttgccgggaaccactggtggttcttcggccagtttgctgcttccatgaccaagctcgggaatctccaggggccccaaggaaacgtcggcgagatccgtcgcaacagctgcttcgtgcgcaatggacagagcatcctcaccaccaccagcgacgaggggctcgccgcctctgcttgagatcaccgatgttagcgagattaatgtcttaataagagctcgctagctaatgtagcccatattattctagatttactcttgtttaaaatcatattatagcactttgttctgggactcctaaaaggcgcgcttcgcctcggtgtgctataattcttttatagggccaaaacagtctttttgtccgcgggagcgacgaagagattttc

SEQ ID NO: 26461 - DNA, 439 bp, Triticum aestivum
  unsure (1)..(439): unsure at all n locations
  Clone ID: PAT_TA_26461
cgttgtgctttgagtacatgaaaaatggatcccttgatcagtacattgaagatgcttgttctggactcagttggcaccgacgggaccagataatcaagggcataagcgaagggttaagatacctccacgagggattgaagactcctattatccacatgaatctaaagcctagcaatattttgctggatcataacatgatcccgaagaatagcttgattttnggtctgcgaaggctcgttggagaaggaaacgccagatgtatgggaacaattgcatacatgtcgccggaattcattgaaagacaagtaatctcgcataagtgtgacatatatagccttggtgttataatcataaagctgataacagggggagagattatattcgggacattttgatatgtcttcagataggtttatcgagctggcgcatgaagaatgga

SEQ ID NO: 26462 - DNA, 1065 bp, Triticum aestivum
  unsure (1)..(1065): unsure at all n locations
  Clone ID: PAT_TA_26462
ctccaatacaaaaatcaagtaaaaatgataatataattacttgtgcagaaaactcaaacctttctgcaatccccaagggcattcatctaccaagggtcgtcttgtgtttagctcataatggaaaagttgcttgggacatcaaatggaagcctcctttacaaaatcagttagaacagaaatcacgtttgggttttcttgcaatactgttgggaaatggctcactggacggatgggaagttccatctccaagcatgatccagaagatatattcctcttcttcggtgaagggcaccgaccctcgctttctgaagctgcggcctgtatttaggtgtgctaaagtgaagtgcgggaacatacagagcattcccttgacagttgattggtcgccttctcctcatgatatgatactggcaggatgtcacgatggaacggttgctttatggaagttctctacagacttgccagcacaagattcaaaaccttttatgtgtgtcactgctgagtctgttcccatcagagccctctcgtgggcaccatatgtaagtgaggaagacacaaacaccttcgtcactgctggagaggatggcctaaaattctgggatttaagagatccataccgtcctctgtgggaactaaccactgccccaagggctggtttaagtcttcattggttaaaggaggctagaggtattgcatctcactggaagatggcacattgaagttcctcacctacctagaattggcaatgatgttccagtaccggaaggccattgctgggactaaaaccagggnggttctacttatcaattgncagaatatttgatatggaatgnccatgtctnanaaataccggttntccacttatttgggggnaaatgnactggtgggcgcttccacttactttaaaatntggganaagaacctgggggaaccggggnccttttctttggggttcnttccaaggaggggccacccttaaaatgggggaaattanaaacctcttttaaaagtctttggttgnaaaaagggccaaccctnccaaaanncctaagccccnnccaaaan

SEQ ID NO: 26463 - DNA, 622 bp, Triticum aestivum
  unsure (1)..(622): unsure at all n locations
  Clone ID: PAT_TA_26463
ctcgagttttttttttttttttttactttttttttatggtgttcatatcttttcgtaattgacatacacaaccattatattggtgaaaaatacatgcagctcctgtcctcaagactcgggcagaggcgcagagcacatccttctaatggtgtatacatatgctttccctgtctatcgtggccatggactttgcaataccatagataccatacgaaaacacgaaacgggagaagcaaggaaacgttacaaatcgtacatgtggatacaacactaaaacaagcgttccacacagctagcacggcactgatcactgtacctgatcccgtggagtgaagcggtgaacggtccgacccacaggacaactgaactgaactgaactgcacaggcggcggcggcaagacagaggaactggtgaaaaanaggccggtggttcaaaagaaggaccttggtggagggcgcctccccaacggcctcagaattgggaacccaacatcgcccaacttggngccccttggctcgcngaccncgctccctcgcctcgcgcgcttgccactcgtcggccctcccctcctggacgctccccacgcccccctttttgacacntngcnttcantgccgcnca

SEQ ID NO: 26464 - DNA, 1804 bp, Triticum aestivum
  unsure (1)..(1804): unsure at all n locations
  Clone ID: PAT_TA_26464
gcatcttgctcttccttgcaacaaggctgcaaggtcacagattattccagacatcataaaatgctacagccatggaggacggaccattattttcaccgagacaaaagaatctgcttctgagctctctagtttgattcctggatcccgtgccctgcatggagatatcgcacaagctcaacgtgaagtcgtcattgctggatttaggagcggggaagttccttggtttgggntgctacaaatgtggcagcaagaggccttgacattaatgatgtgcagcttatcatttcagtgtgaacctccacgcgatgttgaagcctacatacatcggtcaggccggacagngaggggctggcaatactggcatttgctgtcatgctttttgaacccagantataaattcggtgtgaccagaatagagagggagtctggggtgaagnttgaacatatatntgcaccgcagcctactgatgtggcacaatctgctggcaatgaagcagcagaggccattgcaagggtgtcggaccgtgttattcctgttttccggcaacaagcagaggagctgctaagcaactccagcatgtctgcagtggatctactagccaaagcacttgcaaaggcagtaggctacactgacataaagaagagatctttgctttcatctatggagaaccatactacactacaccttcaaactggccgaccgttgtacacaccatcgtttgttattagtacattgaaaaggttcatgccagaagatagactctcaagtttacatggtataaccctgaccactgatgggacaagtgctgtatttgatgttccttcagcagaggttcaagactacattcaaggcgcggagaacgtggccggggtgacaattgatgaagtgaagcaactgccagccttgcaagagagggagcagtcaaagggtaacttcggcgggtcgaggtttggcggccgtggaggcggtggaaggaggttcggtggtggcggaggtggacgattcggtggtggcggaagaggcaggggaggcggcggtggcaggtttaacaggaggtgaagacctaaaaacagtataatctatttttgacgggagtttgagagatgaaagaaggcacagggaatcgtcaaagttttgactgcgccgtgtatcgggttttttgtttttacgtatttgttaagtgttctgtccccccagattatgacgatcaagtttgccaacggaagagtgtaaaatattgatctgatactgatactcaaccactgttatgaacgaatgaagctatgtgtgttgttttgagactgtatttgatgttccttcagcagaggttcaagactacattcaaggcgcggagaacgcggccggggtgacaatcgatgaagtgaagcaactgccagccttgcaagagagggagcagtcaaggggtaactccggcgggtcgaggtttggtggccgtggaggcggtggaaggaggttcggtggtggcggaggtggacggtttggtggtggcggaagaggcaggggaggcggcggaggcaggtttaacaggaggtgaagacctagaagagtataatctatttttgacgggagtttgagagatgaaagaaggcacagggaatcgtcaaagttttgactgcgccgtgtatcgggtttttttgttttatttgttgtaagtgttctgtcccccgagattatgacgatcaagtttgccaacggaagagtgtaaaatattgatctgatactcagccactgttatgaacgagaatatatgttgttttgttttgaaaaaaaaaaaaaaaaaaa

SEQ ID NO: 26465 - DNA, 401 bp, Triticum aestivum
  Clone ID: PAT_TA_26465
gagtattttaatttgtcttgttcaatccatttgacgttctttaatacatctcaaaacacaccagattcgaaatatccagctgaatgacaaaaatgcagggagagaatgagaagagtacaggcgttcataaaaaggaatgagcgactcagctcatacaaatgtcaatgcaacgtcaagcacatttagcaggtcactgtaccacttcaaggtccttgaagtactcatgctcaagtgcttgcctcgctgtgattcttttgcttggctcgtatcgaagcattttagagagaaggtccaacccagcagggtcaagatttgggactactgttgccaggtcctgagcttgccacctggggaaagctgtcttgaagtcaggcaaacaactgactccctggccaactctg

SEQ ID NO: 26466 - DNA, 1138 bp, Triticum aestivum
  Clone ID: PAT_TA_26466
gcacgaggacccggccgcgtcacacggccgtcttccccgttctcccccgcgccgctccccctctcccccgccgtcgccggctcgcccccgcggcgcaaggcggtgaccccgcaggacgatcggagccgcgtcgctcttcgcctcctccgccctccccagcggcgagtagaccgagacgcggaggcctcccccggcatcgcccgccatgttgcgccggtgcgtgcgggatctgtacccgctgcggtccctcaggaggatccccaggccgatctccagcgaggtccaaagtccaacattcggtcagctcagaagaaactcaacaaaagcatcccaacaaggttcagcacagaaatctgtccctggacctaaagaagaaccttctaagtctggaagcaaggttccaaagcttctgcttggaactctgcttgttggtgctgctggtatggccgcttatcaagctggctacatagaccttcagtttatggatgaaaaattgccttcgaccatcagggaacaaaatctcacaaagatgtatgaaaatctgaagttcccttttgaacaaaaggttgatcagaaacaaaccatgttggatccaaagaatgacattgttcaggatacacccatggtccttccagctgaagggattccaactgccagtgagcagcctactcctgcagaagaaaaagaaacagaaaccgtaacccagggaacactgccagttcaagatgagcatggtgctgatactaaactgccgtctcaagatactctctctgttgatataaagccaaatgttgtaaataaggcagcaggtgaagttcctcttggacaagctgacaagataagtagcacagtttctccagtagaatcaagcccaacaacggctgaagtacaaaaggatccattaggtgctgatgtaggtgaacagaaatctcttgctgagacatatttactacaggaggagcatgatattcctaaagatgtgagtgctaaggagactaaaagtgacggcactgttggtgctgtatatgcctccgatgtcgcccttcctatccgggatattatagatgctattcatgccgctgaaaaaaagcaggcagatacagatgcttacacgtattctgaagagaaaaggaagttg

SEQ ID NO: 26467 - DNA, 606 bp, Triticum aestivum
  unsure (1)..(606): unsure at all n locations
  Clone ID: PAT_TA_26467
taagaactaanaactagggtagtaagacttccacttccctttgatagaaaacaaanaaagaaaacagagaagctcacaccatggcaaccaatgggtactccaatggcggcagcaccaaaggaaagcccatcaaatgcaaagcggcggtggtgtggggtcccggcgagccgctggtgatggaggaggtgggggtggcgccgccggcgcgcatggaggtgcgcgtcagaatcctcttcacctccatctgccacaccgacctcagcttctggagaggagagaacgagcgtcaacgcaggttccctcgcatccttggtcacgaggcagccggagtggtggagagcgtgggcgaaggcgtggaagacctcgcgccgggagaccacgtcgtccccatcttcaacggggagtgcgggacgtgcgcctactgccactccagcgcgaccaacctgtgcgggacctaccgcgtcgaccctttcaagagcaccatggtctccgacgacgggacgaggttctccgtggtgaacacctccggcgacacggtgccggtctaccacttcctcaacacctccaccttcgccgagtacaccgttctggacgccgcctgcgccg

SEQ ID NO: 26468 - DNA, 1539 bp, Triticum aestivum
  Clone ID: PAT_TA_26468
gggggtgcggcacgaggcgtggggaagaacttccacttccctttgatagaaaacaaacaaagaaaacagagaagctcacaccatggcaaccaatgggtactccaatggcggcagcaccaagggaaagcccatcaaatgcaaagcggcggtggcgtggggtcccggcgagccgctggtgatgcaggaggtgggggtggcgccgccggcgcgcatggaggtgcgcgtcaaagtcctctacacctccatctgccacaccgacctcagcttcttgagaggagagaacgagcgtcaacgcaggttccctcgcatccttggccacgagccaggcggagtggtggagagcgtcggagaaggcgtggaagatttcgcgcccggagagcacggcgtatccagcgggaggtgagggtaagcttcgatggcttcataaccccacgagatgccattctcgggagatcaatgaggctttccggctgctaggaggaaggcaagtccctccaggtgtgtgctacgtctgtgatgaggcgcaccaggagttgcaagtgtgtgttgacgcagatataccgttgttgttaataccatttactgtacatcttgtataattaaatcgaaggttatatttcactcaaaatgaagacgaactatgtgggcctcccctgcggggcactcgccccaggggtcggtgctcccgggtgctctgcaaacgtgtccaagggctccaccgtagcaatattcggacttggtgctgttggtcttgcggttggcgaaggagcaagaataagaggggcgtctcggatcatcggcgtggacatcaaccctgaaaagttcgccaaaggcaaagagatgggcatcacggacttcatcaacccgaaggcgtgcggcaagcctgtccacgaggtgatcaaggagctgacagatgggggcgtcgactacagtttcgagtgcagtggcaacgttgatgtgcttcgagaggctttcgtttccacacacgacggttggggattgaccgtggtgctggggatccacccgacgcctaggatgatgccattgcatcccatggagcttttcgacggccgtcggatcaccggttgcaccttcggcgatttcaagggcaagtcccagcttcccctcctcgtcgaccaatgcatgaagggggaggttaagataaatttcgatggcttcataacccatgagatgccattctcggagattaatgaggctttccggctgctggaggaaggcaagtccctcaggtgtgtgctacgtttgtgatgaggcgcacaaggaattgcaagtgttctgttggcgagatatataccgttgttgttgctaccatttactgtacatcttgtacaattaaactggtggttatatgtcactcaaagtgaaaaaaaaagacccaaagtgaagacgactcataaatatgtgttgggttcacctgggtctccctcaaccgagaactctttagtctcggtcgatccacctcccacttttgtgctctccatttttggcttttgtttgtattgtggacttgcgtcggtt

SEQ ID NO: 26469 - DNA, 599 bp, Triticum aestivum
  Clone ID: PAT_TA_26469
cgtgtacgtgggttcggtgccatccagcctcaagtattgtactacgtgtgtgtgctcaacttcctcagctagtactccagtgtgtgtgagttcagctgttcgtgagtgcaagggagagtgagagcagcttgtgtgcagccgctggttagctaggcttcctctgttggagtacaagtgagagctagctgcttgttgttcgggccaacacatggccggccatggcggctttgtctgccgacggagctccccacgacgagccggcgaggacgtcaacttcgttcatctcttcctgtagtctgttggcgccgagtactagcctagcgttatcttgtcgatgccagcgacatccccattgtccgcgatcgcctcgcaggacggatgagtgcagaagtagaaggtaaaagtgatggcggagatggcgagcagtaatcagtggagatgcacccaaaggttggccgccgatgagctccatccgaatacgccgtgcgaggcaccagaaggttcggtgctactgtatgactgtatccagattacactaaaaaaataatactgtacccagataactggtttatagaaaaatgcctattagtcgtttttct

SEQ ID NO: 26470 - DNA, 621 bp, Triticum aestivum
  Clone ID: PAT_TA_26470
cctccccccacgagggcgccgctcgccgtccccccctgctcctgctcgcccccgcgcgctccggcccgctccccgtccgcgcggggcgccccggggcggatccccgggtggtctgcgcctggtgggggtggggcgtggcccatggccaaccccatggccggcggcgggcgcaagttctggcgctccgcgtcgtggtcggcgtcccgggccgcggcgcggggggggccggcggcggcgccgctcccgcccccgctccgcccgccgccgctcaccccgcggtccaagggccgggcctgcctcccgccgctgcagccgctcgccatcacccgccgcagcctgggccagtggccggaggagggctccgacgacgtgggcgagtggcccgaccccaccaccccgggcgcgtccccgggcggcggcggcggcggcggcccggtctccgccccggccggcgagggcctccggctgggcctctcgaccctccgctcccaccgccgcacgcaccaccgcgccttcttcgacgccttgtgctccaggagggctgcccacgtctacctcggcggcgacgccgtcgccaagaaccgcgacatcctgcgcaagaacggcatcacccacgtccta

SEQ ID NO: 26471 - DNA, 660 bp, Triticum aestivum
  unsure (1)..(660): unsure at all n locations
  Clone ID: PAT_TA_26471
ctctctgccactaaccacctccctctgcatcaaacccaccactccctcctccctcccccgtttctcgctttcccccgcgaccgaatctccagcggcgtcgcccccctccggccccaatggtgaacccgccggagctctaccaccggatcctcgacgtccccaggggcacctcgtcgcaggggctccgcgccgcctacaagggcctcgccaggaaatggcaccccgacaagcacccgccggcctccaagcccgaggccgaggcgcgcttcaaggccatcaccgaggcctacgaggcgctcctggaccagcaggagaacagggcggtgttcggggtgtgcaacgacgaccgggcggccgagatgttcgggacgttcggcgccggcgccggcgggggcggcgcgcgcatggcgaggtcgcgcagcgacgacttctgcatgcggagcgcgcccgccacaccggccagggagttcaccaaggtctacagctccggcaacacgggcgggcgccgcgccttcgccgagttctccaactccatcaanggcaaagngccgccgnctggaacgcgcctcnaagtgcacctggaggagctctccgcggctgcaanaacangtcaagttcaccgcgaagtctcacaacaacgggtcatagttanaaggagtg

SEQ ID NO: 26472 - DNA, 550 bp, Triticum aestivum
  Clone ID: PAT_TA_26472
accccccggccggcgccgggggggttcgcagccctcgccgccggccccgaggattcagaccagtcgccaccgccgccgcccgactcctcctcaagacgccgccgcccgccgcctttacgccgacgtatctcctccggcatacccctggctatggcagagagccgtgagacctgcctccctcccgccgctggggatgaaccccgtcccgccgtggtgctgcggagcgaaatggcagagttgccttgagggacctgacctcgcggaacgacggatgaccactttgctgccacaagtcgcctccacaccgtgtagcccgcaaacatgtctcgcaagcatttgccaatcaaattttatgttgcaatgaaccattgaccttcgttgatcgaacatcttgtatttttcatttggaccatggcatgtatgcatgtaacattttcatttgaaccgttgatagtacttgcaacagattatatgagcctttgtgttgttttgagttgctcgtgccggctccagattatacaagcctttttgttattttgcataaaaaaaa

SEQ ID NO: 26473 - DNA, 656 bp, Triticum aestivum
  Clone ID: PAT_TA_26473
gtttgacctgttattgatggatcactataaacttaacttatcatgtcaggtctagtgcgacactagctaaggtgcaaatgtgctgaatgttcacacctgtaatcttttaattttgtgaacaaacgtcaattccgtctgaaaaagaaacataataaggcaactttgcaagtgcatcagtgcaccttgaataaaatacagaagtgcaccatcaaattttccatcagttcgcttataaaaaaacagaaaggtggttgtgtaaagaaaaccggagaatcaatgtcagcctagaagttcactagggaactccaatcaagtgcacttgttagaaaaattttggtttactatattttatagactgcagaaattttgaacttactgttgtgaaattttagttgtcattatgcgaagttgtacattggactaaaaattgccttttttgatcttttgttctgaaccttttttctgaacttactatactgtttgtgtacattatcctctcgttagttttgtgattttagacaaagtttcagccttcgagcaatagctcgtccaccacgggtgcttgcagccgtccaggtccaagtcgagggttgacgcgattccaagtagaatcgcacccaccatcttcactagcactgtgcaaccgccaagtcgag

SEQ ID NO: 26474 - DNA, 1357 bp, Triticum aestivum
  Clone ID: PAT_TA_26474
tttttttttttttttttttttttttttttttttttttttttttttatttctattatatatgtattgcttgctcttattagtccacaaccgagtggattttcaatcctccaatccccttgacaaccatcatactgtaactgtcactgtcagcaacaacagaaaagacatactgtaactgtcttgcagctaagaggcagcggcagagccagacgcagcagcggcatctgcaggagcagcctcgtcgtccttgtgcttcaccatgcccgaatcgaccaggatgggcacctccgcggcgagccacggcgcgagcccgaggcagagagcgtgcgcgagcccgaaccgcgggcagttcttggcccagagcggcttgaagtgcacggtgaggcagatcttccctccgcggtacatcttgtgggtcttgccgtcgagggtggggagctcgatctcgggggcgacctgggggtaggcgacggggatgtcgaactggagggggaactcgtagcggcggaggttgtggacgtaccagcaggtgccctcccagcgggtgccctccgggttggcggcggagatgcggaaccagtcattgtccttggccttgttgacggaggtgtaggcgatgagggcgcggtactcctccttgagccgctgccgccacggatcgccgtcccgggggcccgcccgcgtcgacagcagcgggatctcgcccaccacgctcttcgtgcccttgtcccacccctccatcgccgacccgacgatttcccgccctttttctttatcttctgttctccgcctctgccccagcctcttcacttttccaacaatgaattccctgccaatgatctttcttttcatctctccggctgggactccttttaactcggtaagaaatttcgccgagccgccagcacaggggtcgggggggtgcgagtcactgttgatggctgacattccacgctccgtctccgggtgcctccacggcccagtgtccccattagcacagtgaagcctatcccctattgcgttatgaacaagagtggctgcaactgttgaatcaactcctcctgataacgcacaaatcacatgttcatcaggcccaaccatactcttgatggtcttaatttcctcatccagcacatcttgcatcttccagtcggctttaatcccacaaacatcaaaaagaaagtggcgcagtgtttccattccttggggtgaatgtgtcacctccgggtggtactggagcccatagaagcgcttctcccggtgctcgatggcggcgatggcgccctgcacgctgcgcgccacaacctcaaatccctcgggcagcctgacgacctcgtcgccgtggctcatccatacg

SEQ ID NO: 26475 - DNA, 818 bp, Triticum aestivum
  Clone ID: PAT_TA_26475
aagaggcataaagggcacacaatagattcatatttgtctaagcataatcaattcatatttttctaagcataacctacacataaataactgaactgcaaatttagcactaaacccactgcagcgttgctacatcatcagagcatgattttgcaattcccggtccattattgcaccaccagagcattactatcctattcccactccactgtcgccggtggctttgatgttacgtccaggacaacacggttgacgcctcgcacgttattgcagatcttcttcaccacatcaaccaggaacgggcgctcaaaatcataccaatttgcagtcatgccatcctcactggtaattgcccttaaagcaaccacatgggagtgagttctctggtcaccctggaccccaactgtttggacaggcaaaaacacagcaaaagcttgccaaatttcatcatagatgcctgcatctttaatggattgaataaatatctcatccacctgacgaagaacctccaaagcattgcctgctgtaacatcacctatgacacgtacagcaagaccaggcccaggaaatgggtgtcgctttaagaatgactctgggacatttaagatacttcccaacttccgaacctcatccttaaaaaggagcttcagtggttcaatgagcttcaacttcatatctttaggaagaccacctacattgtgatggcttttgatggtgtgggaatgtgtcctcccgctcccggggggtgggcatgattcaatcacatcagggtacaatgttccctgaaccaaatattccccacgcttccgcccacgcgtccg

SEQ ID NO: 26476 - DNA, 865 bp, Triticum aestivum
  Clone ID: PAT_TA_26476
gctgcgcgcccgtagacttggacgctggcatgaaaaaagctttaaagaaaggagtggcagcaatcctggaggcattggatgcgggtgtgcctaatgaaactggagtagcatctgcagaaggtaatgaagagcaagtgtttcaatcagcaaatttaagatgaattcgtgcctggtgaaacgaagccaaaactggacctgcagcgagataataagaaaggaattcaagtgcagctcaacctgctgggcaatggcaacggctcgagtgcaaagaaggcgccagcggcaagatcaaaaactcctgggtctgcaggtaaggccgtcggaggctcaggcgggaagcggaataggtagcctaccgccgccgcacaatgatgactggctggaagcaacggagaccccagaagggtagttggtggtctcgtgtttggtttgtcctgttagtccagttgttcccatttgtagggaaaacctgtttgcttgcacttcatttgctcttctgtttctcgccccggctgacggtgcttgtttagcgtgtgacctttttctccagatgcaatccgctctgattctgaatccgttaggcgtatttttcagagatatagacctgaaactagagaacatctggatgcctggttcgttcctcgccccggctagaggggcttgtttagcgtgtgagctttttctcctgacgcaatccgctctgaatctggaacggttaggtgtatttttcagagatgtaaacctgaaactagagaacaacatttggatgcctggttctgccctttcccactgaaatggatgctcctctagcttgctgtagataacatggttgtaacctgcgaaaggccgatcaggcaatctgctg

SEQ ID NO: 26477 - DNA, 804 bp, Triticum aestivum
  Clone ID: PAT_TA_26477
ggctcggcggctggagccgcgacacgagggcgatgccaagagggcacgcaccgacgtgccacctccggctgctgatgtccatgtggtaccagcagacgtggcgctcaacatccccccggctgctggccccgtggtgcttcgtggtggtggtgcgccgaaccctcctcatcctctgcccgctgagccggatctggccgagcaggcggcagctgctgccatgaatgtattcatgaacgccctccagcccgcgtcagatgtactgaaaagtgcccatgaccctgatccacatctgaaaccgaccttgaccagggcccagcttggctatctggtggataatcccatcatgcttactaatgctgcactctcggcgctggaaaggggtgtccagcccattacgactgtggtgccacccccaccccagccggtggctccagggatgcctccgcctccactatgcctcaggtgcggcctggctgatgcgaccactgcattcttctcgtcaacccacaagtgtgtgtgtgacccatgccatgaggcggtattgctcaaccctgtctgggaggcgtgcacaatttgtttcagtgaaactatcaatcggatagtcaacattcagtaaagaaatcggaggagtggagtgaagactgagatggaaaggctgtcaagctagagtgtcggcaagggcctagaagggatctcatctcacattgtcacatccgtgctggatactatcatttatgagacaatttatgtttgagactattcatgtaaccttaatatttctctggatattattagtgtgaggtt

SEQ ID NO: 26478 - DNA, 1252 bp, Triticum aestivum
  unsure (1)..(1252): unsure at all n locations
  Clone ID: PAT_TA_26478
nacgantcttgagaaanctctganggnacagganctgtctctgaaggcnananacagccgcatcagccaactggaggagaaaaccgccgcagcgtcaaatcctgaccagatggcagctctcatggaaatcctgcagcggnaggaagccgaactcgatgagatcaagaccaggctccaggactacaggactacagccagaaaggtcgtaagtagtaagtagcacttcggcacgaacaaacccaacgacacctgccgttgtagtagcagcaaaggttacaaactccagcaggaatagtactgtacctgctagatcagaagagaagagagctggcaacaccacagtgacagaaagcaaaattcagaaaccgaagaccagatctttagaaggaaagcaagtgaagctcgcagtctcagccagcacacgagttgatgatttgcaggagcaagacactgatttcttcgatatggatgatatttatgggggcaccctccccgagtcggccgggcctgctcggcggaacaagaaggttttgcccgacagtcatgttgaaaaccaaaaatcagggcaccccctggaccagcaggacagccaccatgtcagatataacaagctacttgagaaggaaaacatcaaaccggatgaaaccaagaagaagaacagtactgttgggcacttggaaaagatctccaaagatgaaaccaagacgaagaacagcactgttgggcacttggagaagatctccaacgatgaaaccaagaagaagaacagtactgttggacacttggaaaagatctccaaagatgaaaccaagaagaagaacagtactgttgggcacttggaaaagatctccaaagacagcttaagcgacgtcaacctagacagaccgagacaaaggatgactggtgctgctgatgtgaagccgaaggtgcctgtaaatgatgatttgcagcaaaacaagaagcagaagaacaaaaagcccaaatccaagaagaaggtggtcgatacttcaacttggtgatggattagttacagaaggaaggtaagtagagaccacatttttttgaacctaaaatggttactgtgatagaggactagaacagaagacatgtcatttccatatgtcgaaatagaatcgagaaatgaaggccgtaatgtttccgagcaattgatactgtaatatttttacactttgtcttgtgtgacaaagcaattttgcacacggtacactataaggttgcaacactagactaa

SEQ ID NO: 26479 - DNA, 596 bp, Triticum aestivum
  Clone ID: PAT_TA_26479
aagatcgccctcacacggccgtcaccgcgggtttaacgcggtggactacttcccgagcttggccaaggtccctctgctccagcgggtgctgctggccaagaccagcaggctgaagaagaggtgggatgagttgcttgacaagatcacagaggaccacgcaaccagatcagcatcgctgccggtacaagatgagcaagacagagacatggtagatgttctcctctctcttcagcacgagtacaatctcaccacagacaacctcaggggcatctggatggacatgtttgaagctggcacagacacgtcatacgtcaccctggagttcgccatggcggagctcataaggaagccacgcctcatggccaaactccgagacgaggtgaggagcaagacacccgggacccagcagatggtgaaggcggacgacctgggcggcatgtactacctaaaggcagtcgtgaaggagaccctccggctgcatccgccagcgccgcttctcctaccacgcctctccatggccgactgcgacgacgtcaacggttacacggtcccggctgggacacaagtcatcgtcaacgcgtgggctctcggcagag

SEQ ID NO: 26480 - DNA, 1272 bp, Triticum aestivum
  Clone ID: PAT_TA_26480
caaaaaaaaaaaaaaaaaaaaaaaaaccctcgtcgtctccgccttgctctatccatccgtcggcgatgcaggccgccgtcgccttgagccagagccaggcgtcccttctcgtccggcggctcccaaggccttaccacggcggcgggccggagccggatgatggcgtgctgctgctaggacgacgaggcgtgtcgctcccgctcccgcggctgcggctgcggcgcgcctgttgctccgcgagcctacccgtcggtaccggcgccggcgcgccggcagtgagcatgtccctgtattcccaagacaaaaaacatgggatccttacaagcttcttggtgttgaccatgatgcatctgaagaagagatcaatagtgcaagaaacttcctccttcaacaatacgctgggtatgaagaaaacgaagaggcaattgaaggtgcctatgataagataatgatgaagagctactcacaccgtaagaagtccaaaatcaacctgaaaaggaaattaatgaagcaagttgtacaatccccatcatgggttaagtcactgcttggacactttgaggtgccatcgatggatgttgtgtcaaaaagatttgctcttttcggctttattgctgggtggagcatcgcaacttctgctgagactggacctaccttccagcttgcactggcactcgtctcatgcatatactttctcaacgacaagatgaaaaaccttgccagggcgtctgctacagggcttgggctctttgcgggtggctggatagtaggttcgctggtagtcccagtgatcccggcatttattttcccgcgtacttggtgtctggagctccttacttcgctggtcgcttatgtatttttattcttgggttgctctctcgtcaagtgaaatctctgaagcttgaaaccgttgttgtttctgcaagattttctcttactgacgtctcaagtgcgtcaattcacccttttgacctgtgctgtgagtatagatagatgccctttggacaaatcgaaactcggccctctattgttccgatcccatgagccgttgttatctctagtctaagctcatacagtagtattgatcagtattgtattgtaggcagagcaagccagtttctgcaagctgatgctgctacctctagagtgcttgggcatgcttttggacctatatatacatgactcgtacagtttcagggtgtgccgggcgcttctctctgctggggatttcacgggcgggcatccaccgtgtgtttgttgtgagattaaaaa

SEQ ID NO: 26481 - DNA, 1591 bp, Triticum aestivum
  Clone ID: PAT_TA_26481
tggtaatccccacccggaaggatatggagggaaagatcgaatcgatgagggttttagataacaatccccagaagccagtagtgcggatggcgaatttgtgtgttgtggctgggcatacggtgaatggagtggccgagttgcacagcaacatcttgaaacaagagctgtttgcagattatgtctctatttggcctaacaaattccagaacaaaactaatggaattacaccacgtagatggctccgtttttgcaaccccgagctgagtgaaatagtcacgaaatggttaaaaacagatcagtggacaagcaaccttgatcttctcaccgggcttcggaaattcgcagatgatgaaaaactacatgctgagtgggcagcagccaagctggccagcaaaaagcgcttagccaagcatgtgttggatgtgactggtgttacaattgatccgaataaccttttcgatatacaaattaaacgcatccacgaatacaagagacagctgttgaacattttgggagctgtgtacagatataagaagttaaaggaaatgagcgcagaagagaggaagaaggttacaccacgcactgtcatggtaggagggaaagcatttgcaacatacaccaatgctaaaagaatagtgaaattggtaaatgatgttggtgctgtggtgaacaatgatgctgatgtcaaccaatatctgaaggtggtgttcattccaaactacaacgtatcagtggctgaagtgctcattcctggcagtgaactgtcacagcacattagtactgcaggcatggaagcaagtggaacaagtaacatgaagttctctctgaatggctgtgttatcattggaactctggatggagccaatgttgaaatcagagaagaagtagggcaagacaacttcttccttttcggtgccaaagcagatcagattgctggtctgaggaaggaaagggaagatggcttgttcaagccagacccacgctttgaagaagccaaacagtttatcaggagtggtgctttcggcacctacgactacactcctctcttggattcccttgaagggaacactggatttgggcgtggtgactacttccttgttggctatgacttcccaagctacattgacgcacaggcccgggttgatgaagcctacaaggacaagaagaaatggatcaagatgtccatcttgaacacggctggaagcggcaagttcagcagcgaccgcaccatcgaccaatatgcgaaggagatctggggcatttcggcttgccctgttccatgaagaggagacgtgatcaagaggtgatggatgatgatgcgtggcagtaataaggaccttatactggtccatggtgaataacccctgcttccgttgtagctgagaagaatgaagcaacgtacgaagcctgttgtgttgtgtattctgctgcacttttgaagtgcatagaggatgcgacttttcttttgttctttttcttttttggtctgtaaccatactattttgatcctgaaccggaatggcggaatcatccaggttctcaataaaatagttcaagttttgaaaaaaaaaaaaaaaaaaaaaaaaaaaaa

SEQ ID NO: 26482 - DNA, 2842 bp, Triticum aestivum
  Clone ID: PAT_TA_26482
ccctatcgccacctcccccacacacaccgagtgctcgtgctcgacgcaattccccaccccgcgatgagtgcggcggacaaggtgaagccggcggccagcccggcgtcggaggatccctccgccatcgccggcaacatctcctaccacgcgcagtacagcccccacttctcgccgctcgccttcggccccgagcaggccttctacgccaccgccgagagcgtccgcgaccacctcctccagagatggaacgacacctacctgcatttccacaagacggatcccaagcagacctactacctttccatggagtacctgcagggccgcgcgctcaccaacgccgccggcaacctggccatcaccggcgcctacgcggacgccctgaagaagttcggctacgacctttaggcaatcacttgatagatgagagatgcggcacaggtaaatggagtcgcggtttggctttcatcattattttcatatacgattacaacactgagcttgccttcttggtgctatggccttcgataccgatatggcttgtggaagcagcgccttgccaaggaaggacaagaagaaatcgctgaagaatggcttgataagtttagcccatgacatacaccaatgctaaaagaatagtgaccaatcagatttttcggggtgctgtggtgatcaacgaagctgacgtggaaatgggccggtggagaagttctgttccaaactacaacgtatcagtggctgaagtgctcattcctggcagtgaactgtcacagcacattagtactgcaggcatggaagcaagtggaacaagtaacatgaagttctctctgaatggctgtgttatcattggaactctcgatggagccaatgttgaaatcagagaagaagtagggcaagacaacttcttccttttcggtgccaaagcagatcagattgctggtctgaggaaggaaagggaaaatggcttgttcaagccagacccacgctttgaagaagccaagcagtttatcaggagtggtgctttcggcacctacgactacactcctctcttggattcccttgaagggaacactggatttgggcgtggtgactacttccttgttggctatgacttcccaagctacattgatgcacaggcccgggttgatgaagcctacaaggacaagaagaaatggatcaagatgtccatcttgaacacggctggaagcggcaagttcagcagcgaccgcaccattgaccaatatgcgaaggagatctggggcatttcggcttgccctgttccatgaagaggagacgtgatcaagaggtgttggatgatgatgcgtggcactaataaggaccttgtactggtccatggtgaataacccctgcttccgttgtagctgagaagaatgaagcaacgtacgaagcctgttgttgtgttgtgtattctgctgcacttttgaagtgcatagaggatgcgacttttcttttgttctttttcttttttggtctgtaaccatactattttgatcctgaaccggaagggtggaatcatccaggttctcaataaaatgatcagtggacaagcaaccttgatcttctcaccgggcttcggaaattcgcagatgatgaaaaactacatgctgagtgggcagcagccaagctggccagcaaaaagcgcctagccaagcatgtattggatgtgactggtgttacaattgacccagatagcctttttgatatacaaattaaacgcatccacgaatacaagagacagctgatgaacattttgggagctgtgtacagatacaagaagttaaaggaaatgagcgcagcagacaggcagaaggttacaccgcgcactgtcatggtaggagggaaagcatttgcaacatacaccaacgccaaaagaatagtgaaattggtaaatgatgttggtgctgtggtgaacaacgatgctgacgtcaacaaatatctgaaggtggtgttcattccaaactacaatgtatcagtggctgaagtgctcattcctggcagtgaactgtcacagcacatcagtactgcaggcatggaagcaagtggaacaagtaacatgaagttctctctgaatggctgtgttatcattggaactctcgatggagccaatgttgaaatcagagaagaagtgggacaagacaacttcttccttttcggtgccaaagcagatcaggttgctggtctgaggaaggatagagaaaatggcttgttcaagccagacccacgcttcgaagaagccaagcagtttatcaggagtggtgctttcggcacctacgactacactcctctcttggattcccttgaagggaacactggatttgggcgtggtgactacttccttgttggctatgactttccaagctacattgatgcacaggcccgggttgatgaagcctacaaggacaagaagaaatgggtcaagatgtccatcttgaacacggctggaagcggcaagttcagcagcgaccgcaccatcgaccaatatgcgaaggagatctggggcatttcggcttgccctgttccatgaagaggagacgtgatcaagaggtgatggatgatgatgcgtggcagtaataaggaccttatactggtccatggtgaataacccctgcttccgttgtagctgagaagaatgaagcaacgtacgaagcctgttgtgttgtgtattctgctgcacttttgaagtgcatagaggatgcgacttttcttttgttctttttcttttttggtctgtaaccatactattttgatcctgaaccggaatggcggaatcatccaggttctcaataaaatagttcaagttttgattaaaaaaaaaaaaaaaaaa

SEQ ID NO: 26483 - DNA, 918 bp, Triticum aestivum
  Clone ID: PAT_TA_26483
gccgcggcggcatctcctaaccctagccgtcaacggcggcgcgctccgtaacccgtgttctacgattgactgctggagagaaagctacaggggtcgagttggatggcgccttctacatccgacggtgaggcgagcagcagcgggacgggctcaaaatcgaaggagaaggagcggccaaggtcctttgacgagaagacccggaccgcgtgctggcggaaggcggcggtgctggcagggcgacacccagagcggtggcggcaggacgccgctggcaacgtggtgtgtcgccgcttctggagctgccacggctgcctctgctacgaatacgaccacatcattcccttctccaaaggaggggaatctactgttgagaattgccagatccttcagactagggtgaaccgttccaagtctgataaagcatgggtggagaaggcagagatgcaaggcttttcctgcgatatcaagttcacagacaaggagcttgatgtaatcgagatggcagtctatggggatgtcattcgtcctggcaaacaatgtcgctgcaagacagtagctgagatgcttggacaggtgaaatcaaagaatcaaatggctgcttgtgactcaccaacataatgatgcctcctaatatgaagaccattttgacctgtgcccttctttcggggagggcagtcattgtcaaactgctgattacattatactattattgatctcccttaaattggcatcattgtcttcagcacaaaagcacacccatagagcaatctaagctcataagtgcaattatattgtgctttgtcagtgatgcctgtcagaaacttggaatgtaacaatgtacatgtttgactgtagaattatttaacttgataacaccacttatcaagagttgtgtcaaagtattgtgtttgtagtaat

SEQ ID NO: 26484 - DNA, 437 bp, Triticum aestivum
  Clone ID: PAT_TA_26484
gcctacagagaaggtttcaccttgtcctaggtgatttgcttcctatgaaccaatattaatcagacatgtcacgagcatgcagcttcaactgcaaggctttttgtgacccctgtacatggatttccaaaataattcgacgacactggcacgctgcagctgctcactccgatgcaagcctcctgaacaattgagagagcctgagtgctgctgcattcgccatggctgtagcttccacatgtgccactcggtgtcccaaagcttgcaaacttgacgctgctgatgacctggccttcttttgggcattccaggcgaagtgcaggtccatatctctgcatcggctgttgagaactccaactatcaatttgggctggatgtgcctctgatacttgtgcgcacaaaattcctggtcggcctcatcacaaaggatatcttgcttg

SEQ ID NO: 26485 - DNA, 544 bp, Triticum aestivum
  Clone ID: PAT_TA_26485
cagcatcattacaactgcaaccagatttaggattcatgaaacggatacaacaaatattaggtcggaaacaccagcgaaaccttcatgggatttatatactccacccaaccttggggttgagaacagctattctggggatgcagcttttgattgatggagaggtatggaagaaagttgtgtatgttgacaggctggtgcaattgttcagatatgtaccacgcgaacaattaactatcccagattttgtatttcagcatgatttggaggtgaatggtggtaggggcatgattgtggacccaagaacaaaacatatctatcagagaccatctggctgattcatgtcatttatgcagtccaaagctcatacttgttgcttgtgcaagtctttgtataattactcctttgttgatatttctcgttttcctttgtatcgaatttaggtgttctattcctttcattcgttcctcagccttcagggaaggggattattgtttgtatatgttaatttctacagctgaataaaagtggcgtctcagtgctcgtc

SEQ ID NO: 26486 - DNA, 1645 bp, Triticum aestivum
  Clone ID: PAT_TA_26486
attcggcacgagcttcacggggccctgaacatgctgtcaagtatcactctgctgcagtgagtgcccgcagccactgctacagggctcccctggttttacccgtagagaaaggtcttctacctattgccatgggctgcatatacacaaacttctccaattcataccgtgatccgcccgctcttctcccaatatatactgtaatagagttctcggagaaattctaggacaaactaactactgtagtcgatcgtatcttaccataaactagtacagagatctttatgagactgcttcctcttgagtttcctctggtgaatcaagaagatgagagcggttcgtaaaaacctccagctgatgttggggatgagaatggtgagccaataatagatgaaaggaaaataagaataaaaacattgcctgctgaggcagcaaatagcaagtatgcagttcccgtgcccgcagatattcctctttctggttctggattgacacgtagaagaaattctaagttggattcatatttggatccatcctttatgtccataattaaagatccggatctccgacgcaaggagcaatgggaaaagtctgcgcaggcaaagaagggatttaattttgctaagttgcttggttttggtgatcttggtggtcctgcattatcggctgcagaagaatattcacttcatcaacgataccttgctaaagcaaattcccttaatctttcagaaatcgctgaaatgaaaataatttaccgtggcggagttgacagtgaagggcgtccaattatggttgttgttggcgctcactttcttcttcgctgtttggacctggaacgatttattctatatgtagtaaaggagtttgaacctttgattcaaaagccttactcaattgtctatttccactcagcagcgtccttacaagtacagccagacttgggattcatgaagcggttacaacaaatgctaggtcgtaagcatcagcgaaatcttcaggctatatatgtactccacccaacgctgggattgagaacagctattttggcgttgcagcttcttgttgatggagatgtctggaagaaagttgtctatgtcgacagacttatgcagctgttcagatacgtgccacgggaacaactaacaattccagattttgtcttccagcatgatctagaagtgaatggtggaaagggcataatcgttgatcctagaacgaagcatgtctaccaaagaccgtcaggttgacatttagcaacttgttgctcccagtttccggtcaccccgctgtcaaatctctgttctctgtaggagagttcacatctagatccgtgaagtatgtatctagttgagttgacattatgttctgcattacattctttcttatcttaggaaggtagttatgtatatgtatcttgttctgtataaccaaataaaggctgtgtctctcaagttcttccgctgggctaaatcgcctagtccttgtgtactgtaaaattttgactggtccttgcagtgcagcaacagattgtcctgttatcaatgttctggacatgctggcgtaataatcttgtaaagtcacgtagataccctccacagacagaattcgtactgtatggtgtgggataagtcaatctacgtttagttca

SEQ ID NO: 26487 - DNA, 1491 bp, Triticum aestivum
  unsure (1)..(1491): unsure at all n locations
  Clone ID: PAT_TA_26487
cccggggtcgagtccagcttcgtgccgccggnagcgcctccgtcgccgtccccagctccggctctgactagtctggacccggatcttggcctcctgatcgcgtccgccggcttctcggtgggcgccggcggcgccgactcggacaacagcgacgaccggaccagcaagtcctccaccgcgctcccgcgccacgacttctcgctcgccggcttcggccgcgaccgcgacagggcgcggtcccgagcccccggcgccgctgctcacgccaagaacctccgcaccgcacgcgcccgcggcgccggtgcgcgcgccgtctctgcggcctcctccacggtggagccggagaactcgcgctccagcgtcgaatctgacctccgcagcactggcgctgctcacgcgcgaaaatcaagcgctggcatcagcagtaatggcgttcacaagtttctctacactgatggcgaccacagcgacgatgaagctccaagtgagcacttgcgatctgcagctggaggtttctataaggagaatgggagtgcagtagggagaatggcaatggggaatggtgatttgtattcccatgatcatggatttcatgaagggagcatcggcaagggtgagaatggagggttccgcgcaggtcttgatccgtacgccgactcgatttcgatgcttcagtcagcacaagaagcacttgagaatgagctccaaatgtttgtggaaatcgggaaagaaagcagtgacaattccacagacaattccgatgaaaatgaatggagcagttcacccaattgcgaagatttttcagaagaaataagtgaaaagttgaagcttctagagtccaagctggaagaagcttcccttctcatcgatgagaaggattcgagaatacttgaacttgatacactcaacaagacaaaaccaggggaaaccgcgctatacaatagcaagctactttccctacagtctgaagttgatcaactgctcatggagaagatggaggccgagatccagtgcttcatcctgaaaagagcttcagaagcttggcaaccccagactgagggtcagggcactcttcaagaagctcagaagactctgtccgaggatcacaaacagctggaggtcaagcttcggcacaccgagaacagagcgaggacgctagaggagttggtggagaagctagagtcacagtgcaaagagctgtcgaacgcttcagaggtcctgaagctgcaggcaggagcaagtcgagcttcacttttttgttccgttcagttagtgctgctgtgcatcgcagcgtggacattcgtcgcgcggttcttgccctctccccccgaatttgtacctacttgatgaggttagaaagtttctctgcggatgagcctctgtgtagacattattgaaaagttacttcctgtaatctattaggcattggtggccttataaattttctgtttgtaacaccaactcagattttgcnagttaccatcacnnnnc

SEQ ID NO: 26488 - DNA, 884 bp, Triticum aestivum
  Clone ID: PAT_TA_26488
ttcagcaacataattgggtcttcccacgagacggtggtgtacaagggaaccatgaaggatggccgggagatcgccgtcgtgtcgatgtccgctccggtgcactactggacgaactacgtcgagctttactttcagaaggaggtggtagaagtggcgagattgagtcacgaaaacgccgcgaagatggtgggatactgcaagtcgtccgatccgttctcaaggatggtggtcttcgagtacccacccaacgggacgctctatgagcatctccacgatgtggaagggtgtcagctatcctggccgaggcggatgaagatagcgctgagcatcgcgcgcgtcctcagatacctgcacaccgagctgcagccgccgttcgccgtggcagcgctggcctccagctccatctatctgacggaagacttctcacccaagataattgacttcgagagtgggagggggtctcgtcggcaaacccctcctgagctccggctgcgtggtgaacggcggcggcgggcattccaacggcgtcgtggactcccggcacgtgcgcttcatggacgtccaggccaacaccttcgccttcggcgtgatcctcctggagctgatcagcggcagagcctcgctctccaaggacacagacgacctggtgaactgggcgaggaagcacttggagcaggcgggggagtttggcaagctggtggacccgaagctgaggagcgtgggccaggagagcctgggcatcatctgcaacgtggtgaacctgtgcatcgacgccgagccgtcgcggaggccctccatgaacatgatcggggccatcctcgaggaaggcgtcgacacgtccgtcagggactcctcactggcctgggcggaggcggccatctcct

SEQ ID NO: 26489 - DNA, 1051 bp, Triticum aestivum
  Clone ID: PAT_TA_26489
agtagcctctgctggtaacacttgctgttgcttttatggaaacattaagtaccgtgcttcagggattcacggatggccacggcttggaagatacatcaggctttttggtatcacttgtatttggtcttggtccactttttggaggaattatacttgtcgcgttctcacttgccttcaacatgccacaccctcttcttactggtgtagcatctggcattgccttccgtcttgcttcatggaggccattgcaacttgtgacgtccttaaagatgggtttcttcaccaccttgttcctcctgctaggaggttccgtcttctaccatctcgtggaagcaagcatccttatggttgctaaacacaagaaatcatccgtcaatgtcattacatcttccagcgggctctctcttagtgtcctcacacagcaatcgctccttgcttgcggttgcgtcttccttcacgcctacgccgaagggcttgcacttggtgtggcggcacgcaaggcatctggtctaggccgctacatggttcttccagtctctcttcacggcctaccacggggtgctgctgttgctagttgtgtatatggtgccactgatagctggcgaggagccttggcagctgcagctctgaccgggtttgcgggaccaagcgcggccatcggtgcaatccttgcgaagattggctatgatggactggactattggatggtgattgcatgcggggctttgatcccgagctttggccgtgtcttcagacgctcgctgcggctggacgcgaggaacagcgtctgcgggctcctgataggttttggttttgcttgggtgtgcttgatgtccaccagattcatctgcttgcacaccccttactgcaattcagctccagaagcggttacatgatgtgttcctgtcagatagtcacatgtaacatcaatgtaacgataatactgaaattataagagggatatcctttccttgtatgaacaaagtgatgaatgggaaacgaacattagacagtgattttgcctggaaaaaaaaaaaaaaaaaaaaaaaaa

SEQ ID NO: 26490 - DNA, 1274 bp, Triticum aestivum
  unsure (1)..(1274): unsure at all n locations
  Clone ID: PAT_TA_26490
cccgctcctccccgtcatcttccgcgccgtcgggtcctgcgcgccgggatctgtcctaggagagcttccggcgggggcggccggcgttgcggggctctccaggctgccgctatcgctacttcaccagttcgcgtccttgctagaagggcgaacgagttcgccctgtgcctgcccagcggcggcgacggcgtggcagtcttcggtggcggcccgttccagctcctggccgcgccgcccgtggagctcgccgagcggcttcgcgagaacccgctccctctcctcaagcacccctacaacggcggctactacttcggcatcaccggcgtcgccgtgaaccagcagcgcgtgccgacgccagacggcgtcttcgacctcgacgccggcagcggcacgggcggcgccgtcttcagcaccgtcacgccctacacggcgctccgctgggacatctactggccgctccgcaacgcgttcgacgtggccacgagtggtatcgcgcgcgcggacaaggtggcgccgttcgacctgtgctaccaggcgtccgcgctcaccgtgacccgggtgggctacgccgtggccagcatcgagctgatgctggacggcggccggaactggacgctgcccggcgccagctcgctcgtgcaggtcaacgacaacaccgtgtgcttcgcgttcgtccagatggcgtcgtccatgccagcggcaatcgactcgccggcggtcatcctcggggggcaccagatggagaacaacctgctgatgttcgatctggtgaaggagacgttcgcgttcagtgggcttctcctcggaatccgcactacgtgcagcaacttcaacttcaccatgggcagttcttattagaagagtgtgtcactggtcttgcgagtctagcgccaccgccaccacgttcgtttgtgctcgatgtagactttggttcaagggaagtaccgtcgtagtgttgtgttcgtggtaacaagaataaagttttatgctagtggcggatgccacacaagtaaaaaacaaccaaaaaggggaaaaataccaattcccccaaaaggancctattacccngccaacngccttctttaaactctgacnggnaaacctgggttnccaantaatcccttgaanaaacccttcncaanngggtaatacnaaangcccacgntgccttcaaaattccactaaggcaaggaccccttacggcataaccggggtgtgggtaccaataccgtaatncagccanccgccttntttctcttnatcngttcctanaa

SEQ ID NO: 26491 - DNA, 590 bp, Triticum aestivum
  Clone ID: PAT_TA_26491
ccggtcttgagctacacgcgcttccacaggtgtcgtatggacgtcagaacaagcatacaagcacggtttcctcgaacatccggaagaatgggcaaacctgggtcagggagcgcccgaggtcgacgatagcatcaaaggctgctttgagaggccaaaggaggttgatatcagtgctcacggcagagagtacggtccgactgctggtatcaggccgctgagagaggcggtcgcgacactatacaacgagcaccaccgcaagtggcgcaagagccagtacacatgggagaatgtgtgcattgtgcctggtggacgtgcgggtttgatccgtatcgctgctgtgctgggcaactgctacttgggcttcttcattcctgattacactgcatacaacgagatgttgtcgcttttccgtaacatcgctgccattcccgttccgctaggcgaagcagaccaataccacatgtcacccgacaagattgccgaggaaatcgcccgtggtacatctgttattcttacatcgaacccgcgtaatcccacaggtcagatggtcaccaaccccgaactcgcacagattcagaacatctgccgcg

SEQ ID NO: 26492 - DNA, 398 bp, Triticum aestivum
  unsure (1)..(398): unsure at all n locations
  Clone ID: PAT_TA_26492
cnnaatgtgatgtgcaactcctcaccgtccgtctcatcaccgcaatgagcagcccttgtttagtcggtactgctaaatgcaaataacgggacacaagagtgttatctggaggcagacaatgcatgtgttgtgtttgtttagtcggtactgctaaatgcaaataacgggacacaagagtgttatctggaggcagacaatgcatgtgttgtgtttgttgatctttctttagtttgctgaaatttttaatagcaactgtgtaaccaagatgtagggcgtggtgaggatgtgtactctactactatgtgatttgctcaaaattatctcaatggaatcttcgacaatgtgatccattttgaagttcagctcgtgccgaattcggcacgagnnnnnnnnnnnnn

SEQ ID NO: 26493 - DNA, 645 bp, Triticum aestivum
  Clone ID: PAT_TA_26493
ccctcgagtatttatttttgttttttaaagtgaaagaccaatgcagtcaccaatattcaagtaaaagaaggcgctctagtctgagagagacatattaaagtaaaataacaggtactctagtctgagagagtaagacaggcaggcaggccataacaaagattctcagcttcttcaatagaagaaacctagaaccttgcctcctacgctcttccggcgggcctcctcgtggtccatgatgcctgccgaagttgtgaggacgatgtatccgaactgcctggacgggagcagccttgcagtccatccctcaatgtctttcacgccgatatcaaagcgagggctgatgacgccgcacttgttcagcctcccgttgagttcgaccacgatcttgcccgatcggtggtcatcaacgtactcgaactctccaatgtagccgtggcgctgcatgaccgtcaggaacttgatgatgaccttggacgacggcctgatcatgacctgcctcttgccgatcttctaagcgttgtacatggacttgagcgcatcgttgagcacactgaccctcaccatgctgaccttacctcgacggacggcgtgatcgagggtggcggtggccggtggcgacgagctctggaggaggagcggcacgag

SEQ ID NO: 26494 - DNA, 846 bp, Triticum aestivum
  Clone ID: PAT_TA_26494
ctctgcccgcccgtgttggcccctccctgttaggttttcccccacctcaccgaaggcgccgccggctatctgctccgactccgccgcgcccctggacgccggacctccacgtcccttgccgccgtcccgtccctcccgtcctgcgcccgactctgccgcatcctcgccgcgaggcggcgccggtacatcctcaagctgctaagtttcggtttgctgcaatggcagaggaggagaaaatgacagaggtgtttgatgttggttgtgtcacaaatgagcatgcaagggttccaactcccacatatcaaggtggcccggctcaagtcgattcggaagatgattctggctgtgaatgtgagcacgtccaagttacacctctcccgaatcgtgtaaagagtaggaagaagagggcatgtccttattcgcgtatggtggcaagtgagattgctaaaaacaaggcacttgtgcgtttggtggaaatttttgaggcgagggaaaagagagtgacaaatcaaagtgcaaaagagattgtggatccaacaagacaggagattcaagacgtgatggccatggtgattgcagacggagccaaacctgggagtgatgagcatttctatgcttcacatcttttgttggaaaagaagaatcgtgatgtttttacctcgtttaagggtcccaaacctagtgagaggcttgcatggataaggaggatgtgggagctcaccaataagtagaatctctatgttttaaatgctttgaagtttgaacaaaactatttgcttttaacttgtactgctgtgaactatcttatttgattcgaacatcgctttgctgctcatatttgaggtt

SEQ ID NO: 26495 - DNA, 575 bp, Triticum aestivum
  Clone ID: PAT_TA_26495
agaatgtaactctggtgttgatatattgggatctgattgtgatggagagatgctcgtgaccaaatttatctctagaaagcaatgggtcgtaatcgggaactcagacgggtttatccttgtgtgcacgtgtccttcaatggaccaagtcacacatttcaaagctcaccgtgatagtctcggtttattggcagttcacccaactcgcccgttcctgttgtcgtgtaacaacatgaagatgaagatttgggactggaaccgtggctggtcttgtattggaaaaattcatagcactagccgggtgacacaagtcatgtttaaccccaggaatactaacgatttcgctactcaccatcatgatgggattgtcaagatgtggagaattgatcatcccgaccccgtcggcacaacgcaccgcctacatgacatgtatgagactgctagcagctctttcacttacaccggtgatcggtatttcattgctgccatccacaacagcaagaatgttgcgctgaccatatgggatttgcagaaagaagaacatgtctacacactcaccactgacgaggtgactgctg

SEQ ID NO: 26496 - DNA, 638 bp, Triticum aestivum
  unsure (1)..(638): unsure at all n locations
  Clone ID: PAT_TA_26496
accccatccaacccatcgctcgctcgccaagatccaagcagccgcgacggctgggagactgggaggacgcgcgcgggaggagatccaaggaggccgaggaaggccccggcggcgccactggcctagaagcccgtggccggtgacgataacagagagggcgtcgccagctcggacaccccgctcgccttacccgagggcgaccagtacgacgaggtggcggcggggaggacgaggccatggccagcgcacaggacaagtgggcgcaacaggagcaggccagcccgccatggcagtggatcgggggcgacggcggctactccttggttaaactgcatctttttgtggcgcttgggtacattcccgaatcaactacaaaatccctcactacgcccatgcccagagattagccaatatttcggagatgtggtggctcaactaattggagacagaacaagatgaagaaggaaagtacggccacatcagggcgacctgngagcaagagatgatcaccataatctaggtgctaaaggcctagtgaattataacatggtttttttatagaaaggcaactaaaactttntactttcttggtctaatgtagttttcctatgcttatagtctctttcctgtatagagag

SEQ ID NO: 26497 - DNA, 928 bp, Triticum aestivum
  Clone ID: PAT_TA_26497
cgcttcaccccccgccgtgctccctctctttcccctctccccgatctccgtctccgtctccgtcctcccgccgctgccgccatggacggcgtcatcggccagatcttggagaagcaggtcctgtcggccgcgaaggcggtcgaggacaagctagatgagcagatcgccgcgctcgagcggctcgacccggacgacatcgaggcgctccgcgagcgccggatgctgcagatgcgccgcgcggccgagcgccgggccaagtggcgcgccctggggcacggcgagtacacggaggtccccgagaaagagttcttctccgccgccaaggccagcgagcgcatggtgtgccacttctaccgcgacaactggccgtgcaaggttatggacaaacacatgtcgattcttgctaaacagcatgtagaaacacggtttatcaaagtccatgctgaaaaggctccctttctgaccgaaaaactaagggttgttgtgctcccaactcttgccctagtgaagaatgccaaggttgaggattatgtggttggatttgatgagctgggtggtaaagatgacttcagcactgaggatctggaggaacgcattgccaaagctcaagtgatcttcctcgacggagaggggcctgcaaatccttccaagcaagctgctgccagcaagcgaagcgttcgacaatcagatactggcaactcagactcagactagttctgttcctgtattgaaggcgtgtgcgccaaggatttttatatataggatttatgccaagctgttatgctatccttactagtaataggaaagaagtttgtgtttcgatggcgatttgaaccgcaattgtcactgttgtagagtgctcttgtttttaccatgcgtccatacctggtttggccggtttataatggaaagtttttgtgcaaaaaaa

SEQ ID NO: 26498 - DNA, 674 bp, Triticum aestivum
  Clone ID: PAT_TA_26498
caaaaaaaaaataaaaaaaataggagagtagaagaaaccacacatgaaaagcataggagtcagggggcagcatcatctcgtcctccattagtagtaatttttctcggacacaaatcttatttctcatacgccattgacaagacaaacttgcttggagttttggctccagggagcatatactccctggtgaacagtaaatagaaaacaaaatcctgaagatggatcttgttttgtaaacacaataaattttcaaaatcctgaagtttttctgtagaccttcatgttagtgtaacaagcgtgcttgccaattatttcggtctactccttgctcttgctttggtgtcgtcactctacttctctccatacagtttcaccctgacatgaaaagctagttcttattatccatgtcatttgtttttgtatgcattggtaacactcatatgtatatgtgtgctcctcaaatatttggattttgaaccaccagaccattcaaataaatgcatggactcttacctagatataaataaatggcagggatagttgcatcagtacatgctcgaggaacactatgtttgaccacgaagataagtttgtgccaagtactgatttgtgatttgtgacaagtactgatttgtcacaagtatatatacaaactgaagatagttccatcagta

SEQ ID NO: 26499 - DNA, 947 bp, Triticum aestivum
  Clone ID: PAT_TA_26499
ctcggcatcgccccgcccgccaccttctccccggctggagcccggcgccgtcccgccccccaccttctccccggctggctcatggcgccgccccgacccccaccttcttcccgtctggcacctggcgccgccccctgcttccacccgccatcgtcaccaccacctgcttccacggttccacccgccaccgtccgccccctgcttccagccaccgctgcccctccgccttctttcgctggtggaccaacctcgctgccgtgctacacggtcaaggtcgcgcgggagacgtcgtccctagcccagccgatgtggcccggcaccctgaccaccgccatgcccctgcgccttgactatcgccgatgtccaacgccacggtgcctcccatggcggccgttcactgccgccaccctgggccgttcaacaacacagcgccgagccgttaaacgccgcagctctaccaccattcgcaactccgactttcatggttgcagcaagaacaagatgccaaagtaaaagtctccaaaaaagcctaatctttgcatctttcggtactcactcaagtgaagtctcgatttcttctaaatctgaagttcaagttctctgaaacatttggcaatagttcggcgaaaaggtttacctcagtacaaaagtccttgttgggatgagagggatgactagaatgctctgggaaatatctttacttgacccagaggcggtatgcttttattgatctcctttgtagtgctatgggtgctgtaataagagcaaattacatattaacttgtatatctaggaatactgtgtggactagaaaatgtattattttagtatcttgagatcttcagtcaagtttgtgtgcccaagctgagcttaatttgtccatgtaccgcggccgcgaccgcgctagttgtgcattgcagagttttgaaaaaaaaaaaaaaaaaaaa

SEQ ID NO: 26500 - DNA, 916 bp, Triticum aestivum
  unsure (1)..(916): unsure at all n locations
  Clone ID: PAT_TA_26500
ctctcctcctccnctcatccagtcgccgccgcccgcggagctcacgctcgtctaccgcccggccatcggcggctccgcactggagcttgccagccgcgcgctcccgccggcgtgccccgccgaggccagcctcctgctcgtccgcggcgcggacgacgcgccggcgtacgcgagcgccgatcgcgtctcggccgccgagggcgcgcgcttcgaggtgtacgccgggaaggagctcgcggcggagggcgcctttttcccgcggcggcgcctcgacggaggagggtggcgcgtcgagtgccgccggccggccgggtcgcgctcgcgggtggcggaggtgctggtcctcgcggagggcggcgtgctcataagggccagggccagggcggcgacgcggatcgggtgcgcgacgccgctcgaggggataccggaggaggatgcgtcctcctgggggtcgtgcgagtgcggggcttgtggggacgagtggcagatggtcggagacagcagcagcgatgatgacgacggcgacaagctgaaggaggaggaggtggaggccgagacgatgcggtgggcgctggagatgggcgcctgggcggtgtgcgtcggggtcggcctgctcgccaccgcccgccggttcagccggaggagggccgcgctccggtgatccctgcctgtcaagagaaatttgtttttgttttcttcagtctcacttggtcaaagtgtattcagcagtagcttcttcttcttcagtctagtgattttgtttcgtgggagttgtcaatcaaagcttgtagcgtatatgtacatacactccgaaatcatactggtcagtagtgatactggtgtatgaactttgcacaacatactaacagtacatcaaaactgatcactccggaatcgattcaccatgaaaaaaaaa

SEQ ID NO: 26501 - DNA, 1066 bp, Triticum aestivum
  Clone ID: PAT_TA_26501
cccgggccgcctccggctcgaggtgacgggggctccgcccagtggggcattccgaacggcggtgaaactgatgctgctcaaaatggtgtcttacaaagtgaggatggcgatgcttttgtatctgcaagttttcctatatttgagcgtctggagcgcggtcctcccggtggcagtgccccctttacagacatgctgtcgctgcgtgcggctgccttcccggcgcttgtcacattcatgaagctgcgatttgctgccatccagttggatgtctgttgcatggccagccgtaaagagagtcccgacccgtttgtcgctgaccgccttggacgcgtgtttcttgtcgttcctcctactgtcaataccttctaaagataccctgaccaacactcccggcatgccccggcttctcggtatcctggcactacctcccagggatggccatcctatcacaccccgattccccggtttcgagggaaacggccagtgcacccacctcaacggccaggctttccctgcccgccttcgggctggcgtcgtacaagctccgcagctccttgtgggcgtcctaacggcgccccggagcaggagagcgtcacgtcgctgatgcaggaggcggacaactggctccgctgcgtacaggtggaccacccggacttccggttcttcgtctcgcactttggcgcgacgtggagatgactgcttctgttgtaaatgtcttttttgtgactgttactgttagttatatggtgatgactgtgtgttgccaagtctgaactcaggtggctgtgcgttgagcacaagtctgttatggcacatagtgcagcagcgcccctctgccgcgggggttgtatcagttaaaaaaaggcccgcctgtattgcgggcgggctcgactcttgttgtcgtctccaataagtttataactgtctggtgtaggtaactttttgtgggggagttacagatatgatggatcggaagtacaattggagacttgtaaaacttttcaggcaaatgataggaaagaataaattatcggatttagttatgaacataaaaaaaaaaaaaaaa

SEQ ID NO: 26502 - DNA, 441 bp, Triticum aestivum
  Clone ID: PAT_TA_26502
gacgtcgttcacaagttattcacagagcttgcgtaccgctacaaggatcgagctggtgggtatacaagactattgcgaaccaggatacgaattggcgatgctgcaccaatggcttacatcgagtttgtcgaccgggagaatgaacttcgtgaggccaaacctgcgactccaccgccaccccagcgtgcccctcttgatccatggaccaagtcccatgccagccaacagtgggcagggcctaaagtcagccagaactccaaaacagaagggctatgagaatcaaacgcaccagtttatctttattttgtgtttgtgagatttttttatctttagacgcgctaattaattaggagatccattctgtaagagactaaaaacttatgtttccacatgatatctatattatttgtcaaggatcactgtgactagaaattgttactg

SEQ ID NO: 26503 - DNA, 922 bp, Triticum aestivum
  Clone ID: PAT_TA_26503
ccacgcgtccccgcgcgcgccctcccagccggtcccctcggcccgctgccagccggaccgaccgagcaccttcgcaaacccctcaaccctcgccgccgccgccgccgcacacgaccaccccggcgacatgggcaagttccgcaagctcgggcgccacgctgcgcaccgcgtatccatgctcaggacgatggtgtcgcagctggtgaagcacgagcgcatcgagaccaccgtcgccaaggcgaaggaggtgcggcgcaaggcggatcagatggtgcagctcggcaaagatggtacactggatgcagcaagacgtgcttctgcttttgttcgcggagatgatgttgtccataagctattcacagagctggcctaccgctataaagatcgagcaggtggatatacaagacttttgcgaactaggatacgaataggcgatgcagcaccaatggcatacattgagtttgtggacagagagaacgagctccgggaggccaaacctgcaacgccgccgccgcctcagcgggttccacttgatccatgggccaagtctcgtgccagccaacaatgggcgggaccgaaagttaccatgaaccccaagtcagaaggcttatgagagcagcatctgcactgtgtttctttctggtgaatgagagaattcatttgtttgtggaactcgactaggcatggggcttgtcatgcaggaggatttttgtcagcgtataattgtcaatagaataattcaacttagatttgctatccctccggtgaatacagagatgtatgatcgaatggggatgcggtggtggtatggcgcaagtgtcagtgatatgttggtttttcctattgctgatgtacaatgaaatgtttgaagaatcacctggcagattcgagcctggatctcatgcctttcccgagcctccat

SEQ ID NO: 26504 - DNA, 475 bp, Triticum aestivum
  Clone ID: PAT_TA_26504
ttttttttgtttagcaaaatactattatagcttagcttgttcatagagactggaggagcatgacggctgatcacacgcgatcaactatcccaagtttttacaggcacagaactaccaccgacactcatgctggagctaccgacgaatctagagctactgacaatattacgattggatcaaaatccatgaaagaggggaatctataggcggaattgagggggggatctcgccagcgacaaggcaggcagactacttcttggccttcctggccacgcccttcctggccggggcggcagcagcagcagccttcttcggggttgccaccttcttaggagccgccgctgcctttcccttcttggcaggagcagccgccttcttggctgccttggcgggggaggccttggcggaggtcttggcgaccttgggagggcgcccgcggggcttgggcgacgcggcggcaggagcgacaggcttg

SEQ ID NO: 26505 - DNA, 1261 bp, Triticum aestivum
  unsure (1)..(1261): unsure at all n locations
  Clone ID: PAT_TA_26505
aaaccatccggtacatgaaactgaagnagactactgacaaaagttgaccatccttatgtagtgcagctgaggtactcctttcagaccaaatatcgactttaccttgtcctggacttcgtaaacggggggcatctcttctttcagctctacaagcaaggattatttagggaggaacttgcacgaatctatacggctgagattatatctgctgtagcccacctccatgctaatgggattatgcatagagatcttaagcccgagaacatcctattggatgctgaaggccatgccatgctaactgactttggccttgcgaaagaattccgtgagaacacccgatcaaactcgatgtgtggcactgtcgagtatatggcccctgaaattattcagggccaggggcatgataaggccgcagattggtggagtgtaggaatcctcctgtttgaaatgctgacgggcaagcccccgtttgttgggaacagagacaaagttcagcagaagatagtgaaggagaagttgaagcttcctccgtttttgactagtgaagctcactcactgctgaaaggattgctgcacaaagaggccggcaagcggctgggaaccggacctggcggcagcgacgagataaagaagcacaagtggttcaagccgatcaactggaggaagctggacgccagggagatccagccgagcttccggtcccgacgtcgccggcctgacctgcatcgccaatttcgaacgtgtcgctggaccaacacgcccgtgctggactccccggccgccacccccgtcactgccggcggggggcaaggcaacttcgcggggttcacctacgtcaggcccgcgccgttcctccatgacctgaagccgccctcgagctctagctaggctgcaagattcactctagtgcgcccgaaacgggtgtgcgcaattttgatctagttcattcactgaaccgctgtgttctatggcctgtatgatgtatagattcttgtgcatctgctttacttgcggcaatgagaacgttggaaacagagagcaactgccgccggccggccctgcggcgccgtcgtcgacgtgccctggcccgtcacgcccgggcgcggctccccggccgccacccccgtctgctgccggcggccggcgtggcctctttcgcgggctgctccttcgtctggcccgcgccctgcctccgggacctgttgccgccctcttgcgctaccttgctatttttgttaaaattcagtcaaattttgaagct

SEQ ID NO: 26506 - DNA, 1227 bp, Triticum aestivum
  Clone ID: PAT_TA_26506
gtggccgtcgtggcggccggcgcgcttcctccaccgcagcgtgatggggtgcgctcgtccgggcagcctgccacctctcttgctttctagcttactgtggcctgtggtcgcccagctcctggcggggatagtagtatgtggccagagcagggcatctatctcggcgacccagctgtacaccacactactccagggtatttggatccttgccttgcgcctgcaagcccatcgcctatcctcacaggcactagcataaaattcatatgcttctgtacttcaaaccaaaggacccttgttatagaaggaaattgcttttattcatgtattttaatagtatatacattcttgaaccgatggtgaaattgtgttgactttcatacttaaccaaatgcaaatcaactagctttagcactattagccatgttatagaaaaacaactccttagggtcatttatccaagctgcattcttttcgtcaaggattcgcacatgtgatgggggatttcccaatgctttatgaagcatcatgatcagggtaacatgacgacgctgggtctccgtgctgctctggtgccccctcgacgctgctcgtgcgcctcgcttcccgtgtcccggctgatcggtgatataacctttggaccaacaatgctcgacatttttagggatttactctcgcatcgactaaacgcatggttcattgctgacagtagggaaacgagcgggtatttctttttggaaaccacattagagcttatgggcatcaacaattttatcaatgaggaagtattccaagccaaggtcactgctgagtagacatgaagaggatgaatcctactttgatgagccctcatacatcatgcttcaccttccttcaatgttagagtaatttgtgaacaaggaaatatcaagctgatgcacttggccatttaggagctgatgatccggaagaaatggtagaattagatatttcataggcatagtaattttcttctaatgccgggactcgagttagatccgtatcaggtaaagactccagtctacatgtatgttcactctctgaatgtaattcagaaagttgagggttccgatctgcatgttagcccacaccttgcacaaagtgaacactcacatgtatgcggatactggttttgcttatggtgcctatcaactcaaactaatttgacatgtgtatcttattcgttttcgcccccccggtcaaaaaaaaaaa

SEQ ID NO: 26507 - DNA, 929 bp, Triticum aestivum
  Clone ID: PAT_TA_26507
gcggcggcggcggcggcggcgcggcggcgagtatactcgtagacagcaagcctgaatccccaaaaaactagagagcgagaggatttgcgaaatcccagatctttgaaggagatggagatggagatcgagagggactcccaggagcagaggaggatgtggatcgcagaccactcgttgaagcatgcgaagatgctagcagagttcggctatgatatgccgagcaggaagaccactatgtccctgaggaaggaggcctccacgtccctgaggttggaagatggaggcttggttgacgctctttgtcgccaccgtgagatcctgaggagggaaaccaacttcttgatgggggaggtcaattcacgggcgcttgcaactttaggcggaaggaaggcttacagggagtcgatccaacgggagaacaatgtcgccgtcgctcttctccgattcgttcgcctcaagaacggtcgacttggtgggggtgagcttgccccactttgtcaccagccatgaggagtccctggatcttctcttgcgcgagtcggatcatctgggccgccggatccagtctctggcgtccataatgaggaaatttgatatccccgtctcctccgacaagcccaaaaagctgctgtttctcatgtcacgcgcagctgtgataatctccaagactatgaagaattattccaaggaggatgctacttcttcaaagcttcttcaccgtgcccactgggaatctatatggggcagtcagatggcaagccatggtgtcttcgatgatataagtatttttgttgtcagcttgctttcttcttcttaattactacccatgtcccgttcaattaataatgcaatcggaccactctctattttcactcttcgtatacttgcttaattaattttgtaatttgttaatatagattttttttgcg

SEQ ID NO: 26508 - DNA, 684 bp, Triticum aestivum
  unsure (1)..(684): unsure at all n locations
  Clone ID: PAT_TA_26508
gttcattcaccagctagaaaatgtgttcaaataggagtggcagaaaaataacacggtttaccagattatactgtcacaaactgttaccgaacacttaaaacaaagactagatgttccccaaaactgatgacaaagcacagctcctcagtacttgataggggcaagaatctccaactgagaccccaacttctcctcggctgccttctcggccttgacacgcagcttggccaattgcttcttcctctcgtaggcaaccttggccttctccttcctcttctcctcaagttccctgatggtgtcatggtagttccacccgacctccttagagagtcgccgaggaggcagtacttgtgtccaggctgtaacctcagaaccttaggcgcggcggggacgtccctcccgccggcccttcgggccgcggccccgccctccttcgcctccccgcccctccccgctcccccgcgcggtcttgcccgcagcgccccccgctgtcccgcgggcatggcggccgtgccgggcccctacctgtctccataccgcccttcccccgcttcggcgtctgcggactccggcggaccactggctcccactatccctganaaancccttcantgnganacaaagccgacgttcctcaaattncactaangaangaccccgtcggntaccgnggtngnaccctcn

SEQ ID NO: 26509 - DNA, 1110 bp, Triticum aestivum
  Clone ID: PAT_TA_26509
gcccggaccttcattggtcgtcgaagcggcgtacgccgtgtatcatcccctagcacaggcatctgaggaaatgcagtgaccagtgtaggcactcccccgcaaaggctcgactgtgagttaactgggtgagaaacaggaggtgatgcggctatcagcagtgtcgtgccagtccagacttcgcatctcacaaggatgtcgtacagcgtgcatatctacacacgcaaggggatgagggaaagaggaaaggctgcggtcgagtccctttgtcgggaatgtaacctctacaacataatcttccatcagctcaatatactgtatgctggtagacgtgcctaattaacccgacatatttagaccacatatgaggaagctcgacattttggtgaacaatgcaggtgttggaggggtggcagtagaccaggaaggcctgagagctctcaacattgatcctaagatgtggctatcggggaaagcagcccatctggtcgaatcggtgattatacaaacatatgacgaggcagtaaaatgtcttaacaccaactactatggactgaaatgggcaacagaagctctccttccgctactgaagaaatccacatcaggagcaaggatcatcaacacctactcccggcggccggagccgcccgggtggccgatgatgctgccggcctacagcatgtccaagatggtggtgaacctctacacccgtatcctggcgaggcggcacccagagatgcgcatcaactgcgtgcaccctgggttcgtcaagacggagatcaactggaacacgggggtcctccccccggaggaaggcgcgaggggcgcggtgatgctggcgctggcgcccggcgacgggcccactggctgctacttcgatcagacgaagatgggggaggcttggtgatcgatggttacacgaagggtgccactttgtttaggtttgcttttttccacgcttcagaccttcagtttagatgtttcttagctaggctggtccagcaaacatgattatcattcgccgcattgtgaaacgcggctgcaataataagaggtctcagcttagatgtttccgtcaaggattttagtaatgcaatgttattactcagtttc

SEQ ID NO: 26510 - DNA, 1812 bp, Triticum aestivum
  Clone ID: PAT_TA_26510
gccgcgaccacaaaaacggctcacttcccctcccctctcgcccggcgggccgaccttcggcggccgtcggctcccccacccggtccctgccaacccgccgaccgtacgccttgcggggcgacggcctcgccggcggggccgtcacgccctttgatgcacccgggggggacgggggcgccggtacgggctgcggtgccgatgggccctgcccatgtcccccgccgccgcctcgcggtggtctccgcggtgttctcgggcccccgcggcggcgccccacgagcccgccgcacccgcggaatctcttgggccaccgtcccccgctacgcttgcgtcctcgcttcggcggcgccatgggagacaccgtgtggagaggcctacggcgcaactctttgccgactgctacgcgcttcccttccgtggccgcgatgcgcggcaccctatggtggctaggcgggcatgtctagcgtgcgccggttcaccgcatgctatccctatatctttccgtcgtggctccccatgtctgccgtggtgcaccaggtgatcgccgatccgtggctcctggtggagcggctgcttccctgccggcttcacgcctacgcggtctacagtcacgccccgctctccctccgcttccagtcttcccttcggttccccttcccctccccgtcgccccgtacgccctgcgtccggacgcagtcggtcgtcgtgccgctcgtcgtctgctccgtggtgccgtcaccgctccacgtcctgctgaaccacctgctggtgaacgtgctcggccttggcctttccggcgcgtctgccgccatctctctcaccttctggttctcctgcctgatgctgcttggaagcgtgatgtggtccaagcagtttggcgagacgtggaagggtttctccgccgacgcgtcgaactacgtgctggcctcgtgccggctcgctgcgcccgcacgtcgtatggtgccatatgcgcaagcacgcaggccgtttcctacatgatcacctatgggttcagtgccgctgtgagtgagcacgtgtctgatcgggttgtggttggtcacggaggcgattgcctacatgcgctcctacggattcagtgccgctgtaagcacccgggctgtcggatgagatcggagctgggaacgtggacatggcgaagaatgcggtcgcggtgacgctgaagctgtcggtgtgcctcgctttctcctttgtcctgctgccgggcttcggccacggtctttggccgaggctcttcagcaggagcgaggtgatcggggcagaattcgcggccatcaccccgctcgtgatggcatcgatcgtgctcgactccgcgcagggcgtgctgtcaggggtggcgaggggctgcggatggcagcacctggcggcaataacgaaccttgtggcgttctacttcatcggcatgccgttggccatcctctttgccttcaagctcaacttctacaccaagggtttatggtcgggtctgatctgcgggctgacttgccaaaccatcactctggtggtgatcaccgcccgcacgaaatgggccaagatcgcggatgcgatgcagcaagagaaggccaactatgtcgcttgatcgataatattgagtgtggctagcacatgtatgtacggggttttgtgagatggccagagggtgcgatgcttgagctgtttgtttagccttatgaagtaagctatagcttttttgaccgtgtacttcgagggatttatgtctccgaaagatcgaacttgtaatggcaattaaccagagagtatacaggagaagcgtaaaaaaaaaaaaaaaaaaaa

SEQ ID NO: 26511 - DNA, 464 bp, Triticum aestivum
  Clone ID: PAT_TA_26511
ctaatgctcgcccccatggcgatggcggacggctacagccagccgcaagactaccagccgccggcctacaggaagcccgcggacggccttgccgccggatactacggcgagtcgtgccccgacatggagggcatcgtccagagggccgtcaagaaggccttcgccgcagactacaccatcgccgcgggcctcatccgcctcttcttccacgactttgccgtcggggggtgcgacgcgtcgatcctgatagacgcgccggggagcgagaagtacgccgcggcgagcaagacgctccggggcttcgagctcatcgaggccatcaagacggagctggaggccaagtgccccaagaccgtctcctgcgccgacatcctcaccgccgccacccgcgacgccagcagggaggtggggagtgagctactggccgctcgtgtacggccgcaaggacggccgccagtcccgca

SEQ ID NO: 26512 - DNA, 630 bp, Triticum aestivum
  Clone ID: PAT_TA_26512
gcacgagcgaaccgacaaacgccaggctccaaagaaaacttagctgcagagcagctaggtcgtcgacaccggcgaggtcgatctcgcctttgccgcaggccgatcgatgtccaccatggactgcgtgatccatgtggtgctgggggtggccatgcggaggtgcatctgccggctgcacgaggtcgtcgccatggcgatggaggtcggcacggcgctgctcgtggccgtacggttctccggcatggccttccgccacacaccagcgccgactcaggcggtctcggggtcgactcaggcagtctcggggtcgacgcactactactactacgcccccgtggctgcctccatggttggcatgtcccggctcgacaggcactagcactggggaccggtgagctacacccctctggatttgatggctaatcaatcgtgtatttttatttagtgagtaataatgaaattcagtgcttgattagctacatacacacatgcgcactgtatattaagcaatatatgtgttcatcttgatatcgatatagtaattgatcagtctcgcatgcatggtggtgattcccacttttgtgatgactccagggttataccccccttgggaaaaaacggtgtcatttg

SEQ ID NO: 26513 - DNA, 1174 bp, Triticum aestivum
  Clone ID: PAT_TA_26513
gggagtccggcccgggtttgctcgctcccgacgtggccgctggtggaggcgagagccgagcgggggcggatcgggggggagggaggcggcagggggcagatccggcgggcggggcgcggcgtgggccggcaaggaggttggggaggggcgggttggcggggcatggagcggggggcgggggtggtgggcgcgcgggtccggggacggagcgtccgccgcgcgtggtttggccgctcggcgcattcctcgcgggcctctccgtcgggctagccatcgccgtcgagggcacccgagtcaaggtatcggatgtgcaaactgattcgtcttgaggtgatggcttccgccgacgttatcgtcggataggccattgtcagttgtctgccggctcccttctggtcgcacaggcttccattaatacagtagctggttgcgtgtgttgtaagaggctcattgttccttcagacactaactggcatgtgtgcctccgacctcattcatcgtatcttgggtcactttcataatcggcgttccttctcctgctgaccgggagccgcgctgaacgaccaaaggggggcaggagaatcatgtacttcggcgagcttctgctacgtcgtcaagccgggggtcttctccggaggggcggtgctctccctcgcgagcgtggccctggccatagtctactacgtggccctgacgtcgtcgaaaggcccgccgagctggggcccgcagcagaaccagggcatctccatgggccagcccgtgatcccgcagcagagcagcgagccggtgttcgtccatgaggacacctacaaccggcaacagttcccatgagtgatcacagccatattcaagccagccatttcgagggtcgcccatgaggacacttgcaaccggcagcagttcccgtgatcgcagtcgtagtacctaagccgtttcgacggcccacatgaacgctatgttggcgagtttggtttgtatagccctgcaggttagaacaatagcagcagcttggttaccgttattattagctaggttcatcagtcttctctttttctttgtttgagacttgagaaaggcggcggcatgcctgtttcgtcggtatggatatttgaattttaaatgaactgggtaatgttgagtttgatggcgtcttgcttgtctgcaagccttttta

SEQ ID NO: 26514 - DNA, 1067 bp, Triticum aestivum
  unsure (1)..(1067): unsure at all n locations
  Clone ID: PAT_TA_26514
gttggtaatgcggtcacaaatcactcaggagtgggaggaatgggatttggggccatgggtggatttggttcaaatagtgcagctagtggactgagaatggcaatggcaaacaatgcaatggcaaacagtgcgatggcgatgaatggcaggatggggatggggatgcatcacagtgcacatgacctatcacagttgggccagcagcagcagcagcagcagaaccagcaccagcaccagcagcatcagcaacagcatgacataggaaatcagctgttgggtggacttagagctgcaaatagcttcaataatcttcagtatgactggaaaccctctcaatagattgatcggaaatacaagttcaatatgatgatggtgcagctgccctcactgggctcattgcttatggagcgtcaattgcttgctgtgacctctcttgtgtccaagcattggtgcttttgcaccaagggtgccatggaaaggaatcataggcgatgggcaagcatctcagctcgcggctgtatgttgcaacagtagttggttccctgtgtattatgcaactatggtaccgggctacctgcctcggttatcttaccgaaagatagagttaaaagattagaatctgcctgcactgggcatggtcggtgtcagtgtttggtgttatttctcacccggaaaagaagttttccctccttttttttccttaacggatgacatccgaactgtaatttatcaccgcccttgccgtagcaatcatatgtgctgatatcttcgcctgagaattctctcgttgtagccttactgtactctgtataagctgtcatattgactcgtggaaaaagtatcaagaatgtgtctgtcgggtaaaaaaaaaaaaaaaaaaaaaaaaaaaaaaaaaaaaaaaaaaaaaaaaaaaaaaaaaaaaaaaaaaaaaaaaaaaaaaaaaaaanaaaaaaaaaaaaaaaaaaaaaaaaaaaaaaaaagggggggccccttttaaaaggatcccaattttacttacccgcgggtttgcaaacggtaaatatttttttttatggggcccccctaaa

SEQ ID NO: 26515 - DNA, 773 bp, Triticum aestivum
  Clone ID: PAT_TA_26515
gtaccacccccccacctgcccagcgaaaacaccgaccaacacctctcgccgtcgacgccagcaaggagccgcgagatgcagcggccccaaggggccgaagaggccggaggcggcgaagggcgagaagaggccagaaggcgaagaaggccaaagaagacaaacgccgagaagaggccaccggcgtccaaggagggcggcgagaagaaggccaagaagaactccaagaagagcgtggagacgtacaagatctacctcttgcaggtgctgaagcaggtgcaccccgacaccggcatctcctccaacgccatgtccatcatgaactccttcatcaacgacatcttcgagaagctcgccggccagtccgcgaacctggccaggtacaacatcaagcccaccatcacgccccgcgagatccagacctccgtccgcctcgacctccccggcgagctcgccacgcacgccgtctccgagggcaccaaggcagtcaccaagttcacctcctcttagttagtctgctcttgtgtcttttctgaatgtgttgacatctcgtgggtgtttgatgaatccactgtgctctgcagttagatgttcagaacgcagcatcttgtaatttgtgagggcacaaatctttcaggatatggtggaaatagtaatggatctgctttaatcaaaatcaaaaaaaaaaatccatgccatgtctcctattctactgatttgtcagtccatggtcgtttctaaatgcccgcagacctgaacattgcaaaaaaaaaaaa

SEQ ID NO: 26516 - DNA, 680 bp, Triticum aestivum
  Clone ID: PAT_TA_26516
gcggggaccgcgctacacacatagcgagagacgacgaccttgggcgcgctcacgagcgtatcatcaatttcatcatgaggcgtgagtacctaattggcttcgcgctcatagtcgccgggctctggccgctgcacgcggccgcgcagaagtacgccgctatcttcaactttggcgactccctcgccgacgccggcaacctcgtcgtggatggcatcccggagtacctcgccacggcgcgcctgccgtatggcatgacgtacttcgggtacccgacggggcgcgtctccgatggccgccttgtcgtcgacttcatcgcgcaggagctgggtctgcctctgctgccgccgtccaaggcgcacaacgcgtcggtccaccggggtgccaacttcgcgatcaccggcggcgcgtcgctggacacgagcttctttgaggcgcgtgggatgaggcacacggtctggaactccggctccctgcacacccagctcaagtggtttgaagacatgaagccatccatctgcaattccccgaaagagtgcagggacctgttccggcggtcgctgttcatcgtcggcgagtttggcgggaacgattacgcggcggcgctcggcgcgttcctcccggtgcagaaggtgcacacattcgtgccgcacatcgtcgactccatcggcaagggaatcgag

SEQ ID NO: 26517 - DNA, 939 bp, Triticum aestivum
  Clone ID: PAT_TA_26517
ctcccggccacctcctcgtcggcggtggcggtatctacgccgcagggagtggcggagcggcggggaatcccggcggcggcggccacctcctcgtcggcggtggcggtatctacgccgcagggagtggcggagcggcggggaatcccggcggcatccttcgtcgaggatgtcgagacctacctccggcaggccgggctcgaggtcaactccgccctcgccttcctccaagaaaggctgcagcagtacaaaatggtggagatgaaacttttagcacaacaaagagaacttcaggcgaaaattcctgatatagagaaatgcttggatattgttgcgacattgaaagctaaaaaagctttgggtgaggcactcatagctgattttgaattatctgagggaatctattcgcgtgctaaaatcgaggactctgactcagtgtgcctatggttgggtgcaaatgtgatgctggaatactcctgtgacgaggccaatgagctcttgaaaagtaacttggaaaatgcgagggccagtttagaagtccttgttggcgatcttcatttcttacgggaccagcaaacgataactcaggttacaattgctcggatatttaactgggacgtgcaccagcggagaagcaagcagtctgttatgaaagaaacatgatcatcatagggtatgcgcagccaatgaaatcgggttatttttgtacttcttgctgcctctggcgatttagtttatcgtcatagtgtgtgtgctctttgctagtgatggtgccttggccgcgtgacagaaatgtatcaatcacattcagttttatggtgttggaactctagaccgtgtggtgtagatgacattcgcttctgttttgggctgcatgtacttgtttagcgcttgatgaaacaaaatttgcgaagcattttttttgttcattaccttcttttc

SEQ ID NO: 26518 - DNA, 536 bp, Triticum aestivum
  Clone ID: PAT_TA_26518
ttttaacagcagcgatccgtgatcctgagatccgtcgagtttgtggtgatgtttctactgagcaactacttgagaaaatgtttggcgtattcatggaccatgcaaacatgttggctgatataagcaccataccagaggtgaacagtccagagttgtcagaaagcgatctttacggctatatccaccaatatatccatttgctcgaaagcgatgtccgagtagatgttcttgaagcactacacgagaagataagaaagcgtttcaagacacctaaattgacaaatagcaactttgcgaagatctgtaagcatgcttctctgtcatggtgccggtgtatactcatcaaattggcctcaatcaccccgctgcctgaatctatggacacagacaatcagcctgttccattatccaatggccttctattgtacgttgatctgcaacctgatgagctccttatctcatcccctgatgggcctactcaattcaaaggtcttgacatgaattggtttgagacactcactaaaattaaaaacatt

SEQ ID NO: 26519 - DNA, 967 bp, Triticum aestivum
  Clone ID: PAT_TA_26519
gccggccgggtcgggaaaaaaaaacacggagacgagtcgcgagtcatggaggcgagggttgcagcaggggtgcccgcagacgaggagtccggcctcctcccccgcgcgcgcccgccggcggcagcagccgccggacggaggccttcctcctcctcctcctccgcagcggccccgcgccgcgcccccccgccggcggtctgggcgacggtggacgggcccctggggatgccgctggaggaggcggagggccacgcgcggcgcttcttcctctggggcttcgcctgcctccccttcctctgggccatcaactgctgctacttctggcccgtcctccgctcccccgccgcctcctcgccccccgccttcgcccccatccgcccctatgtcatgcgctccgcgattggcttcaccatcttcgcggcggttctcctcacctgggccacgactttcatcgtcggaggcgagcgactgttcggccctgtgtggaaggatcttgtgatgtacaacgtggcggacaagctcggtctcactggattcatggggtagattctgccacacacatcgcttcgagaaggctgacatgctttgctccgaccatttgatgtctcactggtagtaccttgtgcgtgatgttctggcatgttgttagtcactggttagactgaagcttggtgtgggcacttgagcagttgtattgccgcgggcgcacagaagcccgtttcgagtaattaaggattttatgtgtaaatgtagggtcgaaccagcccacttcagctatggggaaaaagttagcagaaaatgtattgaagagctggcttgttagctgcctgactgtctcttaactaccatgtgtcaaacaagttctacttaacatattcaagaaacataatgtatgtatccaacataatctctttttgaccgaagggattttgcgtggaatacggcaggaaatctggacagtgctttc

SEQ ID NO: 26520 - DNA, 664 bp, Triticum aestivum
  Clone ID: PAT_TA_26520
agggaaaatctgcaagagtcctggtccatggcatgtaggtggatggaccttagtgactggttagcatatagggcaactggtgatgacacccgcagcttatgcacaactgtttgcaaatggacatatcttggacatgcacacatgggccagtggagggaattagattcgcgtgatatggaagcatgtggatgggatgaggtcttttgggaagaaataggcttgggagaccttgttgaagggaatcgtgcaaaaataggacgcagtgttgcatttccaggccatcctctaggttctggtttgacacctacttctgcaaaggagttaggcttgcttcctgggacacctgttggaacttcgcttattgatgctcatgccggtggcgttggagtaatggaaagtgtgccagaggcagaatctaaagccgacttatctgatgaagaagcgatctgccgccgcatggtcttggtctgtgggacatccacatgccacatggctgtttcaaagaacaaattatttattcctggtgtctgggggccattttggtctgcgatgattcctgagtattggctcacagaaggtggtcaaagcgcaactggtgctctacttgattacattgtcgaaaaccatgctgctgctccccttctggctaatcatgctgcttctc

SEQ ID NO: 26521 - DNA, 930 bp, Triticum aestivum
  Clone ID: PAT_TA_26521
attcggcacgagggccgcacaagggagctgccaagggagaccggggcgactccggacaatgctcagacttacaacaccaatctgattcgccatgttgtcaatgacagcggcacgcctgccaagcccggggaagaaatagatgtctacatcttctccttgttcaatgagaacaggaagccgggcatcgagtccgagaggaactggggactcttctctccagaccaaagctccatctacagcatagattggactggccgaggaaatgtggacatcatgactggaggaaaccgttcaaatggtacttggtgtgttgcttcaaccaatgtctcggagacggctctgcagaatggcttaaattgggcatgcggcccaggcaatgtcgattgctctgctattcagccaagccaaccctgctaccagcccgacacattggtttccgatgctttgggtgcgttcaacagctattatcagcaaaatggagccactgatgtggcctgcggatttggtggtgctggaatgaggacgacgaaagatccaagttatgacacttgtgtttacatggcagccggcagcaagattagcaccaaaaattcaaccgccactccaactccaagcggctccagcccgtcactgttggcccaatgccgcacccttctgctccctgtgcttcccattgtgattgccgtgggctttctgtgattttcggagcacgctctagttagtacgttcggttcgaaggtgagaggctaattgcctaatactgggaaccagtaatgttctgatgtgtggtgaaaggtggcagtagggacctgttatgcagtatgttattctgtttggatgtacatcgctgcgcgaacaatatatgttagttgccattgagaactagaaatgtgttgccgattttttctctctaaaaaaaaaaaaaaaaaa

SEQ ID NO: 26522 - DNA, 768 bp, Triticum aestivum
  unsure (1)..(768): unsure at all n locations
  Clone ID: PAT_TA_26522
ngagcaatcaagacctactgcgtcattgctaccgtcgtctgctcctaaactatcatcctggggttcagtaagggtggagttgtcgtcaaccagcttgtggcagaactttctaattgggcctcaaaatcagcaaaaggttcagttgatatttcacggcaaaacccagccctcttgaccggtgatctatttgttcctgctacagctagtgatattttatcaagtatttccgaattccattatttggatgtgggcctcaattgtgctggagcatacactactgatcatgcggtgatcaaggggatagccaactatgtttcccagactagtgatactccccgtttcgtccttcatgggactccgaggcagtggtctgatccgaaccgcccatggatcctggccgagaagaacacgatgctgcggttgcttcaggacgaggccaacaaatgtgaaggaagactgacgctatctgaaaagaagtattttgatggtagaccacgcagtctcctgatgcattttgagattctggaagcaatggacatctcctgatattcagcatgtgcagcttgtagccttctagtctctgtacagcttgtgcaacgaataactgcataactgcatgtgaatatttcgagggttttagattgttttttgtctttttggaggtagtttcattccctcggggagtatatgacaagtcttttctgaacaaccaacacaaatcagttacagctgaaatgattaacgaaatatacatgagatgtagtttct

SEQ ID NO: 26523 - DNA, 857 bp, Triticum aestivum
  unsure (1)..(857): unsure at all n locations
  Clone ID: PAT_TA_26523
actacagttcaccagccatgacgaggcgcgctgcagccacctttatgctgatgctctcgctcccgacagcggccctcatggtcgccgccgacgacgtgggcgtcgacagcatccgcctccctaccgacggcggcgaaggtctcgcaacgagcaaaggaggcgagaagcagacactatcactcccagtccctgaccaaatagtggcgccgagggagcagaacgtcggcgacgtcctcgaagaagaggagaggccgtgggcgtgctgcaacagcaccgtgtgcaccaagtccttcccgccgacgtgccggtgcctggacgaggtcgaggagtgcgcccccgcatgcaaggcgtgcgagccgtccgggttcaacccggccttccacgtctgcaacgaccagtaccacggcgacccagggccgacgtgcgccaaggaggagaggccgtggacgtgctgcgaccggaccgtgtgcaccaagtcgttcccgccgacgtgccgctgcctggacgaggtggaggagtgcgcccccgcgtgcaagcgctgcgagccgttcgggatcaaccccaaccgccacgtctgcaacgaccagtaccacggcgaccccgggcccacgtgcggcaaggacgacgacgacgatgaccaccccagcggctctccatccctcgccgccgccacacagatgcagttgctgctggtttctctgatcttgttgtttatccagagtccttagatgcgtgcgtgtactagcatcgcatcatggtacgtgagatggcgcgtttctcacggangccatgcagcacgtaataagattagattagaaatcttagggtgtgtcgaataagattaacaagaaagaaaa

SEQ ID NO: 26524 - DNA, 426 bp, Triticum aestivum
  Clone ID: PAT_TA_26524
agggtacacctgttcttcgacgcgtaagcggacaaattctacagagcccagttctttccactgatgagacaaaaatgagaaggatggaatctttgcctctgactgcagggaagatacccaaatcagttagtttagtgtcaggctatcgcagtttttaaattagcgtggtgtcttaatgtgcctgagttcttctgccaagtaccctttcttagtttaatgagtgttttaggaactatttcagtcaatcatcagcagaggggtgaggtgagctgaggaggagttcatggagatggagggccggggtctgtctgacctgttcaggaacaccagcgaggagatcttcctcaaggcggtgatggagaactcgatcggagtggcggcgccgccgagcatggagatgatggggttcagaaacatgtcgcagag

SEQ ID NO: 26525 - DNA, 1326 bp, Triticum aestivum
  Clone ID: PAT_TA_26525
actgtcctaagcctagttggtgctttattcaacattgttttacaccttgaaagtccactaattttctatatagagaagctacctcctctttgccctgatttgcatccagatgctggagcgattgttctaatgtgtgttgaggttatcacatcatttgcggggaggcatacttttcaaatcgatgcatgtcatgtgtcccagtgcctgcatcgtccgcgtgggcttttcaagggcttcaaacatcttcttgctgatcggagtgtatcctgttcatcagaaaacattcatgagcaaattgcaggacaacctctagctagtaaagaatacttacttgacagacaattttctgttgacatgtatgctgcatgttgcaaattgttatgcactgttcttcggcaccaacaaagtgaggttggacaatgtgtggctgtcctggaagactcggtaaacatactacttagttgcttggagtctgcagattccaagatggttagcatggcaggatgtttcacttggaacaaggaggaggcactaaaatgtgcttcctttttcagaaggatctatgaagagatgcgtcagcaaaaaaccatcatggaacatcactcgatgcactttcttgctggttatatttccatgttttctggactgggtccatttcagacaggcataacacgggaaattgacgaggccttgcgacctggggtgtattccctaattgatatctgccaggaaagcgattttcaacagcttcacacgtacctgggtgagggcccatgccgaaccactcttgctaacctagtgcatgactataaattgcacttccagtatcagggcaaaatctagtcccaagttgctaaagatgtttggaatacttggttattcgtcctgcttacactggatatgaaatctacagtgtcaccttttgcatgatgttgggttcagggaagaaccaatggaactatggttagtgctattaaaccagcctgctgttatgtgtggcagatgaagagaaatcaaattgtttgcagcaaatcccagtaatcaaactcggtaatgtcaagcaaatgttggcgttcatattttttgggtaatacatagcacactcgttctagactaaaactagtaggggtatattattcatgccccccccccccccccatattcgctaaaagtgtgaaaaggttgcaggggcacccggttaatcttttgttgaaaaattctgaaacgaaaaaaataatctcagatgcacatgtatcccaaaacttgttatttgaccggcttgagccaacgtgcaatgcagcatcaagtttaccattagagaggatt

SEQ ID NO: 26526 - DNA, 459 bp, Triticum aestivum
  Clone ID: PAT_TA_26526
agcacccatcttcaagaaaattacaatatgatgaatctgaaaggagaagagaaatggcaaagaactcccttaatatacacattattatgaacaatggacagccaatcagtcaattgtcgcaaggttgagactagagtccaactctgagctctgagctccaggggagtgaccaactcatggcgtggtgtctgcttgctgtaggtatactcatcctcaatacccagctctcttctcgtgcacttcttcttgatcatcatgtctctgaatcccgcatgtatgttctctcttccttcaccatccttctaggagtattcgacaagtaatctctttttctcaaatatccatagttcacaggactggtgattgcttagcaaagcatttgaacaatttaactgatgctcatgattgtaaactgcatgatacagagcaccctaacgagtttatatatgtcatcattga

SEQ ID NO: 26527 - DNA, 478 bp, Triticum aestivum
  Clone ID: PAT_TA_26527
agagtagttcttttgtttgctacttggtcgtacctgttaagaagctactacatgcaggttcattgtcaggtccagttgttggtatcttcagctggtttgccgtctacccctctgttggctcgtcggttatttgtcttcccaccaaggttggctttcccgcctcaggtttttgtttcatctcgttatgtttctgtacattacttattgcttctggtactgaccgggtgtttttttttggtataaatcatgttaatgcaaatgttttaaagttcctgcccgttgcatctttgcatacttattggaattcaatttgctcattaatcgtagaataaaactttttagctcttatgtatgggaaaattagttgtatcatggatgcatcgatatattgctcccaggcatagttggcctataagatgttattatatatgtgacatgctattggccgaatacaattcatactttacaaactccttat

SEQ ID NO: 26528 - DNA, 352 bp, Triticum aestivum
  Clone ID: PAT_TA_26528
aggaagcttcaaccatcgcccgatatgccgtgtacagctccgtccatcgcatgaatcagcttcacaacccggttcagtcttgctgtcgtccgctgcagatcgagctgctccctcgactccgctgcagatcccgtagtttccatcagaattgatcacactggtccttcattcggcatgtaagcgccgtcctgctccataggccacatactacaattctctagaagctcaaatggccgaggctgtacttattgctgtgaccaagattggttccattttaggagatgaagtcatcaaggccatcatatccgagctctctgtaaaagttactaatctgaaagaactgccggtaaag

SEQ ID NO: 26529 - DNA, 543 bp, Triticum aestivum
  Clone ID: PAT_TA_26529
agtgctggctccgcggctcgccccagtggcccgtgttctcccgggcctcgggccgccgtctccgacgctccccagcccccagcctcccctgcccctcctgttgcgtcggcacccagcgcctgccgcggcgcccgtctcctccctgccctgggagctcctccagagccccgcctatgcggtcggaacccaccgccttcgccggcccaagtcgcagtctccctccctttcggcgctgtggcggtgcctctctcgcgcggcagcagcaggacaggtgggagccgacggcgacggccggcagaaaacaaagtcgggcttcctttcggcgctgaagaggagccactgaaggcagcagcagcaccagctctaacaaagcttcctctgtgttgatgcccgagtataggtgattcgatgcccgcgctactgtagtgtacactgataataatttcctcacgtagtagctgttttgccccatttcgcttcctcttttttttctcttgccatgtatcaactgttcttgttctagtgttattgttgaatgaacga

SEQ ID NO: 26530 - DNA, 888 bp, Triticum aestivum
  Clone ID: PAT_TA_26530
gctcaagcatctagcaagaactccatgatgccagggaagcctggcttcactgccaacctcatgtttctgccaccatcgaactcaataaaattcacaccagcgccagccttaacaagtagcttgacacattcctacggctctctaggcatgggcgtgatggcccggatggcccaactcaatggggtataaccaagaccggaaaccttgttaggatcggcatggctctaagataaaatcttaattatgttatgatctttagcaattgcagctgcatgcaatggcgtcccttgtgcagaatctaaatccgcatcgactcctcttgaaagcagaagttctgctatttcacaatgtcctttctttgcagcgccatagagaggtgagtgcagtttgccagctagtggatcagcaccatgaccaagaagatatcttgcagcagcagctctcccatatatggcagaatggtacagtggcgtgtcacctatgaagttgagttgattgacatcgaggcggaggtcctcgacgaggtacctgcagacctcgacccgccccgccccggccgccaggtgcagcgcgcggtcccctacgccgtcctccaccgcgcccaggacggcggcctcgccttggcctcccgagcccatccaccgcgccatcttcttgaggaggccgaggttgccggcggcggcggcgcggaggagcgcctcctcccgctgctgcttccccatcgcctccatctccatggcgatcgagcaggcggcgagagggagtcgcgaaatttcgagagcggcagtgcgcaagactgcctgcggggctgtggagaagacgaggagacccggagtccgtgagccctgggccacgggagcaggcaagatgttgtgacggggaaaatgt

SEQ ID NO: 26531 - DNA, 616 bp, Triticum aestivum
  Clone ID: PAT_TA_26531
aggcttatcagaaagcagtcgacgatggtgcagatgtcattgattgccctgtgcaagtgaccaaagacggcataccagtatgcatgggatccattaacttaatggatagtactactgttgcaaaatcaccatttgcgtcccaggcagcagttatgaaagatattgagagtgtcctaggagtctttactttcaacctcacttgggatgacatcgtgaagaatctaaaacccaagatatctaccccacttagcaccttcagtttggacagaaatccaagatacaggaatgcaggcaatttcatgagattatcagactttttggacttctctaaagataaggatttgtcaggaatcatgattagcatagagcatgctgcttttctcgcagaggaactcggatttgacatggtagatgcagttatcaaagcgcttgacgactccggctacaacaaacaaactgctcagaaagttatgattcagtcaaccaacagctcggttctggtgaagttcaagcaggaaacaaaatacgacctcgtgtacatgatcaatgaagatgtgagcgatgccgcgccttcctctctcgcgggcattaaaaagtttgccgatgccgtttctgt

SEQ ID NO: 26532 - DNA, 911 bp, Triticum aestivum
  Clone ID: PAT_TA_26532
cgcatctctagctctccgtgcgcaccgcctgctcgacgcaattccccactcgcccaccaaccttcccgtccccgatggcgatcatggcggccaccgccactgccgtggcttccccctccagctccacctcgccaggtcccctccaccccagcccccgcttcctctctcccgtctccacgcccgctcgctgccgtctcctccccaagccgcggcggtggtgcgcgcgcctccacatcgagcgtcgggtggccgtcggcagcgacgtgtcctcgtcccatgacgtggctgccgaggaggccgctgctgtgcccaaggtcgggaagcgcgtgcgcgtcacggtgcccgtccgcgtccaccacgttgccaaggcgcccggcctggacctgcgcggcatggagggcgtcgtcaagcagtacatcggcgtttggaaggggaagcgcatcacggccaatctcccattcaaggtagagttcgagctcaagctggacggccaggacaagccggtccggttcatcacccacctccgcgagcaagagttcgagatcctcggggaggaatagagctctggactagagaataacgcgctctcatcggcggctgtggcatctgtatactattgtgtctgcgctaaagaagaacgtggtcgagggtgcggggagaataggagattgcaactttgctagtaagttcctgtttgtttgcttatttgcggtgcgcttctcccctctccaccctttaacattgaaattttcatatgtgaggattgaggaattgttcgattgttgatacttatgatccaaagtaattaaactgaggaatctgttcagcatcacgttctgttgatgttcaagacaaaatgttacctctaggagtgagcgatgccgtgacatatgatggaatgtattgtagtt

SEQ ID NO: 26533 - DNA, 1583 bp, Triticum aestivum
  unsure (1)..(1583): unsure at all n locations
  Clone ID: PAT_TA_26533
gaaatatactagnaaaaacaattatttaggaacagcagggagtacaagggaagctatatataagagcacacttcaactcttcccatcgagctgaacgcttgcgggtcacattcatctgcctacataacttatccagaagcaaaactcgatatgtactcagccgaccaacaatttccgacggttcgtcggcaaagtcgaagctcaatgccaagccacaaacggcgacctcaacatttcctcgcgtacgtaccacgtcaagcggagcctcacacgttagcgaagagcttgtacgtgccggcgtccagcacgatctgcctgacggcggccacggacgcgacgacagcnaccgcggagaacacnacggcgatggccgtgttgagccagaacacgaagcccttcttggagggcttgaacgtgaggttgtagaagagagccggcacggcgaagtcgagcggcatgaagccgaaggccccgatgagcgcgttcatgtcgccgaagaagggtatcatggcggcgatggtggtgccgaaggcgacggccaaggtccgggacacgagccgcggcaccacgttccgcgccgcgtactgcccggccttggggtccgacaggaggccctccagcacctcgttggtcggctgcaggtacacggtggccgtggccgacagctgcaccagcgtgaagagagctccgccatgagcagcagccacaccgggatgacgggcttgccagtccgggctggcctccttcctaaaccccacacgcaaccgcccaccacaaaccccggccgccggccggcccgcgagttcgaccgagtccaactaagatcagtcccgttccggccatgatgagcggcggtggcagtggcagcggcagcggcgcggggccgagcagctccagcttcgagcggcacgcgaagcggcggcccccggcgacgccggcgtcggaccagcagcggaagctgctgcggctgtcggtgcagcacgggcagggggacgacgacgcgctggcggcgggcgtggtgccgccggtgacggtggtcctggacgggcgctgcatctgccaccgcatccagctcagctgccacaccgggtaccgcagcctcgcgggcgccctccgccgcatgttcgtggacgacgcggccgagggcgacgacgacgggctcgacctctccaatgccgtccccgggcacgtcgtggcgtacgaggacatggaggacgacctcctcctcgccggcgacctcaactggaaggacttctgccgtgtggccaagaggatccggatcatcccggcaaagtcgacgacccgaaggatcaagcaatgcggaggcgcggttaactagctagctagtcagccccgcccggtgaagaaccacaggtgtaattaagccatacctctgcagctccaccccactctcagctcagctcagctcaactccggcgaaaaaaagatcaagtccggccggccggctgtcgagaactcgacgtctccctaaaatcaaatcgatccaacctttttcatttttcgctgtatcaaaagttcaatgtcgcattgtcacaatgaaaagagaaaagagatcaattttc

SEQ ID NO: 26534 - DNA, 680 bp, Triticum aestivum
  Clone ID: PAT_TA_26534
agggattacagagaaacaccaccggggatcaacgagcatgaaggtagaggacgtcctccacatggctaccggcgacggagagaatagctacgccgccaactccaggatcccaatgaaggccatgctgaagaacaggccattgcttcaaaggaccgtggaagaggtatacacctcgctctcctctgcgagcaccatggtcgtcgctgacctcggctgctcatcgggcccaaacgcgctattcatcgtcgccgaggttaccggcatgatctctgactacaaccagaacacaaacgaagaacaacacggtgtggagctgcagtttctcctgaatgacttgcccaagaacgatttcaacctcatcttccagtcgcttgatcagttccacactgtcactaggaaaggggagggcgatgaggcggcgacgccaccgtactacgtcgtcgggctaccgggatcgttctacaacaggctttgtcctagccagagcgtccatcttttccactcgtcctacagcctccattggctctccaaggtgcccgaggaactctcaagtggcgagtatgtaaacgaaggaaacatccatattggaaagactactccacattcaatagtaaatctattcagagaacaatttcaaattgactttgagttgttccttaccctgcgctcaaaagaattga

SEQ ID NO: 26535 - DNA, 740 bp, Triticum aestivum
  unsure (1)..(740): unsure at all n locations
  Clone ID: PAT_TA_26535
ggtcgcctgcagtaccgtccgnattcccgggtacgctcccattcccgccgccgctagcacatgtagttgccccgatagccggntggctgctcgactccttccacctgttggttgatcgattcgagaggaagagatgagaagatatgacgtgtggcgactatggggggcagaaggcaggacagcatggccaaatgtgatggcggctgtgagggggttgaggaagatgtgagcaaacggatgtggtggacgacggggtgaggtgctaataaatcctgagaactgtcgaagagaggacacctcagtggcgagggagcaagcctcccgatttacactggagcgacgcactgctcaatcctggcctgccaactgtagcagttcattggatgagacacggtagtccgagtctttgcctggaagtgcttcgaccgtcgatctacgatctggtggctacgagaagaacttacaggttcgctgctgagagtgcccacaaccgtcgatcgtcatctggacggctggagtcgtcgcgcgttactttttaaaagttaccgcgatgtcttttacctgtcgaacatgtcgctttctactttctctgaatatccctttataaaccctcctccggtttgtggagagggcattctggattattctgggcttggcccttgtagccgccgtgtcncggctggcaaaaccctagctaccttgcttcagatttgaatgaatcgagccccaaaattcgccac

SEQ ID NO: 26536 - DNA, 1734 bp, Triticum aestivum
  Clone ID: PAT_TA_26536
cggacgcgtgggtctctgccctgccaccgctgattaatccccaccgctcccaccttctcttggccccggcggcgccaccccaaccgtgacgccagcccggccttccacggcgccaccccacctcgcccgaccttccactccatagactgattgaactgacgggcttgatccccttcgttcgcgccgccggggatcgcccactacgcctccgccccagttcgcgccgccggggctcgcccactacgccagcgcgatgcagttcgcggcgcggccgtagcacttgcgcttccacctcttcgcacctgggcgcccagcgctgttcgtcaacatacagtggcgctacgaggtgacgccccgcccctcccgcaccacccacagggggcgctgcagctctacgggtatcctccggtacctgtcggccaggtaggcagcccgtgttgggattgccaggcccggccggcggagcagccgtttctgtgcggccacgtcttcctctgccgcccgtgctacaagcgccgcatctcgtgtctgtgctgcgccggctgggttccctcgcctttctgaagggggatgctgttgctgagggacagcagcggatgattgaccttgggataactggtccagaagggcatgctctctcaagacctccagttttggaaggcgaggcaacttcacgggcaattcgattagcaaaattcgtcaatacaccgttgtatgttgttcatgtgatgagtactgatgcaatggaagagattgccaaggctaaaagagaaggtcagagagtcatcggggaacctgtggtatctgggctagtccttgatgattcttggctttgggatcctgactttgcaactgcttcaaagtatgtgatgagtcctccaatccgggaagcagggcataataaagcacttcaagctgctctttcatcaggaatattacagcttgtgggaactgatcattgcaccttcaattccactcagaaagctttcggttctgatgatttcaggaagattcccaatggcgtaaatggtattgaagaaaggatgcatataatttgggatagcatggtggagaccggcaagatcacagtcaccgattatgtgagagtgacaagcacagaatgtgccaagatcttcaacatataccctcgcaaaggagcaatcctcgagggatctgatgcagacatcatcgtcctgaaccccaagaggagcttcgcgatgggcacgcgcacacaccattcgaggtccgacacgaacgtgtacgagggcaggaaaggaaagggaatggtagaggtgaccatctcaagagggcgagtggtgtgggaggatggcaatctgaacgccgtgcccggtgcaggaagatacgtcaggacaccgcctttcggatactcttcgacggccttgacaagtcggacgccgtctacagggcttccctccgagcacctgtacagcgtggtgaggctgctgctgctgctgcttaactgcgtgttccacggctggtctcattgccccactgacggtaccactatcccatctggttcaaggacaaattgcacctaaaggtgaacgccgtctgctccatgtgtagcttccttgtacatacaaatctgcctcgtttatatccagattcggacataggtgaaattgtaaagttaattatgcatacaaggcacttcatttattttcttgcgaatataaaaatcacatttctgattggggaaaaaaaaaaaaaaaa

SEQ ID NO: 26537 - DNA, 1378 bp, Triticum aestivum
  Clone ID: PAT_TA_26537
tcgcaccaagctggcgatgctaaaactataccaagcttctctagcttcggtagtccaggaaacataagcctcgcggtggttctcctctgcgcgctggtggccgtgcccgtcgcgctccccgccgcccccgcggaggcgggcgagcgggtggtgggggactacgacaagaaatgcaggggcgtggggaacgtcgtccacgtggcacggcaggagggcggtccagaccaaccgccccgccggtcccgcccccgtccggctcctcttccacgcctgcttcgtcaggggttgggatggctctgggctccgtgacccgtcccccgagaaccctcaccccgagaaggcggcgcccgggaacgtcggggtggccgacctcggcctcccgggcgttcgacatggcggccgtcgacgaagcggcccccgggggtgggtgcccctgcgctgtcatcctcatcgacgcaccccgtgacgcggcccccgcccgcagcaagggcatcatccacgtcgacctccctgtcggccgccccggcgggctctcctccgcggccgcggcctcggcggcggagcccccggcggccaccttccacgccgccgccgccatccagcaactggcccacaaaggcgcccgcgaggaggaggaggtggtcatgctgggcggcccgtcctgcgccgtcggcatccgctcctcctccctcacccgcctccccgcgccgccgcagcagatcaacccggccgaccgaccccttctcacccacacgtgccacccaggcgccaacccggccggcgtccacaacgtccgccatgaagactacgagacggtgtccaagttcatgcccgggttcaccagccgggtgcgcaagatcagcgacttcctcgacaacaccttctaccacaacaacctcgccaggatcgtcagcttcaactccgactggcagctcatgacccacaccgaggccaggggccacgtccacgagtacgccgacaacgccacgctctgggacggcgacttcgcggaatccctgctcaagctcagcaagctgtccatgcccgccgggagcaagggcggcatcaggaagaagtgcagcatcgccacccaccctctctactaaacaagtcgtatgcatgcatgaacaaggtcgatccaacgaagaagagaacctttgcccctggcggtgtgcggatttcttcaataatcatgtgatttttctggttcaattccattcttttgattcccattggttgtgtattttactttatggcaacatatatgtatcacggaaataaagttacggactttcaaatgtattaaaaaataaattttttgtctttcaaatgtaaaaaaaaaaaaaaaaaatcccaagaccctggcagccctattatt

SEQ ID NO: 26538 - DNA, 692 bp, Triticum aestivum
  Clone ID: PAT_TA_26538
caaatccctagcccgcggcggcgacgcatctccccctcactcgcgtcggtgaatcaaccgcgtcgccgcccttctcctcaggcgtcgccgccaggccttctcgtctgcgtcacctctccctctcgcccgcatcctcagcgccacagttgagccaaagttggatattttagcgaggtcgagtaggagcgtgagaagcgcgggcacgacggccttgtcctgcttgaggaaggcggcgacggatgctagcgctcctcgccgccatcgacctgcaaggaggagcgccgtgttggacgctgccatctccgacgctgctggtactcctccgccgctacgagtgccctgtcacctgcgcccaggtcagctgcgaagtcgagctccccatgcttgacctgcaagatgtactgtggtcaagaactgctctctgccgcgggagtagattggaaaggctgctgctgctgccactaccactcgccgattcgggcatgagcacattcttggagtggatctgcatttcagaaagttaacaagtgggagtacatggagtactacattttaagtcgaggagaagatggtgcctgctccgtgatgatgccaccagcacctacgacttcctcgaccaccaccaccatgatgacgacttcctcgaacgtgcaaggcaggtgagtactccggagggttaccagaggctggag

SEQ ID NO: 26539 - DNA, 549 bp, Triticum aestivum
  Clone ID: PAT_TA_26539
aaacagtgcttttcataaccaaacctaactccaactctgttcgcgttctctgtgctgaaatggtcagatggcttaaagagcacaaaaatattaatgtctttgtggaaccgtgggttagcaaggaacttctaacagacgattctaacaacacagtgcaaacatgggataatgatgacgacaaaaagatgttgcacaagaaggttgacctcattgtaactcttggcggtgatggaactgttctatgggcggcatcattgttcaaaggaccagttcctccagttgttgcgttcgccatgggatcactgggtttcatgacaccgtttccaagcgagcaataccgtgattgcttggacaacgtgctgaagggacctttcagcataacactgagaaaccgtctccagtgtcatgtaatccgtgacgcagccaaggacgagatcgtgaccgaggagccaatcctggtgctaaacgaagttacaattgaccgcggaatatcatcctaccttacctacctggaatgctactgcgacagctcattcgtcacatgtgtac

SEQ ID NO: 26540 - DNA, 697 bp, Triticum aestivum
  Clone ID: PAT_TA_26540
gaggggcggcggccatacacctccccctcctctacggcaccccctcgccgcggttggatatgcagcctcgccggcgtctccttcccctcgtcggagatgcagcttcgcggcgtctcctgcccctcgaccaaggatctgggaaaggacggggcggctccctctcgatccggcggctcgccctctggaacgacggctcctccccggtctctctctcgtcaagcagcagctgattgctcccttctcccgttcctctcacccagtaggcagcaacgatggcaggtcagatgcagccgatttgttgggaagcagagcaggcggcggtcggctcggcccgtctccttcccggcagctagccggccggtagcatccacacaccttggcggtagcagcaccaaccagggagcagccagttcggcaagcagcaagagaatcatcagcggcggcaagagcaagcttcttcgattggctctttctaacttggcattctccatccaataattagtagtactcaacttgattaatgctagctttgtgtgctctgtgttgagaccggtagtaacaatttttgttgtcattaatactttgtgatctagattttgtgcttcatcaacatttgttatttattttctgaaaagttgttgtgactaccattttttgtatataaacaatcaaatatcaggttatatatttcagtgat

SEQ ID NO: 26541 - DNA, 482 bp, Triticum aestivum
  Clone ID: PAT_TA_26541
agaggatgtcaaaagatctgaggtgcaggatgacaaaaaaagatctgatagaggtactagaggtggcaaagatgaaaggtctgtgaaggacgcagtggataagaatgcacatagttctgttgttcctcataagaggagttcatctgtatctgaagatgaattactggatattgacaatggcaatcacaagaaatctagacatgatgctgctggtgccgtggagtatgacaagaggaagaatgaagactgtattgaggatgttgattctccaaggtcaaaatctgagaagagaagcttgggagaggatggcgataatattcagaaacatgacacaactaggagtaccaagacgaagacagatggcaagaagtatgacaaagacgattcttctcgcaaggacagaatatacagagaagatgaatcaagacattccagagataaaagttcgcgtcattcatcttcacggtcccatagaagttcaa

SEQ ID NO: 26542 - DNA, 793 bp, Triticum aestivum
  Clone ID: PAT_TA_26542
aaagaagatgggatcgtgtgcgacattcaatacgctcttcaaaggccaaaagtgatataatagagaccatgaattacatattatctcttagttattttgatcttccccaccacctaagaagctgcttattgtacctggctctgtttcctgaagaccaattgattgaaaggcagcggttggtacgcagatggatttctgaaggctttatccatggagaaagtggacaagatctcatggaattaggagaggaatattttcaccagcttgtgaacagaagtctaatacagcccgacaacatagggtatgacggcaaggcaaagtattgccgagtccatgacaccatccttgatttcctaatcgacaaatcctccgaagagaacatgtgtaccgtcctaaagaaacaatgcaagcctaatggcatagttcgtcggctctctctaatggggaatgaggatgaagaaaccgtggagcaattggatctgtcacacgctcggtcaatcactgcttttagggatatcaagctattgccttcgcttgggaggtcaaaatgcttgcgcgtgctagacttgcaagcctgcaatcagttggaaaatcatcatatcaaggacattgaaagactctatcagctgagatacttggatatctcttttacaggaatcacggagcttcccaggcaaattggggagttgctgtatctagagacgctagttacatccgatggattacgtgagcttcctgaaagcacaagtcggctacaacgactggcacgtttgattgttggctgcgattgtaa

SEQ ID NO: 26543 - DNA, 411 bp, Triticum aestivum
  Clone ID: PAT_TA_26543
aggaaagatgagcgccggcgccggcggcacggggtgctccgggagcgacggcggcatggtggcgccgttcgtggccaagacgtacgcgatggtggacgacccggcgaccgacgccgtggtcgcgtgggggccggccagcaacagcttcgtcgtcgccgaccccttcgccttctcgcgcgcgctgctcccggcccacttcaagcacgccaacttctccagcttcgtccggcagctcaacacctacggcttccgcaaggtcgaccccgaccgctgggagttcgcgcacgcctccttcctccgcggccagacgcacctcctgccccgcatcgtccggcgccgcaccggcggcggcaggcgcgccaaggacagccacgacgaggaggaggatgaagacatcagcagcaagatgtt

SEQ ID NO: 26544 - DNA, 854 bp, Triticum aestivum
  Clone ID: PAT_TA_26544
cgacccacccgattgctcctctccatctcctctgtctccctcgatccgcgccgcagctgcccccctgctctcctccaccggagcagcgccgccagccgacgccctccctctcttctccatccgtccatccctcgtcgagccaagctgggagtgctgcggggggatctcggggatgttaatcggcgaccaatcttcggccgaatcaagatagaaacaggttttgatactgaagtgggagagtggtatagtctgtttgagtataacatttagttttggaagaaaccacttctccacatggcgggggctgaatccgcattacctgcagtagatcatgtggtgctggataatagcgatactgaagtctcagaagtcgtggaatgtgattccacagttgtagatgtgctgaagaagagtgccagtaaagaatttggtttgcaacttcccttgggaaacaaggaagacatagaatcccttggcacagtttgtgatcttgagaataacgagggtaatgttgctgaggcaaccactctgaatgtggttgcactagaaatgtcccatctctagcaagggttcagatgaaagtatttcactgggctgtcaaacaccaaggggaaacatctttgacccctttgctcccagaccagaaggagggggtttgtcgtggcgccaaaaaaaaacgtggttaggggaggtgaagaccttttcccgcaaaagggtctttttttaaaatggatgaattcccaggcaagaggttaaacttttagttttgaggaatcggagggaggaaaaatttgtttttttcggggcattttgaaaagggttttttggttgggaaatttaaaacaagggcgtgg

SEQ ID NO: 26545 - DNA, 387 bp, Triticum aestivum
  Clone ID: PAT_TA_26545
gggaatgaatgcccattcattcatcaccgtgtcatgatacgtcatcgtcaatgatggagctggctgctactattttgtagattatttttcttataattttggggagattggcaattgttccatctgtgtagcttcgatcccaagctgtaagctagatccagtcagtccaaataagcaagagtgcggtcgttgcccggtagcccccatccacaccccccgtagagttgttgaaaggttgtatatgtccggattcagaggggctggcccgatatgatgataatgagaacccagtacaaaaccatccatgtgctctccctccatgtaatttggcctctggctcgggctacgtcgctcaggtgttcccttccttcagggtttggttctgca

SEQ ID NO: 26546 - DNA, 1401 bp, Triticum aestivum
  Clone ID: PAT_TA_26546
gaccccgcccccccccccggcccgccgcccgcgcgggcagaagaagattaggtttcttgttcttggtgagacatagtgagaggttcatcttgttccttgggaattttgtgttgtcatggctccctgctcgccccttgcgtgtcccttctccggcctggtttcggaaagaagaaaactaggtttcttgttcttggtgagacacacggagaggctcaccttgttccttgggaacttttgtgttgtcatgggtaactgctggtttaaagggagtccgtacttcaacagggatttcctccaatgcgacatagtcagaatctccaaaattgcagagcccgtcggcgaggaccgagaatggacgatagcctgctgtcccttccaaacccacatcaaggtgggaggccccatgcgcaatcgattcgggctcggaagaaacccgccgcataggcattcacgttacgaggaagctcaaggaggctcaccaagaacctcaaggcaggacccggcgctgggcggttgccgcgggcagctctcacacccaaatcttgtgaagttggtcggttattgttgcgaagacaatcaccgggttctcgtttttgagttgatgccccaagagagtgtcgaatcgtatctattcccgagggtgatgctgccactgccatggtccaccagaatgaagatcgcactcagtgctgcaagggggcttgccttcctgcacgaagctgagaagccgcgaattcttgatgcggcactcccaccgtaactcatccttttgtgtccgctgcaggttgctggctttgaggccgatgacggtgtgttgttttctctagtggtccggccagctacgcccatcctggaggccgacatgccctctccggctgaaatcccctcgccctggccccactcgctacatggcgctgaacattcaacaaaggaggggtggtgcctcttctccggcccgcacataccatccccaacaccaacatcggatgactcgaaggtttgtggatagaatgtgagatatttcaattaaggttctgaagaaagatcccaaataatacagtgtccccccatttgaaaaatggcacggtggatttgatacctcaatggtcttgcactagccacagacagctttgcgtttgtgccttggtttaggaggtgtccataacgaaatagtacaaaacttttgcaaattctcgcatacagccatggggtcgtttggcaccggtatatgtgattagtggatcttcagtctgcgggcaccgaggatacatacatagtggggtgagtgcttatttgctgacaggccatgttaaattgtcactgtttggtatgggtcgcttcatgtgaggaaatcagacctctctttgtagcttcaaagatgcagtaattatagtattcttc

SEQ ID NO: 26547 - DNA, 704 bp, Triticum aestivum
  Clone ID: PAT_TA_26547
gcacgagggagagacagaggccctgagccggaagcaaggaagaggcgagcgacgacgaggaggaggaggaggttgttggtgggctgttgagaggaagcttctggaagccgccatgggggactcgagcgggtcggtgtccatcgacgtggagcggatctacttcggcggcaaggagcatcctgtgagaacaagatacggctctgtatccgtctccgtgtacggcgacgaagacaagccagcgctcataacgtacccggacgtagctctaaattacatgtcctgcttccaaggattgttcttctgcccagaggctgcgtccctgttgcttcacaatttttgtatttaccatatcactccgcaaggccatgagttgggagcagctccaattccatcggatgtacctgagctatctgttgataatctcgcggatcaggtcgcggatgttcttgatttcttcggtttagggtctgtgatgtgcatgggtgtcaccgccggtgcttacgtgcttaccctctttgcagcaaagtacagggaaagggttcttggcctgatgttggtttcacctctatgcaaagccccatcttggagtgagtggttgtataacaaggtattgttaaacttactttattattgtggcactagtggactagtgaacgaatgcttccttcagcggtattttagcacggaagttcgtggaagtggac

SEQ ID NO: 26548 - DNA, 1131 bp, Triticum aestivum
  Clone ID: PAT_TA_26548
gcactccgcgggcctccacccccaccccccgcgccgcgcgccccgcgccccccgccccccccctgcagtcacctatctgcatttctacgactgcccccagttctcgtttggtatcttctgtttgcccaagcatgccgtcattcccctgcacaaccatcccggtgatgaccgtcttcagcaagatgctctttggctccatgcacctcaagtcgtatgactgggccagaagtatctcggaggccggcactactgcgctcaccacctcggacggggctcgtctcgcaaagatcaacacaaacaatgttgttgacgcctcagcggaagcccatcgttctgtacccggagaacggaggcaacctgcactgcttcaccgcgctgaccccttgcgctgttctcgacgtcatgggacccccttacaacagcgctgctggtagggactgcgcgtactacagcgagtccccgtttgcaaacacagccggtgtggctgacgtgcggtattcctggctgaaggagatccccaacaacttccggatgaagggcgtaacgatgccgcgggacttcgtcgtctaggaagaagcattgaccattgttaccggtcgtctgaagggcgctccgtccgtctagcttctttgtgtagataacagttgtaacctgcgaaaggcaggcagttggtccgttgtccgtccgttcaacctagctctcaggctagcaaactctttttttacccttacccgtgttcgtcggggttgaaactatctcatgtcgtctgtctgtcgttatcttgtcttgtgttgcgattttcttgtggttctggcgtgcggggggcatggtcgctctttcttgttaccctgttgtacaggcacccgtgctgttggtgcagcacgagtgttttttatggtgaccatgcatgtacccaatcagcccagaccgctgttgaaatatatcttgtcttgtgttgcgattttcttcgttctggcgtgcgggggcatggtcgctctttcttgtttccgtgttgcacggggcaggcgtgctgtttgtgcagcgggaatgtttttgatggtgaccatgtacccaatcaacccagagcgctgttgaaataccagagtgtagattgtttcaaaaaaaaaaaaa

SEQ ID NO: 26549 - DNA, 794 bp, Triticum aestivum
  Clone ID: PAT_TA_26549
tttttttttttttttctgagaacgtacaatttcttattttcaattgctcgttatccttggaacagagagatgctatctttcattaaaaaaaggggggaagaagctaaaacaacaagaatgacaacctttcttctatttaacactcaacaatgttttgtcgaagcagtgtcgtatgtacagtgtcatttacattctcgcttaaacaaagggcagcatcactaagcagccatcaacttaaaaaatactttctgaattttctgtacataaaggaacaagaatattgaaagaagttcatcgactttgagctaattccatcgcttcggagtattcgaggttcttggtgaggatgttgcttgtgtaattgtgcttcttcgtgtgcttgctgacgctgaagatctaggagtagaatctcttgatttgggccacacactagaagatggggctgtttttggtgttgttgccttttgtactcgagtagtcaccttaggtagtcgatcttttggtgtgttgggtgcattttcttgttctttccatgcgctagctattttttcctgctccgggaagagagcaaagtcaaccatgctacttattgagccgtcggtttctgtacccatggatatgccactatctgatatatcgcttaacctcccctctgaatcagcgtaaccaaagctggcaagctcagggtcagctgaattcggacccatatcatcttcagggagcttggaaagtaccataatctccctctgctgctgaatatcatcaatcgactgcatggagctagtttcagaatg

SEQ ID NO: 26550 - DNA, 434 bp, Triticum aestivum
  Clone ID: PAT_TA_26550
ggccggccaccgcaaaaacaaacggatttgctatttttcctcgagtgttttccatcggctatcattcgagtttgtgcctgcctgatctcacgctgagattcgcgctgagagttgttgttttcagtcgtgggtttcttttgtcaggggtggtctggtgcggttttctgttgggccggcgcgggtttattgcgggcctgtccgttacagtctcccccgtgtgtccttttgaattttttccccatttcatttgggcggtattgtttcgagagggcggagtggcagaggaggtgttcgagaggcgaaggagtcgaggcgattcccttgttttccttgcgtttttgagatccctctctggtgaatcttgatcttcctcttcgattccctgcttccctcgttagtgtttgtctctctctatctctctcttcacgcgtgcg

SEQ ID NO: 26551 - DNA, 1235 bp, Triticum aestivum
  Clone ID: PAT_TA_26551
cccccccgggggatgatggcggaggcaaatgcagtagtgaagactgatgatcagaaggcttgatggcaggaaaaagaaaagcaagaaacaggagaacgatgaggatgttgaagctaggctggaaaaggtggaattagcagtaaaagccaagtttgaggcggcggggaaactcaaggttcatgacaagaaatctggtgaggatgaacctaagactcagaatgacgaggctaacgagaacggtttgagtgatggtgctcctctggacaaggggaagaaaaagaagaagagtaaatcaacttcggagacctcagataagactgatgcaggaactgcacctgccgaggccgaggtgaaatctaatggtgccagtgaaaataataatgctgtgggagaagggaaagatgtcaatgagaagaaaagtaaaaagaagaaaaagaagtcaggttctgaagaaaatgttcaggtagaagataaacaagttgcagggaaagattcagctcccaaaccagatgatgaaaacaagactgccatggacattgagaacggacaagatggaaaggcttcagctgatgatgcagttgttagcaagaagaggaaactggaagaagttgaaggaagcgaaccccctgccaaagaagatatcactgccaccgaagatgatgtgaaggagcccagcactgcatcgaaatcaaataaacggcagaaactttctgagcctaaaattgcattccaacgggtaaagactgaaggtattaaatttgctgatgaaagactacaagataattcatattgggccaagggtggtgccgactctgggtacggtgcaaaggcacaggagattcttggacaagttagaggaagggattttaggcacgagaagaccaagaagaagcgcggaacctacaagggcgggttcattgatctacaaacccactcgattaagtttaacaattcagatgacgagtaatcgcgtcatttgttcaagccgtgcgacatttcccattcttgccctcgttactcggtcagtcttgctgaacggaagaagtgaaggcatgcctgctttgcagagaagaagcaaaaacattgaattgttgtatcctgccctttttgttatgctgcatgctctgttaagtcatcagaattttgtaatggactcagtgagacgtaccattttggctatgccaatgggaaatgaaatattactacatagtaagtatcgttttacatgctgccgg

SEQ ID NO: 26552 - DNA, 1079 bp, Triticum aestivum
  unsure (1)..(1079): unsure at all n locations
  Clone ID: PAT_TA_26552
aaccccccccccccccccgcctaaatgggcggttaagggggggggcccctttccccttcggggggggcaacttttggaaaaggggatcggggggggccttttttttttttccccccctgggaaaaaggggatttttcccaaagcatttaatttggggaccccccgggttttccccctccccccgttttaaaacccgggcccgggaattaaattttggggccccaaaaaaaaaaaaaaaccttcccaaccccgggttttaaaatttggttcttttaaaagggccccccctttttttttttttttttttttttttttttttttttttttttttttttttttttttttttttttttttttttttttttttttttttttttttttttttttttttttttttttttttttttttttttttttttttcaaatcacatacataatcaatatttcaaacagaacattacaaatgtagttcatcaactaacgctaagtctactacaatctgtacatagtctataacaacccaaatatgcctacaattacaatataacaacatttacagtctattacagtcaaacaaaagagacgactctttgctgagtagggctatctggcttcgaacttcaaatttcgtagacctcctgttcatcaattgcgagcaccatgcaccttggttggacatgaagcgcttgtcctccgttgcaccatgcacctttgatgaaagacggctgatcgctaaaaccgagccctggttctcctcccggacaatgaagaaggggtcctgcgcggagctcatggcggacgccggaggttggtgaggtcggcgaggggcagcagcagcctccaaaggacgcagccccagcagcagcacctcgtcggctcctcccgctccggccctggcgattgccccggtccggcaacacgatnaacgcgcgcacnaacaccanagcgcncggngacaacaagtgtnatgctcacganccacatgagtatgggtaaggagattcatggnctgagactttccccacagtnatgaacntncaaagggtggncccgctgtcaccttacnctcatngncacac

SEQ ID NO: 26553 - DNA, 1022 bp, Triticum aestivum
  unsure (1)..(1022): unsure at all n locations
  Clone ID: PAT_TA_26553
aaatatnannaaatgcactcctcttgtcatttacttgcaggaaacatgggaaaacattatgaagtaccttttaaacagtttttacatttggaatccatgcaaattttcatttacatgatttttattcgctttgtactgtggatgtgcaaatgttacaatgccttccaaatataaaaggttgtcatgacagtcttgcaagggtactgtcaaacatatgtgccgtggaatgaagatgggacagccctatcatgacatttgcgggtctcctagcaggttgcttgtaaaaagttactgatgtaggtttgtgcaagactttctccaagctttacttgtgcttcagtggtaagatgcagattatcttcgttcaagggcagaccaattgcatccacagttacaacattcagcaagttaatgctaagctgagcctccctcactttttcaatgttccttttattcccagatgcgagagcaacctgaatgaatggtagatgcggcatcccaagatctgccctgatatttgctatcagcctctccacgttcccctggtacgccgccgtttcggcatcggactctgcatcgctctccccctggtaccacaacacggcctcgatctcgccgcactcggtcgcggcgcgcgcgcgccgcaccatctgctcgtacaggtgctccccgcgggcccactcccggatggccgtgccgccgacggcgcacggtacgagcccgaccccggcggtgcctgggggctgcagccgcgggagaatggcgcgggcgaaggccatcccggggccgacgccgcaggtcttggtcgtgtcgatgtcggcgtgcagcggctcgcgggcctcttcccatgcgagcgcggcggagaggcggaggatggaggggtccggcgcgcactccgccggcacgaccccgtcccaccgtcggtggtgcacgccgccgcggccggccatgttgctctgccctgagagaaggaagatgcgcatgactgcgggagcagcggggcggcagcggtgaggaaagtg

SEQ ID NO: 26554 - DNA, 749 bp, Triticum aestivum
  unsure (1)..(749): unsure at all n locations
  Clone ID: PAT_TA_26554
acctggtggtggcgagcgaggagtccaagctggtgcagcacccgtggcgcaacatcctgcagcgcaagtaccggccccagctgaccatggcgatcatgatccccttcttccagcagctgacgggcatcaacgtcatcatgttctacgcgccggtgctgttcgagacgctggggttcaagggcgacgcgtcgctcatgtcggccgtcatcacgggcctggtcaacgtgttcgcgacgctcgtgtccgtgttcaccgtcgaccggctgggtcgccggaagctgttcctgcagggcggcacgcagatgctgctggccagctggtggtggcaccctgatcgcggtcaagttcgggacgagcggcgtgggggaagatgcccaaggggtacgcggcggcgggggtgctcttcatctgctctatgtggccggttcgcgtgggccgtggggcccttggggtggttgtgcccacgagatcttccgtggagaataagccggcggggcagacataacgggtcggngaacatcttttacctttgtcatcggcaggcgttctcacatctttccaatgaagttggccttttattttcccggtggtggggatatgaccgtttatggctttcttgcggaacaaaacgcccttnagaatggctttttgaaggaatggttgccgagtctgttcctactcactccgcggacggaggggccggccccatctcttatcctcgttctccgccccctggtttcttttctttt

SEQ ID NO: 26555 - DNA, 771 bp, Triticum aestivum
  unsure (1)..(771): unsure at all n locations
  Clone ID: PAT_TA_26555
cttaatctctcctattccagttgcagccacaccggcccaagctcatccagttcccacgcaccgcccggagctcctcgcccagatttccttctaccccgcctcgcacgctgctgcttcctgctctccccgccgtcgagcagcacggccgccccgccggccagctccgctcgctgcttctccaaaccacatcatcttctacacctgtgcgacccccgggcgacaacgctggtgctccatcctggcgtggaacgatccctatcctcatctatgattcctgctttgccaggtcaaatcaggtccgccaccccccctggccgccgccctgttccgccggcccggggagtcccccgtccccgggcccccccatgctacgggctcccggcggcgagcacgcgggtctgccagggcatctaccggcttgacgtccggtggggatgttgtctactggtcctctgcggtcctggcgcccgtcggggggcctgcttgcttccttgcatgcaactcggcggcgtcgtggaccttcacggtgcagccttgtggcaagtcgttggcctttgttgctgggggacagcgggggtctcccctgcccgtatttgttctcgaaggggtacgaacgtgaagctagtgggaggcttgtagcaccaatggccagcntnnnntnggggggggggaanttttttttttttttaaantnnncntcnccnnnnaaanggnccnttnttttttnnnttnnnnttngggnnnggnnaanncccccnanntnnnggnggg

SEQ ID NO: 26556 - DNA, 609 bp, Triticum aestivum
  unsure (1)..(609): unsure at all n locations
  Clone ID: PAT_TA_26556
ctccaccagnagagcagagctgtggtgctcgagttattactgccaggagcccaggagaactgtagtagtggtcaccggcgatatggcggcggcaggcgatgggacgacgaggaagacggcgtgcgtcaccggaggcagcggctacatcgcgtcggcgctcgtcaagatgctgctggagaaggggtacgccgtgaagaccaccgtcaggaaccccgatgacggggagaagaacgcgcatctcaagaccctggcggcgctggggcccttggaggtcttccgcgcagacctgaacgaagagggcagcttcgacgacgccgtcgctggctgcgactacgccttcctcgtcgccgctccggtggcactcatgccaaagaaccccgaggaagaagtgatccagccagcgatccaaggaaccctgaacgtgatgaggtcgtgcgtgaaggcggggacggtgaagcgcgtggtcctcacatcgtcgacggcggcgatctccagccggccgctggaaggcgacggccacgtcctggacgaggactcctggtccgacgtcgactacctcagggcaaccaagagcggtacctgggcgtaccctgcgtcgaaagtgctcgc

SEQ ID NO: 26557 - DNA, 1254 bp, Triticum aestivum
  unsure (1)..(1254): unsure at all n locations
  Clone ID: PAT_TA_26557
ctgcggaccactccaccgcacgggcagagcaccggtgctctagttattactgccaggagcccaggggaactgtggtaggggtcgccggcgagaaggcggcggcaggcgatgggaggacgagggtgccgcccggcgtcgccggtggggacgctgctggcgcggcggcgctccgcaaggaccaccgggagaagccccgctgacggggggaagaccgcgcatctcaaggccatggcggcgctcggccccttggaggtcttccgcgccgacctgaccgacgagggcagcttcgaccacgccgtcgccggctgcgactacgccttcctcgtcgccgctccggtggcccccctcccccgagaccccgcggaaggaggaatccagcccgccagtcaggggaacccggaccttaagggggcggtccgtgagacccggaacgttgagggggtcgtccctcactccgcgggtggcccgacgccctcccgcccgccgctgggtgacggcggcgacctccacgaggaggcctcctgggccgaggtggacctccgcagatcaacaatgaccggtccgtgggcgtactctctctcgaaggtgcttgtggagaaggcgacgtgcgcgttcgcggagaagggcatcagcctggtcaccgtgtgccccgccgtgacggtgggcgaggcgccggcggcgaacgacctcaccagcctcagcatcatcctctccctgctatccggggatgatgcgtacgccgggcgccctggaacacatcgagagggcgacggggtcgatcccaatggtgcacatcgacgacgtctgccgagcggagatactcgtcgcggaggaggaggccgcgtcggggaggtacatcgtctgcgggctcaaccccaccgtcgtcgagcttgcccgcttcttgcctgccaagtacccgcagtacaaggtcaatacacataggttcagagatctccccgagaagccgagagtgtgcatttcttcggcgaagctcgtcaaggaagggtttgagtacaagtacaagaacgtggaggagatatacgacagcgtcgtggagtatggaagggccttgggaatacttccatactaagtagtgtgatggatcttagaaccaggcgatgagcttggaagcaaaataagcctagtctcctgaagaacacaaatgatgaaatgtgggtgttcggtttatgtgaaaatgtgttataaaatgtacttgtangaaagtaggttccatgtcggcatgtcctcacatca

SEQ ID NO: 26558 - DNA, 1394 bp, Triticum aestivum
  Clone ID: PAT_TA_26558
cttcctcccttcgccgcctccccgccagctagtcgcgacgcgaacgccgccgcctggcagatcccaggcgctagccgcggatccgtttgccggctccgaggggtcgtggaggcgccgccgccgaggtcctaaaggaggcgccgccgcccgcgccgtggacctccgggtggccatcgggacacctctgctgaggtacgccttcgccttcgcgcgctgccgacctcccagaggagacgccgccgccatcgacctccaagcggagacgccgccaccacctgcgctaaaccctaggcatcaaccaccgtgctcccgtcgtctggttcctcctgcgttcgccaccatgcgatcggcttcctccctcaggttcttgtacggaatataccaccagaccccgatgaatcagttagcaagcttgtggaacatttcttccttgttaatcatcctgatcattatctgaaacatcaggagtgtaaactgatacttatttctaactacaaagtgttggctgcccaggaagacggaaaggtcaggccagacatgacagttaactctaataatggaggtacgtagtgcctactgctccctcggcgccgctgtccccctgggggtccgcctgaacgtgcggtcgtacttgaagttcttgagctggatgccggctgctctcaagatgcccgaggaggagttgatcgagcatgccggcctcgattccggtgtctatctacggatatacctcaccggactgaagatatttgtcccgattacgattcttgcttttgctgttctggtccctgtgaactggaccaatgatacgctagatgatttgaaggtagtccacagtgatattgacaacctttcaatatccaacatacctcatggatcaaagaggtttatagctcacttggttatggcctatgtatttactttttggccctgctttgtacttaggattgggtttgaaagagtcgcgactatgaggttgcgctttcttgcttcagagaaacgccgaccggatcagttcactgttcttgtacgggaacatcccaccagaccccgatgaatcagttagcgagcttgtggaacatttctttccttgtcaatcatccttgatcattatcttgaaacatcagacagtttacaatgcaaataaacttgctgatctgggtggggaggaggaggaaatgccggattggcctgtgttctcccaccacaacctgctgcggcgatcctccaggccgccaactacgacggccggccttcgggggtgttggggctctggtgggggcgcgtgatcactgcaaatcagagattgaaaagatagggaaggaagaagctgaagagcgtaaaaaggtcatgaaggatcccaagtccattatgccagcagcctttgtttcttt

SEQ ID NO: 26559 - DNA, 1146 bp, Triticum aestivum
  unsure (1)..(1146): unsure at all n locations
  Clone ID: PAT_TA_26559
gccggggttgacatacacaggaggtctggaagtcaattccaggttctcataatcgtccacgcaagagtgaagctttgtctgccaccactcttcagttcacgtcgttgatgttgtgaggactggcagctcttcaattcacactgccaatgttgtgaggactggcaggacttcaatgggcatggaggctgcaacctagggcgagggcatggtgtgttgagatggcggagctgcgttggtgggaggcggtgatggcggcggcaacgccaatgtccaccgggatctctagccgcaaaagttggaagaacaacttggggatgtcgtgctgctcctgcgtgtagtagataaattgccgcccagataaatcaccgagacactaccaagtgtgtcgttcattgggccaggataaaacaatcttgagggtgcctcatgtgcgactctagctattgaaagtcaaagaacttgactacttccggagtttgataaggctttacagtgagttctcatacttttactgtttttttttcgaaacggttttacttttgttgttattaagcagattctgtcaaagcaattgctatgtgtatgccattttcatgttctatacgtggctgtttttccatgttctagacatggatatgatgattgggtcgatgaagcaattgatttctaataccagcaatttggtttctggatattctaatctgacagttttgtttcattgccacgctgaatctattcatatggngatggatgcagcataaccatcaattgaagtagataatatgcaaggctatttaccattatccaggtttattaacatttaggtttggnggaattattcacatccaggttgggnggggtaacctgattatttagtttcaaatggnncgttnagtggcataaaggcaaaacatnggnattttgaanaantgggggngattcccnntgnannttntccaaaccncntttttttttttntttnttntgccanggnanganttgnnnggcangtnaancnnttttacgggggtttggnnggggttaanttnntnttnnnnngggnttttnttnccngngnccccnttnnnnnnnnnnnnnnnnggnncnnnaaannnnnnnnnnnnnnnttttnnnnncccnnnnnnn

SEQ ID NO: 26560 - DNA, 932 bp, Triticum aestivum
  unsure (1)..(932): unsure at all n locations
  Clone ID: PAT_TA_26560
ctggagcggcacgagaacgcgctgctgaagcaagagaacgagaagctgcgcacggagaacctgaccatgacggaggccatgcgcaccccaatgtgcggcgggtgcggcagtcctgccatgcttggggaggtctccctggaggagcaacacctgcgcatccagaatgcacggctcaaggacgaactcaaccgtgtctgcaccctcgccaccaagttcctcggcaagcccgtgtcccttctgtcgccactccagctgcagccacacctgtcgatgcccctgccgaactcgtcactggagctagcagtcgggggaatcggtggcatagggtctatgcagccttcgatgcacggtatgatgagtgagtatgccgggggtgcctcaagctcgatgggcaccgtgatcacaccagcacgggcaactgggtctgctttagcatcgatggtggacattgacaggtctgtgttcttggagcttgcaatcagtgcaatggatgaacttgtcaagatggcacagncgatgatcctttgtggggttacnggattgcctggntttccggacaagggagtcactcaactttggggagtatctncactcctccaacatttgcattggcatgaaacctgccgnttttgtgtctgangccttagggaagtccggctgggcatcatcgnnataanngtgcccttggagaacccttatngacnaaggggggggtccacatgttttatgtttgattgttaaggcncaatcttgggaggngnntacgnattgggggaacaaaaatggncatttttntaagaagggtnnctaangggctttactttgggnccanagggaggttttttntaanttttnaannntnnttngggnccggncanggggatgtnccnttntggntgngnnaaaaaaatttntnccantccnggnccann

SEQ ID NO: 26561 - DNA, 925 bp, Triticum aestivum
  Clone ID: PAT_TA_26561
atttccattacctttccgtaattcccttggggcgggggcgaccccggacgcgtggggcaaacacgcgcggaggagagaaggcgcctcccctgcccccgcgatggacatctcggccggcggcggcggcaactcgctgcccaccaccggcgcggacggctcgaagcgccgcgtctgctacttctacgacgcggaggtgggcaactactactacgggcagggccacccgatgaagccgcaccgcatccgcatgacccacgccctgctcgcccactaagtaatactcggcacaaaactacccctcaagccctaccccatacaagacccagaccttttccccttccacgcagacgactacatgcccttagccttcagtttcaagagcgacctgcagataccgagttcccgcagccggatgaagatgaagaggatcaggatgaaaggcatgatgaccatgattctgatatggaattggattatcacacacctttggaagactcagcaaggagaagcactattcaaggtacaagagttaagagagaatcagctggagctgagacaaaagatcagcaggatggtagcagagtaacaggtgaacatagaggatcagaaccaatggcagaagacatcagcccctccaagcaagctcatcaggtcgacgctaatgccatggccgtggatgagcccggaaatgtcaagaccgaatcaggaagctctaccaagttgcctgacccaccagccatctaccagaagccatgattgtaagcattcggaccgtgcggcttcttgcatgtgtttttggcagtaaaaagacgaagtgacgagtggtagtctcgagtgtctgacccatgtatacatgtagcatggattattaagctgtaatatgtatagtcgattaaatgagccgcgaggcggaatttttttggct

SEQ ID NO: 26562 - DNA, 1842 bp, Triticum aestivum
  Clone ID: PAT_TA_26562
cgtcggcccgcgcgtgcgcacaaacccgcaaaaacaatccatcccccaaaaccccaccgccccgcggcggcggcggcgtcgcgatggacccttcctcggccggcgccggcggcaactcgctgccgtcggtgggccccgacgggcagaagcggcgcgtgtgctacttctacgactcggaggtgggcaactactactacgggcagggccacccgatgaagccgcaccgcatccgcatgacccactcgctgctggcgcagtacggcctcctcgaccagatgcaggtgctgcggcccaaccccgcccgcgaccgcgacctctgccgcttccacgccgacgactacatctccttcctccgctccgtcacgcccgagacgcagcaggaccagatccgggccctcaagcgcttcaacgtcggcgaggactgccccgtcttcgacggcctctacagcttctgccagacctacgcgggggcctccgtcggcggcgccgtcaagctcaaccacggccttgacatcgccatcaactggtcggggggcctgcaccacgctaagaagtgcgacggccgtcggggttctgctacgtcaacgacatcgtactcgccatactcgagctcctcaagcaccaccagcgagttctatatgtcgatattgatatccaccatggtgatggagttgaggaggcattctacacaacagagagggatatgacagtctcattccacaagtttggggattatttcccaggcacaggggatgtccgtgatattgggcattcaaaaggaaagtattactcccttaatgtccctctagatgatgggattgatgacgaaagctaccagtccctgtttaagcctataatggccaaggttatggaggttttccggcctggtgcggttgtgcttcaatgtggcgccgattccttatctggggataggttgggctgcttcaatctttcgatcagaggtcatgcagaatgcgtgaagtacatgaggtctttcaatgttccattgttgcttcttggcggtggtggctataccataagaaatgttgcacgatgttggtgttatgagacaggagttgcacttggccaagagctcgaggataagatgcctgtcaatgagtactatgaatacttcggtccagattacactcttcatgtggcaccaagtaacatggagaacaaaaatacacgctacgaactggataatataagaaccaaacttcttgacaatctttcaaaacttcgacatgcccctagcgttcagtttcaagagcgacctcctgatactgagttccctgagccggatgaagatgaagacgatcaggatgaaaggcatgatgaccctgattctgatatggaaatggattatcacacacctttggaagactcagcaaggagaatcactattcaaggtacaagagttaagagagaatcagctggagctgagacaaaagatcagcaggatggtagcagagtaacaggtgaacatagaggaccagaacctatggcagaagacatgggtccctccaagcaagctcatcaggtcgacgctaatgccatggccgtggatgagcccggaaatgtcaagaccgaatcaggaagctctaccaagttgcctgacccaccagccatctaccagaagccatgattgtaagcattcggaccgtgcggcttcttgcatgtgtttttggcagtaaaaagacgaagtgacgagtggtagtctcgagtgtctgacccatgtatacatgtagcatggattattaagctgtaatatgtatagtcgattaaatgagccgcgaggcagaattttcttggctacgtgttaaaaaccccccccccccc

SEQ ID NO: 26563 - DNA, 1228 bp, Triticum aestivum
  Clone ID: PAT_TA_26563
ctgctatctctcgtattcttcccgcgcacaatggactagtatgtgctcctacgagcatggccataaaaaatggactagtatttagtatacagaaagaatggcgtgtctacttacaaactctgtaatgaacactttacaaatggaatctacgggagttctccctggcccattacaaaattgaactgttaatggttgcctgcttcaggagagaatggacatgaagacggtggaccatgtggtgagcgcgaccgcagcaactaggtacgtccacaggaagatcaccgagcactcctcctgcccgacgtcgaacagctgcgccatggtcccgatgttcatagcgggcggcagcgcgaactgcaacatcagcacgtaccggtagagagggtcatggggaaggaacccgaccccgtgcgccgcgcggacgacggcgatcccgatcaccggcatagccacgtagcggataaacacgatcgccacgatcaccatgcgcttcagcaccgacttccgcagcccttgtggcagttctccacccaggacgagggtgatgcagggtatggtgccattgcccatcaacgccagagaatcctggataactctgaaaggggcgccttcgccgatgatcagcgacttcagatatggcactagcccaactgcgaatccaatcatcgcggatatggtcggcggcgccatgagctcctcgacgagctggtgcacggcctccttcaggtttacccagaaccctttgttgttggcgacatcgctctcgcacgacagtagtggagcctcaatctgtctcccctcgttgtgttcgtcatcgggtccagccgatgcggggagtgctgcttcctcgtcgccggctttgaatccctcgagatgctcctcgtcgctgtcggccgggcactggatgctcttggactgcatcttgtggtacagcttgccggacttctgcatcaggctgtaggtgtacgtccatatgaagaggccaccgagagccatggacagcgacgagtaggagaggccgcgcgagcggcactggctcctgtcgctcccaaacgggttgccgtcttcgtcgcagacggccgggacgacgatcagcagcaggttgccgaggtttcctgctgagcagaaggccaggatcaggccgcggaaatgcggcggcggtttcaggagcttgcacgctggccagcctagagcactgccaaccaggaaggtgattgctgtgttcacc

SEQ ID NO: 26564 - DNA, 1070 bp, Triticum aestivum
  Clone ID: PAT_TA_26564
tgccttttacccatttttatatatatatatatattgctttcccgtgtgaaatgatctgatgatgacatatacacatgtgatgtggactactacaaagcatatcaacaaagaaacaaacagccgtattcctcccctacaacctcaaccctattccccttgcttgcctatcccagaagacgtagattacaggcttacagcaatccactacagcaaatgctgccattagcgtatcgatctcgatctatgcaatgcgttccgtgccaaggtaccggaaggtatcaaaacttgtctcgcgatggtgaccgtgctccgatcagctcaaccaagcagtcttcgcttttttgcgagctgacttgtcaggcgaaccaaaatctctgcacacatgatttttagacaatgagggaggcccgggtcttgatgggcttcagcttcacccccatgctctcgggcgacagcagctccggcgatatgcagaacgggttcagggtgctccgggggctgctctcgatttgtgacggtctgtacatcccttatcacatcaattcttagtgcatctacttcagcattgcgatgtcacgctcctacctcccacgtaacccgaaagcctgtagcaagccttcttcctgggggaaacattgaagtacctgtatttgctgtttggtgaaagtaatattcttccactggacaagtatgtatttaatactgaggcccacccacttccggtcattcggtctgtggtacaggcttctaataccgtatagcatcaaatgtatcactgttgtacttagtgtactaagatgagaaaggttaactaacagaaatgtgagaaatcttagaactttgttttgggacaaccaggctgaaacaatgagtagctttctcctttctggatgtttgtgcttgtgccacaggtggttcaagtggcaagaaaatcgttcttggaagcaaagctcaaatatgtgtcatcttaatagtttgatacagagatctgcacttgtatttattggaagataatatatcttctcgtaaactgtgcaatccattccaattctgaaaaaaaaaaaaaaaaa

SEQ ID NO: 26565 - DNA, 1291 bp, Triticum aestivum
  Clone ID: PAT_TA_26565
ggccccccacacacgcacacatcaagcagcagctgatccaccagtcgatcgatccgacagctagctagccatggccgccgggaggaagatctcgattggcctctgcggcgtgcccccagggcgtgaggcgctcctgtggtttgggagatgatactggacatcaggatcttctgccctgtgccttttcttgtatgcgactttctacttcattactaagcgggagatcacaaagtttgtgtcagccatcctttacatcgggttacatgctcatcgcctcatatgcgttctttgccttgacgggtacaattggattatatgcctgtttaatgttcactaggctgatttactcgtctgtgaaacttgcgtaatagtcatgttcttcctagagtaagcctgacacgggaaatgaatctgttgtggccagtgaatgccgccctttaaatttagagatctgtggcatcagttctgagttatgaaagctggctgttaaatatgaagtggtgatttgttatccatggttaaactatcatagctagctccgtgagttttattcttttgttccttttttggctttagcatttggatcacgaggatgcctgtgaagtacctcttgtgaattgtatgtggatgctgataaagtacctatttgccctggtcttcggccgcttatacatctttcttcttctatgccaagctggagtgcacaaagtttgtgtcagccatcctttacttcggctacatgctcatcgcctcgtatgcgttctttgccttgacgggtacaattggattctacgcctgtttaatgttcactaggctgatttactcgtctgtgaagattgagtaacagtgctcttctccctagttgtctgtgaagattgagtaacagtgctcttctccctagttttctgttgacatggtgaaggtcgatgctgtggccagtgaatgccgccctctaaatttagctatctgtggcatcagttctgagttctgaaagctggctgttaagatgaagtggtgatgtgttatccatggttaaactatcatagctagctccgtgagttttattctcttgtcctttttttggctttagcatttggatcacgaggatgcctgtgaagtaccagttgtgaattgtatgtggatgctgataaagtacctgttgtgaattgtatgtggatgctgataaagtacctgttgtgaattgtatgtggatgctgataaagtacctgttgtgaattgtatatggatgctgataaatctcaattacttcatgccagaatgtcatgtaatt

SEQ ID NO: 26566 - DNA, 406 bp, Triticum aestivum
  Clone ID: PAT_TA_26566
acttctatggcttggaagaaactccatacgtaccagtgaatataattgtagaagtcttgaagaattttgatgcacaagggtttgttgctgtcaacgatgatcatagcctaaacagatggcccgtgcctaagccgttttggtgctatccgacatggcacaagcttgaggaagaagtagatctggaggaagaacttaagtaccagcgggaacaatactaatgtgatgaactgtatctcgatgaatgctttctatcttgccctcaagctgccggccctgtatagcaagtatgaattgttctgtaacttaatttgaaccctgaaatactagtgtacgcatgcctctttatgtaatggacttgtactaaggccaaactaggtctattaagagatgggttcggttcaggctg

SEQ ID NO: 26567 - DNA, 831 bp, Triticum aestivum
  unsure (1)..(831): unsure at all n locations
  Clone ID: PAT_TA_26567
cggncgcgtgggttcagttcgagnaatacaactgacaatctatgatcactacgacaatttagattggttagcaaaatttcttaggcggtgagacttatgcaagtagctaaggctacaaatagatgagcattggccatgattagcagcaccgcatcaggagggcattcgtcctggaagtgtggtcggggctgactggggatgattattttttcggtggtaagggatgattgaacacatgtgagtgtcttctcaacttggcgttgcttctaatgtgttggacactgatccaagtttgcagtgagctgagatgcatctttgaaaatctcagcagagagatgctaattctccatgattattaacttgatgtcggaaatcttaatttcgtctttcctattgcaggtttattccagctcgatgtggtaatctgcagcaatcaagttaacaaatcttaactgaagaagtggagaggaaaacccctgatcagtagggagtacaggataacgtggtccagctcaccatcctaggctgcaggctggtttggtaacaagcggagacagactaaggaaaaggtgccaatgatggaggtgtgtgtagacatggaagaccttgccactaagagcttcttgcgagggcaagaggtaaactgacgctgagtgttgtgatctgtggggagtagtgtgaggtgtccagtgaagggacatgattcaggcaagtaactgttactataggaaaagtccctttgtacactaagtccctttaaagtgatgtgcatagcacaataaaataggaaaagtttaacctttgttttagtttgattttctcggctatact

SEQ ID NO: 26568 - DNA, 735 bp, Triticum aestivum
  Clone ID: PAT_TA_26568
acggcggggactccacctatgttgctccgctgccatctggatttgccattctgcccgatggtcctagcatcggcagcgagcacaagaccggcggctctctgctgaccgtggcattccagattcttgtgaacagccagcccacccgtgggctcaccggtgggtcggtcgagaccgtgaacaatcttatctcctgcactatcaagaagatcaagacggcgctgcaatgtgcaacgcctgagtgttagggtggattttgccttggggaggaccggcgacgtcgagcctgagtcaagaacgaaccgcgcaatgaaaaaaaaaatcctttgctaggtgataaggatcttacttgaaaggtccttagcacagagcaatggtggtggttcgggtattgactcggcctcttccgtcggctgtattccccggtgccatgcattttagacatttcttgaaggacatgctatagttccatcgttttagggtgaactttcggctggctcgttgcctctgttttgtccgtctctctctttctgttgtaaggatgagctggtgtgcaagtggagactcaggaaggctgggttgatctactagtgccgtccataggttctggtagaggtctagaatcaaacatgaacgtttgaaagctatcagccaaataatgtctggcgttgctgtggatcaactgggatttatttttgcaatcaatggccggccaaagttcagattgttgctgcaaaa

SEQ ID NO: 26569 - DNA, 398 bp, Triticum aestivum
  Clone ID: PAT_TA_26569
cctgcccagatcgccgagatgtcccaaagcaagttcggagaccagcacgctgcaagaattgtggagttgaaggtcaccgtcgcaacaactgccacaaagcagcggaacttattagactcaataaagcatgagcagacaaagtagtcagtgaaactgtttaagataattccaacgctctatgtttcaacaattttcagttgtgttgtactagtattttaattagttggttggtgtgtaaagtatgagggaaaaaacttagttcaattaagtcatttcatcatgagcctgtactgacggtgttttaggggtacttctgatctcaggcgtttgagtcgttgtatagagaaacacttacctgtgttgcctgatctggtacttaaaagacaacataataattc

SEQ ID NO: 26570 - DNA, 797 bp, Triticum aestivum
  Clone ID: PAT_TA_26570
tcgcttctccttcgattccccacacccaccgccgccgggctctccaccgcgcctccgcgctccaccacggcgttggcctctccctcgcgcccccgcgtctctactccacgctgtcgacctctccaccgcgccggccacctctccacctactccagaggagcgttgccctgcggaatggcgtgacggccgtggcggcgcacgtcccggaggtgctgctgctcgtggtgtccaatcccgtcgacgacctcacctacctggcctgaaagctttcaagcttcccggcgagcagcgtcggcggctccggcaccaacctccactcctccaggttccggttccttatcaaccagctccacgtcaacacccaggacgtgtaggctatttaacttgtttcttgattaaggtgttgatgggctgtaactatttgccactctgaagatataaagtgttatttcttcaggtatcgtatcactgaggcaccctcccatgcacctgcaagcatgaatgaaggacgtgttttgaggtctagtgtaacacaagatcatgatcatgtagatcacgcgcatcagccttccaaagaagcaaacataaggactggactcacaatgaaccatgaagccggcgatccgcgtcaactggatgctttagctttcattttgtacaaccgatgtctcatatttgcgtcttttgctgtcattctgtaaacctgatgtatggtgtcttgtcttggtgcttagaacagactgaagtgtatgtatgtgacaattagttaatggaataaaaatggtttggtgcacctg

SEQ ID NO: 26571 - DNA, 884 bp, Triticum aestivum
  Clone ID: PAT_TA_26571
cgacgcccttctacttctccttcgattcccttcacccaccgccgccgggctctccaccgcgcctccgcgctccaccacggcgttggcctctccctcgcgcccccgcgtctctactccacgctgtcgacctctccaccgcgccggccacctctccacctactccagaggagcgttgccctgcggaatggcgtgacggccgtggcggcgcacgtcccggaggtgctgctgctcgtggtgtccaatcccgtcgacgatctcacctacctggcctgaaagctttcaagcttcccggcgagcagcgtcggcggctccggcaccaacctccactcctccaggttccggttccttatcaaccagctccacgtcaacacccaggacgtgtaggtgttgatgggctgtaactatttgccactctgaagatataaagtgttatttcttcaggtatcgtatcactgaggcaccctcccatgcacctgcaagcatgaatgaaggacgtgttttgaggtctagtgtaacacaagatcatgatcatgtagatcacgcgcatcagccttccaaagaagcaaacataaggactggactcacaatgaaccatgaagccggcgatccgcgtcaactggatgctttagctttcattttgtacaaccgatgtctcatatttgcgtctttttgctgtcattctgtaaacctgatgtatggtgtcttgtcttggtgcttagaacagactgaagtgtatgtatgtgacaattagttaatgcaataaaaatggtttggtgcacctgtgggacgatgtcttgatggttttgctttggtcacggggcctatatgtatgtgacaatcagtaccatatgctaattaaaattgtggttggctgaacaaaaaaa

SEQ ID NO: 26572 - DNA, 938 bp, Triticum aestivum
  Clone ID: PAT_TA_26572
gcgttccccgctcttttttctgaaggagaaattccatcttcttgttgttttgtactgttggatactttagcatcattctcatactactaggagtgtaggtaaggagtccatacacgagtttgtaaacaccatgtgtaagggagttcaccaacgtgatgtgcctcacctacaggggtgttgctttgtcaccacccttgtgccttgtccaggtgctacttaccagcctcttattttgtttctgaattcaagatcttatgctggtcctacaagtaatattaaagcacttccctccctgttggcattaaaacctctggcgtggttgttgtgttgtactgttgtttatactaggcgagcatcacttccaatttgttgtagtagcgttttcttgctacttcatggatcttgggtctttggttgttgagttatttgcttcagcaattgggcttctgacttagagcttttggttttgtaggcattgatggttgtcttgaagaagatgatggtgggctcttcccaccactagcagctatagaggaaggggaaatctgtggctgacaagggcccgccgccgcaactgtggtggcagagaaggtggtggcacagttagggcagccacaagaccccatcatctgggcgaggcggtagcatcatacttgtcatcatcctgtcacatagctttggatttgaagcatgaggagaagcattgtgggggagaagcttcagtgcaacattgttgttgtatagggattaacatcctcaagatcacttggaaaactttcacaaaaaactcgtaatgcaagcatatgttttattggaaaagttttccaagctgaatttctgaaagcctcctcactgctttagttatgctgaattggaatttgcagctaggggtttctcacaagtaaatttcttagctaaaggtggattttggtctgttc

SEQ ID NO: 26573 - DNA, 500 bp, Triticum aestivum
  Clone ID: PAT_TA_26573
cccacgcgtccggaagacttgaatctgtatcatcaagaggtattgggcaggaatggacaaggtaccagaagatagagggattgaaagaaacaataagcacaagagaaggagtgaaaaaccaagctcttagagaatatgagagtattaaggaaaataacatgactgaaattaaaagatttgacaaggataggcgtcgggatcttattgagatgctgaaaggatttgttgtaaaccaggtctcatattcggaccattttgctaatatgtggggaaaggtcgcagaggaaactaaagtatacgcgaacaggagcaactgatgcaggcatgcagctttggtgtacagtactagtatagcagtggattttgccctgactccaacaccggcacaacctttcctttgttctctccagttttgccattgtgatgatgcaacaattgcgcgataatttattgcggctacctggtcttgttatagacaatggactgaaaaatgagaggtg

SEQ ID NO: 26574 - DNA, 1135 bp, Triticum aestivum
  Clone ID: PAT_TA_26574
ttgcacgaggccgagccgcgccatcgccgccttccaaggcgaggcgccacggcactggaccaccacggtgaatgccgccatcccgaccgtcccggccaaagctgggagagacttgtttgggatgtttaaggatttgaagcagaccgtcgtccatgggttcggcgcgacggatcccccgcctgtggaggaggagactgatacagaattcctgtcgcacaagtccaggctcgaggacttgcagcagcagctcaccacgacgtctcagcaggcggaatcacttgttaaagctcaggatgatcttcgaacaacgacagctcatttgggaatgacattcattaaactggcaaactttgaaagggagcaggcaacatgtaattccgagagaagacgggctggtgttatccaacattttgcaaattctgttgtcaagttcagcaggtctcaggcaaaattaaattctgaagttgtacaacagctggatactatccatgaatacttggagatgatgatatctgttaatcatgcatttactgatcgttcaaacgctttacaacatgtgcaaagtctgtcagcagatctgtttttcttgcacactagggcaggaagacttgaatctgtatcatcaagaggtattgggcaggaatggacgaggtatcagaagatagagggattgaaagaaacaataagcacaagagaaggagtgaaaaaccaagctcttagagaatatgaaagtattaaggaaaataacatgactgaaattaaaagatttgacaaggataggcgtcgggatcttattgagatgctgaaaggatttgttataaaccaggtctcatattcggaccattttgctaatatgtggggaaaggtggcagaggaaactaaagtatacgcgaacaggagcaactgatgcaggcatgcagctttggtgtacagtagtactagtatagcagtggattttgcccctgacttcaacaccggcacaacctttcctttgttctctccagttttgccattgtgatgcaacctcctcctgagatctgtacaattgcgcgataatttattgcggctacccggtcttgttatagacaagggacagaaaaaagagaggtgaaacaggagcacacgatctttctcc

SEQ ID NO: 26575 - DNA, 722 bp, Triticum aestivum
  Clone ID: PAT_TA_26575
gcacccacgcgagcaagaggactagggtttctctccctgtcgattcacacccgcattcgcgtcgctctcctcactcctctcctctctcctgcggacggatctcgccgccccgtcgcctcgcaagcacgtcgccggcgcgcatcctcaccgcgcagagagatgggcttgtggatgctgctggagggttttttgcttcttgcaaattctttggcgatcctgaatgaagaccgctttcttggtcccaggggatggagcatgtctgaagtttcaggaaatgggcaaacaaagtcgttgaaggggcagatcgtggggctcatctacgccactcagtttttgcggatgcccttgatagcgcttaatgttcttatcattgttgtgaaaatggtgtcaggctgaggctctttgtcgtgtctctgctgttgagttgaactgatttcagttccagcattatgtgaaagctaatcgtgttcaaaagttgctgcaaggatgttcacgctgacttgaatgcctgttggctttgttgctgtaaatccctccttgctctgaatggtaatctttcctcctgtatgacttgtgaatcatgcatgcatcttgttgctctaatttaaacatcgtatgcacttacgctaccttgatcaccatgtaaatgttcagtctaatttaaacatcggtactgcttacggttaatgacattatctggtggcagaaccaacgttttctgg

SEQ ID NO: 26576 - DNA, 2257 bp, Triticum aestivum
  Clone ID: PAT_TA_26576
ccaagcaaaaaaaacaactaaccgaaactcggttcggcagtggttttaaaatccaacacaacacctcttctggtgcggttccaatcaagcccagcagcaactgaacaattccaaaacaaccacaaaaatcgaaactacgtacttcgttggtttatcataccgtttatcatgccaccaaaaacacctaagttgattggccaactgcaagtaatcattcatctgcaatcatgcaacccaacagcgaaatttgaaccgacggtcaaattccccagcaaggaataaagatgtagttgaatagatctgacagggtcgttgggttccaaatagtactttgtgcctcattagaatttcacacaaaatagcccaaccatcataaatgaagtcagcagctgcaagggggcgccaaaggggcgtccaacgaatgggaaactctgtgcaccaccaaaccaattggcaacccttaactgttagcagatcgcaaagcaagatttgcaccttaatgcttcttcagtaagaagcccaactagcgaatccaccatactcatatcagaccctttgttgacccctgaagaaggaagatcacgcaaaacttctaaaagaacagtacccctccagctggcatgtgactcggtacgtgaagagaatattgctagatttgcaccttgcttatgaagaagcacaattagcaaagccacaataaccataccaggtaacttgttaagcacctggggaaggaagatcacacaacgtctccagctggcatgtggttttgctatgggcaagagaataaagcaatgctagcataataataacataagagtagcaaccacctcttactaaagatggctgaagcttaaaagatcgttcagcggggaaacaacgcccaaagaccacccaaaataagggtttagcttgatcaccatggcacatctgaatttcagcctcatgatagattggcggcaaaggaatgtgagcacctcatacatcttcaataactttcattttttttttcatttgggtggtccttagtccttgcgctcctcaaggaaggcagaaactaaaggcaatcaagtaatgttcataacagtagtgttcaccggtatccactcaactctagttctatgtagacacataacccatacaattcagtaagccaagaacctgacaagtaaaaggttttgttgtcccttgaacatatagtagcacaaaaagcgggaacaaaggggcacccttcaaatttcatgttgaatatcaacgctgcaaagatgtcgatttattcggtggtctgcatcggcgtcgtaccctgtgcatggtacttctccaactcagcatcaagttcttcagcagaccttggctggctacgctctttcccacgacgaccgccagatccactgcctccgccaccaccacgacgacccctcccaccccttgcacggggtctgttctgtggcaaactagctgagacaccccttggtgcactcttagcaacattcctagcataggttccattattggttggtagtgcagctggagcagtaggagtgttagtcccaagtatctctattttcataggcttgccatcaagttggacattgttgtatttcctcagcgctgcaacagcatcaccacgccttgcaaatataacctcagctgttcccttagacctcccacttcggtcatagtgaatcaagcatcgcttcacatcacccagctcggagaaaagctccttgaggtcctcggttgagacgccgaagtccaaattggtgatgaggagcttggtgccggtctcgatagccgagaccctcccgccgccgccgcctctggcagaggcgtccgagtacatgtcgtgctgccacgccgattccggggccttcggcggctggtagggcgccgccctgttccccgacctcttgaaggcgcgcctgttggggccgacgcctccggcggcggccgcggccgcgccgctgccggcagcggcagatccgcggcggccctcgcggcggcggccacccccgccggacgaggagttgcccttcttgttgctcttgatgatgtcctcgagggacatgtcgagggactccgccatggctgcgcgggcgagcgggcggatctggcgctagggttgggagggggagctcggcgacggggaatcgagaattggttggggaagctgattagggttgccaagtcgcggcgtgccggggaatttgggagatatttttgcgggaggcgggcgcgataaaatagtaggggggac

SEQ ID NO: 26577 - DNA, 846 bp, Triticum aestivum
  Clone ID: PAT_TA_26577
gccggccgcgcccgcgcggccttcctttccctttccgcccgccccttccccgtccggcggcgtccctcctcccccaccgcgtcgaaatcccaaaccccaccctacctcgccgcccgcccgccggccacgatgatgcacatgaccttctactggggcacgtccgcgacgatcctgttcgacggctggcgcacgtccgcgtggacgggctacctcctctccctcctggcgctcttcctcgccgccgccttctaccagtacctcgaggccttccggatccgggtcaagctcctcgccggcgccaaggcggaccccctccccccgcccgccggctccgacgcgcgggccccgctgctggcaccgggctccgccgccttcttgggcgggcgctggccggcgcgggtggccacggcggcgctcttcggggtcaacgcggggatagggtacctcctcatgctcgccgtcatgtccttcaacggcggggtgttcatcgccgtagtgctcgggctcgcggccgggtacctcgcgttccgcagcggcgacgtggacggggacgacctcgtcgtggtcgacaacccctgcgcctgcgcgtagggaatcggacgaggggcgggtcgccggccgccggcttgcccccaggtgtgatgattacttgatgttgtacaacgcaggcggtaataagatggtgtacaaattgatttgggggattgcaaatgtttggtgtcatccgggaggaaattgtagaatacagaatcagaacagtgtttgatgcgtgtttctcacagcgaattgtttttttgatgcgtttctgagttgatgatgaagtgtgtgcgaagacggttctttgat

SEQ ID NO: 26578 - DNA, 2503 bp, Triticum aestivum
  unsure (1)..(2503): unsure at all n locations
  Clone ID: PAT_TA_26578
tcgagcggccgccgggccccgtacagctagtccttactatacaagaccagaccccccagaggcaggtattagacgcgccgggatctctgacccgagcctttcctctttactaactcgccagtaacgcatgcccgaaaatctcttgtttgcaacctagtaggaaaccgcggcgctgcaagcaatttcttttcgcctgtctgtttttgtcatcccaggtgcacgccactctgagactgctggtactcctcattaatcggctcccccgcacttacagagcagatacggtcgccggcctcatgtttcttgttttggtgtggtcccctttctctgctctgctcttctctgcgcgctcatcgcctctgggcggctccgctgtcttttttcctgtttcgggagcctcgtgggttggcgggagatgggcttctgctgcgcgaacgccgccggcggcggacggtggcggcggcggcggcggcaacgttgcagaaggtgccgaagcatatggaaagggctatgtagcccaagcccttctcgatgcgagtacaaccggtcggcgccgccgggggcctccgggctggtggttccgcgggagcccacggggacgggccgggacatcgccgagcggtacgagctcggcggggagctcggccgcggggagttcggggtcacctacctctgcaccgaccgcgccacccgggaggccctcgcctgcaagtccatctccaagaagaagctccgcaccgcggtggacgtcgaggacgtgcgccgcgaggtggagatcatgcgccacctccccaagcaccccaacatcgtcaccctcagggacacgtacgaggacgacaatgccgtgcacctcgtcatggagctctgcgagggcggggagctcttcgaccggatcgtcgcccggggacactacacggagcgcgccgcagctgtggtcaccaagaccatcgtcgaggtcgtgcagatgtgccataagcatggagtgatgcaccgggacctcaaaccagagaatttcttgtttgcaaacaagaaagaaaccgccgtgctgaaagcaattgattttggcctgtctgtttttttcactccaggcgaacggttctctgagattgttggaagtccttattacatggctccagaggtgttgaagagaaactatggccaagaggtggatgttttggagtgcaggagtgattctttacatccttctttgtggcgtccctccattctgggcagaaactgaacaaggtgttgctcaagcaattatccggtctgtcattgactttaaaagagatccatggcctagggtctcagataatgcaaaagaccttgtaaggggaatgcttaacccagatccaaggaggcgtttgacagctcagcaagtgcttgatcatccctggttgcagaatattaagaaggctccaaatgtcaatttgggtgagacagttaaggccagacttcaacagttctctgtgatgaacaagttcaagaagcatgcacttagggtcatagctgagcatctttcggtagaagaggtggccggcataaaggatatgtttgaaaagatggaccttaacaaagatagtatgattaattttgatgaactgaagcttggactgaataaacttggccaccaaatgcctgatgcagatgtccaaatactaatggatgctgctgacgctgatggaaatgggtgcttagactatggagaatttgttactctgtctgttcacctgaaaaagatcggcaatgacgaacatctgcataaggcatttggatactttgatcggaacaagagtggatatattgaaattgatgaactccgggagtcattagctgatgatctgggaccaaatcatgaagaggttatcaatgccatcatccgtgatgtagacactgataaggatggcaagataagctttgatgagtttgtggcaatgatgaaggccggaaccgactggaggaaagcctcgagacaatattcgagagaacggttcactagcctcagcttgaagctgcagaaggacggatcgttgcagataacaagtacccaatagtagatgataacgcaataggcaagttgtgaattccagatgaaaaccaaccctgtgtagcttcctggttttgttgacaagtatttcttttgttcatctgggtattctgttgcgctctaatttccgcttggtatcctgatgaagcattagttgattgttgaagatttattttgtacgtagattgtgtgatccagaccatcacaaaaagtactacgcctttgatgaaaggtagtgtacaagagaaagaggaaaaagtttgtggatgtatgcatttcctcacttctcttgaccatgggggggccgtcatctgtttggtgatagtatattctaagcaaaaaagaaaagtaaaatnnnnnnnaaaaaaaaaaaaaaaaaaaaanaaagggggggggtatacaacattttttaaatctaaaggaactaatacttgcactatactatcacatgtgcct

SEQ ID NO: 26579 - DNA, 1033 bp, Triticum aestivum
  Clone ID: PAT_TA_26579
tctttgttggtgaggagtagtaatttgatcatttattgtttcacccacgatgaattagtaacacgtcagtgcaatgacattggccggtcgaactggctttgtgtgaagtgtagattgctgatgaatgcgtcgacgaaagggaaacagcagtggtatactcaaggaatcgccgtcacgcagacacgccatcacgtcgacgaaagggaaacagccgtcgatggcgtgagtagtaacgtcgtcacgcagacacgccatcgccgccaaatgcgtcctcaaggaattcaccttgatcgagatggccgacgtcgccggtcttctcgaggatccattcgccgccgccgatacggaagacgcagatcgaagtgttgtagagcttcccgcgcacagggctggtcgggtcggcgtgtatgcacagctcctccgtgctggcgccatgggtgaccacgatcacccgctcccacttgtgcttctcagctactgtgttcaggtacgagacacacctcttggataactgatcgaggctctccccaccaccggggatttcttgggttctcgagtaagaagagaagatctcaggattccttctgacggcgtcgtcaaacaccaagccgtggagatctcccatgtgcctctccctcagcgctggatccagcaccagagaggatacgccgcaggctgtggctatggtttgcgcggtctcggcggcgcgcttgaggtcggaggagtacacggcagctggcttggcttccctcgacagccgacgggcaaccacgagagcctgtcgtctgccggtctcgttcagctccggatccatctgcccctggatggtgcgggtggcgttccacgacgtctcgccgtgtcgcaccaccaccacttccgcgaactgcttgcccggcggtggcgaagcaggaggaaacgttgctgctcctgctcgcccggccatggttggtggcgtacgctctcctccccgcgccgcggcgacgcgggcggggacggcgctgctcgaccggccatggttggtgcctcgtgccga

SEQ ID NO: 26580 - DNA, 579 bp, Triticum aestivum
  Clone ID: PAT_TA_26580
ttcacgcgtccgcccacgcgtccgatgggtcgtcaagggattccatccgatccttggggcagctctggaatttcagcctctctgatcttacagctgatttgacaagtttaggagatttggaggctcttgagaactacgaaggtacccctttcctgccctcggactcggacctcttacttgattccccagaccataatgatgacatagttgagtacttcgccgacgccatcaacgggactcaatcagatgaagagaagtcatagagaagatgaaagactcaggtagtctcattcagagtgggacctggccagagtgtcatctcatgtagtgtaatcttgtagctgcgcgcaaatcagactgggaattcacccagaggtgcggtgattggcgcgcgcccctgaagaattttgtagcgttcgatgctaattatttggaataattggttcgggcagccttaaccgggtaaagttgctgtctacaaggctgaaaagtttagaaaattgtgtcaaacctcaggaacaacccctttgtaattgctgaagaagtgggcagttcatctggtattgcaccaaaaaagaa

SEQ ID NO: 26581 - DNA, 398 bp, Triticum aestivum
  Clone ID: PAT_TA_26581
cccacgcgtccggcagagaagccgaaggaggaggcagcagagaagcccaagggggcttccgtcgcccccgcccccgccgccgtcgacgagatcggtcagaaaatgaaggagatgaacacggaagcggtggcagccaagaactgatcggtggcggcgatggcgacggcggcacgtcatgatcggttacctagtcataaatttgtttcagaataacgcattgcattagcatgtcatcaaccacccacacatatgtatcacctgatccatcgatgagagttcagttcgacaacgatgtaatttcctcctgccttttttctggttttaatgtgatgaaatttaatggatgtcattgccatgaagctggcgctacccgatcaatcgatggtactactactgct

SEQ ID NO: 26582 - DNA, 1242 bp, Triticum aestivum
  Clone ID: PAT_TA_26582
gccgcatgcgcgcccactcaccccctagctccccgctgcagcgagccagccgcacgtgcacgcactagctcccagctgcagcaagcaagcgaagctcgtgcgtgagcgagcgaccgagcgagctgaaaaaccaccctacaaagctccggctgagccacccgtccggccggcgacgatgccgatgctcatccccgacgacgtgcgcgccaaggcggagatctacaccggcgacgcggcggggcaggagaagacgcggctgatgctggcggagacggagctccccagcggcctcctgccgctcaaggacatcatcgagtgcgggtacgtggaggagaccggcttcgtgtggctcaagcagaagaagcgggtggaccactacttcgccaaggccggccgccatgtctcctacgccaccgaggtctccgccatcgccgagaagggccgcctgaagaagatctccggcgtcaaggccaaggagatgctcatctgggtcaacctccacgagatctgcgtcgacgacccgcccaccggcaagctccactgcaaggccatcggcggcctctcccgcagcttccccgtgggaggcattcgaggccactgacgccctggccgtgcccgtcaccggacgtctcaagaagaagacagagaaagagagcaccgacaagaaagacgagaaggaggaggattcagcagagaagccgaaggaggaggcagcagagaagcccaagggggccgccgtcgcccccgcccccgccgccgtcgatgaggatcggtcacgaaaatgaaggagatgaacacggagacacccgtgcaggcggttaagcggtggcagccaagaactgatcgggtggaccggcgaccggcgacagcggcacgtcatgatcggttaccatgtcattaatttgtttccgaataacgcaatgtattagcaagtcagcaaccatccacacatatgtatcacctgatcgatcgatgagagttcagttcgagaacgatgtaagatagtaaaaaatgcgttgatgcagtatagtggtggcggcgatggcgacggcggcacgtcatgatcggttacctagtcataaatttgtttcagaataacgcattgcattagcatgtcatcaaccacccacacatatgtatcacctgatccatcgatgagagttcagttcgacaacgatgtaatttcctcctgccttttttctggttttaatgtgatgaaatttaatggatgtcattgccatg

SEQ ID NO: 26583 - DNA, 1028 bp, Triticum aestivum
  unsure (1)..(1028): unsure at all n locations
  Clone ID: PAT_TA_26583
aagagaaaaattctttattttagctgaaggaaaatagcacaatacaacagatggaaacatatgcattttcctacaatgcccgagaacaacaactataggatggttgttgtcgttattctttgagtaatacatatataccgccatatcccttgatattacttaaggtgtacaatatatataactcctgtagttattttggcctgcttggagtagtgcttcatgttgatattctcttgatccaagataacaataaagaaccttcacatgagtaccggcttcacataaagcgacgttaacatgtctttgattgtatgggagacagtgtacttatcagcttccttgtacatgtagtctacagttcgtgcaaactctagtaccgttcgtggcacaattatcgagtattcttttagtgcaaggccttgttcaatcatgaacttccatgaatcttctgtaagttcttttatctgctcacatgcttcatccattgttagttcatgctgcttcatgtaacactgaacagtggagacacaatgcttctctctttgttcacgcttggttgatacaatatcattggagagccgtacaaatataccaaaagacttaacaagttcagcatcactcataacccattccatgatcttctttgttactacatcacccattccaacaaacgcggaacatagcaccagggtgcctccaatgcttatgagtgaaactttaaggtgttctttcaatgttttggggacatagtcctcatcacgccattttatttccttggtatattcccgaactaattccttcaccgcttcttttaagtagaacactcggtagctcttgtctggtcctaactcattttcaaacgatgaaaatgtcttcaacaaatacatgtagaaatccttcatgtattctgggagtagagagactgcagtttcatcccaccttcgactgcttctgcaagttgcatactctcataagaattagcatgtgagtcaagggtatcatctagaatcgtgatgaaagcaacaanc

SEQ ID NO: 26584 - DNA, 404 bp, Triticum aestivum
  Clone ID: PAT_TA_26584
cgggtccacgcggggaccccatggaaggatggttgaacaggaccacgtggagggctggttgaacaagaccccgtggagggctagttgagcagtagcttaagatttctaggatcacaaccaaatgtaaataaaaatatgatatgcatatgatgtcctatgtataacatccaaattgaaaattgggatgttacaaacactcacattctgataatgaagaagataatgatgaggttcatgaaaatactcaaacaaatagtaatgaaccagacaatgatgttgagatagaaccgccagttgatcttgataacccacaacctaaaaataaaagatatgataatagagacttcatcgctagaaaacacggggaaaacaagcgaccagccgagaagaaaaaagcggccgct

SEQ ID NO: 26585 - DNA, 1083 bp, Triticum aestivum
  Clone ID: PAT_TA_26585
aacttggacccccttatcaggtttccatttcatagatattcaaatcacatacacaatcattatttcaaatagaccaaagagcagatgaaattcgtccaaaacaacactacattagtctactacaatcattacagtatacaacccagatatgcctactaccgcctaaaattacaacacataatatgctactctttgctgatatgcttcgcagcttcagacttggattcatacttcacctagaggtcgtcagggacatactggtgcttcatggagaggtccatggcacgcttgaggcactcgatgtgggcgtccaccgccccctgggaagcctcacgggcgcttccctgatgtccagatcgaagtgctggactgcatgacgccctcctagctcgctgcagcgcactcgccaccggcgtcgcgccagcgtcgctggtggtgcttgatgggactaggagccggaggattcccgtgttgtggcgcctctctcttcttgcactccttgtagtcgtcgaactgctgctgtcacttgctcttgtcctggttggtctccaggcacttgagggagacggtgtactgggggaagcaggaggagtcggtgatccgggccgcgctggggtacggtggggtcgacgtcgcctggatggacgcgtcagccgtccgcgttcgtccacgtgcccttgggcgggtccgatctcgccgggacctcttcaaccgccaactcctcctctgccgctggccagatccagatgatgtggccgcaaggaggtggctgggctcacggccaaccgcaactccatgatgtctgggcaggggaggaagaggccatcctgcccatggcatcctggatctgggagggagagaacacgaggcgaggaagtgagggaggcacgcaccaggaggagatggagtggagggacgcacctgagtcgccggaccacgccggccgaaaccctagcgacgggagacgagcgcgggtggcgctggaggacgcgcgcgccggatctcgccggacaggagggaggagcggagggaggggatccttgttgtatgcttggcactgtcgattcccgccgaaggtcgccg

SEQ ID NO: 26586 - DNA, 635 bp, Triticum aestivum
  Clone ID: PAT_TA_26586
tttttttttttttttcgcaatcacaagacttcttccaactatttgtttataaacctcttacagtctttcagaattcaataggacatcaaaacaacataaattactgaaatacagaaacatcccacatcggcttgacgcggtttcaagcgtttccggggggtacaattttattaaagaaactctctagtgacatcttgtccttacatctctctgaacccagagtgctctactgttttctaacttcaacagcttaaattaacatcaggaaatcaaccgagtcatggtttcactagcattaactcttccagttgcacagtgctcctccaatttctcacccgaacaatgtccggctccggttccgttccagccgagcctccctctcttcttgcactccttgtagtcgtcgaactgctgctggcacttgctcttgtcttggttggtctccagacacttgagggaggcggtgtactgggggaagcaggaggagtcggcgatccgggccgcgctggggtacggcggggtcgacgtcgcctggatggacgcgcggtgggtgggggacgccgccgcctccgcatgagccgccgccatgatgccgcgtcttcttcttcctcctctcgtcctccactccgctctct

SEQ ID NO: 26587 - DNA, 301 bp, Triticum aestivum
  Clone ID: PAT_TA_26587
gagaggaaggcccgagagaagcaactcaaggagcaggaggaatctctgcaagactgggagaaaaagcttaaagaaagtcagaacagactcgttgatttgcagagatctgtaaatgacagagaggagagagcaaatgagaatgacaaactttgtaagataaaacaggaagaattggaggaggcaaagaagacagtggagtcaactaaaatcattttgaaaacaaaggaggatgatattgccaaaaggctaaatgaattacgctcacaagagaaggatgctgacgcaaagcacaagattttgg

SEQ ID NO: 26588 - DNA, 1113 bp, Triticum aestivum
  Clone ID: PAT_TA_26588
tccattccatttctgctaacctgctgctgcggtcgccggcggcgaggaggagggggctgagagatggcgggcgccggcggcgtgagggagcgggaggaggaagaggaggacgacttcgtctgcctggatccctccttcttcatgaatcgcaactacgagatgaagaccttcacctacggctcccaggagctccagctcctctgcctcagctccgcctgcactgattatgatcttactggacagttagtgtggccaggtgctgttctgatgaacacgtacctatctgaacaccctgagactgtgaaggggcgttcactaattgagttgggatctgggatcggcattaccggcatattgtgcagccgtttctgcaaagaggtggtattgactgatcacaatgatgaagttctagagattataaagaaaaatatagagatgcagtcatgttctggcaatgcggatgcagtgttgactgctgagaagctagaatggggaaatcatgatcatctaagcaatatcattgaaaaacatcctgttggatttgatctcattcttggagccgatatctgcttccagcaagctagcattccatgtctctttgatactgtagtgaagcttcttcgtatgcaggccaataaatgtagatttatactggcttatgtatcacgacccaaagtcatggacgcactagtactgaaggaagctgaaaaacgtggaatggttgtcaaggaagtggacgggacaagaacaaccatcacagatctcgaaggcgtcatattcgacatcaccctcaaatgacgcctccgatggaatgcttgggtgccaattccatcagacaggaacaagatgtggagcctcctcccatcaggaaagccaatgttaccgcctgcatgatctgctgagctggccctgaacatgatgtggtctctagtttgcatctctcccccccatgggagaaaacagtagtccaaccctagcaccagtcctgatatggcgctgattgattcagcccaacttttaaatgattccccggtcgtggcccttttcgttaaatcaaaaagcgattcgggttccgacgtcccagcgtttttcctaagctttctttcctagacc

SEQ ID NO: 26589 - DNA, 567 bp, Triticum aestivum
  unsure (1)..(567): unsure at all n locations
  Clone ID: PAT_TA_26589
gnggcggtcgccggcggtggtggttccggtgaccggcaggcgggcagggagacgagctcctgttgaggtggcggagctcagtgcgggctggttcctccggatcgagccttggctctcccgaggcatgcggttgcgggcttggatcggggtgatccttctcccccgccctccccctccatggcaacgacacaagttgcgcaggcagttggagagtgccgatttcgatacgagtgtgtcaatcttcactccggagcagatccaagggattgttgagaaatactccagttgacatatttgaagagatgagagatttacatcccatccagtcttctccctctactatagccgatggttgtattctgcccatacaagaagcatataattgccatccagctttacttcatgtaatctgcactttgctaagtgaaaagactacagctgttctacttatattatctgcggcacctgttggaaccgtccacctggctcccggggcgaacatcgccgccaccccgctgtcgattcccacccaagctgctagcctccttgtggtgggtggtcttcacc

SEQ ID NO: 26590 - DNA, 1270 bp, Triticum aestivum
  Clone ID: PAT_TA_26590
tccgcgcgaggcggcgcgtgggagccgcggaggactagtggggaactgccatggcgacggcggccggcggcgggagcatgatgacgagggagcagctgctccacctcttctcccgcttctccttcctcacctcgctcccagagttcaaggaccgaatcgccgacgccgtcagtgacaagcaggaggcctgtggcggtgaccaccgaggatgcaagaggagatccttcgcgagatgggcatcgatccaggttttggtattagttgtctgggaaaggtgaacgtcgtgtatgagaatgacatggatttgatgattaaattctaccaatttgttgccaaagaagagatggctattgatgaggccgagcttgagcctctagagtttgccgagaaaatgcacagtcaacaggaattgcaacaacagcaactggagatgttggttcaaattagaaaatacagccccgagagccaatctgtcatacttgagactttgcacaagcagttggagagtgctgatttcgataccagtgcgtcaatcttgactccggagcagatccaggggattgttgagaaatagttcacatgtatgactagatgagagatttacatcccatccagtcttctccctctactatagctgatggttgtattccgcccatacaccaagcatataattgccatctagctttacttcatgtaatctgcactttgctactctccttgtaaagaagtataaggccgtttagatcactcaaacgcctaacgctcttatattctttagagggagtagtaagagactacaacaggtgtccgacggttcttagcggtacctggtttttccctcctcagtgaaagactacatgtgtactaattacattggcagtggcacctgttggaaccgtccacctggctcccggggcgaacatcgccgccaccccgctgtcgattcccacccaagctgctagcctccttgtggtggtggtcttcaccctctttcataaccatgaagtggatcatcgttgtgacgttgtccagcactggtgagaagggtggcccgcgtcgagacgtccaaggttgggtggtctgcaggtcaggctcgttaggatggtgactggcaagatggagaggaatacagatgtgtccttcaccctcgacaatgacactggctgcatcaatttttcatcagatggtgagagcgtctcgttgaattgcacactttctaatgaagtttcagatgtatcttagcggtacaatgttatacttttgtgctctc

SEQ ID NO: 26591 - DNA, 944 bp, Triticum aestivum
  unsure (1)..(944): unsure at all n locations
  Clone ID: PAT_TA_26591
cttctctgtggcaaccagactcgctggaacttttggatatttggcacccgaatatgctgttaccgggaaaatcacaacaaaagcggatgttttcagcttcggggtggtgctgatggagctgataaccggaatgactgccatcgacnagagacgtatcgacgaggaaacccggtatcttgcgtcctggttcggtcagataaggaaggacgaagagaagttcagggcagccatcgacccgaccctggagctcaccgacgagattttcgagagcatctcggtggtcgcggagctggccggccactgcacctcccgggagccctcgcagcggccggacatgggccacgccgtgacggtgctcgtgcccatggtggagaagtggaagccgtccaacaacgaggcggaggactacatgggcatcgccctgcacctgccgctgctccagatggtgaaggggtggcaggagtcggaggcgagcatgacggacgggagcatcatgagcctgagcctggaagacagcaagggcagcatccccgcccggcccgcgggcttcgccgagtccttcacctccgccgacggccggtgaaccatgatcgtcatcatcgtcatcgccaccatcatgtctacaagaaataagtacattgcctctcccggacctccctcccctgtttccgcacagccctcgttctttgtaggtaaagttaaaggagttcgtcgtcgtccatgtgcttgtgtttctgccgccgccgctgtagatagacatcttgtttctgttcttgttctcttttttgttcaactgggcactagtaccgtaggatggatgggttggtcggtcaccttttccattattccagtcttgagactgaagcttctggctttacctagcaatcaaatcatatcatgcctctctgattgatccctgtaaaaaaaaaaaaaaaaaaaaaaaa

SEQ ID NO: 26592 - DNA, 356 bp, Triticum aestivum
  unsure (1)..(356): unsure at all n locations
  Clone ID: PAT_TA_26592
cgacccataaacaccaattccagtctactgcttgtgaagagccttccgatgattccttccctcggcactatcctcgccggagttcgccggagccgccatgccattgccaagaccacacctgtttccgctctcactgccctcctcttcctcgcagccgccacattctggctcctcttcctcgggcctctccgatcgccgcacaaccaccttcgtcattcggcgccaatacccacggcatgggcgccacctcatgcgacaccacgctgggcgagtgggtccgcgaccccgccggcgcacggccgcactacaccaacgcgacgtgcgccttcatccaggactaccangaactgcatgan

SEQ ID NO: 26593 - DNA, 524 bp, Triticum aestivum
  Clone ID: PAT_TA_26593
gtttgtcctctccgtcgcctgacgagatggccgtgccggcgccggccaaggcggcgcgcgcgctcgcagccacggcggcggcgctcgtgctgctgtggtgcgtccacttccgcggcggcctcgccctcagctcccccaccaacaaggggctcatctttaacgttcatcctgtccttatgctgatcggattcatcatcattgggagtgaagccataatgagctacaaaacattgccatggagccatgacacaaataagacggtccatttgattcttcatgccgttgcgctttttctgggatcgttcggggtatatgctgccttcaagtttcacaatgaaagtggaatcgctaatctatacagcttacactcctgggttggacttggcactatcattttgtatggtttacagtgggtatctggctttctcaccttcttctttcccggcgcttcgccgacactccgacgtgccgtgctcccatggcatgttcgtgctgggctcgtggtctacgtgctggcgctgctc

SEQ ID NO: 26594 - DNA, 694 bp, Triticum aestivum
  Clone ID: PAT_TA_26594
gctctgcgactaaggttgtatctgacgtgctcactcagcacaccaagaagcctaagtttcttcagcatgtggggatccagcatgtgcatgagagaaccagtggtaccaaccttgaagcataactggcagcacaccaagaagcctaagtttcttcagcatgtggggatccagcatgtgcgtgagagaaccagtggtaccaaccttgaagcacaactggcagcggagaagaaaggtaatgcagagctttgtgagattgttaacaccttgactaagaaggtagaggaatcataagaagcaagggtcagacaagaagaggagtacaagacgaagcaagacgagatggatgctaaacttgaccttttactaagccagaggtgatcgagctcatctgcagggtaaggcgtcggcattgaaacacaatgttgttgtaagccgagatggacgctgaacttgaccttttgctggtgccatgcttttgttggaagctatcttgcaatgcttttgctgatgcaaactgtatgcattctgttcatggttatcaatgcatgcattttgtcgcaggtagtttgtggcactggagtgattgtagtttcatatttatgttggatcagaacatatgtcatcgcatgttgaaactttaatttatatgtactgtgttctttgtcagataagaacaatatattgttgttcatat

SEQ ID NO: 26595 - DNA, 852 bp, Triticum aestivum
  Clone ID: PAT_TA_26595
gcacgaggcttagcgtggtagtagaagcgaaacagcagagcagcattgcagcaagcaacaggggacgctgccattctggtggacagcactacaatggcaacgacgacgcctaaggcgacgagaagggcgtcgatacgagggcgggcgtggcggctgctgcggctggcggcgctccgggcgcggaagggaatcgtcgtgcgcggtctcggcctgctcaagaccctggggtgcagcgggcgcagcgaccggctgcgctacggtgagcgcgagttctccatcgacgagactccggcgttccggttccgcgccccctccgcgcgcgtgctccgcttcatcccctgcatcgcccccgccgtcccggacacccccgacgactacagtggcgaccgctacttcttctgcgacccgctcgagagggtcgcgggcagcgtcggggacggccacggtgccgggctgagcgagtacggcgtcgagaacctcgacgattgcgcggaggagcagctgctccagcgggcggtgatgggagcgagctgcgcggacttcggcgccgtggaacaagaggacggcgaggacgccggggtggacgtcaaggcggaggagttcatcgccaacttctactcgcagatgaggatgcagcggcagatctcctcgctgcagtacaatgagatgatgcataggagcatctgctagacaaggcgtgtttcttttttttttgacacttcaaacatcctttattcatctacaagcataggaattatagtcatcgggaccaaatgtagccaagtattagaaggagagaaccaattatcctcgtgcagtaaattgccaaaaactatcatttgtgggacctct

SEQ ID NO: 26596 - DNA, 1216 bp, Triticum aestivum
  unsure (1)..(1216): unsure at all n locations
  Clone ID: PAT_TA_26596
gcacgagcctatcttaggtgtcctttccaaggccacacctgaaccagctatcaataacgttgaaggtgcctcaactgaagatggtgaaagcagcaaatggtcacctgtgttcgagatagttgatgagatcaacagtgccagtgaagaaaaggaagtagctgctgttgaagtgccaaaggaagccatcaacgaagatgatttcagttccaccgctgaggcatctgatgttcctaacaagatgatcccagctgctgtgacagagaaggaagtcgctggtgatgatttgaaggaagatgctttcaattccaccgttgaggcttctgatgctcttaacgagaagatgaccccagctgctgtgacagagaaggaagtttctgctgatgatttccaggaagatgctttcaattccaccgttaaggcttctgatgctctcaatgagatgaccccagctgctgtgacagagaaggaagttgctgctgctgatttcaaggaagatgctctccattccaccattgagactgctgatgctcctaacaagatgacaccagctgcggtgaccgagaaggatgttgctgctgatgatattaaggaaaatgctttcagttccaccgttgagactgctgatgctcctaccaagatgatcccagctgctgttacagagaaggaagtcgctgctgatgattcgccgcagagtgatctgacagaagaggagagtgctgaggaaaatgacctcgatggatgggcagtgaggaggatgacctcagtaagtccagcagcgatcaccagcaggcgaggcagggatgaaccttcagtggagctacccagcagcgaagggatggtatctccccttccgcagggaagggatgggatactctgctagtaaagggtggagtccgcaccttttccgcttggttcgttggaaccttttttatttcttgaatggaaggaggtaaggaccctttgaaggcagggagggattattgccagaaagagcctaaatggaccttcccacttggaaagccttaaacttttggatattcttaattaanaagaaagaaggagaggattcttcaaagaatgcctgggaagacaggtttnaaaaaagctctaaaagaaaaatgaagggagaagtgggagaaggaaaggatggattttncaggcggcttggnatcttgtncattcaggaagttttggccgaattgtttgaaattccagt

SEQ ID NO: 26597 - DNA, 1139 bp, Triticum aestivum
  Clone ID: PAT_TA_26597
gcctgcagcgccgcttcctgcatccatatcattgacttcgatcttggtgtaggcgggcagtgggcttccttcatgcaggagcttgctcatcgccgtggcactggcggcgtggctttgccgttgctgaagctgacggccttcgtttcagatgcttctcaccatccactggagcttcatcttactcaggataacctcacgcagtttgctgctgatcttggaattcccttcgagttcaatgccgtcagtcttgatgccttcagtccggctgagctcatttcttctactggcgacgaaattgtagctgtgagcctcccagttggttgctctgctcgtgcaccaccgctggctgtaatccttcggttggtgaaacagcttggtcctaagattgtggtcgccatggactatggagctgatcgtgctgacctcccgttctcacagcacttcctgcattgctttcaatcctgcatgttcctccttgactcgcttgatgctgctggaattgacgccgattctgcctgtaagatcgagaagtttctgatccaaccaagagtcgaagacgcggtgcttgggcggcgcaagaccgacaaagcagtttcatggcggaatgtgtttgctgctgctggcttcacacctgtgccgctcagcaatcttgccgaggcacaggccgactgcctcttgaagcgggtgcaggtccgagggttccacgtcgagaaacgcggggttgcgctcactctctattggcagcgtggcgagcttgtatcagtatcagcctggcggtgctgatcgtcggtcgccgccaccgttcgcaggcatcttcaactccagtaatgttcattttgtcttgcaattaaaatgttgcgaaggaaactactatcttggttgttggacaccccgtatcgcttttcatcgcaacttatttagctaggactagtggatttagcaacatttgtgtcggtaactctaatagtgtaatgatgttgctctaggttcttaccacgatgttcacactctgctcatttagcatttatcatgtcatttcaaggattgcttgtgagccgagaggataattttaaccagtggaactgttctatggtacagtattgatatctgctcatgttgctttagttaaaaaaaaaaaa

SEQ ID NO: 26598 - DNA, 523 bp, Triticum aestivum
  Clone ID: PAT_TA_26598
ccgcttgaacagtaagaaggccagcttcccggtgcctccgtcgagcgcggcccggcatccgcgatggcgatgacgaggggtgcaatggttgccgccgtcgccttggtcgccctcctcctcttccccgccaccttcgcatttcctccggctggccagcagcagctggacccccacttctacgaccactcgtgccctcaggcgcagcagatcgtggcgtccatcgtcggcaaggcgcacgcccaggacccccgcatggccgcctccctcctccgcctccatttccacgactgcttcgtcaagggatgcgacgcgtcgatcctgctggacagcagcgcgtcggtggtgagcgagaagcggtccaacccgaacaaggactcggcgagagggttcgaggtggtggacgagatcaaggccgcgctggaggccgcctgccctcgcaccgtctcctgcgccgacgtgctcgccctcgcggcgcgcgactccaccgtcatgaccggcggcccaggctggatcgtgcctcttg

SEQ ID NO: 26599 - DNA, 299 bp, Triticum aestivum
  Clone ID: PAT_TA_26599
tggggagaatgttgggtcaaaccttgtctcggaggcatgcatacagcggcagcagcagcaaatactttgctaggaagtattgggcatgtcggcagcatgcagcaccagcggcagcagtaaaagaggagagaagttacttcagttgccgtaacttagtagctaagcaaatgctagatgtaagcagtgacgtgtcataggatatgacgtatgtgcttagatcaattagaacagtaggtcggtttgtacgtgctatataaagagcaccactccacccggttggagaaggccattccaatttc

SEQ ID NO: 26600 - DNA, 631 bp, Triticum aestivum
  Clone ID: PAT_TA_26600
ggcacgagagagtgcagagctcgtcggtgctggtgaagctgggcggcgtggcgctcccgtcagcaccaagagaggtcgcgggaggccacccgaccctcgtcttcgaccgcctcaaggggatcaatgacaaggtctaccccgaggaggctcacatcatcatcccgtggttcgagaggccgatcatctacgacgtccgcgcacgacccaaccttgaggagcctacctggagctgcctcctggtgctaatcccaacctcaccgaactcgaagagaatcacttggaggattcaaggaattgcgaagctctttttggcttttgatatggcaggcctgagataagcacaacaagctcggggtgaagacaggctactgatgactagtaaggcgcaggaaggataccagtgagatgcatagagaacctattcagcaacataagtctaaggatctctgatgagtttcccttcactaccttttttcactccctactccatctttgctcggtgcataccgcatccaccttgttacttatctcataagatccagtaaattttgctgtttagtttgctcctaaacaattttttagtgccatcctttaagaaccgagcagatgtaagttgtgatgacatgaacag

SEQ ID NO: 26601 - DNA, 693 bp, Triticum aestivum
  unsure (1)..(693): unsure at all n locations
  Clone ID: PAT_TA_26601
ctgaaggtgccagcgtcggtgagggaatttatcaatgtggaatgctcatcacctcatagggaagatctgaaccaagtgaatgcaaggattttttggcaatgtctagctcaatctcaccttcgagaaaatgtaatatttttcctccggagttagtctacactatccaggttgtatgctactactgagatcccatcaaggtaacactcttcccccacatcttaatctgcaagaaaagtataaacaagattcaagtgagcggtcttcatggggttgcttgtacgtatgatttgttcatgtgcttcattttgtaattctagtcaagtaaaggctaaagaaacatgctaccctcaaactgaagttttgcaaccatgttaatatttaatgcaaattgccaagactcttctgggaggattatgtttatctctgtaactagctgttagcattttcctgttcaacaataaaggtcgacatcactacaggaaatggttctgattgttacttcgattcaaactcatgaattaagttaaagtctacatatgaggttgtgtttcagccatgcatactttgtgtgcctgtgttgtttgtgttgagtttggtttagtggtatatgagctgtgttgtgttgnggngcccctgtcgggccgntatttncngggttcaacgatattgattgacntctcttcctgttggagt

SEQ ID NO: 26602 - DNA, 743 bp, Triticum aestivum
  unsure (1)..(743): unsure at all n locations
  Clone ID: PAT_TA_26602
tttttgttaactgaatatgattagtgttaattgaataaaaatcagtagatatcaggggggtggagggagcaagctagaaataatttgctctgtgtcttctatcttctcaggaaagatgttgtagaaaacataaagaggtgatgtgcctaaatctccaaacaccacaccaaggcattggaaagctagttgtagcatcaaaactgttgggtaggtcttttctctgtacatattcctcagtctcccggcctctgtgtccatcggctgatcaaggctcttttccagctcccgcatcgcccccttgccggtgtcctcatttgtcgaaacggtctccatgaagttcagacttcagagcagtcaatcaacagcagaagtatgtcacaaacttggaacttgaaacccaatctggttcagttgagtaaacagcaagaaacacatatttttggtcttgaacttgttttgcatgttggtggatggccatgcttgtgctgaggaaatttgggagctatccttatcgcttcctcggcatctgcgagggcgccagtagtacccccaatcgctattctcgccttacacctgcctccgtangccagatgcagccaactttacaacacattctctgtcaggtacaagatgttagattgggcgcgggtgaaaagaatgattcngtccactggcgaagctctccggnngaaagaggggctcctcgtgcgaaatcngggcgaagtagaccacgagaagcgaga

SEQ ID NO: 26603 - DNA, 729 bp, Triticum aestivum
  unsure (1)..(729): unsure at all n locations
  Clone ID: PAT_TA_26603
ctcataccggccttgtaaaagatggacggcggtacttccataacatgactcagttatacaacatcacacctaggattgagcactatggttgtatggtcgacctgctcagtcgcgctgggttgctccaggaagcccgtcagcttattgatgatatgccaatgcaggcaaatgctgtcgtgtggggagcacttcttggtggctgcaagattcaccgagacgcagagcttgcagaacatgccttgaagcagctcgtcatgctagagccccggaattcagggaattatgtcatgctctcgaacatatactctaacagcaacagatgggaggatgctgcaaagcttagatcggacatgaaggtgaaaagggttgagaaggtccgtgcatatagctgggttgagtttagtggtaaggtccacgagttccgtgttggagacaagtcgcatccccacatggatcagatttaccaaaagctagatgaattaggcatggaaatgaaaactatgggttacaaaccaactacagatgtggtgatgttcgacgttgaagatgaggagaaggagcacactctagtttatcacagccgagaaacttgccattgcattttgccttctcactacccaaccaggggaggtccttagggcccccaagaccccggggggttcccgactggtnncactggntattcacttaatatcnaggataatccatcgggagatcatgtgtcgggat

SEQ ID NO: 26604 - DNA, 378 bp, Triticum aestivum
  unsure (1)..(378): unsure at all n locations
  Clone ID: PAT_TA_26604
gggtccagcgcggtgttgccatgaacagaataggaaaatgaatattttcgaattattttgaactaggcaaggaatgtttttgacacatttgatgaagatatgatccanaacatttatgagatttttttgggaatttttggaataacagaaatataggttgcttcacaacttagggcaaaaactgccacatggacatgacacataggcaaaactgatgagatggcgcctagtcatcacaacccaccacaatctacaagctatgaccatctatattggtcgttaacaactagaaataaggcagcggaccagcactgtttgctttgtgaccatttcgtgtaaggaaattacggcctttctgaccaaaatggtcccaatggt

SEQ ID NO: 26605 - DNA, 624 bp, Triticum aestivum
  unsure (1)..(624): unsure at all n locations
  Clone ID: PAT_TA_26605
caagcacanttacctcggcggccacagcgcccgccgcagcgcttcagccgcggcctcctccgccgcgaccacccccaccgcccctgccgccggcgggccattccgtctcgccccggccagccccgcaccaggagcgccattcaacccctccgccagccacagctccccggcccccaccaccacgggcttcaacatgaacggtaccgcctcctccgcctccaccgccaccaccaccgccacgcccagccccatcttcgccgccggccacaagctgaacggagcctcatcgccgcagtcggcgtgaactagggagagcagaggcagagaagaagagggaggagaaaggcaaagccatttagctttcatttcagttatcattgcattacttttctttctgtagcttggatcgttggttctactaagaaattaaccccaagaaagggcgccgtctgatgtctagaaatctaagctttatctgttcttgggatccgatggaagctcgcgatttaggattaattagattatctgatctcaaaagtggcacctttcttggtctgttcttgtccctgtaactgtaagttgagcatccgcccgtccgtccgtaatagaagaagtttatttcct

SEQ ID NO: 26606 - DNA, 1207 bp, Triticum aestivum
  unsure (1)..(1207): unsure at all n locations
  Clone ID: PAT_TA_26606
gcggcagctcctgcccaggtcccctgccgcgccgagggagcacggcgccgctgagatgcagggcgatgcactgccgcctaccgcgcccttggccttctcacatcccctgcccctccctcctcttcggcgacggcgagctgtacgagtcgggggcctccccgctcgtcttcctgatccagggcggcggcatgaacctctcccgcgtcggcgagaatctcctcagctccgtctgctgcgcgcgctccctcgccctcctccctccgaccccagccccttcctgtgtcgaggttccagctcgagctattgttgcagcgacggctggatttgatgtcactgaagttctaaagattacatgatggcttgcttaattttcttcattaagattcccgcccgcggcaggtttctcccacacaaccccctcctctgctcctttctcttcctcggcaccgccggatctgccgcagctccggcccgtggcccccccccccgccgcgcccgcgccccgcccccgtcccccgccccgcccccctcccccccgccgcccccctcgccgtctcgcggcccccgcccctcgtcttcctgccctgctcctgatccagggcggcggcatgaacctctcccgcgtcgacgagaatctcctcagctccgtatgctccccgcgctccctcgccctcctccccgcgacctcagccccgccccgtcacaaggctccagctcgagctgttgatggcggcgacgtctagatttgatgtcactgaagattgaaaaattacatgatggcttgcttaattctcttctttaagagaagagaaggtgagggacgagaaagacaacgttatgaacgctttccttccagttatcattgcattacttttctttagggttttcgatcattggttctaagaaattaacgccaagaaagggtgccttctgatgtctataaatctaagctctatctgttcttgggatccgatggaagcttgtgatttatggattaattagattatctgatcacaaaagtggctcctttcttgggttggtccgcgtcccctgtaaagctgagcttcctgtccatccgtccgttaataagaaagaaagcttatttccttcctaaaaaaaaaaaaaaagggggggggcccggtaaccaaattccnccctaaaagtggagtccgtaataacncgcggctcaactgggncggtcngtttn

SEQ ID NO: 26607 - DNA, 815 bp, Triticum aestivum
  unsure (1)..(815): unsure at all n locations
  Clone ID: PAT_TA_26607
ctatgagcctactcaaggccgaatcacggtggcagnggaagacattcgtgtatttgataaaagagaatggtctcaaattgtatccctagtgaatcaggaccctgtcctattctcggcatctgttggggaaaacattgcttatggtcttccggatgacgttgtctccaaggatgagataataaaagctgctaaagctgccaatgctcatgaattcatcatctcgcttccacagggttatgatactcttgtgggagaacgaggtagcctcctaagtgggggacagagacagagaattgcaattgcatgagctcttctgaaagatgccccttttctaatacttgatgaggctacaagtgcactggacacaactagtgagcggcttgtgcaggaagctctcgatctcttgatgaagggtaggacttctttggtgatcgcccacaggttgagcaccgtgcaaaacgcgcaccgaatcgccgtctgctcagatggcaagatcatggaacttgggacgcacncggaattggncnccaaagggnggcagttatgcagcacntgtaggcacgcaaaggcttgcgtttgagtaaacaccttgctaacattttttgntccacacatggaagttatanggntgcaaccggnttncgaaanacatgtnacaaagantnaaaggttgtagaagatttntggaattntacacttaattgtgcngtgcatgcntgtaacaaaaanngnaaacangaatagagccctttgnatngtctgtggccccancggggggcaatgtttnnaagtgaancanaaaannanntttnttt

SEQ ID NO: 26608 - DNA, 430 bp, Triticum aestivum
  Clone ID: PAT_TA_26608
gcgttcgcgcgagcggcgcccttttttttttttttttagaagaaaacaccacacgattttattgtaggcaatacactacaactccacctgattgcttcgattacaaccttacacctgaccgaattaactaccttatcggcttatcgccaccttattgaatctgacaaagcaaaccaccacaacacatcccctattcctcgtgagccttctcctcacatttcgcgccaccttcgcccgcttcctcgccagctgcctccgccgcctcctcaggagcaacatgcgctgcccccggcgcagcggcctcatcttcagtgtcgtcgtcggtggggactaccgcccacttggccgccgctttctgggccttctttgcccctttcggctcagcagcctcatcatcagtgtggtcgtcgacggggacgaccgcccactt

SEQ ID NO: 26609 - DNA, 2320 bp, Triticum aestivum
  Clone ID: PAT_TA_26609
cagcagcggctgcagtagtggcggcgcctacccccgcgcgactcctcctcgtctccgcccgccgcgctgctccgcgattcggtcattgtagagcatctcccttcgcaaggtcactgaggagcgcctgctacgcttccaccaccatgggagacgagacctccacttctgcctcaggctcgggccaggaacctgcggcgccggccctgcagggagctgggagtgtcaagcagcagatctccaatttggaggctctgtcactccgtgcgacagtgcctgaagcggatgtacagccgatagttgaattttgcacatgaaagtttggtgactaccagtgcaacaatgcaatgggattgtggtcaaaagtaaagggaaccgggacaagcttcaaaaaccccaaggcaatcggacaggcgattgctaagcacctgcctggctgtgacgttatttaataaccctcttttgctggtcctggttttgtgaatatttttttatccaagtgctggcttgctaatagacttcaagatatgcttggtaattgtaacaaaacttgggcacctattctacgagttaagaagttgggcctcaattttacctgtagcgactgtagtacttgatttctcatcccctaatattgcaaaggaaatgcatgttgttcatctaaggtcaacaatcatcggagacaccttagcacgcatgtttgaattctcaaatgttgaagttctccgatgcaatcatgtgggggactggggtacacagtttggaatgctcatagaatttctatttgaaaagtttccgaattgggaggaacttggcagccaggctattggtgaccttcaggttttctataaagcatccaaacaaagatttgatgaagatgcagaatttaaagatagggcccaacaagctgttgttcggttacagggaggggaggagaagtatcgtgctgcttggaaaaagatatgtgaaatcagcaggaacgaatttgaccaggtttacaagctcttagatgtacaacttgaagaaaagggggagagcttttataatccctatattccgcaagtcttggagaaattgagtagccaaggtttgatcgaggaaagtgagggtgctcgtgtaatattcattcaaggtcatcaaattcctttgatagtggttaaaagagatggtggcttcaactatgcctcgacagacttggctgctctttggtaccggcttaatgttgagaaggcggaatggataatatatgtaacagatgttggtcagcagcagcattttgatatgtttttcaaggctgccaggatggctggttggcttccagatccaaaggaaaagaagttcccaaaaacgagtcatgttgggtttggccttgttcttggagcagatggcaagcgcttccgaactcgtagtactgaggttgttcggttgggagacctacttgatgaggctaaatctcgaagtaaatcagaacttctccagcgtctcactgaaaatggtaaaattgttgactggactgatgaggaactagagcaaacttcaaaggcagtaggatatggcgctgtcaagtatgcggatctgaagaacaaccgactgactaattacacgttcagctttgatcagatgctaagtgacaagggaaataccgctgtctatcttcagtatgctcatgctcgtatctgctccattattcgaaaatccaacatggatgtagaagagctaaaagtgagtgggaacatttctcttgctcatccagatgagcgtgtcttgggactgtatcttatccgttatgcagagattgttgaagaggcatgcaccaatctccttcccagtgttctgtgtgaatacctatacaacttatccgaaatgttcacaaggttctacacaaactgccaggttgttggatcaccggaggagccaagccggctgctgctttgcgaagcgacgggggtcgtcatgcgacaatgcttccagctgcttgggatcacaccggtttacatgctgtgattggcctggccagtgtctgatccttcacatcatacatttgtttccacacaagcccgtctccatggttacagttttcgtccttgtaacctattacctctgttctgaaatataattcgctgggggagttcagtttacactcccccaaagacatatatttaggtacggagggagtagtagttggcaccactaacatactctgagtcagattgccccatttgagaactgaagcatctggtattctggttgaaactactatgtagcaaaggatagtcgaaacatgtttgtttttacaaaaaaaaaaaaaaaaaaaaaaaaaaaa

SEQ ID NO: 26610 - DNA, 786 bp, Triticum aestivum
  unsure (1)..(786): unsure at all n locations
  Clone ID: PAT_TA_26610
actctgaccaatatgactccatctcaaatgaagggtggggagaagcaggcaagcaggataatttccttccatggagaggaaagtccattcgattcaagggagatcccaacaaaagacggggtggagtagagagagagagaaaacaagagttctccaatcgacacaatacatcgagggagcagtaaataaactccctttcttatgatatgtatatgatcttcctttcccttttcattgtcgagcgttcttgattctcgaagccgatgcttgagttgcgtcactgggtcgtgacggtgccggaggacgaggacggcgaggccgggtgccgcggcaccgcgttggccgcgaccggtgaaggaggcgaagaaggacggcttccctggccgtggccgtggccctgggagttggtgcggtggaaacggcacttgaaggacccggcatgggtggccggcgcgcagacgcacttggaagcaggcccgtggcctgcaccggatggcgccgacgccgacccgggccacctcctccgtgtattcttcggcgacgcggcctcgccggtcggcgtcgtgctgttgctgtggtggccgtgggtgtggaaccttccctcctcccccgtggtgtccacgtagttggaagccatttctgtcgcgggtctagaaatctgaaagcgggggatggaagcagctgcccgggcgagaggaggtgccgagagcggcaaactttttttttttttttttttttttttttttttttttgtatttcccggggcccggccgnngcctcgagcgg

SEQ ID NO: 26611 - DNA, 878 bp, Triticum aestivum
  Clone ID: PAT_TA_26611
ccctttttttttttttttttttttgctggtttattttctttcatggagaggaaagtccattcgattcaagggagatcccaacaaaagacggggtggagtagagagagagagaaaacaagagttctccaatcgacacaatacatcgagggagtagtaaataaactccctttcttattacctgccattagaagcaggaaagtccattcgattaccaagggagatccaaacaaaagacggggtgggagagagagagagaaaacaagagttctccgatcgacacaatacatcgaggagggagcagtaaataaactccctttcttatgacatgtatatgatctttccttctctcttcatcatcgagcattcttgattcttgagaccgatgcttgggctgcgtcactgggtcgcgacgatgccggaggaggaggatggcgaggccgggtgccgcggcaccgcgttggccgcggccggtgaaggaggcgaagaaggacggcttccctggccctggccgtggccgtggccctgggagttggtacgatggaagcggcacttgaaggacccggcgtgggtggccggcgcacagacgcatttggaagcgagtctgtggcctgcgccggacggcgccgatgccgacccgggccatctcctccgcgtattcttgggcgacgcggcctcgccggtcggcgtggtgctgttgctgtggtggccgtgggcgtggaacctcccctcctcccccgtggtgtccacgtagttggaagccatttctgccccctgtgtttcctgtttctagaaatctgcaagaggggagggaagcagagcagagcagctgccggggcgagaggaggtgccgagagcggcaaactcccgacccggccggc

SEQ ID NO: 26612 - DNA, 600 bp, Triticum aestivum
  Clone ID: PAT_TA_26612
ttgttctcataatgcatgcatgctctaagctaagttggtgcaatagtgcatcacttgtaacaaacataaaagaaaattgcatcacttttaacaaacataaaagaaaaattgcgcacgaaatgtcctcttgcttcgatttatattccgcatagaagccaacaattactaatgactttctccataaattagtagtgacttccttagtataatttcctaactaggttgcgcatcacttggttcctttggtcaagtagaaaatcctgatttgcttctagggaaagtggatacagaccttgaccatcatgtgatgtgactcgagaaggactagagtgaccatgtactcaagtatgattagaactacttgtttgttgcacgaatattcatttctgagccctctgctcccaaggaagagtagatttaaaaaataattgaaaatttcaaaaaatctgttttttttgtcaacaaagacactcaaatgcctgatgtcccaacaaaattttatcgtgttcggacatctgaggggctcgtggaaaaaaaaaagaaaatttgtctgaacggtgcatgaacattgaactttctcatagaccccattttctactg

SEQ ID NO: 26613 - DNA, 636 bp, Triticum aestivum
  Clone ID: PAT_TA_26613
gtaaagtctcaccaagaaaaagaattgctactgtacatttttttcacatcacagctcttaccagattatgaattataggatgtgaaggagaaccagccagctgagataatctgcatgacatctgatgccaacttgcagcgctgtgtaaatatagaaatcaaccactgtcagccaaatttgtttgatgtttatataaactttatatggaaaggatttggagattgcatgtttttctttgaatatgtgccaactctcagattatttgcattttgacaaacaattcttctatccaggattaagaatcatatcttatagagtgtacaatattttcttggtagatttgtaagatttaagtattgttggttgtgcaaaaaaaatagcttcatgtatgtattatggagttacacatgtttctgtgtctggtttctttgttgtattgggaacagatctagatagatgatatttttaatacaaaacatccatattagtttttttgcatctgtgtaaccatggaatccataatatcattgtttgtttttaataacatgtgtgatccttcctttgcagttacaatgtccagatatcatagttgccacctatagaaaatatgctaaagaagttttagatacactttca

SEQ ID NO: 26614 - DNA, 581 bp, Triticum aestivum
  Clone ID: PAT_TA_26614
cgattttgcccccagaaggttattcctttgtggaatcacagaggccacacgggatatgctatcgttgagtttggaaaagactatgcttgcttctgcaacgccttcaagtttgaaaatcacttcgaggcggaaggatatggcaaacgggactgggaggcacgcaggtatcgagggtcgaagatgtttggatgggttgcaagggctgatgatcaaagaactctggggccaatcggggagcatctgcaaaaaaatggtgatttgaaaactgttgcggaacttgagaatgaaggaacacgcaaaaccgacaaactggtagctaatttagccagccaaattgaggtaaaggccaagcatgtccaagaacttgaatgcaagtacaatgagacgaccaactcacttgacaaggtgatggaagaaaaggagcaggtcctccagagatacaatgatgaaatacacaagatgcagcaacttgctcgtaagcattctcagatgatcatcaatgagaatcagaggctccgttcagaactgggagtccaagatgcaggatctccgaaattaaaatccaggcagccttgatgaac

SEQ ID NO: 26615 - DNA, 580 bp, Triticum aestivum
  Clone ID: PAT_TA_26615
ctcccctcccgcgccggctgcacgtctcccctacctcgccggtctgccatccccgtcggtcgcctccccaaccctgccggccgcacgcctcccctacctcgccgggccccgcctcctgcgctggttcaaccgccgccgccgccgccgtcggtcctcatgcgaccgtgagcagccaccccccaccaccaccaccacccaagctggtcctcctctgctgccccaagaacgccgcggcccaccgtacaaatccacgcgaccgtgcaatggtggacagcttacacgtttaatcataattgttctgctcaattgcgacactttgtatctctcggactctatttgaaacatgcttctttctgaaaccctatcaaggtaaagtcaaggaaccaattgggagtatcctccacatattatgatatgaagcagggaacgtggacgcacgcggggtggccgccgacgaacaacgtcgtgcgtgagtgcgcaccagcgtggtggcgcagagccctctgccgccagcatactgccgaggagttctacattatttcattagtccatttacagcatgtcaaatggatcatcttat

SEQ ID NO: 26616 - DNA, 1024 bp, Triticum aestivum
  Clone ID: PAT_TA_26616
ggcacgagacggcggctgcttcctgcagcgcgccgggaggtttagctgtcggtgagatctcttcaccacccacccacccctcgtaggggcggctttggcccggcgaccatggacctgcgcctcctcctgtgttcatggccggccggcgcggcttcggatgcgacgagccctagaagttgtgctctttccagcttcttcgatttgttaactcctcggcatctccgcaccaccatcactctgccggcgcccttggttggccgtccatcccggcgcatcgtcgattccgtcacactccaagagctgcgtccccttccagtttattgagcacgatggagtccctgttgctccggtgcaggtggcctggatccatgatcccttctagattctcgctcacccgagtctctggccaccgtcgcatccccatcgccttcattccgctcagccacccaaccttgccctccttcggggctcgcacgtccggcggcgcccggtgcctctctcggcatcgggtgtggctccccttcctgcagttgcagctcttgcgtatgctcaacttccttttctccgatatgtgctccgatggcttgggattgcttggatttgggcccgggagaaatacctgcatcctatgctggcagtggcaacatttgcgggtgtcgttctcttcttggaggcgctgccatggccattatctgtgcccctcttcgagcatcaggggaaaccctaggtacggattttcggatcggacgacgatgatgtcttgatgttattctccttcgtgaaggcgttgtcttgtttgctcgcgacgtcctcggtgctggatttggagatgttggtcgcttagttgtcagttggattgcttctctggtcggcgagtttagctttgttatccttatttgggtcgagcatctcatgtatatttacttcaggcaccatgttcacgcctcttgcgtccgtgtcatgtgttgtacacctcttgtattcattctaacttctctatcaatgaaatgatacgcaaacttgc

SEQ ID NO: 26617 - DNA, 521 bp, Triticum aestivum
  Clone ID: PAT_TA_26617
cggcggcgaggccgtggtggtgaagcggaagaaagggggagggttcttccccaagatggtgctgtcactgggcaacaggaggaagggcgcaccccaccgatcccccctagcctgagaactcccacgtttgcatgccccaccccaaccccctatatatgtgtcatcatgctgttaattagttaccgtagctagccagtgttagtcccctattggtggtcgtagctggagcattatattagtagtggtgtgtgtgctatagtcctatggttagccatgtagagagagtggccctgtttggatcatggggttagagctagtttgggttagttgggggcttaaataacccaaaagtatccaaacaggtaggattagagtgggtcagttccatctaacccaatgcaactatcccggtggagaggtgcttatttgagttaagaagttggttagaaaataactctaactctaactgtgttagagtatccaaacaggggccagtgtgtatgtgtctggttggtttggga

SEQ ID NO: 26618 - DNA, 521 bp, Triticum aestivum
  Clone ID: PAT_TA_26618
cagcctcgaggacatcgtctcgccgcacgccaccgacgaccaggacatctcatactgcccaatctgcgactgcgaggtgaaattgcgcagcaagcactgcaaaacttgtgaccggtgtgttgatggatttgatcaccactgcaggtggctcaacaattgcatagggagaaggaactatgcagcatttatcatgctaatgctctttgttttgctgatgcttgttattgaggggggaacagcggctgcggtttttattcgctgcttcatcgatagcaaagggttgaaaacagaaatggagcacaggcttcacgtaaggctacctaaaggagctcacgcagcattatctatggtatttgtcatcttcactttgtacagtactgcagcattgggtcagctcttctttttccatgttctgctcattagaaagggaatgaggacatatgattacatccttgctatgcgagaagctgcacaagcatatgatccttttgatgactctgatttttcctcggacgagagca

SEQ ID NO: 26619 - DNA, 1651 bp, Triticum aestivum
  Clone ID: PAT_TA_26619
cacactactaccctgcttgttaccgggaagaacaccagctgagctacctttgcccagcaacacccatacacgtcctagacccccttgtttgtacgtgtaacttagcaattaagctcattttttacgcactttcactgtcgacatgaagatcaccgtgtactcgtccaaggccgtcacgcccgagtatggcgcctgcggcgttgctccgggctgcaccgccgacgtcgtcccgctcaccgtgctcgacaaggccaacttcgacacgtacatctcggtgatctacgccttccacgcaccggcgccgcccaacgacgtcctcgaggccgggctggccaaggcgctggtggactaccgcgagtgggccgggcgcctcggtgtggacgccaacggcgaccgcgcgatcatgctcaacgacgccggcgcgcggttcgtggaggcgacggccgacgtggcgctcgacagcgtcatgccgctcaagcccacgccggaggtgctgagcctgcaccccaacggcgacgacgggcccgaggagctgatgctgatccaggtcacgcgcttcccgtgcgggtcgctcgtcgtggggttcaccacgcagcacatcgtgtccgacggccgatccaccggcaactcctacgtggccgggagccaggccacccgcggtgccgccatcgaccccgtcccggtgcacgaccgcgcttccttattccatccccgcgaaccgctgcacgtcgagtacgagcaccgtggcgtcgagttcaagccctgcgagaaggttcacgacgttgtctgtggtgctgacggcgacgacgacgaggtggtggtgaacaaggtgcacttcagccgggagttcatctccaggctcaaggcgcaggcgtcggcgggcgcgcccaggccgtgcagcaccctgcagtgcgtggtggtgcacctgtggcggagcatgacgatggcgcgcgggctcgacggcggggagagcaccagcgtcgccatcgcggtggacgggagagcgcggatgagcccgcaggtgccggacggatacactggcaacgtcatcctctgggcgcggcccaccacgacggcaggtgaactcgtggccaggccgttgaagcacgcggtggagctcatcatccgggaggtgtcccgtatcaacgacggctacttcaagtccttcatcgacttcgccaactccggcacggtggagaaggaacggctggtggcgacggccgacgcggcggacatggtgctgagccccaacatcgaggtggacagctggctgcggatcccgttctacgacatggacctcggcggcggccggcccttcttcttcatgcccagctacctgccggtggagggcctgctcatcctgctaccgtccttcttgggcgacggcagcgtgggcgcctacgtgccactctttagccgcgacatgaacactttcaagaactgctgctacaccctcgactagctccgcttgacgtacctgccaagtgcaaatgtgtgcgtggtgtcggatcgacgtcagctactcgagggtgcaaatgtgtgcctggagtacttgcctagttgtatttttgaagttcttgattcaattgtcgttgctgttttcaaaaaaaaaaaaaaaaaattttatttttcaaaaaaaaaaaaaaaaaaa

SEQ ID NO: 26620 - DNA, 482 bp, Triticum aestivum
  Clone ID: PAT_TA_26620
tttgccaaaaatatagggtatttaacacatagtcgaccacgtgcaataattaggcctaaatctcctctgaacttaattaagtttccatgttcgttggtaaatataaaatggagaaaaattatggacaaaatatatggtaataaattatcttattttcgtttaatatatggcatgatcatttaacataatgatattctgtcgagctatcgagctaaaatcgaacgagccaatattggctcaagatcggctcgtttcttggtcgagctacataaagtgttcaaactctgcttgtttattttcgagttgatctcaagtcgagtcaaaaaacaagtcgatctcgagcggctcacgagcctcgagcttttcttgcagccctatctgttgcatgcgcaaagggatcttcgactattctatttttcctacacattttgttggttttgcagtatgtcaaccagttctgttgttttaggaacagtactcta

SEQ ID NO: 26621 - DNA, 861 bp, Triticum aestivum
  Clone ID: PAT_TA_26621
agaatttttctgttgtcccctttgatgccaatcctctgctgtatctggttcacactaactattcatcaagttaacttatctgttcatcgttcgtccggcattcccgaataggaaaggcgagttttagcaactatgaacacacacgcacgcgcacacggcaaaaaggatctagctacctccgcagctctactactgcatgtgaatcttgaaatcatcttcttttagccctgtttctttttcttttctagtagtagcttccccccctcttgatcttcatcgatcgtgtgggaaatacaagccacggcagagctagctaagctagagctagctggcttggtaaaagctgctccttgagcaggcccaggcggcaggcgaggctacctgtggaactgagccagcctgttgtccccgagcctcgagttgtaggcagccttcttgtactcgccccatgtgaagtccttgtacaggctctgctctcccgcgcccagcagctgcggcaatggtgcaatcctctgtgtcatcgctggccctccaaagtagatcatggaaaccctagactttaggctgttggccaccaccctgtgcttcacgctcttgaacctcccgtccgtcagcacctcctccggccgacttcctctgccggagaggccgccgccgtccggggccgccgtccccctcggcccggcctgccgcgccatcccccggccgcacgtgccggtggcgcgcagcaccgggacctcctgcgggtccgcgtcctcgccgaagccggtggcgctgcagcccagcccctgcagcgcgtggcacggcgggtagtggttcacccggaacacctggtcgctctcgtgccgaattcggcacgag

SEQ ID NO: 26622 - DNA, 536 bp, Triticum aestivum
  unsure (1)..(536): unsure at all n locations
  Clone ID: PAT_TA_26622
ggcacgaggcggtgcgaccggaaggccccgttcaagccgcgggaggccggcgaccgcgcgctggacaacctcatgtggcgggtggagcgcgccgagttcgccaaggccgccgcggacgacggcggggcgggacgccgcctgaggctgctggacacgtacgagatgtcgctgcagcggcccgacgcccacgccgggccgtaccgggcgtaccagccgttcgccaagggcggcggcgccgccgccggcaaggtgcagaaacgactgcctgcactggntgcctgcccgggccgatcgaggcgtggaaacgacatcatcatgcggatgctggccgaggactgacctcgcccccccgttcggcgtcgtcccgcgggcgggccggcgggcttgtgggcggggcgcgccatgggggcgtgtcgcttctggctcgccgggggtcgtcgggccccggttgcggctcgagtgccctggcctgggcttcgtcggcacttggccggccgtgctgtcaccggtcgcacctggtttgtgcttggacttca

SEQ ID NO: 26623 - DNA, 735 bp, Triticum aestivum
  unsure (1)..(735): unsure at all n locations
  Clone ID: PAT_TA_26623
gaaagaaggcgattctataggctcgtagatccccgtctagagggaaatttctccataaaaggcgctcagaagacggctcagctggcacatgcttgccttagccgggatcccaaggctaggcctctcatgagccaagtggtggaagttctcaagcctcttccaaacctgaaagacatggctagctcctcctacttcttccagtccatgcgccaagagcgtgccgcaagccttggcaacccaaatggtagccaaagcatgaaggcacagagcacctttgcacggaacggagtgcagccaatgaggagcctctcgtatggtccgcacgcttctccgtaccgccagtctccaaggcccaacggcaaacagccctaagactcacctggttcatcatgagtgggtcaaggttgggttctcgtccagcactgatgggggnatggcgcgtgcattggctgtggcccccgttgccgtggatagacagatgccctccnaggatgattagaattccgcagtggagatttcttctcggtgcttagcntttttagcngntctggaacnatanncnngggaacattnactttggganggggggnatnanacanggttttntttgccatttgaacaaatgctcngatgggtgcttagaaacnccccngattggggaatcnaccntcggncanggagaagagcnagtgcatgtatgggccccgnnnctnatcngagcagatttttnttgtt

SEQ ID NO: 26624 - DNA, 473 bp, Triticum aestivum
  Clone ID: PAT_TA_26624
tctgcttgttctcacgccttaagaagttttgcgtagttacgcccgaccggccgcaggatgtggatgaggaagaagaaggcggcgacgacgacgaggccggcggccagaaggagggcgccgacgtcgctaggggcgctgtggcggcgcgtggtcgggccggcccgcggcggcaaggccaaaaagaccaagaccaagaagagcaagatcgggtcgctctcgcgcgcgttccgggtcttctcctgcgtccgcggccatggcaaagggaggatggctgcgcgccggtattgatgggcctgcggcgcgcacgcccaccgtccgggcgtcgaaagagttgcaactagcggctgcgagtctcggttgtagctgcgggtcacaaatttcatgttaataactttgtactatatcttgtatccacgtgttgtggctgtactgccttctgttttgtgaaagaaaaaaacatgtgtttccgttcc

SEQ ID NO: 26625 - DNA, 637 bp, Triticum aestivum
  Clone ID: PAT_TA_26625
cctatacatgcatatgtatgttataaaccgcaaagtctatcagttctcatttctctagagattatgaacacacattattcgtaccttgaatcagtggagtgcaccacatctagatttgttgcttaagtttggagggcatcggaatttactctttcgcatcatgttaatgttccgtgagcaatgtggttctccttcaaccttgttcagaatgaccagttggatgttggagacaccattcatgtccaaaccgaggaacacatgatgttggcgggtacatagcatagtagcattcttccatacacgatgcggatggggcacaaacaccagtggcattgtggcatctgttgtcctagagaccacgaaggattcaacatggaacaaggtacgattggtgcactcccatgtaaaaccactggaacctagggattacaatgtcagtgtagcaaaaatgaaatgtcgtttattcttcctattttgctaacatgaaggggttctgctaatggtgtaacaataaataaaatgatgggcatgccgttacacatttgtatatagatgaaataaaaagggcaaccacacatatgggaaattttgttttataattatagtattacaaagtacaactttcccacatgattac

SEQ ID NO: 26626 - DNA, 1176 bp, Triticum aestivum
  Clone ID: PAT_TA_26626
ccccgagggggaggtgggttcgggaccttctttttgcccccgcccccccgtggcggccgagtgaaatagtgattagcgtggttcgcggccgaggtgagagaactagtctcgagttttttttttttttttttgaaccaaatgatatctcttttcatatttccattcatagaatttcagatacatgtatctcactttctacagctttcccatttctgtagtgttcatatcctacacagcaaaggaggccttagcaggtgcagtgttttgataagtttcagacgaataatcacgagcatggatgaatggtcccagacagattatttccacaattcctcaccaggttcagtcgcaatgtaatatcaagcacaccaaacctttcgtgcagtatacagcaaagacaaaccaccctatcagaagcaaacagaacgccaatatccctattaggaaagaccagccggccacctgaccgccggggcacgcgacagttacgaatggcgcgaatgaccgaaccattcacattgggtccacccacccgccgtgcagccaaacaagagctgccacattcaaaacattccactacgccgaaccaccgtgggcaagccggttcaggcagtttgccacgaatgagtaacagttgcaggtgaacaggttgtagtatttgtgctggaaatgtctcgtgcccagttgcagggctccatcccatgatgttgctgttccaacttctgtgtgcttgtatgaccactcgcatacatgtgccgccagattagcaggaaagcagcacttctttctgtccagctggaggtatctagcgacagaaccatatgcaaaattatccatgctcactaaatttgaaccagcaaaatccagggcagatccatcctcctgacagattccaacatgccctatgtaaggagcaagccatgaaacttacaggaagaggagtcccagacaatgcaacaagggaatcgccctctctttgggtctatctcaccaactggccacaactcctgcagttcattgtttgatctggaatcttcaacatcaaaatcagcttcagcctccatcgaggaaaatacttcagttaacattagtgcttcgttgaacttatacaaaatcaaatgtgcttgcatctcatgaccatccagacctttgcggagaatgggcgggagacggcag

SEQ ID NO: 26627 - DNA, 397 bp, Triticum aestivum
  Clone ID: PAT_TA_26627
ctactactcgccgtcctcggccgcgtcgtcgtcgctcttcggcaacccgccgcggccgcgcctgcaccggctggaggaggcggtgatgcaggaggcgatgatgatggaggtgagggagcgggcgccgctgctcatggacgacgacggcgacatcgacagcgtcggcgccgcagccgtggacgaggcgatcgcgtgggccaaggagaggttctggagccaggcctagcattcattagcagtggcacaagcatgacgggatttgaagaaccacattaggtctcaactctcaagtcctccactcaaaagaagagaaagaagatcgatttgaagttgcaaccacactgacattctagattatgtgcccattgatgatatgtccagatcaacatttgtttcc

SEQ ID NO: 26628 - DNA, 1418 bp, Triticum aestivum
  Clone ID: PAT_TA_26628
ccacgcgtccgccgacgacatcatggccagcgcgccagccccgccgccccgccgcgtggtcgtctgcggcggtggcgttgtcggcgcttgcacggcctatttcctctccacccaccccgcctcccccaccgtgccgacccttgtcgagaagtcctcccccgcttgcgctgcctcaggcaaggcgggcggcttcctcgccctcgactggagcgactccacccccgcactctcggcgctggcgcgcgcatccttcggtctccaccaccgcctcgccgctgccctcgacggcgccaacgcgtacggcttccgccccgtccacaccctctccatctgcctcccctctcagcccgccgagcccctctcaccccacccgctcctcccttcctgggtcgacccctccgcctccgccgcgccgccgcgccagctcggaactccggacaccaccgcgcaggtccatccgggcctcttcaccaaggccgtcctcgccgcgtccggcgccgaggtggtcatcggcgaggtggagcgcgtggtggtccaagccggctctcgcgttcgcctcgccgcgaaggggcacggaggggtgggtccgcttcccgtggtgctcgcgctcggcccttggtctgggcgtttcgagatggtcatagaggtgttcgacgtgtccgggctcaaggcgcacagcatcgtgctccggccgcgcaaccccgacaagatcacgccgcactgcctgttcctgagctaccagccggagcccggcgccaagatgctcgacccggaggtctacccgcggcccacggggggaggtgtacatttgcggaatgagcaaggacgaggatgttccagatgatccggcagcgattgacggggagccggactccattgcaatgcttcacaagatcgctgggagggtgtccagccaactgaagacagaggagggcgcagaggtagtcgcggaacaggcctgctacctcccgtgcaccaatgacgggctgccggtcatcggggagatgcctggggtgaagggatgctacgttgcaaccgggcacagctgctggggcatcctcaatgctcctgctaccggtgcagcactcgccgagctcatccttgatgggcaggccaagattgttgatcttgtgcccttcagcccggcaagatttctcaagaagaagagcaggcgcggagtgtaatggcatgcgcggtttgtttcgatctgatgttccaaacttggcaaccgaataaaaagctatcctctcttgcctgtccgaggggataggcaaataatgtacggataaataaaaccttcaacacttgctgtcgagtgttgtggagatggatagatcctgttttacttttatctgatgctgtagtgatctaaatgctcttatatttatatagggagggagtacctaatgtacccaccc

SEQ ID NO: 26629 - DNA, 592 bp, Triticum aestivum
  Clone ID: PAT_TA_26629
tcggagtcaggggctacatatccctgctatccttgattttgtgtccaatatttgagatgaggcatgagtgactttgaggagatgtacaatgcaaagttcagagatcaacactataatgatgtgtgtggccgaacatttatatatcaagttcagatctggccaccaaggggcagtatccatcagctaaagatgcagtacgaagatgacccagtaaaaagaagatgtccgggttctcgtcaaatgaaagctgcactactataaaaaatggaaacaaaagaacaccgggcagtctcattccgcactgcatttgcacagtctgtcttaccagtggactgtaaagcaagaacaaagcatgataaaggcgaacgacatctttcttcttggccggatgacatttatttacaatatggtattgtctttagaatttctcgtgttggtgttttcgtgtacttaattatgtgatggtgatgattatacactcctcacttataggaatagtgaccatgctgtgtacattgtaatctctttcctgtttttcctttataggaatgataagacttcctacagtaggcttaatgagaatttcttgttt

SEQ ID NO: 26630 - DNA, 533 bp, Triticum aestivum
  Clone ID: PAT_TA_26630
aagcaaatcctaagatagcatcatatagcaagccaacattttttttttttttttttttttttttatcacacattcagttattttattctccatcgaccggtctgcctgacgctgatcacggcaaagatctactagtatgtatcatgtgcccgctacagcgtgatcacgatcagcatggccatggtggtcaggttttccgcgtcgtcgttcaccttgcgcagaggcgcctcctcccgcttcgccgcggcgtcgccaccgcgtccgccgaacgcgtcgtcgcagtcggtggcggacctcctgacggcgcccatctcggccacgtacgcctgcttccgcccggtggccagcgcgtggacggcgctgtgcaccacgttcagcgcctcgatgtaccgccggcggcacgtggccagcgcggcctgctgcttgtccgaccagcccccgcgccgttgcagatctttgattgtggccaccgccgccgtgtagttggccagcgtcaggttcgtggcgatcacggccagccctttcgcgtccgc

SEQ ID NO: 26631 - DNA, 449 bp, Triticum aestivum
  Clone ID: PAT_TA_26631
tctaaccagatgtcaccccaaactctgttttatgccatggaatcactggaagtcgatcataatcaaagtactatctcatctttgccacaccgatggtccagaattaaatgactatgcagttgtgtatgaagatctttttgccaagtacttcggattgagaaaagatggtgaaggtgacagatatgtggtgctgaacatgaatgcaagttggctttctaacgctggcaggaattctttgcagcaagacggcaacagatgtttattgggtgcctccgagtgtcattcatgtgctcagtgtttctggatgaatgagctgtcttctgtgggtttcagtgtacttaagaaggtggagtcaattgttcaaatttctccaaagccggcatcttggggatacccctggtgtggaacctggtccttatcattcctgggatagcggcctaaggtttttt

SEQ ID NO: 26632 - DNA, 1176 bp, Triticum aestivum
  unsure (1)..(1176): unsure at all n locations
  Clone ID: PAT_TA_26632
attgggaccggcccttctttgtttttcactccctctttttttatatctcggttcatattcgttgctttttcatgataccagatcttttcccacatatatacagtgagcaactcaaacatgtggtgaatttgaagtctatcaatgatacttgtcattcttgaatctttggacaagggaggataggggcttgcatctcacaatcaattggaagtcaaaagatgaagaaaggcattcttcgaatctttcgaacaagaccagcgaggggggagaaaaatactcacgcgcagaagaaacacacatacatcccgcccgggaaaaaaagatggatcacatccaggaagatggaggcagccctcaacgaacacggcggcgaccttctcgggcggtcttggtcgagcgactggaggttgcacttggacgatggtgtcgatgaacacgcgggtgtcctcgatcgtgttgcccgccggcacgtccacgacgtacgactccacgacgacggtggcgctggacggcgcggccggggacgggtggacggtggtgacggagaggtagttcttgagccggtgctcgccaccgacgacgcggaagctgagcacgtggctctcgtcgtccaggatctcgagcccgctgcgcggctggacgccgcggggaggcccgacacgacgtgcacctcgcggagcgtgcccacgccgccgtcgccggccaccagggcgcagctgcgcacgaaccgcttgtacgcctgcggctggtcgaaccggcgcaccacggaccacaccgccgccgcgggcgccgccacgtgctgcaccaccgcggagcagcactggccggaccccggctccgcgtgctcgtggtgccgcgccacctccgccgggacctcgcagtcgtgctccctgcacctcatccctgccgtcccggccgcggccacgaccgcctccgcgccgcaccccatgccgacgccgacgcctgctaggactcggtggtggtggttgtggttgtggtgctggatgctggggctggacgccgggatgcacggcatggtgcgtcgagtctcggtgatctccctggcgctcgccgtccttttcttgccgtgtgctgccggccggtggaatatctttcgcccttccttcccgtgtgctgccggccggtggaatatctttcgaanggtaggggtagggg

SEQ ID NO: 26633 - DNA, 1105 bp, Triticum aestivum
  Clone ID: PAT_TA_26633
cccgtcgtccgcgccgtcgtgggcacggccgtcagccgcgccgccgcgcccgcagccgtcgctagcggcgctgtcgtcgtcgactgcagctccgcctaccggatggaccccgacgtgccgctcgtcatccccgaggtcaaccccgaggccatggccgacgttcggctcgggaaaggggctatcgtcgccaaccccaactgctctaccatcatctgcctcatggctgtcacgccgctgcatcgccacgccaaggtcaaaaggatggttgtcagcacataccaagcagcaagtggtgctggtgctgcagccatggaagaactcaaacttcagactcgggaggtcttggaaggaaagccaccaacctgcaacattttcagtcaacagtatgcttttaatatattttcgcataatgcacctattgttgaaaatggctataatgaggaagagatgaaaatggtgaaggagaccagaaaaatctggaatgacaaggatgtaagagtaactgcaacttgtatacgggttcctacgatgcgcgcgcatgccgaaaacgtgaatctacagtttgaaaagccacttgatgaggacactgccagagaaatcttgagggcagcgcctgggagttacttgtgtgtggaccgcgctgccatcaaggccccgcgctgaacgctgtgcagattgcagagttgctactgaagtagccgcctttctcgtatctcttttgttaaacattgcttccgagccattgttggattgatgtactctcagtcagtttgatctcagttttggtcgtcgtcatttttgtaatctatcaacctagcagaagcgcaagacgggttttagtcatctggttgcacacagaagtgcagtcagaagttgagaaaaggagagtctcctccagcccagttttggtcgtctgtcttttttgtaatctgtcaacctagcagaagtgtaagacgggctttagtcatctgttgcacacaaaagtgcagccacaagtttagaaaaggaggcttttcacttgttcacattaccacgaaagccagtcacagaaccaagcatcccgtggggttcttgatagctgggccgccgtaactttacccccaaa

SEQ ID NO: 26634 - DNA, 727 bp, Triticum aestivum
  unsure (1)..(727): unsure at all n locations
  Clone ID: PAT_TA_26634
ttgaggctggtatctccaaggatggccagacccgtgagcacgccctccttgctttcactcttggagtgaagcagatgatctgctgctgcaacaagatggatgccaccactcctaagtactcgaaggctcgttatgaggaaattgtcaaggaagtctcttcgtacctgaagaaggttnnntacaaccctgacaaggttcccttcgtccccatctctgggtntgagggtgacaacatgattgagaggtccaccaaccttgactggtacaagggccctacccttcttgaggctcttgaacagatcaacgngcccaagaggccctcagacaagcccctgngtcttccccttcaggatgtttacaagattggtggcattggaactgtgcctgttggccgtgttgagactggtgtcatcaagcctggtatgggttgttacctttggtcccactggtctgacaactgaggtcaagtctgttgagatgcaccacgagtctctgctggaggcgcttcctggtganaangtcggcttcaatgtcaaaaacgttgctgttaaagatctnaagcgtgggtttgttgcanccaacnnccaaggntgnccctgccaaggngggggccaanttnacctcccaggtcatcatcatgaaccnccctggtcagatcggtaacggctatgccccagtgctggactgccacaccncccanattgctgtnaantttgctgagctggtg

SEQ ID NO: 26635 - DNA, 442 bp, Triticum aestivum
  unsure (1)..(442): unsure at all n locations
  Clone ID: PAT_TA_26635
tancacctcagcacggatgaacccggagttcccggcttccagcttcnctcctccagcagcagctatccgccgccgcnagagtccggctcagagtttcctgtcttgtcanggtcagttgntcgtgcactgacatacatggcgcccatgtttcatgaccccgggagcacttacncggcggtgccttccgcnggctcttactaccctccgccggggacacggcaccgcgaggaaggggcgagttcgccgtactactaccctcagcctgggacccgctactcgtaggaggaatcttgcagattactagtacttggtaggctttggaatgcatagcaaatcacaaagctattcnnaagactttgtacttaatttataagtatataccgcantgactttgtaatcgcagtgatttccaaganacagcgcttaatttggnttatgttta

SEQ ID NO: 26636 - DNA, 795 bp, Triticum aestivum
  Clone ID: PAT_TA_26636
acaccacccaacagccggcgaaacgccgcgttcgacgcacgacacacgacacaaaaacttctgaatctagcgtcagtaggtaccgagagtttcttctgaagatgagcgtggagatcctggacgggaggacggtgcagagcttcgtgcgcgcgacgagggcgccttcaacgcctccgtcgatcgccgcttcgcggccctcgacgccgaccacgacggccggctctgctacagcgagatggccggggagatcatgagcctccgtgtcctcgagaagcacttcggtgtcgacgacgccggcgccgttggtcccgacgagctcgcaaagctctaccgcgttctgttcgcgcgcttcgaccgcgacggcgacggcggggtggaccgggaagagttccgggcggagatgaaggaggtcatgctcgccgtggccaacgggctcggcttcatgccggtgcagatggtggtcgaggaggggagctttctcaaggtggccgtggaccgggagctggccagagctgcctgaccgattctgtttctactactacgagtgtatgttacagagtgaggcattatgcgagtgaggataatgttttttttttattttcaaaacgagaagtgagtattaatgctgaagcctcaatggcattcagctatgtctacgtaattgtgtatttacagagacgtttatgctctgttcaggatttcatctgattaatcagttaatttaccgattaatccctactagcagagtcattgactagccgcattagattaattggttaatttgctgattagtct

SEQ ID NO: 26637 - DNA, 676 bp, Triticum aestivum
  unsure (1)..(676): unsure at all n locations
  Clone ID: PAT_TA_26637
gcaccgagccaccgaatccacctctcgccggagtcccagcaaggagcaagcaagcgacgatggacggcagcaagctgaagaaggnggccnngaagaagttcggcgggccgaggaagaagtcggtgaccaagtccatcaaggccgggctccagttccccgtcggccgcatcgggcgctacctcaagaagggccgctacgcccagcgcgtcggctccggcgcccccgtctacctcgccgccgtcctcgagtacctcgccgctgaggtgctggagctggccgggaacgccgccaaggacaacaagaagacccgcatcgtgccgaggcacctgctgctgggccatccgcnacgaccaggagctcgggaggctgctgtccggcgtcaccatcgcccacggnggcgtgatncccaacatcaacccggtgctgctccccaagaaggcgccgagaaggctnagaaggccggcaccgccgccaagtngcccaagaagggcaccaagtnccccaagaagggnaccaagggctagatncnagtagtgtctgcggggtactgangggtccaatttgggtagatgtagtcgctgtntcactctgtgtgctgngcncctgatgtatctgcnaacaaaggggagncgcntncttccccntganttntgnanttatgatcnactatgcggtt

SEQ ID NO: 26638 - DNA, 376 bp, Triticum aestivum
  unsure (1)..(376): unsure at all n locations
  Clone ID: PAT_TA_26638
tgctgtggactnntcngaatntgtagtgcctgttntganaagatgtngtgcgttgtgtcgnnacncttggtacgtgacgtgtgttgcgtgtggggtttacgttggngttnagtctcgngtgtgtccgtgtactaggtgtttccgtgtganttcgcgctccaatgtgcnganggnttgcgtataatgtgtngntccgtcgtcttctggtcccctntgtttgtnantgcgcngtgcnanttttgtnnntggnccnntncngnnnttgtgngggcccncnggtgtccnaaannnncnnnnnnccttgggcccccctgtcgcntgggncctcncnannnttgncctgtgtatannngtgtccctnaagtactnttgnaaa

SEQ ID NO: 26639 - DNA, 398 bp, Triticum aestivum
  unsure (1)..(398): unsure at all n locations
  Clone ID: PAT_TA_26639
agccaccgcggcncccggcagcgcgnccaacgcgcancccggcagcgcanaacggcggaaggacaggcgcagcagggggggccancganggcaacaagaaggncgagacccggtccancngccaccgcacancacggaggccccccacaagcaggtggaccnaccagagaccgcncccaagagggngccccgcctgagagcagcaaggcgggcncaacnccgagagcacaaagcgcccccgggganaacgacggcgcganaggacaaagtggaanccgccaagngcgngngcaccgacgccacacagggagcaacgaggtggaggaggccaanaaagagaacccngacgcgacgcccgcaacancggagncgacaacaagcgccaggagcagagcgca

SEQ ID NO: 26640 - DNA, 320 bp, Triticum aestivum
  unsure (1)..(320): unsure at all n locations
  Clone ID: PAT_TA_26640
ccgagaccacccgccgccatgccaagcncaacgngcncagaagagcaagcgcgagngnagccangtaccgcaagcgcngcgccccatgtggganctcnaacacnggcaagcgctagcaccacaacgcgcccaancnccatatctgncaagcgcaacgctaagcgcnngtgccgccncnaccggggaacattaaggaggccgcnaaggtgaatgcgccggnngaacaacaaggngcgacggccgtacaaggtggncnctggnagcaacctcnnnnaaacagctaaaggagaatgccccatnacggnngggtantggtgnag

SEQ ID NO: 26641 - DNA, 461 bp, Triticum aestivum
  unsure (1)..(461): unsure at all n locations
  Clone ID: PAT_TA_26641
ctccctcttcttcccaatcacacacctgtcggagctaaccggagcggcgatgtcgggggcgcggcaagggcggcaaaggncttttnnnnnnnnnngcgcaagcggacggaagtntccgcgacacatccagggcatcaccaagccggcgatccggagctggccaggaggggccgcgtgaagcgcatctcggggctcatctacgaaggagacccgcggcggtgctccagatccttcctcgagaaacgtcatccgngaggccgtcaacctaaaacggagnangcccgccgcaanaaccgtcaccgccatggacgtcgtctaagcgctcaaagccangggcgcaccctctacggcttcggggggctaaggttcccngggtncccttggtggcaccaccantntnggttccngccctctcnctcnnntggccccncctganatgntgcncctggggaaaagggatt

SEQ ID NO: 26642 - DNA, 570 bp, Triticum aestivum
  unsure (1)..(570): unsure at all n locations
  Clone ID: PAT_TA_26642
cgaaacaccacacctctcctcgtcgaagcagcagcagcagccgcggcatccatggcccccaaggcggagaagaagccggtnncnnnnnngcgagagacgacgcgcgagagaccaggcgagaagcggcgcggcgtcaagaggcggcgagaagaagggagaagaagngagatgagcgtgagacgtacagatctacatcttcaaggtgctgaagcaggtgcaccccgacatcggcatctcctccaaggccatgtccatcatgaactccttcatcaacganatcttcgagaagctcgccggcgagtccgccaagctcgcccgctanaanaagaagcccaccatcacctcccgggagatccannaactccgtccgcntcgtcctccccggggagntcgccaagaangcgtcttcgagggcaccaaggccgtcaccaagttcacctccgctnaaanaancnggtcccngncttcctttgtcgatcgntngnnnncngtaanaatcaagngttccggaccaagtcgtcttgtaanngtttcataancttgtggaaaannaatggnnnttcnttnatt

SEQ ID NO: 26643 - DNA, 392 bp, Triticum aestivum
  unsure (1)..(392): unsure at all n locations
  Clone ID: PAT_TA_26643
ttgcaacatcggcatccatgtagtgctgcgtgatactactgggtccacacacatgagaactcatctgtcagactatgtttcgcccggaagtctggctanctttttgtacgntcggccggggagganaaggcccnccactgncctggggggnangggntcaaaanngccggttnnnntnggcacnntggcctaaattaacnccnntttcgnccggggnaanngctccatnggggnncctccaagggcnncaaaatttttntnnggngggcgtttnnctnnannnnccgcntcncggntanntnnnnntnncgccngttgtnccnnggcgggggtnttnnnaaaaantttttnnnnnngggggggnggggnannngnncccgcngnnngngggg

SEQ ID NO: 26644 - DNA, 491 bp, Triticum aestivum
  unsure (1)..(491): unsure at all n locations
  Clone ID: PAT_TA_26644
ccaccacaccgaggccaagcgaagatgtcgggccgcggcaagggagggaaggggctgggcaagggcggcgccaagcgccaccggnnntgtnctnnggacacatcaggatacaagcggnatcngngtgccncgtgcgcgtgacgcactcgggctcatctacgagagaccgcgcgtgctcagatcttctcgagacgtcatcgcgacgcgtcacctacaccgagcacgccgccgcagaccgtcaccgccatggacgtcgtntacgcgctcaagcgccagggncgcaccctcctannggattctgcgggntanggccacgcgaatcgaccccccccaccaccagatttgtgctagnagccnaaccnaangggcgctgtagnggtcccngggcntttngtttattnggcggcatcntngctgctgtatntccnnnccttnntgntgntttgangtagttcnggggggggaantnaaantgaagntggnttacctcg

SEQ ID NO: 26645 - DNA, 471 bp, Triticum aestivum
  unsure (1)..(471): unsure at all n locations
  Clone ID: PAT_TA_26645
ccttcaagaagaaggcaccaaatgccatcaaggagatcagggaagtttgcacagaaggccatggggaaccaacgatgtccgcatttgacnnnnnngctcnanagcacatctggagcanggcatcaagagtgtcccaagagagtccgtgtcaagattgcccgcnagaaggaacgacgaggaggatgctaaagaggagctgtactctcctggtcacaagttgctggaagtcccccanggaangtcttaaaaggtttngggnacaaaggttgttggaggatgaaggactaaaccccctgtntgtcgtatcgatcannttatgaacattaatncatcatctgntggggagnatattgggggagtcnttgcttnagcnttaatnntcanctacnngtccatgatggtnccncgacttccttngtagaagaatttntngacgttggtgaatttcgttccaanngcttggaagnnttt

SEQ ID NO: 26646 - DNA, 390 bp, Triticum aestivum
  unsure (1)..(390): unsure at all n locations
  Clone ID: PAT_TA_26646
agagtgcagagctcgtcggtgctggtgaagctgggcggcgtggcgctcccgtcagcaccaagagaggtcgcgggaggccaccccgctcaggtcangcagctaccgagagcnacatcatccgtgtcgagagcgtcatntagangtcgcgcacgaccaacttgagagctacngnngcgctcctgtgctatccacctcacngactcgagagaatacttgaggantcangagntntgagntctttttggctttanatnggngggcctnnatanaccatnagnntcnggggagacagncnctnatnantatatgagcnggagganacacntgctgctctagactctcnncacataggnntnggagtctgagaggtnccncacaccatttttatcc

SEQ ID NO: 26647 - DNA, 325 bp, Triticum aestivum
  unsure (1)..(325): unsure at all n locations
  Clone ID: PAT_TA_26647
cagcagcccgcntcanatcccacccaaacccagcctccccacacgctccaaccaccagcacgcatggcacccaaggcggcggannnnnncccccnnntggccgcggagaagaccccnggcgggggaagangccccaaggcggagaaagcngggcnccggcgtccaaaggnnggccggcggcgaagggcnaaacnaaggggcaagaaaaangggcnagcaaangccnaananngggngtggngacngtacaaanntttacnntcttcaaaggngctgaagcagggtgcnccccngncggtagggntctcccnccnaaggcnntgtc

SEQ ID NO: 26648 - DNA, 574 bp, Triticum aestivum
  Clone ID: PAT_TA_26648
gcgttccgattacgaccttcaagtggccaatgggtgacaggcttccaagcagctgctgatactgtcaacggtttctccttccatccataccttcctcttgctacaacatcgtctgggcacagaagatttggtatggaagatgaatttgaagaggaatcgagtttggcaggtgatgagaactgctgctctgtctggaagttttcttgctcacaagaatcttgaaacatcaaaccctgagctgtggagggacagttgaacattttggacagcagatgctggaagtacatggtgtaatgcgatcaggctatagctgtgggtgggcaagaactggatgcagaccgctaaaacgcacactgtaccaatgagttattagagagttcaccggcttatcctgttccaggcagacaacttgctgtgctgggtaacaagctggtaaaccatgatagtacgattgttttttggggaatatgagctgattttttttatcatggcatgtatcgatgggatttgcgtgtataaacaccttgtatgctggtcgattaggcccccattcaattcaaagtcttatttactg

SEQ ID NO: 26649 - DNA, 450 bp, Triticum aestivum
  unsure (1)..(450): unsure at all n locations
  Clone ID: PAT_TA_26649
actctccctatccccgtgtccagaatctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgttgaggcttgcactggtgtgaatgttgcggttatggttggtggattccccaggaaggaaggaatggaaaggaaggatgttatgacgaaaaatgtttaatctacaaagctcaagcatctgtcttgaactcatgcagccccaattgcangntttggttgtgcacccagcaacccaatgctt

SEQ ID NO: 26650 - DNA, 922 bp, Triticum aestivum
  Clone ID: PAT_TA_26650
tggggtggctggggcggcggcggcggtggggggcgtgggggcggttaggggggttgggaattataattcaggggaggagagtgggggtaactatggtgcccctcaaggcgggcaaggtggctatgggggtgatgctggtttcgcaggggttggtggtggtggataaaatgctggtggtaccaaggtgcctggcggcgatggcaaggttgctaggggggtgatgctggtttcacaggggttgggggtggtgggtgcagtgctgctcctgccagcaactatggcggcaatagcctgaatcaagggggtggagcacctcctgcatttggaggtggaaactatggcgcaggcaacgacagctacgcaaacgatacccctgtcgatctgccccctggtaagctgcgatgacctgcttgaaggatctcaaactcgatgttggtggtaaggaggatggggctggggagggacgctgggcttggttgacgcatgacaccaacgagaagagaaggacaggacgacttgcttgccgacaacttccagcaaggattaaggatgactacgccaaacaagagaagctgaatgtcggtccagcaagcagcacaagccgaataattttccatggtatgtgttctccagtgaccgccttgtttttggtatgtcctgttggatgaatgataataatgtagtgcttgcaaacaagttatgttcggtctcttagctacgttctgtacgtctgttttgtgtactgtgtgctggattcatgcgaacttgaacctgaactctgcatgtattgggatgctgtgaaattgcatcttcagtaactgcttgttatatcagttcccttataaaaaaaaaatcagaacttctcgtgccctcgcccgcggccacgcggctcgcttgcgaacccctctggcgatccccttga

SEQ ID NO: 26651 - DNA, 556 bp, Triticum aestivum
  Clone ID: PAT_TA_26651
aaaatgtgcagtccaacactgcatcaccactactacctccgtctcgggttaattgagtgcatgcatgcgtttaggctttgtaaactgccgttttgtctggctgcatgatcgcgcttttccagtagatggtttgcatgctcgcgtggggttattaactacagcgatttggttggctgcatgcactcggctgcagcaaacgcagtgaaagggggatgggaatcgagacgtgctgctctggctcacaggaccgataaacccggaccatacaactctgggtcgccatgcaacactgcattttccttcgctcagcgctacttctgtcaagcttgggctacacaatccatttcctggcggctgaggggcggggtccttggtacggttggggtagccggcttgccgtggtccccctcagccccacgccccgctaggggattgtattatctggcaaacatcaaatatcatactctagctagcaaccagcactgcacaagcacatgtaatcagctaatgcatgttgaattagtgtagttcagaagtattatttttgcgttcccct

SEQ ID NO: 26652 - DNA, 855 bp, Triticum aestivum
  unsure (1)..(855): unsure at all n locations
  Clone ID: PAT_TA_26652
gaaaagcttgccagtgtcctgaatgcagctgcagagatacatggggtggctatgattgttcgtgcggccgcccgggcaggtacatcaaggagcacgacacttgcataagtaagacaacagttcaggctaaagcagcatgggctgctgtgtgggggatcttggtagccttggttattgtggcggcaggaagctatgtggtatacaaatacagaataaggtcatacatggactctgagattagagctatcatggcacagtacatgccactggacaatcaaggagaggtcccaaatgattcacacgaagatcatccacttgctcactaactgaacctgtacaactaacataggcagaatgtggtttgaacagcgttgaaatatacagaatgcataccaaggtgaatggcagcatgattttagagtctgacatgaatgtgagactcacgtacaaatttatctacagtactttcaccttagaggtcacggcaactccatctccggtaatattaacagattctataatgagcaaacgttcgctcagctcgtccctggcgcgacccaaccacaacatgtggggtagttagttgcatacatgcatgtgatgatgcaagccagtttcacccgtccttaaaccaatgtatcttgtgggttcctaaccgtaggcccatccctctgtgtccttttgtgtgacgagtaatttcgaacggagggaatagaatgtagaaggtctagagacctttctcttaattatccaccatctttnatctgtaacgaagctgtacttatgtatataaacgcatccttttggattcaactagtgctgcctattatgatcattatagcnntagtgctactc

SEQ ID NO: 26653 - DNA, 1142 bp, Triticum aestivum
  unsure (1)..(1142): unsure at all n locations
  Clone ID: PAT_TA_26653
tagaaaaaagcccatacacttggaccttctccccttcccttcgccacccggtgatctcgccgccgcgacgcaccaccgccggcgctgacctgccgtgcccaacatccgcctgctcgaagtgcctcctgtttttgcttttatttggagcgtctcctccgtgctcagcgggctaccgccctgcagcagatcccgcggccccgatgcctcctcccgccgccccgacgcctcctcccgccgagccgctgccaaattcgccagattctacctcccccacggaggaggctgaggcggatgcgggaggcacgccgtcgagggccgggccggtggggacagtaagctggggaactgggaccctcgtcggcgtattcaccgggcttctctacggcggggccaaggaggccaacgccaacgtcagcaaagatgctgaagtgatgttgaagatgggaagcaccacagacaagcgcgaacagtataggttgatgagagatgccatggagaaaaggttcatccgggttgccaaaggctcactagttggtggtgctcgccttgggatgttcactgcaactttctttggcatacagaaccttcttattgagaaccgtggggtgcatgatgtattcaacattgctggagctggctcggctaccgcagctgcttttgggcttatattgcctggttcaccaatgtggcgtgcaaggaatgtattggttggatctgctctcggtgccggaatttgctttccccttggttgggtacagttgaagctggcagagaaggccaatcttgagattgaaaattcaaaatcgccgtcagatttacaaggcaatcaaagtcgtgtgggggccgcgatagacagactagagaacagcctgaggaagtaacagtttgtacccatgagaggagccaaggatctgttgtcaacacccacagctatttcgcttttgttttgttcatgtacttttcataggaatgtggttactttttgaagtggtaatggcagcaagggaaactctcttgtatgaagataaatttggatacaaacactcttacttgctggagctgggatatttctagttaaggtacctgtttgggtgtttgtgccctcgaggggggggcnngtacccantttcggcccnatattg

SEQ ID NO: 26654 - DNA, 1828 bp, Triticum aestivum
  Clone ID: PAT_TA_26654
ctccgcgcctccctctccggcgcctcgcccccgctcgtcccgactcgcgcgcgccgccgccgcgtccttccgccgccgccccccgcccccgcgtcctccgcgcccctcggcccgcgcctcccccgccccctctgcgcccggcggccacagacacttcccccttcgcccccagcgccgtccgccccgtcccccccccccgtcgccgccgtaggcccgccggtggcctgcggatagggcctctacttcctcttcgtcaagtcggagaccaagaccccgagcgggctgacggcgcggccagtgctcaccagctactacaagagcgagcagttcaagaaccgcccctacgacccctaccacaactacaccagcccgacggcggccatcctctgcgccgacgccttccagagcatgtacgcccagatggtgtgcgggctgtgccagcgccacgaggtgctccgcgtcggcgccgtgttcccctccggcctcctccgcgcgatccgcttcctccaagctcaactggaaggagctcgccgccgacatcgaggccggcgcgctcaccccacgcgtcaccgacgcgtccgtgcgcgaggcggtcgcgggcctccccgggcccctgcccccgcgagccgggggcggccgcggaccacggtggcaacgacgactgggccggcatcgtcaggcgcatttggcccaacaccacgtatctcgacgtcatcgtcaccggcgccatggcgcagtacatcggcaccctcaagtactacagcggggacctgcccatggcgtgcaccatgtacgcgtcgtcggagtgctacttcgggctcaacctccgcccgctctgcgacccttcggaggtgtcctacaccatcatgcccaacatggggtacttcgagttcctccccgtggactcggcgaccggcgcggcgtcgtgcgtggacgcgggcaacctggtggaccttgcccgcgtggaggccgggcgggagtacgagctggtgatcaccacctacgccgggctgaaccggtaccgcgtcggcgacgtgctccgcgtgacggggttccacaacgcggcgccgcagttccagttcgtccgccgcaagaacgtgctgctgtccatcgagtcccacaagaccgacgaggcggagctgcagcgcgccgtggagcgcgcgtcggcgcttctccgcccgcacggcgcgtccgtggcggagtacaccagccaggcgtgcaccaagagcatcccgggccactacgtgatctactgggagctgctgacgacgggcgccggcgcggcgacggcggtggacaagggcacgctcgacgcctgctgcctggagatggaggaggcgctgaacacggtgtacaggcagagcagggtggcggacggctccatcgggccgctcgagatccgggtcgtccggggcggcacgttcgaggagctcatggactacgccatctcccggggcgccagcatcaaccagtacaaggccccgcgctgcgtgacgttcccgccgatcatcgagctgctggactcccgcgtggtgtccagccacttcagccccgcgctgccgcactggaccccggcccggcgctccgactagagcgacggcgatcgccccacgaagcacggcgacgtctccgcctgaatcgattcactcgttgaaaattttgggtgttgccgtcggcgtcatcggctagtagtagcagtagcagtagagaacgagagtgagtaccacctttgatgctaggaatgaggctggaatatggttaatggttgatgtaacagtccgattactgccggagtatgattaatgattaatggttgatgtgcttgtca

SEQ ID NO: 26655 - DNA, 655 bp, Triticum aestivum
  unsure (1)..(655): unsure at all n locations
  Clone ID: PAT_TA_26655
cagnaaaactgcccagtgcacaccagtgctagtgtgtgacacgccaccatgaggtctctgcaggctgtgctcgtggcggtcctcgtcctgctcgccgtcgccgcgacgacagacgccgcgtgggcgccgataccggaccgcgacctgaacggcatggtggtgcagcaggcgggccggttcgccgtgctcgtgcatgacatcacgcaccggacgaccctggtgttcgtcaaggtggagcgcggcgagatggagcggccggtcggcggcggcaacggcaccaactaccggctcgtggtgaccgcggcgagggcgcccggcgggaacaagggccagtacgagtgcgtcgtgtggggcgtgcccggctcgcgcaccagcacctggaagctcctcagcttcaaggcgctctagctgcatgcatggccactgagcactcgtacgtgtgagtgtgatggtccgaggcaaagccgcgcgcgtactccgctgaataatctgcatatagtatgtgcatgggttttttaagtactggtacacgtcctttaatttgtaacccgcgtaggcacggcaaatacctgtctgcgtgcagtccgcacacactagcgccggaataagtaagttgtgactatcacccagtatatttttttttgtcatcactgcc

SEQ ID NO: 26656 - DNA, 412 bp, Triticum aestivum
  Clone ID: PAT_TA_26656
gttggcttctcctccccttccggttcgggttctggttcggttcgggtccgagagtagctagcctagtctagggtttccgtagttcggagaggagagaaagggagagatccatggcggagacggagtaccgctgcttcgtgggcggcctcgcctgggccaccgacgaccacaacctccagcaggccttcagccacgtacggcgagatcctcgacgccaagatcatcagcgaccgcgagacgggcaggtcccgtggcttcggcttcgtaacgttcggcagcgaggagtccatgcgccaggccctcgcggagatgaacggcaaggagctcgtcgggcgcttcttcgccgtctgcgaggccctgtcccgtcggtccggcggtgggggcggtggcggcggcttcggcggcctgcgcg

SEQ ID NO: 26657 - DNA, 168 bp, Triticum aestivum
  Clone ID: PAT_TA_26657
gcgtttgttcagatagccaacataatgctgaacataaagatgtgaggtatggcagtccacatgaacaaattaactgtccgacagccaatggagaagaactcacgcatatataatttataatctcttactgtcacatgcataagagtaacaaaacaaagaatggcatct

SEQ ID NO: 26658 - DNA, 1366 bp, Triticum aestivum
  Clone ID: PAT_TA_26658
gcacgagggaaagcccatggcgcgtgccgcactcctccgttccttgccgccgcgccgcgtccgcccattttcctcgccggcggcggccccctcgcccctaaccggcggcggctcctccgctcctcgtgcggcgcagggtcgagagcccggaggagcggtcggtttccgaacggaacaagtccccgagttctcccccgaatcgccgatgctgcgggcggcggccgaggcggcgctgcggcgcgtctcgccggccccggcaggacccgtgcacgcgcagtttcgccggggcccggtgctgcgggtggcgtggctccccctgtacagacgcctgtcgaagctgcccccggcggcgccgctgggatgcgtggcggcggagctcgaccggtggctccgcgagagacagccgctctgcgagcaccagctcctcttctacgtccgcaagctccgcaacttcaggcagcacaggcgcgccctcgagctgatagactggatggaagctcgtggggcatacttgcttcctggggatcatgcgctgcggcttgaccttgtatgcaaagtgaatgggctagaagctgccgaagaatacttcttgagtcttccggatatgcataaatcagtgaaaacatattcctctctgcttaactgctatgcagaacacaagccagagaaaggtctggaactgtatgaaaagatgagaaccatgaacatcgttccgaatacactggtgtacaagaatttgatgtccttgtacctgaaagcaggccagccagagaaagtcctcaaaacatttgaagaaatgcgaggaaatggcatacgaacagataattttacatactgcatcctgacagaaggccatattatgcttaatggcccagaatccaccgagaagttcctggaagattcgagaagtcaattccggttcactggtccatgtacactgtgctggctaacaactacaataaagtggggcagtttgacaaggcggaattagccctaaagaaagctgaggaagtcatggacaagggtgagatgtttgcttggcataatcttctctccctctatgccagttccggcaatttgtccgaggtcaagaggctttgggtatctctgaagttagcattgaggatatgttcaaacagaagttacctagtgatgctttcatctctgaaaaagctagacgatttcgactccatgcagcaggtcttccgggagtgggaactcactcaacagagctttgatatgaggataccaaacgtgatgattcaagcttaccttgccaaggacatgacagacgaagccgaggctctccgccaggcagccatggcccaaggccggtccaatcctgtgaccttctacatattcgctg

SEQ ID NO: 26659 - DNA, 805 bp, Triticum aestivum
  Clone ID: PAT_TA_26659
cctccccgccgtgggttatcacaacgaggtgcgcgtctgcgggaagttcgaactgcctccctccctccccgcacgatgatgggcgaaggaggtgcgcgtctccggcgagttcatcgtgcctccctccagttccatgctggacgacgggccgttggccaccggtgagcttgcttccttggcttgctttctgttttccttgattcagtttatgatctcctgctgctgatctaggttggcggtcgagccgcaatcttaatttggagtgtgtgctttcgttggtgccgtcgctctctcctccatgaacgtcgtcgtcatgagcccaagtatcttggctgggtatcgacattttggtgcaactagttattgcagagcagacgagtactgaaagcagcagcgtgatgtggcagaaaaggtggattgtagcaccagcgtgaaagtatgtactccctccgtaaactaatataagaacgtttagaatgctaaaatagttatctaaaccctcttatattagtttccagaggagtatataccaatttgcctaaaaaagagaatgtctagaactgaaaagagttctaacttttgctttatgtaacattgcactacattcgagaataacgatggatttggttacaaatactctgctgattactatgtgtatgtgctatacaaaaaaaaaaaaaaaaaaaaaaaaaaataaaaaaaaaattcaaaattattcactcacccgttgcagtgtaggtaatatatattgtaaataaattaccgtaacctttgcacttttgttgaacatactaaccttgcacca

SEQ ID NO: 26660 - DNA, 941 bp, Triticum aestivum
  Clone ID: PAT_TA_26660
gcctcaaccatgatgctggcgaccaggtagaccggcgcagaggcacggcactggcatcgggaccacacgcggacaaccaggttctcggggttctgcaagcgccggtgggcaacacgacactcttcgacgggcctcaacaactgggaggccatgaacagaaggtcatggggcggcaaggcctccgaccatgactctggcgaccatcgagggtgtgcagtgaggcgaggtgctctatggtcatgccagctcgagtagccctcatcgcggctcggggatccactccgagtcccatggcctggacggcaacgactcactacaggtcggggcagcgcctccggacaccacagtgccggaatgggttaagacccagcggaaggcactccgctactcaagtgatcccgtccctccgtcggtagcgctttcctccggaccaacgttctcgggggcctacgattggttgccggggaaagtcgggtgtgggggagccccacccgggcaaccacgtcccgtgcgacgccggtcaagcccgtgcaagttggcacggcaaccgcggccccgacatcctcgggacccgacaagcccgtgtcgggaggcacggcaacgacgcatccggtgggccacgtcccgaccatgatgctggcgaccagtgagcccgtgcgagaggcacgacattctcaggtcggccacaccccgacaaccaggttctcggggttctgcaagcccgtgtggccgacacggcactcttcaacaagtctcaacttggaggcaatgaagagacggtcatggggtggcaaggcctcgaccgagactacggcgaccatagagtccgtgcaggaggcacaacactctctggtcggctatgccgcgaccccgacgcgctcggggtccatcgagtccgtgcgggacgcacgggactctgtagttgggcacgacccggctac

SEQ ID NO: 26661 - DNA, 1383 bp, Triticum aestivum
  Clone ID: PAT_TA_26661
tgtgttttttctattttcgtgtacgcgcaatcacattgcagcgcctacgctttgacctttttttgcctttccggggggtttttaacacggggaaaacaaaagggaaaagaacgaaggtataaacaagaaacggcatcaaaggaggctggctaaaaatattagtctgccgtgccgtggcacgagacaagaagattttttttacagtatatgtatggtgcttcttgtctcttttttcctttctcctgttctgttcctggaatatctttacattacaatgcacttctctttcttcgactcggttcttgcaggcggtgggacatttgacctctgccttgggccaacaacaagtcctggccggcctgatgattgattgggtgtctggtgtgtttgcgtctgttgctgctgttgttgctgaggctgctgctgttgtggtggaggctcctgtcgttgaggttgctgcccaaactcctgttgttgaagtgcgatagctagctctaaatccgagtctccagatgagttcggcagagtggaattgtcaaattgagcaatatagtcagcagtagtcgtcatggcctgctgttgattccatgaatcatttctgggactttcagccgtaaatggcgtgaagttactagtgacaaaaaccccgatctccattcacctcatccaacttttgccataccaaatcagtttggctgaaaaaaagctgatcagttacaaaccgtgattcacttgcgaagtgctttagcatactgttatacttgaacatagtgttgaagtggttattgcggaagaagacccaaagctctctttccttaagaccctcttgtagacaaaacaaaccatagacagtcagctggttagcagtgctctgtagaaaattatcaatcaggtcccattgatgatctgcagctccattttccaagcattgactactttccgcgatcttgtcagcctgctcagcaagaaccacctcaccctcatacactggctcctcagtttgaaatgccatgtttccactgccaagtacgtgctcttctccttgatagattggctcattcccctgaatgcttgaagaggcaagcacagcagtgtctagagaagcaactttctcatcctgctcaggtatagcacccataggagtagcttgactagttccagttgctgagtcacagctgttctcagtatcagaaacctgaggggcagtatcataagcctgaggttcggttccccgaggctagttttccctagttacagttgccgagtcacagctgttctcagtatcagaaacctgaggggcagtatcagaagactgagtgtcatgaatttgcatagtagaatgttctctgcaggttgttatactagctcggacgcgtgggtcga

SEQ ID NO: 26662 - DNA, 1340 bp, Triticum aestivum
  Clone ID: PAT_TA_26662
tggtggattagccctgccgcctcggccccttcgtcgcgtcgcccctctctagcgccactccggccgtccgcccacctcgacctcgcctcctccgtcagtcgagccgtcgaacggcgcaaggctgttgggacttgggaccagccacataatctcagatggctgaatcctttgtgctcaacaccggcgcaaggatcccatcagttggcctcggcacggcgacggggaaagccgaacccggcgtcgtacgggaggccgtctacgccgccgtcaaggctggatatcggcatatcgactgtgctccagcgtaccgcaatgagaaggagattggtctcgctctcaagaaattatttgatgaaggtgtggttaagcgtgaagatctatttatcacttctaagttgtggtctggtaatcaagccccagaagatgtgccagagggcattgacaccactcttcaagatttgcagctggactacttagaccttttccttatccatgctccacttcgttcgaagaaaggtgccatcccaacccctgaaaactttcttcctgttgacattcctgctacttggggagcaatggagaagttatatgcctctggcagggcccgtgcgatcggtgtgagtaacttttcttgtaagaggatggaggatttgcttgccattgcaagtgtacctccagcagtcaaccaggttgagtgccatccaggttggcagcaaatgaaactcagggaactttgccagtcaaagggtgttcatctttctgcatattcacccttaggaaaacatggatcacctggatccatgggtccaagctttcttagcaatcccattgtcatctctgttgcggagaagttaaacaaaactcctgcgcaggttgccctacgctggggtcttcaaatgggccagagtgtactcccgaaaagcaccaatgaaacaagaataaaggagaacttaagcatatttgactggtctatccctgaagatttgatggcgaatttctctgaaattcagcaggttaaggtgctaagagctgaatttgtggttcacccccaaggtattttcaaaaccgtggaggatttttgggatggtgaaatctgaagcgtatgaagtgctgcacagaaggcattgcattccagcatgaaaccgtagtcgtcgtctgattttgtatttgcatgtagatgcttcttgtagagaagaaactgaaagcatattggctagatcatctgtcttcctctgtaatttttactggtttactatgattatcggatccctttatccgggaatatctcattttcaagtgtcaatacaggccgcttcgtttaccgaagctcaggaatctat

SEQ ID NO: 26663 - DNA, 829 bp, Triticum aestivum
  Clone ID: PAT_TA_26663
acacagcgcacaaacaaacacgagggtgaagaagagatggatccagccgagggccgaaggatactggtggccgtggacgagggcgacgagagcgtccacgcgctgcgatggtgcctcaccaacttcgccacgcgcggcgacggcgagcttgccccaccggacaccatcctcctgctctacgtccggccgacgccgcccacctactccgtgctcgacgcctccggctatctgtttgtcaatgaggcgaccgccgcgatcgacgggtacagccgggcggtggcggacgcggtggtggacaaggcgcagaagctctgcgcgctccacagcaaagagaacggcgaggtgaaggtgaaggtggatgtgaaggtggcggtcggggacgcccggagcgtcatctgcgacatggtggacaagctcggagccgacgtgctggtgatggggagccatggctatggatttttcaagagggctctcctcgggagtgtcagcgactactgcgtcaggaacgccaactgccccgttctcatcgtcaagttgaaataacagggccaactgttcttgggagattagcaatgatgcccgtacttgcatttgctgtttggcattaaatttctttctactactatttactactgtatttgttatgcctccttttttttttcttcacttttggtcgcttcgcgtgtaacctgctagaggagctaaggggaagtgccaagcaatgtgtctcaagatccccgcgacttgtatatatgccgctgttactgctcggttatcggttaatttatcgtattggacatgttattaagcagcttgtcatactttcatc

SEQ ID NO: 26664 - DNA, 550 bp, Triticum aestivum
  Clone ID: PAT_TA_26664
cttccccgcccactattgccgatggcctgctgctgcagcttgccactgctacggatgggttggctcccgatctgaatctggctttgctaaccagccgctggcgggttccgttcctgcagatcctgtggtgcttgggtcaccggagcctgccgagcaccaggtaggggatgcgatccccatggaggctgtggtcgcttctcagtccccctgctatagcccacacatcaggagcgcctataatggggtgcgcatcagcacggtggagcgagcttccaagcagaaagcgacgtctgtctcgagctccagcagtggttcttcccgccgctttggcccttcttcttcgcggggcgagaaggcaaatgcggctgctgttgctggcctcctggagctgctgctgctggagaccccaactccgatgaccaggggaaagctgaagcaaattgctcaccgatgcgacctgaacacgacaaccatccttgatcaagcctgggtacttgccaatggcgccgtgtctgacggagcagtagcttctcctcctgtcaacggatcc

SEQ ID NO: 26665 - DNA, 768 bp, Triticum aestivum
  Clone ID: PAT_TA_26665
cactatggctcatgcctcctcagtacgttgctgagcgtcctgattttctttacataccatcggttactgatcacagtcttcaggttttagctctcggttgtcctatgcttcagagcgttgaacttacatttcatgagggcacattctacttgccagatataggcttaacactagagtgtgttaggattctcattcagtcttgtcagattcgtgttcttgtgcttaatggagctgacttctttgatgatgaaggaatgatggtactttcatcctcaccattcctggagacactcgagcttgcggtgaacgatcaggtaactgatgctgggatgcattccattgcgcgcaccccttgcttgaggagtctgacactccggttgtgtagtcaggtgactgatgctggattaaccgaactggtacattcacagaagttggattctctgaccatcgaaggctgtgcttgcatctctccgcaagttgcccaaggcgcagctagatcagttcactactctctggagtcagcaagcaggagccgtctcagtagaatctaaacataatgctattggtcaagtagttaaagttattttcggttgtgcctcatttgtggatgtcgctgtcattgaccctgctatcgttttcatcatttcttagaacctgtgtctaatggtcaactttggatccaatgcggtgaatgaagactttaaaattgtctgttactggtgtactgaacctatttatgttgttttgctcatgtagcataatttctcc

SEQ ID NO: 26666 - DNA, 478 bp, Triticum aestivum
  Clone ID: PAT_TA_26666
ggtccacgggctggaggaagggttttccccttcttggacccttcggcctccccagttggggcggccttccttttcttcccttcccccgctagagggggaggggtctattcttcctcctcctcatcttcatgggaggagtgcgtcttggagtcgtcggatgagggatctgacacctccaggtggcaggcactcttccgagtccccgtggccatcttcttgaccttcttctccggcaccacatggggtgccgaaaccagcagcttcgccaaacgagcgtccgctgggccttcgggcaaaggagccggatagttgatctgttcggacgtctcctgccaatcctgtcaaaggtaagggagcttagatcccgcatggagtcaaactatgaaaaactgataccctataaaaaaaaaaacagcttaccacatgagtgtgacgctgcgtactaaatccgcgatcctcggtagcggatgcggggggc

SEQ ID NO: 26667 - DNA, 1225 bp, Triticum aestivum
  unsure (1)..(1225): unsure at all n locations
  Clone ID: PAT_TA_26667
ctgctcagctgcgtcgcctggctcggcaccgccatgctgctgctcaccgtctactacttcaagcggcctcgcccggtctacctcgtcgagttcgcgtgctacaagccggaggaccagaacaagatcaccaaggaggccttcctcgacatgaccgagagcaccggctgcttcaatgacgggcccctcgcgttccagaccaagatcaccacccgctccgcgctcggcgacgagacgtacctgccccccggcgtccaggcgcgcccgccgaggctcaacatggccgaggcgcggctggaggccgaggcggtcatgttcggctgcctggacgctctgttcgagtccaccgggatcgacccgcgccgcgacgtgcgcatcctcatcgtcaacttgcagcctcttcaacccgacgccgtcgctggcgtccatgatcatccaccattacaagatgcgggaggacgtcaagncgttcaacctgggcggcatggggtgcagcgccggcctcatcgccatcgacctcgccaaggacatgctccaggncaaccccaacgcgtacgcggtcgtcctcagcaccgagaacatcaccctcaactggtacttcgggaacgaccgctccatgctgctctccaactgcatcttccgnatgggcggtgcggnggntctgtctcgaaccggcgcgcggacgccgggcgcgccaagtaccgtctnctgacacggtccggacgcacaagggcgccacggacgagttgcttnaagtgcgtgtaccacgcgaggacgacgtgaccnangtgggcgngtnncttgngngctggnagcttangacngtggcccgnngacgccgcttnaangaacnaacattaaccnncgcctggnggccgcttggtgcntnncccttgaaccgaagcaaattaaaggttctnntnanagttcncntgnatgaangcctacncggcttgtttcccnncnnccnaagggtccnnatggccgtccnccttaannttccccnaanatttttctcgggacgaaagccncttntgaaagccaactttttctgnncgntgctancntcncnggatcngggnctcgntnccgcatcgtcttgngcaatgngaaaggtgnccaaatnggacataccctnggaanaccctggggnangggaaatanagggggnaccnttagngaannncccntatacctcaggtgtncncccctattttgcgaaccccga

SEQ ID NO: 26668 - DNA, 709 bp, Triticum aestivum
  Clone ID: PAT_TA_26668
agcacttccaagttgtactcttaaatgttacagtacacgggatcggttaggtgcggtttaaaggaggaatcatgttttttactcctctaaaactttgcaaggaattaagctttacaagagatcggttataacttctctagcagcatgctactgctaattataagtgtaagcagattacactttgcttaaccaaacaccgacgaagacactcctctcatggttaataaacaagggagatacatatagctagccccaacactccttcggagttaaaacactaacaagccataacccgacaagcgtgcaccatttaccaaacacaagatcagaccttctgcttcttctgatcgcaattcatcagagagaaccatacattacccagagaagttcagaagagaaaatggaagggcaaccatgcagtacacttcctgtactggattgctatataaagctgcacatgcattagaagttcttcgtaactcaaatgcgcgtaatcagtagctccacaagctgacctcgccgtcatcgtcgccgtctccgacagtcgctgaagggcctgccatcggaggaggggcaatgagcatcccctgcgccatgtcgaggtagccctgcatcccgaagtccatcccatcgtccatcccatagtacggatcaccggcgaactgctccgttggtgcaactgctacctccttcggcggccgcattgctc

SEQ ID NO: 26669 - DNA, 1052 bp, Triticum aestivum
  unsure (1)..(1052): unsure at all n locations
  Clone ID: PAT_TA_26669
ggcacgaggttggaggctgcggttccaaggctgccacggcaagccgtcgttccaccaccgccttccccgccgcgtgcacccggacgacgccctccaagcctggccagcgccgctcctccgcccttgagaaggatatatcagacacgggccttgatgctctgaaaaaatgtgggtattaacttctccatcttttgtgtccctaattgcctgacctgttcgcaaccataccagagaagctgcacatgcttgtgctttgtcaactgagatgcatttttggctatgtagacgatcaagaggctatgttacgaaacatttattgagcaatgtccatttgcacccgagaaaaacagatcatccacacagcagtagccctcacgtgttcgtggacatggtgcgtaccagcagactgtccatcgccttgcttggcaccggataattattttgttatctcttttcaattgtatctgctgatcgttatgattttgtatatgactgcaaacctgaaacaatgtgtctttgctgaaagtctccattagatttagttccatgatatgtacaattgacaagaatattcagttaatgtgatttaaaaaaaaaaaaaaaaaaaacttccgagagtacttttagggcgcccgcccgcccggcccctttccgccccgggccgcccccccggggggggggtccccggttcgcccttgtgtcccccgtatttccgtcccctgggccggcggggaggtccgtcctgactgcgctgggcccggccgtttccccaactcgttccggcgttttggggcatcccccctggggccttctgcccctactttncatttaacccccgcacccgatagcccccccccctttttttcccccagcctggggtgggagaaaaggccnaaacccaagggcccccgccgcccgaagggggcccatcctcccattttaaatggggtgcccacnccttnnaatggggnaaaagggggaaaaacccaantttttaaaaggggtnatnaaanggggggnaaaanacaacgggnannttaaanngggngggg

SEQ ID NO: 26670 - DNA, 538 bp, Triticum aestivum
  Clone ID: PAT_TA_26670
atatccagcatttatcatagtattatcaacccagaaccaagtcattacataggtagcataattataaaataggagatacttattacaatatagcataacaaggcacagcataattatactgataggtccaattagataacatagatagcactactcttcaacacttcttgcaaaaaaaactcaggcatcactcggtaacaacttgcggcgaaatcattgagtttaacctacagctactgacaaaagcaatgtaaacaccatatatgcaaaaaaaacgcagactaagggggagcacaacttgcggcgatcccattgagtttaacattgtctttccagcctcagtgagtgaaaaaataatcactgcgtttccatagcaaccacccttgagacacatggctctcttcatcatttggcgcctggtggatgccttcggtaacacagcacttgaggattgatgtattccccatcacacagaacgaactcctcaggggggtggcggctgcaccgtggcagatcgttggcgtaacgcctctgcccc

SEQ ID NO: 26671 - DNA, 820 bp, Triticum aestivum
  Clone ID: PAT_TA_26671
aggagtcgacctccggcttaggagcgtcgcgcacggtgcgttcccagctcacactcgatcatcatctagctacacttattcgaagcctggatctcaatttccacagattttacatcagcataggtacgtacgtataaagtgtaaccagaccgtaaacaagcatcctcgggaccgccaaaagaatctctcgtggggagctcaactgctcgacttaagaactacgctcgcccttctaccgaaacacatttttacctccggtgctggccgaccgccaggtccaccgcgccgcgcggcatgccgtgggcggacagccggtgatcgtaccctcctttgatgttcaggtccagcaggagcaggtcctcgtcggtggcgcatttcacgtcctcgccgccgtggtagagctggaagcccaggttgccggctctgaggccgtcgtcggagagggccttggccagctccccgccgttctgctggcacgcctgcgtcgcgtcgtccatgaaccccgagagggctaggttgaagtcggtgagctgcgacctggtagtctctagggttgcgtctccgccggcttcgtaggagaggttcttctgggccttctccaggatcgtttgcaggtacttcccttgcgcctcgatgcgcatctgcagcttcttctgaacctcgagctgttcgtgcagcttcctttggacttcgatttgatatcttaaagcatccgcgagtggcgtttctcccttgttgccgtttccggccgacggtgcgtttgggggcaccgccgtcggggagctgttgcccggcccggccaaggctcctcgtgccgaat

SEQ ID NO: 26672 - DNA, 590 bp, Triticum aestivum
  Clone ID: PAT_TA_26672
ttttagaaaagcacatgatagtccagattaacatgtgacttgatagttcagatactaagagtaacatgcgacttaataattctaccaagagtcgaaacgaacacccataaggttcagaattacagtccacaatgaatttaacacgacattcgaagttcaattatgtcgaccccaaaatacaaacaaaaagttcaattcagacttcctgttcttcaactcttcagtcttgcaccaaaagtattgaatcgaacagagaccttcacttcggacttcctgttcatccacccgttagtcttcatcaaaccaaaagctcttttgctcccatgccgcttaacttgtcaattgtaaaggctggtgaccttcttgaccttcttggcttgcctaacccgttcagatctacggttcaccaaactaccatcacttgttacctcaacattgtttccaacttggcttgttaaatccttttcaatttgcattggcgaatctcctctatcagattgacttgcaccatcatcatggctatcatcatcatcatcaatttccaggtccagctcctcattttcttcttcatcatcctcactatcatggcg

SEQ ID NO: 26673 - DNA, 547 bp, Triticum aestivum
  Clone ID: PAT_TA_26673
gaaacgagtagaataacccggacatcgcatgcttgcatagtataagggtggggcatctatggcaaattctacaagcgtcgtcatttcccaaaggggggggggggggtaactcaggcaagaatcacaagcgtcgttagttcccacattgtcgtccaaacataactactgggggaatccatgaacttcatattttgaacattgtctgtcacccgtcaggttgacctaagttcacaatctccatttgcaaacttgatgtccaactccgtcaggttcgcataattgaccatcatcgttgctagaagtgcatattcaaatttcagtatctcacatcctcataagtcatcgttcatagtaggaactttgtctgataatgtaaaccttgaacgtcgtccggttgatcagctcgaacaccagacaatcaccatcaaccaggttgtgctggatggcgaaccctctccatccggcactgaggccgttcttaagcgcaaggtagagcgtttcggactcgacaccctgctcatccttcaaagtgagcctctcgtcacgc

SEQ ID NO: 26674 - DNA, 585 bp, Triticum aestivum
  unsure (1)..(585): unsure at all n locations
  Clone ID: PAT_TA_26674
ggcacgagggcagattcaatatccatctagtattggcagagcaagagcaagagcagagcacagctttcttctagcacaaccaccctcctgttgagacgctctatcttgctcacgatggacaaggtgaagagccatggcagcaagcacaagggatcaggaggatgtaggaggggggctgagcaagatgctgaggcaacacaaggccaggctctacatcatccgccgatgcgtcgtcatgctcctctcctcttgatcccattcttcttctttctagcttaggcttgacagattctttggtgcgtgagtacataacatagggtagcttagaaggtcccgatggatgttgctgcaagttttggtgtggtatggtgctcctaagtcctgcaatggcaaggttgtacatgtactgatatgtctgctctatcagcagaagtgaacgatctcaagagaaaaagaggttacccctggcaaaaaaaaaaaaaaaaaaatagagcggcccgcggcccatcgattttncacccggtggggnaccaggaagngtacccaattnncctatagngagnngattacaattnactggccngc

SEQ ID NO: 26675 - DNA, 774 bp, Triticum aestivum
  Clone ID: PAT_TA_26675
tgcatggctgatgttctggtgcgacgtacagcttccctgacgccgaccccagcgtaaccagccaaccactggctgtgcgcaaggaccaagacacaactgtttcccaacttgttttacaaagccggtgtactgcaaatatataaaacaggcgtcaggctgacagtaaagtaacagcagtgctaacagctagctgtacacatgaccatatatattctacattctcttgacagattcaaaagcctctcttccccttaagtccggcttctctgccccatgtctgccagctcttctctggctttactcccgtaggcgttgctcccgaggggtaggggaggccacagggaggccagcgacgctccctgcttccaggttccctccccctcttgtagcttttctagcgcggccacgacctgatccacgcccggcctgcaccgggcgtccattgccagccactgcatcgcatgcgccgctgccgtctgccccgcagggaccgaatattgcgaccccaatcgtgggtccaggacatggatgaccctcctcttgctgttgatgtaaggccttgcccactccaccaggttacgctgtccagccgggcggttcttgtccagagcccggcgccccgtcagcaactctagaagaacaacaccataggtgtagacatcgctcttcgtgggtcaagtggcctgttgcgagatattcaggggcagcatatccttgagtccccatgaccctagtagaatccccacgtccctcgccgctccggccatcttttgc

SEQ ID NO: 26676 - DNA, 1201 bp, Triticum aestivum
  Clone ID: PAT_TA_26676
ggttgattggtgcgacagtaattgcgcgggaaacagttagaccatcgaggctacagaaaacttcgtacagttccggccgacacacggcgttaccaagaatgttaatgtagctaagcgctgcgaactatcggctggccggacaaccaaggtgatcatcgttcctgcagcatggcgctaaaagctgagcgagcctacctctcatatggttcaagcacgcattcggtcggttcactcatctgtgatgatttgaggacgcccgtcgtgctatccccgtttggccttcggcaaacgtcagcagagttcagtccggccgattgactcccttctccctcaccgggagtgtattccgtggggcgagcgggtgaccgcgatggtggacaagtcgcttctcgtcaccagcattgggatggactgcttgctccacgagaaggcgttgctattgttgttgggttcctggtctgtctgctccggccgcgattccgtgtttttgggcgactcgtcgaagtagagcctcatcgtcttgttctcctgtttctccgaatcaactttggtggggacagacccggatgaaccattagagtgcggtggttgcggtggtgttgaaaagggatcatgtatggggaagcacccaacaaagtgcaaagtttccagccataggtttttggtgatccttgtctcattgatgggtcgccattggctgaggttgaaaattgtaaggattcatgggcggtaattgtccaaaacttagcaggccttcaggtgcagaggtatacatcggcctccatgtagggttggctgaggaggattccatgagaggcgggtacaggtgtggtggtgtcgaggggctggccgaggatcttgtcggggcgccggggtagaagagaagctgtggagagcggctggcgaacgagcttgctgtggcgccgggggagtgctgcagcggcggcgaggtggccgatggccggacttgcgcggtgtccttacgggcaccggacttggccatgaatctggtggctttgcgccgcttgccagagccgccgccggccggcaagacggagtgcagggcgccggagctccaaggcggcagggagggagaaggatgaggcccaggcgtggaggaagagaaagtcacacgggtggggattttcttggttgcttcgcgatgcgtccggccgccgccggacgctgggcggacgctggg

SEQ ID NO: 26677 - DNA, 572 bp, Triticum aestivum
  Clone ID: PAT_TA_26677
aaagtataatattatattattgaaatatatagaacatatttagcaatacatcgatcaagacttggatataatctattcacgcccaaactttctccatatatgctcaatcaaatcatttttaagagccttatgcgttggacgattacgaactctaacatctctgtcatgtttccttttttgccatcatgttttataagaggctagccattttgaatcatccttgattttttcccacatagttaaatgttgaaaaggctggtgatagtctgcctgcttgctcctttgtgtacgtacgcatcatcagacagaatcaattgtctagctagtgtcgctagcggctgctgctatatagagcagcaatgtcatcccaaaactgctcagacttctttttgttcccatcaatgggattgagtgaacactccagccaagcacctgccagtctctcatgttcctcgggtgtatagggtagacgatgtgcggtccttgctcccgattcgtcggcatctacactcttgaccttccttttctttttctttgaatcaactttggtgggagcagaccggacgcgtggg

SEQ ID NO: 26678 - DNA, 787 bp, Triticum aestivum
  Clone ID: PAT_TA_26678
cgtccgaatcgagccgagccaagccgccgcctgagctgagaggcaggaatggggtggaaggccgcggagaagctcatcaggcactggaagatcctccgcggcgacaacgtgatgatcataaggggcaaggacaagggggagagcgggctgatcaagcgggtcatccggtcgcagaatcgcgtcatcgtcgagggcaagaatctggttaagaaacatattaagcaaggggaaggacaaacaggtgggatcttctcaatggaagctccacttcatgtttcaaatgtacaagtaattgatccagtcaccgggaaaccatgcaagactacatacaagtatttgccagatgggactaaagtaagggtctctagagaatgaatgcgtctggtgtgtcatacctcggccagaaattttgaaggagagaaaaaagccgagacccacatctcatggcccaaaggacacaccaattgagcatgtgctggagaagacctatgatgccaaagctggaattggtatgcctgatctatgaggagacgtccactgctgggagtgaaagagagagagagtcgggaatatttgtgatctatccatcctagttaagatagtaggaactctgcggttattatgtcaggaagcactcaacatttgttcacgaataaaactagccagcatctcgtgtgtttccagaaatctgtccctgaagaccctgattgaatgttgtgcatcttgtttgctgtttgattgtatgaatgaggccccaagaaagtacgggccaggctgctggttaacc

SEQ ID NO: 26679 - DNA, 621 bp, Triticum aestivum
  Clone ID: PAT_TA_26679
cactcgcagctcccaccgtcgtctcctctgctaagcattcgctcgccaccgcccaccgtctcctctccgaatcttctccggcaagtctttcaccgtcgaccgcaaccagatggctcgcttcgccgtggtcgccgccctcctcgccctcctcgccgtcgccgccgcggcgcagggccccatgccggcgcccaggacggcccctcttccagcgccaccggcgaggtccccagccaccgcccctgcgccggtcgccaccccgccgaccgccgcgtcgccgtccccgatggcatctccccctgccccgaccaccgacgctccctccgcgatgacgccgtccgcggtctctgccacacccgctggagcccccgtcggcgcccccaccggcacccccgcgagctccgccgtgtactcatccgccgccagcttcgtcgcggtcgccggagcggtggccgccgccatcgtgttctagatgcagcgacgactcttctcgctgctgtctatacagtttcattgtttctgagatttttttggttataggcggaggaaatattacacacgacattgcgatgtaatcttgttacgagattattatgaatatataattccttcatttgttacgtt

SEQ ID NO: 26680 - DNA, 665 bp, Triticum aestivum
  Clone ID: PAT_TA_26680
gccggccgggtcggggcagctcaagtacagcttctgcaatctacagagagcctaagcatccacactctatcatctcatcacctctccaaatcaccatcagcacagctaccagatggctctcctcgccgtcgccgccgccatcatcgccctcctcgccgtcgccgccgccgcgcagggccccatgccggcacccaggatggccccgctccccgcacctccggcaaggtctccaaccaatgctcctgcgccgctcgccaccccgcccaccgccgcgtcgccgtccccgatggcctctcccccggccccgcccaccgacgcaccgaccgatgctccctctgcgatgacgccgtccgcggtctccgcgacgccctccggcgcccccagcggtgcccccacaggcactcccgcaaactctgccgtgtactcatccgccgccagcttcgtcgcagtggccggagcggtcgccgccgccatcgttttctagatgcagcgacgactatgctactctgcttggtgttgtctatacagtttcattgtctctgagattctttgttatagacggaggaaaggttacacgacattgcgatgtaatcttgtgacgagattattatatgaatataaaattctttcatttgttacaaaaaaaaaaaaaaaaaaggccccta

SEQ ID NO: 26681 - DNA, 1569 bp, Triticum aestivum
  Clone ID: PAT_TA_26681
cccccaccccctccccccgctctcccagccaaatcgaaccgacccactccgccgcctggcctgaaaggcgtggatggccgcggaagccgctcatcagctactcggacacaggcaccgcgccgccgccgcgaccaccttatggggctaggcggcagggggaagcgcgggctgcgggcggcgcgtccgccgcgtccgcaggcacgcgtcatcctccgacggcaagaatactcgtgattgaaaacatattaagcaagggggagggcaaaccaggggggtcctccccaatggaagctccacttcatgtttcaaaagtgtacaagtaagttacccagccccccgagaccaccatgcacaacactacatacaatgattggcccaactagggcaaaggtcacgagctctaggtgtgagtcagtggctgtcgtgcctgtcacagctcgtccagaggtgtgaaaggagacgaaacccacaagacccagacctcatgacacaacggttacaccagtggtgcatgtgctctatgatgcctatgctggcaaaggtatgattgatctgtcagatcatagagacaagacgtcgattgaaaaaaataaaggagaaagaatctttaatatttataatctatccatcttagttaatataataggaactcttgcggttattatatcaggaagcactcgaacatttgttcaacgaataaaactagccagcatctcgtgtgtttccacgaaatcggtccctgaaggaccctgcgtgtatggtttgcagcttgattgttcgaaggttgccccaagaaagtccgaagaatcaacctgccggtccaccgggaacaccccttcagtttttcccgtggtttctgtttccagcgtcgccccggccgcgagctgcatatgaaaaaataaagaaagaagataaaacaatataaaataaattaaaaagtaaaaattcacagctcgcagctcaccatcgtctcccctgctaagcattcgctcgccaccgtctcctctctgaatcttctcaacaaccagatggctcgcttcgccgtggtcgccgcaatcatggccctcctcgccgttgccgccgccgcgcagggccccatgccggcgcccaggatggccccgctccccgcaccgccggccagatccccgggcaccgcccctgcgccggtagccaccccgcccaccgccgcgtcgccgtctccgatggcatctccccctgccccgaccaccgacgcgccgaccgacgctccctccgcgatgacgccgtccgcggtctctgccacaccctccggcgcccccatcggcgcccccaccggcacccccgcgagctccgccgtgtactcatcggccgccagcttcgtcgcggtcgccggagcggtggccgccgccatcgtgttctagatgcagcgacgactctgctcgctgttgtctatacagtttcattctttctgaaatttcttcgttatagacggaggaaagattacacacgacactgcgatgtaatcttgttacgagattattatgagtataaaattctttcatttgttaccttctatacacccccccccgc

SEQ ID NO: 26682 - DNA, 680 bp, Triticum aestivum
  Clone ID: PAT_TA_26682
gccggccgggccgggacaactcgcagctcacaagcctcaagcactactactacgcgcagatccaaagcattcgcttgccgtcgccccctctcctctccaagtctcgggcaaggctttcaccgtcgacaagaaccggatggctcgcttcgccgtcgtcgccgccatcctcgccctcctcgccgtcgccgccgccgcgcagggccccatgccggcgcccaggatggccccgctgccggcccctccggcgaggtccccggccaccgcccccgcgccggtcgcaacacctccaaccgccgcgtcgccgtccccgatggcatctccccctgccccgaccaccgacgctccctccgcgatgacgccgtccgcggtctctgccacacccaccggcgcccccatcggcgcccccaccggcacccccgcgagctccgccgtttactcatcggccgccagcttcgtcgcggtcgccggagcggtcgccgccgccatcgtgttctagatggagcgacgactctgctcgctgttgtctatacagtttcattctttctgagatttcttcgttatagacggaggaaagattacacacgacactgcgatgtaatcttgttacgagattattatgagtataaaattctttcatttgttaccttagaaaaaaaaaaaaaaaataggcccctaagggc

SEQ ID NO: 26683 - DNA, 1012 bp, Triticum aestivum
  unsure (1)..(1012): unsure at all n locations
  Clone ID: PAT_TA_26683
ggcacgagccgatcaccagcacagccgcgcatccaccgttgctagcaaggtcgaccaagcagcaccgagatggctgctgccttctcctccaccgtcggtgccccggcttctacgccgaccaacttccttgggaagaagctcaagaagcaggtgacctcggccgtgaactaccatggcaagagctccaaggccaacaggttcacagtcatggcagcggaaaacctcgacgagaagaggaacacggacaagtggaagggtcttgcgtacgatatctccgacgaccagcaggacatcaccagagggaagggcatcgtggactcgctcttccaggcgcccacgggcgacggcacccacgaggccgtcctcagctcctacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatcattccagtgcgagcttgtcttcgccaagatgggcatcaacccaatcatgatgaagtgccgganaagctggaaaagtggcaacgcccggaaaagccagcccaagcttcatcaggcagcggtacccgtgaggcttgcaggacattgatcaaaaaangggtaagaatgtggcttgccttttttattcaaacgaattttgaacgcttggtggcggggtccggaattggggccggggaaccaccccaagtnncaacccggtnaaacaaancccaaaattgggggggaaccgcccccccccttntttggaaacaattnggcccgnatggccccccccnaccccaaanggnngnnnnnntttnncccaagggnntttgtttcccaaannnanggggggggggnnnaaaacccccttngggggggggccccccnngtnggnnnnnncttggggtgnggnaaaaccc

SEQ ID NO: 26684 - DNA, 978 bp, Triticum aestivum
  Clone ID: PAT_TA_26684
ggggatgtccccttagccgccttccgctgtccgtcgagctctgcatgaggatttgggcattggaaagactagctcttctacgcatgattacagaagttcttctggaggagggtccgtcgttcttgatgattgtaacttccatgagtcagtgcagctcgacagttttgacattgacagaactctgcatttgataccacctgatggagaatttccagtgatgaactaccggttgactcaagaatttaagccacccttccgcgtaactgcactaattgaagaagctggcccatctagggctgaagttttattgaaaatacgggcagactttcctgcaaatgtcactgccaacacaatcacagtacagatgccagtgccctcttacacaatgagggcaagttttgaactggaagctggagcagttgggcagacaacggattttaaagaaggaactaggagactggagtggaatctaaagaacattgttggtggttccgagcatacccttcgtgcaaagctcacattttcccaggagacacataggaaacctcacaaaagaagccggaccagtaaacatgaacttcactatacctatgtacaatgcttcaaagttacaggtcagatatcttcagatagcgaagaaatccaaaacatacaatccatacaggtgggtgagatatgtgacacaggccaactcgtatgtagctcgcctatgaggacattgcttgtacaattcttctgaatgctcttcccacctgttccttgtgcaattatcttggacagacttgaagctttggacagagtgacatgtattgtaactctatagtggggatcccaacatcactctgctcctgtagctcactttcttttttagtgttatattttccttctgcaatatgcagaaaatacatgatggttgtttgtattctgagaagtgaataaatttcttgttcatctggtaattacaaactgaaaaaagaa

SEQ ID NO: 26685 - DNA, 1422 bp, Triticum aestivum
  Clone ID: PAT_TA_26685
cggccgcgtgggtttcgcctcacacgcactggctccgccgccgcaccgcgaagccggaagccggaagccaggagcggtggccgcgcacggcacagcccgaccccgccaccgctagagggatccgcgcgaccagccccggctctaacactgctcgcacgccggagacgacgagatcttcaccccacgctgcctagaccggcggtccactcctcgcctcttttcctcagttctccctcgccgaaggatttcgccaaattaatacgatggatgctgctgccgctgctgatgccgccgccgctgctgctgccgctgctgatcccacgctggattttgacccagatgaactcagagctgcctatgaaagtacctcaccttacatagcggggttttttccgtcttatccaggagtcattgttatgtcaaccaacagacatgatgtggttgctgttcactcagagttgattagcgatgaccctgaataccttcctaaaatagttcggaattattctaataataccgaagcttgtgttgacgcagtggcaaaacttcctgctgatgttacagtcttgtttgcaaagcgcaagggtgagcgattgcctgacattggattttcaaacctggatccccaagaaggtgtgtctgagaaagtggtgacatttttcccatacatggacacagtggctatgttcaagggacacattgggttaaggaatgccacatccagggacgtgagggcaccagagcaggaggttcagccatcatccatcaacacattcacctttactgccccgtatgcatccgttagcttcaggaaagatggtaatgagcatgatcctgatctactggagacacgcttaatgactcttggcgctcctgtgttcaacttaaatggccagattgtaggtatattgagtgatgtcggtattgattgtagtctgaaatttgcgaggaaagcagtatacttaggtgaagtccgttcacaactgcggggcgagcaagtcaattggctgaagggggaagagaaggtgaaacgtggtttgtgagggaccctaaaatctgaagataccagtagttgaatgtgtcggaagatgcaagttaaccttttttttttatctctcttctgtttacttgcgaggatcagtgccgtcatggcgagatgcctgaaactttggaacagttcttgctttttggtatggtcttggaaggtaatcttaacctctgaaaagttgtaacttggaggcagtacctttatgttggtgttgcacaagtatctccttgtgagattttctgagaggtagttgtagattgggatgtaagtgactgtgtgtgctgcatccctttcttccattttgacaacaattttttgtatttaaacctatataaatatatggtgtcaaactgtgatttgtcaaaaaaaaaaaa

SEQ ID NO: 26686 - DNA, 641 bp, Triticum aestivum
  unsure (1)..(641): unsure at all n locations
  Clone ID: PAT_TA_26686
tggacttgactagttgtgcttgcactggtagcaggaactagaggccgtttttctttattcataactctcctcaattttttttggctttgaagtgaatcatggttgtggacattatgtatgcctctgcagatatctgtgaacatgagttcgatgtggaagttgaacttggacatgtcgggcttgcacgtgaactataccatgtccaatgcctacgtttgttattgtttggaaacgtaattactgttattacatgacccaaaaaaatttggcgtgccacatcagtagatgcacggacatcacaacagaaactgctaactggattaacctcttgaacctagctactacgaacgcaaattttgtattgacaacagttttagattttcgggagccactagcccgcgctcccccggcgacccatcccgcgtgtgtgtaacctccacatctgggatttgcacttggcaccaaccaacacccttagggatcgacctggtataacccacccatttgggaaacgttccaagggggggccggtaccaattccccaaagggncctttaccccccacggcgtcgtttaaactcngacgggaaaccgggtnccaattaccctnanaaancccttccannggtaaacaaagcncct

SEQ ID NO: 26687 - DNA, 597 bp, Triticum aestivum
  unsure (1)..(597): unsure at all n locations
  Clone ID: PAT_TA_26687
ggcacgaggcgcgaccatggcgctctcctccccggcgatggcgggcaccccggtgaaggcctccagggcggcgcccttcggcgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgcgggcctctccgccgaccccgagaccttcgccaagaaccgggagctggaggtgatccactgccgctgggccatgctcggcgcgctcggctgcgtcttcccggagctgctcgcccgcaacggcgtcaagttcggcgaggccgtgtggttcaaggccggctcccagatcttcagcgagggcggctngactacctnggcaaccccagcctggtgcacgcgcagagcatcctngccatctgggcctgccaggtggtgctnatgggcgccnnggagggctaccgngtnnncggcggnccgntnnggnnagatcgnggacccgntntancccggnggnagnttnnaacccntgggnct

SEQ ID NO: 26688 - DNA, 495 bp, Triticum aestivum
  Clone ID: PAT_TA_26688
gggccccccctcgagtttttttttttttttggctcgtgcgggtctcgcggtcctgtgctctcttcttctttggtgaagattgcaatgtctaaatctcatggggatgttttcttaattaatataatcacacaaaaatctcttcgatcgctaaggatacatactgcgacgtcccatcgacacgacaaaaccgaagagcgaaccgagtacgatcgacggccgccgtcacccggcaaatgtctccgccggcggtgcagcgccaccgttccccgcctgttgccgctcgaactcctgcacgagctcggcatccacgttctccgcgggctcccacgtcgcctcctcggtgtccacccacttgacgaggtactcccacctgccgtccccgtcgccgtccgccgcctgcctcctgtccacgacggcctccgcgacgccgtactccagcccggcctcgaagtccttcaccaggtcctccgccacccacggcgccctcgtgccgaa

SEQ ID NO: 26689 - DNA, 990 bp, Triticum aestivum
  Clone ID: PAT_TA_26689
taccaacctctcctatttatacatcacgaaaatttacgctatctcatactcgatggcgtttgtgcgttgagatgctcatagcagcgcatgggcacctgtttgcctttccctacaagccgtctgcaggtgcaaatgcacgcccttcggggtgtttcacggaaagccttcttcatgctttaaaattcaaggatctctgtctcgatttatcaagacaggtaaacaggatcttagacgcctattccctgttgctgtcgctcactgtgcaacttctcgatcaaatcggctccattcttgttcgctgaaggaaactacattcttgaaaactgtgccttgcccggatcttgtcataatcggccccattctcatgctgtatgttcctacctacaacgaatatgtgctgtacaaccacaatgagggctagagtgcaccaacaaagtttccttcagggagcgccgtgccaagtgtcagggatgtgggagttggctggcatcaccgtgatgccgccctcaaataatagtccagtgacctcaagcgtgtcatccaaccacgtagaccaggacgagtcgatgaccactccgatcaggaacaaagtggacccgcctggaggaatgtacgacctcacggacctgctcgacgtggacttgtctagctaccccgccaaggttcctgcaatctctgatgtaagaaaacaatgaccaggtgcgacagccaatgtgtctcggtagcgactgggggaaattgtggccttccattttgtcatagataacgctgtaaaaatgtgtgtgtactacttccggttccagcctttccccattgaagaaggggggtttattcatgactgcactgcagctgtgcgcacggcctctctcgccctactcttcgactaatctgtgtacaatgttgtgagctcaaggtgaactgctgtgacatgagactatgaataccatactaatagtttgctgatagcaaaaaaaaaaaaaaaaacgagac

SEQ ID NO: 26690 - DNA, 836 bp, Triticum aestivum
  Clone ID: PAT_TA_26690
tagcgtggtcgcggccgaggtaccacggtgtattggtggcatcccatttgaagaccctgaacctgaagcttatacattttactggcccagaacctccagtaactcttttggaggggggtttggtgtgttcgatgatacgggcttctcatataacagtgattatgaactccaaggattcaccttcaccactaaagggaacccacccatacacatacggacacaacttcttcatgtcgatgtctggcattgacttgtctgcaaacatgctgtcgggcgagattccgatggagatggggaatttgagccacatcaagtctctcaacttgtcgaacaatttctttactggctctatccctgcaacctttgcaaacttgaccgagattgagagcttagacctatcagaaaacaggctgagcggatcagtgccatggcagttaactcggctatcatccctagaggtgttttctgtggcatacaacaatttatcggggtgtctaccagccagcggtcagttcagcacattcggtatggacagttacaaagggaacaacaaccttagatcatgcacttcaagttcaggtcccatggcagcaaatggtgttgcaggaagtgtggctgatgattctgacccgatcctttacgtggtcagtgccgtttcattcatcttggcattttgggccactgtcgcattcgtattttgccatgcacttggacggcgtgttgtacctgaactggcggccgtaaagagacggagggctaggtgaatggcgacgatttatacacaacataaatatttgtaagctgtgccttaataatctgctctcctgttctgttat

SEQ ID NO: 26691 - DNA, 1477 bp, Triticum aestivum
  Clone ID: PAT_TA_26691
gcaccacgcacgagctggtcccgtgccgggccccgagcccgagcccaccgagccgcccctctcagcactgactacggcgacgctacacctcaccctcctgggcgtaaacacgaagtgagccctcctggtttccccggtcgccgcgcagcccgcggcgctcccctcgccgtcatccgtctcccgcacaccccgcccacaccaccaacaaaaccgcctggggctcccacacctatcccccgcccctgcctcctcttcggtgcacctccgccaccctccccgccggtgcatccgacgccgcggtgctcgcttcctcgctgccgcctccacctctaaggttgccgcgcctgccgatgcccccggaggatccgcagacgcgttcgaggtgatccgcgctcaccatggtaaaagctgcccggcttcctcctgttgaagaaatacgaaccgttctggaccaaagtgtcagaggtgttctggctacccattctcaggaacatgtgggttatccatctggttcaatggttgattttgcgtgcgatcaagatggttcccccatattagcagtgagtagtttagcagttcatccaaaggacagtgcaggaggtactaaatgctcacttttggttgccataagcgctgtggacagaacagacagtgtaatcactgtataaggcgatgctacacctgttcccgatgaagaaaaacatccagtgacaactgcatatttacggagacaccctgaggccttttgggttgactttggtgacttccgatttctgcacatcaaaccaaaagctgtacgttacgtatctggggttgcaacagctatccttggctctggagagtttagtgcagctgagttcaaggaagcaaaagtggatcctatatctcagttctccactcctattgcaggccacatgaacaaggatcatgctgatgatacaaagctcattgtgcaacactcaacgtctgttaaggtggattttgcttctattctggatgtggatagcctcggtatcaatgtgaaggctggttatgatggaactgttctgaagctgcgaattcccttccctagacgtgcgcaagacagaaaggatgttaagacacttattgtggaaatgctacaggctgcaaaggcctcatcctgacatgctgaatgacctctttgttctggaacgcagtggcggcgtccatgtaaaaaagaaagccctagccataagagctttcaggttgctctccagtctcagcgtcagcgaagatggatgatccacagaaaattccatggtttcatacatcattcaacaccattgtgacagcgaacttgtgtgaaatacttccagtcaaacttaaagaaatgcaaagcgacttgtatattgcactgaactgttttgcactcatacacgactgaagttgttgtcatgtcggtcttacgtgacttgtactttgatctttatgatatgaatgacacgtattaccatgc

SEQ ID NO: 26692 - DNA, 2201 bp, Triticum aestivum
  Clone ID: PAT_TA_26692
gcacgtgcctcctgctgggcctctttctggcttgccgtcctttcgccggtggtgctcctggctactccgtgcctgtgttggttgccggcgccgggctccttctgggctttgtgctccgtatgtcttcaccccgtctgcttctgaagggctatcctgagccacggagcatcctccgtacgcgcatccccgcctatcactatgcaccggccgctcaacgttttagccctgcgcctccccttctcgctcgcccgctctgggccgccgaccgtggccgagcctgggcgcgctcgcttcgtggccggaggggcttcgggcgggccggagtcccgcgccggcacgcgcggcggatgcattctgaagacctcgaatctgcatttgatatggctggtctggctgacacacattttgagtactcccctgaagcacgcgcacaggctgatttgaaatttacgtatgtggttacctgccaaatatatcgagtgcagaacggagaagggaaaccagaagctgcagatatagcccttctgatgcagcgtaatgaagctctcagaattgcttacatcgatgttgttgagagcgttaagaatggaaagcctagcactgagtattactcaaagcttgttaaagctgacatccatggaaaggacaaggaaatttattctgttaaattgcccggcaatccaaagcttggggagggtaaacccgaaaatcaaaaccatgctgtaatattcactcgcggaaatgccgtacaaaccattgatatgaatcaggataactatttcgaggaggcactcaaaatgagaaatctgcttgaggaattctctcaaaatcatggcaagttcaggccttcaattcttggtgttagagaacatgtcttcaccggaagtgtttcctcccttgcttcgtttatgtcaaatcaggaaactagttttgtgacattaggacagcgtgttctttctaatccactgaaagtgagaatgcattatggtcacccagacgtgtttgatagaatatttcatattacgaggggtggcataagtaaggcgtcccgtatcatcaatatcagcgaggatatatttgcagggtttaactctactctgcgtcaagggaacataactcaccatgagtatatccaggttggtaaaggaagagatgttgggcttaatcagatcgcactatttgaaggaaaagttgcgggaggaaacggcgaacaagttcttagcagagatatatacagacttgggcagctttttgattttttcaggatgttatccttctatgtgactactgttgggttttacttctgtactatgctaactgtactgacagtgtacatatttctctatggtaaaacttatctggctttatctggtgttggagaatcaattcaaaatagggcggatatacagggaaataaagcattgagcgtggctctgaacacccagtttcttttccagattggtgtgtttactgcaattcctatgattctaggtttcatcctggaagaaggtgtcctgacggcttttgttagcttcattactatgcagttccaactatgctctgtatttttcacgttctctcttggaacaaggactcactattttggtcgcacaatactgcatggaggtgcaaagtatagagcaactggtaggggttttgtggtacggcatattaagtttgctgagaattaccgtctttattcccgaagccattttgtgaaagggctggaggttgcacttctgttggttatctttctagcttatggttttaacaacagtggagcaattggctatatcttactttccataagtagctggtttatggctctttcttggctttttgctccatatgtattcaacccttctggatttgaatggcaaaaggtcgtcgaggatttcagagactggacaaactggcttttttaccgaggtggtattggggttaaaggagaagaaagctgggaagcttggtgggatgaagaactggcacatattcacaccttccgcgggaggatactggaaactatacttagtttaagattttttattttccagtatggagttgtttaccacatgcatgcaagccaaagaaagtacagcattatcggtatattgggtttcatgggctgtgcttggagggctttttgtcctcctaatggtatttagcttaaaccccaaggccatggttcatttccagttgct

SEQ ID NO: 26693 - DNA, 297 bp, Triticum aestivum
  Clone ID: PAT_TA_26693
tgctcttggtttgtcggaatcccagcgaaatcgccaagtccgacgagctccgccgcccgccttctctaaaaacgaccgttacgatgccgtccgtccacctctgccctcgcctcgggtatttcctggtgcaataaaaggctttatgtgacattttctttttgcattttgtaatatttttagaaggttctgatttccttggagaagaccaggactattgtgacactcctctgaacaaaggcaagccacaacaaccatttgcaaggatggaattgcaatagcaatgattttacttgaatt

SEQ ID NO: 26694 - DNA, 1461 bp, Triticum aestivum
  Clone ID: PAT_TA_26694
gcggggcgtggacgacccgctcggcggcgtccggttctcgatcttcgcgtgcgtctcccccgatgacctcttcccggcgtccgcggtcggcgcctgccgccgcggtgtcgacgatggcacggtccgcatccacggccggcctcttgccgggtcgcgccctcaccgcgccatgcccggagttttgccggcggcttcgaccgcgctagcctctggagcttcgacgagttccccatggacagcgccattttctgacgttttccgtgcgctttttttacgctcgattcgtttgtaagaatctcccatctggccatcttgttccttgtaaatattcagtgcacagaaccttgctcaagacccaggattctgattcatggccacggaaccaaggaagggtgcagctgatgcatgggtaccgcatgattgcttcctttgatgaatgctgatcgaaatgtattctcgtgcttgcgtttcctggtccccctgccaggacgcctacgaatccctcgccagcctcctcgacgcggacaccgtcatgcacgcgatcccgacgcgtacgaccctgtaacgaccggtggccgccaccccacctctggggagttccccgcggacgccgccaccgctgcaggccgccgtcagacgcacccgatctgtatgacgggcgacgcccgtgttgcaggggtcattcgtcctggcagcctttgtcgacctagccactgctgtcaccggactcacaaatgtcattggccgcccgtatgccgatgttttgcaaagagtcgtcagaggcgcgcggcgggggcaccgttggcggctccacccacgagttcgccgacgagcctgggttcgatccgttcatgatgttcccgtacgaatccatggacagcctcttcgccggagacgctgtcatccaggatgcccgcggtgtgagacggcggcatggacggcgttagcctctggagcttcgacgagttccccatggacagcgccattttctgacgttttccgtgcgatgcgctcgatcggtcgaaccaaggaagggtgcagctgatgcatggctactgcatgattgcttccttgatgaatgcagattcgaaatgtatcccactgtttgaggctgttcgtcggactgtatgtgcatatgtactgctggccgcctgtactatcaagctgtattgtactctgtcatgatttggtactgttggtcaatagtcctacgaattgatcatgtcggcagtgccgtctatgattgtgcttgccattgttaatgccaaataagctcgtgaacctggttatctgttgtgtgtgagtcaccaactcatcatgtcatgttgagttggattatgtaataaatactgtaatttgctgaattgggtgaagctatacaacactgggatgctgatttttaaaaaaaaaaaatttcttggcctcatataaagatttcaacctttggtgaaaaaaaaaaaa

SEQ ID NO: 26695 - DNA, 583 bp, Triticum aestivum
  Clone ID: PAT_TA_26695
gataattttagggcttctttggtgggcgttgccaggcccctgccctcggcgcctgccgcgctccccctggcctgctgtcccgctgccgtggctcgccctccccgccctccgtcagcccctggtctccaccccccctgctctttccacgccgactccccacggcgctccccaccggccgcctgcgctcccccccccctcgcctccccgcccgcttcctttgccacccctgctgcggctgctccgcccgccgctgccgccgctgcccgtggccttgccttaggcgctggccgcgctctcccagctattggtctccccctgccgggcctcccgctcccggggctcttcgcgtgctcggttgtcgtcctcttgcccgttgtccgcctcccgccatgccgccccctcccgccacctccgtacccgccccccggttgtcaccccccctttccgatttaaggtctttgagacgcacgtcgaggataaggtatgccttcgtcggggataatcgtcgccagcccaaaatttgcctcggatttaaggaagtcttggctacatagtttttgggtcttatgcctcgaagactcaa

SEQ ID NO: 26696 - DNA, 1207 bp, Triticum aestivum
  unsure (1)..(1207): unsure at all n locations
  Clone ID: PAT_TA_26696
gggaatcgattccacccgcctccgccgccgtctcgctcctctctccttgctgccgctataggacgcggccgggtcgctatcatccctcgagcagcgtcgacaacgcgggatgcagcgggctcaacttgcatctgcgatgccggtgttcctctcctcggtcgagcgtcggcggcggcggcgcgagatgtagcgggctgaacctgcgtcggcggcgacggcgacgggtctcctccattcccctcctcatgttgcccctctccttttccttgctttcctgcaccggcggagaggaagacgccctcggcttcatggcctcctctctagggccaagtggtggctagaggacactccaggagggcagccaaaaaagaagccgagagaaaaggggaggcagaagagatccgcccgcacgctctcgccgtctcgctctacctgatggtgttgtaaggtcggtcggacaagggaacccggttgctgcctaatgtcaaacgccttctccctgagaattgagatcatgctcccaggctaaatcaacaccacttgctgggatggaacatggaaagctattggccgcttgcagtctcacaatctgtcagacgcacaagtggagttttgtttggcaatgcttttctattgagcatattaagagatcgtcatttgtctgtcttttttattaagaaatggcgagtcatttagtaagagtttgtaactggttcaagtacatgactgtcaagaaacggtgcgtttgacaacacatcttctatcaagttgctgggaatgttgcctgtactccgtgacagtgccacaacattggattcatgcatttgatgtcctcttggatccagattagaataaaactaaatgtgttcctttaaatcgcgtagttgcctgatttcatttttgcaaataaaaaatgtgttcctttaatttggtgtatgtatttgttttctgtaacctatcatcattttcttctttttttgcgctgaaacaaaatgcattctttcatatcaaaaattgcaagagcacacgagctgtacacatatccttccttttgaatcgcagccgcttgcttgattgtattttggaaggttaagcgagtacgtcacaaagtaacactgatcgctcacactgtaattcctctctggtaanttgtagtccttgacctcnaatttatacacaatctgcatgcactttcttaaanggagag

SEQ ID NO: 26697 - DNA, 1240 bp, Triticum aestivum
  Clone ID: PAT_TA_26697
cttttaatgaccgtgtgcattctggtcaagatgttttccgccttggaagagatgcaaatttggatataaagataacacaatggtaattttggccctttgacattccaactcggtatgagagatgccattacatgtattttcttcgtgatgcatctagtctcaaactgttacatgatgatggagggcccatcattgacttataaggaaaagttgtgggtctagttaacaatcaaatcgatgagacgtttgtaccttcgtcaatattgcataagtgcttcgatttttggaggaggttcaattgcatgcctcgcctccaccttggaatgacatttagtccaatcaagtttttagatcctatttgtattgagaggatgactcgtaagcataacatcgactctggtcttattgttgagcaggtgtcaaaagaatcacatgctgagaaaattggaattcgcaagggtgatgtcattgaaagttttaatggaaagcacatttctactacaattgagttagaaagcatgttgatagacttatgttgggatcattttgatcaaagaaagaaactgaatactgaaaaagatgtttcggtgaaaatatttgatgctaccaaactttgtccaagaattagaaacttgactgcaattgtatcggatcgtggagaggacattgtaaaaggtgcttaccctatcatgggtgaagaagccatgtcagtcttatgattcttgatccttgagctgggcctgaggcacctgcccactgctggccttcatggatgagtcaaccgaattaaccttgcatgctcattgcaaattcatttttggcataatcttttcgttgtgtattcttggaaaaaaaaacttcaaattatgggtgcctttggaccgtagaagcagcttaagcttaacatgcatgttagagcagaacttattattggctcctacttatgtcgagtcttgtgaaactcacatgatgtctgtgtgcaagtgtagcagtcgtggatgatgaattgaactgggcaattatgttggagagtaacgtttggaccgtagaagcatatgtagcttagagcagaatgttattggctagtaattgttagtacattgccaattcattccctttaccttgttgtgcagggtaaaagggaataagaatacccatcatgtagcaatgtatactttcactctatattggcaatgtatatttccaccctaaaaaaaaaaaaaaaaaaaaaaaaaaaaaa

SEQ ID NO: 26698 - DNA, 1028 bp, Triticum aestivum
  Clone ID: PAT_TA_26698
cgcgagtccatcgatccccaagccgtcttcctccctctcccgcagaggcggcggcgcacgaggtgggaaagatgtcgagggccgtcagggtccgcggcgacgagctggagacggagcggggagcaagggcgaagaagcgaagcctggcagtggatcgctcgacgagccctagatctcccggcgacctagctgttcggagttcccattcccacccagagatactgttcgcgatcttcgagcccgacgaagctcaatccggagcaaaacaaggtcgtgtgtgcgatgtggtggagtccgcgacggaggaatcctccgatccacccagctcaccgatctacgaaccctacattcctgacgaactagccgcagatccagtcgtacgctccgccttcaagcatgccatggctaagtacgaggcagaagaagatcgtctagctgacctgttcactatggatcactacactactggtaccaaccatcttcctgcctgcgcaaggaccgtcgtctcctttccatccgtgaactcgcaagagatgcaatactttctgctgcaaaatccgtcatcttgctctcgtcctttctcgacaaccaaccgctgaataaatgctgtggcttgtggtttcaaagggacggccagagaaaaaccgcccttgtcgtctgcccatctaattcgtaaagatgatatccacaagtggaagcagcaatggacaggcgagtatcataagaatgctaaggtcattgttcatttgctggataacaaaactacacaagcccagctcacctatcttcaagagcattatgaatttgctatttatgaagttcaagtgggcaaacaagcccctccacctaccctcacttacggcccgcatgctttccgctcgggttgtcgcctgggatgagttccagggttgggccttgagtcaccgcttggttctttcggccttctcacgttcctcctccgtatgaggggtgccactacttggattttcggcgtgacgcatctcgtcccccacggttgctccttgggg

SEQ ID NO: 26699 - DNA, 469 bp, Triticum aestivum
  Clone ID: PAT_TA_26699
gaattcggcacgaggccgtcaattttcctcgtctctccctccaccatgcgcctcaactccgccgccacctctcctcggatgtccgcccacggtctgcccagagggacagagggggccaccaagcgacggcagagcgggttcatagagacggagagggtgagtccatggccagacgagggaggaagacagatggcggggtggatcgggtgccctaggcctatgctgtcggcctcctcgtgctgctcaccatctccgtcgccgtcctcatcgccatctgccactcctccttccccctgcccagaccgcgggaagaagccgagaagggaggccgaccggcggcagccacgctcgacaacatcctcgccttcgcatcaagggagaggaagtcgcctctgcgtccctcatctgtgagtttcttttcgggccaccgactccacggagcttgtcaagatggttgttacgcagatgg

SEQ ID NO: 26700 - DNA, 619 bp, Triticum aestivum
  Clone ID: PAT_TA_26700
gcacgaggggacccgaagatatttcgcttccggggcacgtgattttttcacttccggggcacgtgattttttcatttgggaagtgagaagcacactgatatttgcttcccgaggtgtttttcgcataacgtgcgctgtcatcgggagggttgggtcaaaatacctaaaacatgatcaagtagtgcccccattgtgctactagtcccactcccacgatcggtctacctccaccgtccaacactcgccactccccccatatcggccttactagttttggtctgccgcctccctccaaatctagaggtgcccacctcaccatcgagtgccccctgcctctgtcgttcatggccaccctccttgctggagacatccagatccgcctccctagtcggcgacttccatatctgcctccctcgccgtgcagaggtgtgcaatcttactttggagattccgaggagcgagatcagtgactgcagacaagatcttacacaaagacttcccaagggtacattcgtggacgtatgcagttgcaccaaaattggcgcccatgctctgtagccatttccaagaactgcaaaaccctcatcatacttcggcgggtcgtgcacccaattgatgt

SEQ ID NO: 26701 - DNA, 1192 bp, Triticum aestivum
  unsure (1)..(1192): unsure at all n locations
  Clone ID: PAT_TA_26701
cttctacccttctttccctctactcgccatcgaccgcacagccgccgccgcttccccggggataaaatggcgacggcctcttccttcgccgccgtcttcatcagcagcgccatcgcctcctgcttcgctgaggtgtgcaccattcctctggacacagccaaggtgcgtcttcagctgcaaaagaaaacagctgctgggcctgcagctacagtaggaatgctgggcacaatgatgtcgattgcaagggaggaaggcgtcagcgcactttggaagggcatcatccctggctttcaccgccagtgcctctatggcggcctccgtgtcggcttgtatgagcctgtcaaagccttatttgtgtttgtaggtgatgccactttaatgaacaagattcttgccgctcttacaactggtgtcatagcgattgctgtcgcaaatccaactgatcttgtcaaagtgagattgcaagcagatggaaaatctactgctgtcaagaggcactattctggagcccttaatgcgtatgccaccatagtcagacaggaaggtatcggagctttgtggactggccttggtcctaatatggcacgaaatgctttgattaatgccgccgagttggccagctatgaccaatttaaacagatgtttctaggtcttcctgggtttacagataatgtttatactcatcttttggctggactcggtgccggtatttttgctgtttgcattggatctccagtggatgtggtgaaatcaagaatgatgggcgattcaacatacagaagtacatttgattgtttcgccaagacattaaaaaatgatggacttgctgctttctacaaggggtttattgcaaacttttgtcgagttgggtcatggaatgtcataatgttcttaactttggaacaggttagaagattctttcagtaaggattatatatgaactctgcgctgcaaggtttcatggaacaagctgggtacagcttctggagcaacaagacatacacaatncattcaagcataggattcagattttcatttgtacaaggagaatgcattcccctgctgtaatttgatctatttgatgactacgactgagcatgttgttagcttttaccgatgcccgctttactgggttaataaatttgacacgttatacttaaaaaacatctgcttatttgtgcaatttaaatag

SEQ ID NO: 26702 - DNA, 562 bp, Triticum aestivum
  Clone ID: PAT_TA_26702
gggcgggtggcgtggcgtcgctggtgtcgccgtgccccgtgacgcccgccgtgctgccgacgccgcggctgtcgccggcgcgggaggtgctggtggagatggccaaggaggcgtggggcgtcgacgggtacggctccatgaagggcctcatccgcctccgcccccaggccgccggccccgacgccggcgacggcgacggcgccgactcgggctccggcgagagcgacgtggaggagcacgtggaggtggagcgccgcctcgaccacgacctcagccgcttcgagatggtgcagctccccgccgcgcccgccggcgaggacgacgaggacgaggacgcccgcgcggcccggctggaggaggagaacctgaccctccgcgcgcggctcttcctggtggagcgcgacatggccgacctccgccgccgcctcgtcgccgtcgagtccctctgccgcgaccgccaccgcgacggctgcgtcgtcgacgccgccctgccgcccccctccaacagcgacgaggcggacgccaccgaggacgccatggtactctgacgtggccgccgccg

SEQ ID NO: 26703 - DNA, 360 bp, Triticum aestivum
  Clone ID: PAT_TA_26703
gcacgagggtttcagtaccgcccatttatacgcgcctctcccgtcccgtctcctcctcccccaatccctctctctccccatcacctcacagcgcttcttgttgtcctcatccgccccatcatcggctggagccggagctggaacgttggtgggcgcttagtcacatccggaccgccgcaatgatgagcttcaagaaccaccatgaggggtttgcggggcagcagctgctcgccgccgccgccgccgccgcgagccaggtctccggaggggcgccgctgccctggtgggttgggtcccagctgctgtacggcgagccgatgggccacgggaaggcgccgccggccgtgcccatgtccatgt

SEQ ID NO: 26704 - DNA, 608 bp, Triticum aestivum
  unsure (1)..(608): unsure at all n locations
  Clone ID: PAT_TA_26704
cccacgcgtccgacctgttcgctcgttcgctggacgacctgctctcgctcccgactcccctgaagcaaccgccggcggcggcggcggttcccaggggatttaggagctcaaatttcggtggtgccaagataggagcctgaggtggtcaacgaagaacacttaaaagctgacgttacgtaattggaacaatgcctcctcataagatagagactgggcaccaggatgtggtgcatgacatcgcgatggattactacgggaagcgcctcgccactgcatcctctgataacacaataaagatcattggcgtaagtggcagctcgcagcagcaacttgctaccttgagcggacaccagggcccagtttggcaagtcgcgtgggctcatcctaagtatggttccatgcttgcatcctgcagctatgatgggcgggttataatatggaaagaagggggcaaacctgatgagtggacacaggctcacactttcactgagcacaagtcttctgtaaattccattgcttgggcgcctcatgaactcggcatctgcttggcttgtggttcatctgatgggaacattttcagtctccaccgcgcgttctgatgngtgggt

SEQ ID NO: 26705 - DNA, 2047 bp, Triticum aestivum
  Clone ID: PAT_TA_26705
cctaaaccagatccagatgcgggtctgacaccggaccccctcccccatcgagcacgcgcttccccccgccgtcgattctccccggccgccgagcaagcccctccccgactcgtcgccgtcggcctcccagcaagcccctcccgctcctgacccgttcgcgcctccccgacccctgccgccgacctccgccggctgcggctgacgccgtcgacaactcctccccaactctgcagccttcagcctcccgcaagaagatcgagataggagcctgaggtggtcaggacagaacagttggttactactttaaagctgacacatacttggaacaatgccgcctcataagatagagactggccaccaagatgtggtgcatgacatcgcaatggattactacgggaagcgtattgccactgcctcctctgataacacaatcaagatcattggcgtaagtggcacctcgcaccagcaacttgctactttgagcggacacgagcaaatcgcatgggctcatcccaagtatggttccatgcttgcatcctgcagctatgatggtcgggtcatcatatggaaagaagggagtaagcccgatgagtgggcacaggcacacactttcaatgagcacaagtcttctgtcaattccattgcttgggcgcctcacgagctcggcctctgcttggcttgcggttcgtctgatgagaacatttccgtgttcatggctcgttctgatggggaggtgggagacgaggtcgcccgctcgcatcgaccaggctcatccagtgggcgtgacctctgtttcctgggctccagcgatggcccctggtgccctaatcagcccagggccttctgggcagtttgagtatgttcagaaacttgcttctggtggctgtgacaacactgtcaaggtgtggaagctcaccaacgggagttggaggatggactgcttcccagcccttcagatgcacagggactgggtgagagacgtcgcctgggctccaaacctaggcctcccaaagtccacaatcgccagcgcctctcaggatggaactgttgtcatctggacagcgccgaaagaaggcgagcaatgggaaggcagggttctgaatgatttcagaacccctgtttggagggtgtcgtggtcgctgacaggaaacatactggcggtctctgatggcaacaacaatgtgaccctgtggaaagaagctgtggacggtgaatggcagcaagtgactaccgtcgagccatagatgtttcgtgttctaccgctagctgcatttaccgctatcataataacaaatgtagtctgtctttattttatctgtatggcttcgattacaactggtaacttcccgtgattgttacttaggctgttgcctgtgacaagcttttttcttggtcaaaaagcagataatttggaccttgtatcccaattggactcatgtatgggtacgaagacttttgcctcgcaagttagcttctggtggcgcttccaacgctgtcaaagtgcgccagctggcgttcgagagctggcggcttcaccgccttccagcccctcagagactgagggagtgggggcgagtcggcaccgaacctccgacccccggagtcccaaatcccaagcgcgccaccggctcgcagcgtcgtcctcttgacctcagcaacgcgccgtgagaaggcgggaggcggggtggcagatttcttcaggactccagaacccccgtttggagggtggcgtgctcgcaaacaggaggcggactggggggccctcaccactgtgacactctgacacagaggacgttagcggtggatggcggatggcgactactgtcgaccctcaggccacccgcgttccggcctctacctccagctgcatttatcgccatcataacaaaggttctcctgcctgtggatttgctgttcggcctgcgtgtccggtgcggcctccccggggttggtaggctgctgctcacgcaggacagaacaggccgtgcgtgtgagaagctttttactggtcagaagcagaaaattggaacttctatctatcccaatg

SEQ ID NO: 26706 - DNA, 578 bp, Triticum aestivum
  Clone ID: PAT_TA_26706
gggctgcaggcgacaacgagcgcggtcgggaggttcgagggtaaggggaagttcttgcgtgcgtgcgtgcgtgcgtgaaagccggccatggacgcgcccttcttccacgagctccggcggcaggcctcctcctacctcaccggcaagatccgctccgcgcggctcgtgctcaccgacgtcaccccgacgcagctgatgacggaggaggcgacgaacggggacgcatcgctgccgaacgccaagacgatgagcctcatcgcgcgggaggcgttcgagatcgacgagtacctcaggatctccgacatcctccacaccaggctggcgacgttcgaccggaggcagtggcgggagccgtacaaggcgctgctgcccctggagcacctcctgacgcacggcccccgcagcgtggccctggagttccagaaggaccgggaggtcatccggcagatggccaccttccaacacatcgacgagagaggtttcaactggggtctgacggtgaagggcaagtcggagcgggtgctgaagctgctggagcgggggccgttcctggaggaggagcgcgagcgggcgcccaa

SEQ ID NO: 26707 - DNA, 737 bp, Triticum aestivum
  unsure (1)..(737): unsure at all n locations
  Clone ID: PAT_TA_26707
cccttttttccgatgaccccttaatcacaataacaaaaccgaaaaaatgtaactatagcatatactccttacaagcacgtacgttgtacagatgcacacatacatacatcttgcttgtcgtatgcagtgcactgaagtaacaaaacactcaactttcattcccacggaccactccacacaccccaacaaaatatagccatcacatagggttccgatgctgatgatgcatgcgacctgcataacttccttttctctttggaaaagcaggtcgttgtataactagaggcgcgcaagcgtctgcaggtcgacggggtggacgtcggagggctgggcggcgctgtaggcccgcctcccgacgaggatgttggcggcctccgtggggtggaaggcgtcccagaagaggtactcgttccggttggcgcacggcgtctggaagggcaggcacgtcacctgcccgttgttcctccccaccccgcagcaccccttggtcagctccgtcaggccgttggcccctggcgacctgataatgtcctggaagatcccgtaggcgttgatgtaggtgaagtgcgcccccgtcagtgtgttgaactcctctaccagctccgctccattgcgcttcccgctatcgcggaccccgtggccccgcgccccgctgccggcccccgcggacccctccgcccccccctcgtgcgcgccgcgccccgcctaagatctaactgcncttacggtgacaacan

SEQ ID NO: 26708 - DNA, 756 bp, Triticum aestivum
  unsure (1)..(756): unsure at all n locations
  Clone ID: PAT_TA_26708
ngcctttgttattctccgcctccttctgtgaaaagacgccagtngttccctgctaccaaggtcctatcactctcagcttgtccgaggaggctcagatgctcatatggagtgcatttagcatgtcttagtgcgttcgaactaatataagctgccagagaaatataacctaaagcggtcgaatgatgagtactaaggtcaccactactaaatgtaaacgggcaggcagtaaaccagaaacccaatattgccccataactgctactcggttaacggcctctgttgggtaattaatagtggtggtaagagttacccaaagagcttttcgttttcgtggttcaggtgctttatatttagcagctaatagccggagttgtaatagtaataattgccgcccttagggctaaccttgttgaggggattacggttgcccctgttaccggagttgccgctgttaattagcttctactatccccctttgttgccggtaagcttgagctaccgcctattgtttttaaccttgttcatatgattattgttaatagggccccttttaccgctatttagcgttaataatctagtatggttaccgttgttattcagcgagtaattaaagtaattattaagctacctgtaaggtgcctctgttatttgccttttatccttttggtatactgctaggtgttgagctataagtcagcaactaattagcatgcggtggccgccggagtaaagcacagtcaacatattcgatggcca

SEQ ID NO: 26709 - DNA, 1542 bp, Triticum aestivum
  Clone ID: PAT_TA_26709
ccctggtggctgccccagtggtgacaactgtgagttctcccatggcgtgttcgagagctggctgcacccaacacagtaccgcaccaggctctgcaaggagggtgctgcttgcgcccgccgcatctgcttcttcgcgcatgatgaagatgagctccgccatgtgccgcacaacagcggcgctggtctcctatgaccccgtgcaacttcatccatccacatgactgccgccgctgctcttgggcttcttcctggatctcctaggcactttgtgccgcctcctggatcaccatctgccgtgaacaatggcggagctgcttctgcgcattggcttcaaggtagcaggctgcgttcttctttcaatgcaggagatgcgaccgttgaagaccttggcttgctcctcgactgggagtcacagtaccttggggcactctgcctccctcccagcagccgtccccagccccgtctttctactggcctcagcatcaggcctacagcaattgcccccaccagtcttgaagatatgtatgcttcagagatggcaatgtcaccgaggttcaccaatgatcaagggcactcagcctactcaccagcccacaaatcagccatccttaacaagcttcatcagcagaagggtctcctctcacctgtcaacaccaacagaatgtactcaccaagggctcttgatccggcagcgcttgtccattctccaattggcggcatgtctcctcgatcccctcggctcatggagccaacatcgcccatgagtgcccgtttcggagccactgtcccccagcgtgagatgtatgagcagttctcttccctgaacaagcaccagctgccatccgtgggctccgccacggaattctaatgctgcttcatggggcaacgtgggttcttccccaatgggtaagggttgactggggtgttgaatggtgaggagctggttcggttgagaatgccctgattcaaccagggtttccagagaaggggccagatgccccatgggggcggtcacttgaacagcaacaggggtgaaatgcccctggccttgccggggggcgggccggctggtgcggcaaacccgcccggctggaccaaccaggctgatttattggatcagatggccattggtgcttggcttgagcagctgcagacggatcagaagtgactgaaggaggtggccaagtccacagttgatgagaccatcattttgcaaggtggttatttaccaaagaagaatagttgctggtcctagtaaataataattattcatttttattcttgaatttttggtggcaaagtcagagatggtgttgaaaaaaacagagcatccggtctagctgaaagcagattggtagctgaaagcagttaaggatattcagtaaacaacctcttcattgtcctaactagtattcttttggttagttcaggcgggtcttgaatacaagattcctcccaaagagactagaattgtcaattcttcactcgaaatgaatgattattttgtgttaaaaaaaaaaaaaaaaaaaaaaaaaaaaaaaa

SEQ ID NO: 26710 - DNA, 567 bp, Triticum aestivum
  Clone ID: PAT_TA_26710
cccccctcgagttttttttttttttttttttttttggaaaataccatcacaggtttaatatagcaaacttctgacccgataacattaatgtcaagagaaacacttgcaattcaatatcagctatacatgaaggcagttaaatactaaatgcaaaaaggaacaaaacagcacaagcttgccatcagaaagccatgtgtaatgctgaaagaactcctctgtgcggcacagttggtcaaaacagcatgtagcatcaaattagctagccatctagatcatctcagttagtggtcatatccagaggacatctgctctttgtgatgttcagttctattcaccatgctaagaagctgagcggcccttaacagggctaacaatctttatcctcttagtaatagctctgacagaagtaacagatgtaactgcttgcgaattgatgtcttcagaggggactgctgacattggcttcattggatctggaaaagctggatcggcagacatgttgttactcttcacagtgggcagaagtctttgaacttcaccatttggggaagagacctcacattgaag

SEQ ID NO: 26711 - DNA, 583 bp, Triticum aestivum
  Clone ID: PAT_TA_26711
ggcacgagttgcaatgtcgtgactgcagaggtatccttctctctgtaacaagtctaattatttgcgaattgggtgtgcatatgcttgcgtctacctactctatttgcgctcaaataccatatatgtatggactggtagaggtaaaagataaattcagagaaagataaaaaggaaatgacatctattcctgaatttatgtttctatggtgtcatgggttcagtttgtgttgcacatttatgtgtcaacgacgactatcaaacaagaaaattgttcaccagctatggccacctccgcgtttatcttttcatggtcatggaaaatgaaatgttcatgaatcgccggttgctttcaggccgacacgggctgccggtccacccagcgcgcgggtagctgtgcagatctctaatcggcaccctccctatggcaccgccccacaatgccgaccagcattgaatatgccatggatccgccaagcagacgcctcaggacggtcatccagaatgctatcctgcctccattcaagcccaggcgctcttcacttgcttcataatttctgaataaatgcatctatgttcagtctga

SEQ ID NO: 26712 - DNA, 626 bp, Triticum aestivum
  Clone ID: PAT_TA_26712
gcagcatggctaaacaaaatgcagattctcaagaaggccacaacaaatctgcccaagagttacctcctggttgggctgagacgaaggatccaacgactggtgcttcttatttctacaaccaaagcaccggagtgacccaatgggatcgtcctggtggtaccgtgaatactgtgcagcatcaagctgctccatcattgccagaaaattgggaggaggcacttgacaaatcaacaggccagaaatactactataacacaaagacacaggcaacacagtgggagccacctacttcggtgaacccagttattgtgccacaagcacccacccttgttgcagttcagcctaccactcaaaatactgatctttggaaccctcacatacaacgatgttcaggctgtggtggctggggagtcggtcttgtccagccgtggggatattgcaatcactgcacaagggttcaaaatctgccttttcaacagtatccatcttactcgaacaatatcgtgccctcaagtgtcgccaatgctcccaaaagtcaaggaaacattgcagctaaggacagatcaagttcaaaaccccttcaggaaaaaaaaaaaaaaaaaaaaaaaaagtcgacgcggccgcga

SEQ ID NO: 26713 - DNA, 345 bp, Triticum aestivum
  Clone ID: PAT_TA_26713
gaattcggcacgaggcgctcgcgctggcatgggcggccgcgttcgggaaggcgtgggtgggcgcgtggggtggcccgagtgggcgcgcgggggcgcggctcgggcgcgctggcctccggcggcacggatctggtgccttgcgggggctcacggtcggggagtctggccccctggttgcgcggcgttgcggctccggcgtttggtgactccgaggctgcgcctcggcaggtggcggacgcggtagcgtcgttggcaggatccggggctgcggcccggcggctccttcccagcgagtggggggtggggtggcgccccccttcctgccttcgggtccttcatctcatg

SEQ ID NO: 26714 - DNA, 469 bp, Triticum aestivum
  unsure (1)..(469): unsure at all n locations
  Clone ID: PAT_TA_26714
gaattcggcacgagtctgccctctcttccttatctcttcctctcccgatctgagcggcggcggcggcgacgctcgcatccggcaacgcttccacccctctgcccacctcttcctcccaccactccatcaccatccccacatcgctgctgatttcccatgcggaggtggtcctgtggcgccgatgcccttagccagctgccggcggcggcactttttgttcgtgcccaagcgcccggtgaggccacctctcacctccctcctatggtgccaccgcccccaacccatacgcagcttcctcttccccgctcccatggtagcagatctgagtggtacaaggtcccttcggtcctggtggttcggaatgaggcgggccgcctctgctcccttatcttctggcgggtggctggtgccccaatctctcttanccatctatggcggcaacgacatcaggaagctctctctttctctc

SEQ ID NO: 26715 - DNA, 618 bp, Triticum aestivum
  Clone ID: PAT_TA_26715
gttaatcggctcaaaatgtgacaatgattctatatgaagttcttcggttgtacccaccggctactgtattcacccggaaaacatacaagaagattgagattggaggcatcacgtacccagccggtgtgatgtttgagatgccagtgttgtacatccaccacgacacggacatttggggagaagatgtgcaccaattcaacccggataggtttgccaaggggatctccaaggcgtccaaggacccgggcgcatttttcccattcggttgggggccacggatctgtatcggccagaacttcgcgttgctcgaggccaagatggcattgtgcatgatccttcaacgctttgagtttgagctcgcaccgtcatacacccatacgccgcatagcgtgatgatgttgcgtcccatgcatggtgctccgattaggcttcacactatctcttcgtaatctcatgctcagactaggcttcacattatctctttgtagtatcatacgcatggcattcgcctcctatgtgatatgtatgtagtcttatccgcggcaggttttagtcaccatctgtgttttttaaaaataaaagccaacaattttgggactcatgaagaaaaaaaaaaaa

SEQ ID NO: 26716 - DNA, 669 bp, Triticum aestivum
  Clone ID: PAT_TA_26716
gaggcacttcgctggtgcccctgacagtgctgtggacaccttcccgtgcaaggatgcaacactacaaggatgcaacacttgctagtgccgagctaccagtggcatgcgtaagctctgttgcggaccaggttgattcaagaaacagtgcacatgcaaacgagggagtcccccggcatttcgatctcctcacaaggggtttgagagaaatccctgttccactgtgggatggcattgacatgtcagataggaaggcaacagagtttcaatatccgagaaggaccgacagtattggttatgtgctagatgaatgggacgaggggtatgatcgtgggaaaaggaagaaggtgaggaagccacgtgaggagccgaacggaccgaacccgttccaagaggcggccgatgtcagagcacggccgaggaagagaccgagatgcgaccaggccagatggggaaaccagcctcgcaggatatgacaaatcggagcagcagacgatgttgttgtatctatcacccagttttgcagtgattgtttttcatttatccttgttttgcttccctcggtgtacgttacacttgtttttcctccagtgttgtcttccccatccttggatgtgtttgtaaggagccctgacagtattcggaagcatgttgttcgttttctgagtgatc

SEQ ID NO: 26717 - DNA, 494 bp, Triticum aestivum
  unsure (1)..(494): unsure at all n locations
  Clone ID: PAT_TA_26717
ggcacgagctagtgtcgagtttttttttttttttttttttttttttttttgtcaaaaaaccagaagtatatgcataaagatcagcttcggcaaggttaccagaagcagtttcaacgtcgaccaacaaccacctagtcaatctatagttacacaaatctgtcagcacagctccaacgttttccctattcgtctttcatggccgtctgatgcctccttctctgngcaacctccacaagcagagtcagcanagcttcgcatacctgcgacgtgttcgcctgatccccgggctcctcattcatcgaggaatacaccatccacgcatggtccagcttccgctctggtcggaccgccaccgatccgggaacttcagcatccttcctcgtcacaagaccgtcactcttctcaccatacctngccaccagcagctgcgagcatgctgccaaggcagctgaaagtggcattacaaccggaatcctcgcaggattgccgtcagc

SEQ ID NO: 26718 - DNA, 777 bp, Triticum aestivum
  Clone ID: PAT_TA_26718
gtacaagctaacattgtacatgtgtacattatattggccacttgtattaagtgcagctcatttctgaaattgacgaaggatatatcgtgggtgtcaaatgtgtatgggatctcttaagacatagatttatgttagaagaaaatgctcagctaagcgagctgtctcctgaacaacctaccatcaattgtttcgcataccgttactacctatccaacatttgggcgaatgacaattccaccagagacgctcttggggtgaagcatggaacaattggagagtttaagagatgcagaaaaagtatgccctattcatttgatctcttgagcagcatagagtaccatttcaacctcacaatcaggggctaccgtgcacttgtgtttagcggggatcatgatcttgtgataccatttttgggaacacatgcgtggattagatccttcaacttctcaatagtcgatgactggagagcatggcatctcggtggccaggctggaggatttacaatcacatatgccaaccatttgacatttgcgacactaaagggtggtggccactcagccatagagtatcggcctagggaaagtcttgccatggctcaacgttggttggataataagccgttgtgatgtgttgtatttgccatgttcggttcatttgggtttttcatgtacaataaaaggcatggctccaatagcttttttcaaatggtggaccatttttcacaagacgcatttgaaggaaatatgccctagaggcaataataaagttgttatttat

SEQ ID NO: 26719 - DNA, 1278 bp, Triticum aestivum
  Clone ID: PAT_TA_26719
cgcccgcgttggtccccgaccgccgccccccgttcgcctccgccgccgcctagccaccacgcgccaggagaaccccgcgccgccggccatggcggaggaggagggcacgcagcagctgccgttcgtgcgggagacggtcctcaagaagaggaaggacaacgaggagtggcccaccaagaaccgggagcgcaaggcggccacggggcagcgccgctgccgccacgccaaggacgcaagcaagcgccgcgaggacttcgtcaaggccgtcagcaacagggagcccgactgccggcgcgcgcgcacgcccctcaaggtccggtacctccgcccgagggcgtcgaccgagagctacccgcccttcgccgcccccatcccaggcaccgccgacttccccccgcacagcaggaacatctcggccaggctgctgctcacgcagctcctcaccggcgtcctcatcacggccaccgcggacatccacaagcggcttgcagctgtcgggcccttcgtcacctatggcctccccaatatgaaggttgtgaaggagcttatctagaagaagcgccgcggttatgtcgacgaggagcctttcccccccaccagcaatcatctaatcaagaatgtacttggagaacacgttgtcatatgggtggaagacgtggtggacaaaatctccatggtcgggccacacttaagagcaacggcgagctttctcatgcccttcaagctcaagtgtccggagaggaggctgcggatgaagaagaagcccttcaaggatggtggcgactcgggcaaccgtggggacaagatcaacgagctactcgagaagctgaactgaggcagtctccaacctgcgtccgcaaacaagcgatggatccgttattaccttgtcggttttgtaatagcatagctgaatgtacctttgttttggaaaccctgcctgagtgtttgggatcaaatcacgaaatactgttcttcgccccatagctgaatgtacctttgtttcggaaaccctgcccgagtgtttgggatcagatcacgaaatagcagaaactgttcttctcccctgcccttggttgtgtgcacgctctgcgcttcgtgatcgatcagccgtgctttgctgaaactagctgttcacagtgtttacttgtaccaacaggcttgcctgggtagttgattcgtgaggttggatgatattgcaacaaaacatcaggttctctgggcgctctatactttagctattttgccagatttgggaaaaaaaaaaaaaaaaaaaaaaaa

SEQ ID NO: 26720 - DNA, 511 bp, Triticum aestivum
  Clone ID: PAT_TA_26720
ggcacgagtgcacactggactgcagcgaaacgtataatgagatatgtgagaaatacttagtgttggactcactttcagcaagtcatcatctactcttgttagtgcgttttctgattctgattgggcatgttgcttagatgatagaagatcaactggtggttttgcagttttctttggtcctaatttgatctcatggtgtgcaaagaaacaagctactgtttccagatccagcattgaggcagagtataaagcactggccaatgcaacagcagagatcatctgggtaaagtctatgcttaaggaacttggaatatttcatacccaaatttcatgcctttggtgtgataatcttggtgctacatacttgtctgtcaatcctgtctttcatgcaagaaccaaacatattgagattgattatcattttgtgagggaaagagttgctaataaggagttggaaattcgatttgttcactcaaaagaccaagttgcagatgggtttacgaaggccttg

SEQ ID NO: 26721 - DNA, 662 bp, Triticum aestivum
  Clone ID: PAT_TA_26721
ggacttctcgccgcatggtgggacctcatcaccaccaccgcctggttccgcgaccactggtcccgcgagcacgcccacctggatgagatagccgagcagctcgagttggtcgccctccttgcctacgatgaggatgaggacctcttctacggcgagcaggcccccgccgccgccgccgcccttaagacagattcggtgctcaaggcgctgaacttgggctccccgaagagcggcgacgccccgcgggggttccgggagaaacccaggcactccgagaagccgaccaagtacgccggcagccccaagagcagcgctcctcgcgtgatccaccagcctcgctaggttcgctggccggcccctgatggggactcggtgactcacatggaaggctgctgcctctctagcagcatctgctactggctgcagctgccgtcggcgtcgtggtctgtctgtcaaagtcgaagtaaaaaaacgtgagtagttgtactactgtagaagtttcttttgtatagcatgcacgtaagaaatgaccaaaaaatataacaagaatgcagctgttagtttactgctgctctcctcgtgtgtctagggtgcacttctgtaagcaaacgtatatgatgtgtaatggcagacagcttaatgttacaactagctcttctact

SEQ ID NO: 26722 - DNA, 674 bp, Triticum aestivum
  Clone ID: PAT_TA_26722
gcgtcccgactcgtctcgctcgtcgggtgggaaaccctagcttcgtataaacccaaaccccccgcctcgcctcgccggagcggcggcagcagtcgccggcagcgatggacgcgatgcggaagcagctggacgtgctgatgggggccaaccgcaacggcgacgtgcgggaggtcaaccgcaagtacttcgaccgcgacgtctgccgcctcttcctcgccggcctctgcccccacgacctcttccagctcacgaaaatggatctcggaccctgccccaaggtccactcgctgcagctgcggaaggactatgaggaggtgaaagcaaaggggacggagaatttcgacagggagctcgaggacatgatagacaggctcatcgtggagtgcgagcgcaagatccagagggcgctcaaacgcctcgccgacgaggatgccaaggctgctatcgccatatccgtctccgaggtcactcagtctgaagaagttgcgcagctgtcaaaggaaatcaaggagaaaatgaaagaagctgatatcttcgattttgaagggaagactgatgataaaatcaagaccatggaattggtcgaagaattaagatctaaaagggctgacctgcaggctaccctcttgcttgatgcctttaacaaggacagagctgcaatacctcaacctatt

SEQ ID NO: 26723 - DNA, 1770 bp, Triticum aestivum
  Clone ID: PAT_TA_26723
cgagaggtcccgcagccttctcgctcgtggggtagaaaccctagcttcgtaataaccccaacccccgcccctcggctcgtgttaacgcagccccccgacgcccccgcggccgcggccgcggcgggagggccgggaggtgatctagggggtgccgaacccacgggagatgcgggtgggggccaacgcgaacaatgacatggccgagttccccctctaatgctccgccctctatgccccccgcctcttcctgaactcgccaagcttccacgagcactctcccctgaggcaaacgcactgccgaccccgcaacaatacgaaggcgcaaaagcagaggacggagaatgtagagatagaggtcaaggggacatgatatagagactcatagttgcaggagcggatcgtcaagctcatagtgaaatgtcaggcgtaggagcatgcgatggctgcggtgccccgaccatagtcaggctcaggatacactcaagatgttgaggtccgcggaaaggtaatccgaaagagatgtgcagatgtaaaaagcaatcattttgaaggtgaaagggacgactaattttaaaattgagactatgaaataggatgaagaattaagaattaaaagggctgacctgcaggctaccctcttgcttgatgcctttaacaaggaccgagctgcaatacctcaacctattccacctcctcaaatggcaacactgccagcacctcctcctcctgatgctcgtactcaagaactgatcaatgagaagctaagtaaagctgaagcccttggtgaacaagggatggtagaagaagcgcagaaggctttagaagaagcagaagctctcaaaaagttggcagcggcacggcaggagccagttgctgatccttctaaatacagtgttgctgatgttcgaattactgatcagaagttgcgcctctgtgacatatgtggagcatttttgagtgtctatgacaatgatcgacgtcttgctgaccattttggagggaagctacacttgggttatatgttgattcgtgagaaactgaaagaactccaggaggagaggaccaaaaaaaggaccgagaaacctgaagatgacagacgatcaagggaaaacagcagggaccgcaatgggcgggcatccagggatagagatgcagaaagaaaggacagggttgagccccgggatagcagaagagaccacgatagggatcgtgataggcgccatgacagggaccgtcgccatgaccgcgaccgtgatagagaccatgaccgctcctcccgtggtagagagcatgaccgtgataggagaagggaacgctctcgatccagggaccgcagcaggcgccatgaaagatattgagtctgttgctccatggctggctgattcccctgggggatactctcgtcttcctgcatgatagtgatggtgctttttaagatatatggtgaggttgcgctttgtactggagaaaggaagatagtcttgatgtttgtcttcgctgctggattgttagtcacaaaccctgtgctcctgttatgcatcttttctgtctatctgacctgatgttgtgtacttatactgttttatatgttaccaacaatgtatgagttttgtgttactcaagcctccttggcccggttgtcaaactcacatgtgacggtatttgtaatttgcttatcttatgatggtatggagctaattttctccgtcttgttaaaaaaaaaaaaaaaaaaaaaaaaaaaaaaaaaaaaaaaaaaaaaacacaaaaccc

SEQ ID NO: 26724 - DNA, 634 bp, Triticum aestivum
  Clone ID: PAT_TA_26724
ttttttttttttgagtagacaaagcttccggcatttgaaattatcataggtaaagggtgtgcggtcttctctatgacaaaattgatggtaagctacttaactctgacctgaacctatgtaattaatgtgtaaggtagaccatctctgtataacacttacaagctgtgtattatactagtaataagatcaagtaacctggatggtacatggttcgcagttttgggtaaaaaagcttgtccttgtcagagaagcatctgggacaaactgctgcacatttgctccatatagctgactgaacattccggcaccaggagcacctcttctttcaagactcccttctgagaaaatccatgtcagaactcggagcaaacaaacttaccgaccacaggcatgaaacccctgattccattcagcaagtcaccagtcttttccttttgactatcctccactcacgcagtttagggcagacctgtcatttggaaaaacaggcaccaaacagcacatggtaaacaaaatacagcatttttttacaaccaatttggcacctgcataatctgtttagtggaaggtcacttcaaatcagctcattcacacaagtgcatattctcaccaaggacgtttccagtgagcattt

SEQ ID NO: 26725 - DNA, 587 bp, Triticum aestivum
  Clone ID: PAT_TA_26725
tttttttaggaagcactatatgatggtaacgtaacaatgaactgtcccttaacacgttgtccaaggtagtgattttttctagagacaatcaccccaatgcattgtatctttaggggttgtatccaagtgatattgcatttaattagtttagcgatcttttttgcattttaacattatggcctagttgtggagtggagagaagaaaagaagagaaaattaaggagacaagccacaaaggataaaatcattaattacactgcatagaaaaacgagctaagagtcgtatcttcactaacatacaattccactctcttttctttaattacaacgccacatcagcattttgtctatgataacgtgctatcgagccaagaattaggaatatcatgcatgccaactagacattttttatgagttgtgcacggaattaaataaagaaaaatagggttgagtatcatattagagcaaggttaatagtatagccaacaacggaaaatacactccaccccctgtagggatattaaattcaaaaagtaccaggaaaacaaaaaaaactggtgtttggggacatcaaacctgaatgccca

SEQ ID NO: 26726 - DNA, 201 bp, Triticum aestivum
  Clone ID: PAT_TA_26726
gcggacgacggcggagaacctccggcaggtgacgacggcggcccgcgcaggccggctgcggcggcggtggaaggcggtgctgctgccgccgccgcacaggcggctgcaagaagagatggtggccatcgtgcgtgcctccgatgatatccgcctagctacttccttgcttaattcctttggttttgcaggtgtggatggctg

SEQ ID NO: 26727 - DNA, 1103 bp, Triticum aestivum
  unsure (1)..(1103): unsure at all n locations
  Clone ID: PAT_TA_26727
tcggcgtgtgctacggcatcatcgcaaacaacctcccaccgccgagggaagtggtgcagctctacaagtccatgggcatcaccaacatgcgcatctactccgtccagctccaggcgctcgacgcgctccgcggctccggcatcagcctcatgctcggcaccaccaataacgacgtcgccgccctcgccggcagcctgtccgccgccacctcctgggtgcaggcccacgtaaaaccctaccacagcgccggggtgaccatccggtacatcgccgtcggcaacgaggtcacgggcggcaccgcgcagcccatcctggcggccatgcggaacctcaacaaggccctggcggcggccggcctgggcggcgccatcaaggtgtcacggcgggtgaggtttcgacgtgctcaccaactcctacccaccctcgncggcnggtgttcgctcagccctacatggtcgacatcgcccggcacctggtcagcaccagtgcgccgctgctcgccaacgtgtacccgtactttgcctaaagcagcaacccgaggaccatcaagctcagctcgcgacgttccagccgaacacgacgcccgtgaacgacaacggcagcgggctcgtctacaccaacctcttcgacgccatggtcgacgctatgtacacggcgatggagcaggcgggtgcgtcggacgtgcccatcgtggtctcggagagcgggtggccatccgccggcgacgacctggcaacccccaccaacgcgcaggcgtacaaccagaacctgatcgaccacgtcggcaaaggcacgcccaagagggccgggcccctggagacgtacatcttcgccatgttcaacgagaaccaaaagggagggctcgagactgagaggaacttcgggttgttcaacggccccgataagacgccggtgtaccctataaggtttaccaattagttaagacgaccggactatatcttcatgtttacaggagtacatacgtactgtagctcttactacggtcgatctcaataagctgcggaataattcgtgcaaggacgtacaagtattttactagataatgtcatatgaataagagccataaattgtgttttggaaaa

SEQ ID NO: 26728 - DNA, 754 bp, Triticum aestivum
  Clone ID: PAT_TA_26728
ccgcgctccgcaactccggcatcggcctcatcctcgacatcggcaacgaccagctctccaacatcgccgccagcacctccaacgcggcgtcctgggttcagaacaatgtccggccatactacccggctgtcaacatcaagtacatcgccgccggcaacgaggtgcagggtggcgacacgcagagcatcgtcccggccatgcgcaacctcaacgcggtcctctccgccgccggtctcagcgccgtgtacgcggcgctggagaaggccggcgcgccgggcgtgaaggtggtgatttccgagagcgggtggccgtcggccggcgggttcgcggcgtcggcggacaacgcgcggacgtacaaccaggggctgatcaaccacgtcggcgggggcacgcccaagaagcggcaggcgctggagacgtacatcttcgccatgttcaacgagaaccagaagaccggggacgccacggagaggagcttcgggctcttcaacccggacaagtcgccggcctacaacatccagttctaactagctatctcttataccatacctacatcttcatcctaaataataagctgtacgtacgtacgtaatgcggcatccaagtgtaacgggcacgtacgttgacacgtactacatgtactatcatccatggaagagcgcaatgcaaccatgcatgcgttaacttcctggcgatgatacataatcatatgatgatgaataaagagatggaagcagttatgaatttgtcatcc

SEQ ID NO: 26729 - DNA, 844 bp, Triticum aestivum
  Clone ID: PAT_TA_26729
cagagatatagtatcagcacatgtcatgcatccatgtttccagctaagtgctcgtgtccacctagtgcgcattgtcgtactatccttcttcctttgatcgtatcacaaccattccctttttacaagtatataaacgagagagaaggacatgcacatcgaccaattgtggctccctctcctcgtcttatgagtacatattgtgaagctgctgctcatgtcgccttggtggtggtcactcctccgtatcagagtccagcgggcaggagccgtcgtcgatggtggccagtgggtcgaacatgtgcgaggtcgggtccatgcacccgctcacgatgtccagcttgcaccggtctcctccctcctcgtagaagccgccgatgtcgcagcttgtgatgacgatgttctcatccgggaagatggccctgtcgcaggcgccctccatgttgagctcgtcagccagcccctcgttgaagaagctcaaaggcttgtcgagccatggcttggggaccttgaacttgagggtgtaagcccccggtcccgtgtttccgttggtgaaggagaaaaccagtgtcatggcatgctgcggcacccggatcctgatggtgtagatggggggacaggctttccccctctcttgcagcgtcatctgcctcggctcgccgccgcacatgatcggctggttaaagcccccgttaaacgcgatgccaaactgctcgttgggtgtcagcttgctcgtccctgggttgtagaatatcttcaggccctctcccggggctggaggaaggccgttggtggtcttccagtaaaaggagaattccccagctcgaactccgcccacgtcggaaga

SEQ ID NO: 26730 - DNA, 1692 bp, Triticum aestivum
  unsure (1)..(1692): unsure at all n locations
  Clone ID: PAT_TA_26730
tgtacattctgcggctggagtagatcgagagctgggcaattccgagccgtgtagggtgcaacaggatgccggggatgcgcggctctgctccggtgcttgcactggcgctgctcgtcggagtcttcatcgcccaggcccctgcaggtgtgcaatccgttggcgtgtgctactgcatcatcggaaacaacctcccgccgccgagcgacgtggtccagttctacagattgttggggatcaccaacatgcgcgtctactacgtccagctccaggcgctcgacgcgctccgtggctgcggcatcagcctcagcctcgggaccaccaacaacgacgtggccgttctcgcagtagactatacgccgccgtcgcctgggtgcaggccaacgataaggcctactaccgtgccgcaacatcctttcgctacattgctgctagcttagctccctgtgtatatgctgctcttcctatgagtgtgcaatccatcggcgtgtgctacggcgtgatcggcaacaacctcccctcccggagcgacgtggtgcagctctacaggtccaagggcatcaacggcatgcgcatctacttcgccgacgggcaggccctctccgcgctccgcaactccggcatcggcctcatcctcgacatcggcaacgaccagctctccaacatcgccgccagcacctccaacgcggcgtcctgggttcagaacaatgtccggccatactacccggctgtcaacatcaagtacatcgccgccggcaacgaggtgcagggtggcgacacgcagagcatcgtcccggccatgcgcaacctcaacgcggtcctctccgccgccggtctcagcgccatcaaggtgtccacctcgatccggttcgacgcggtggccaactccttcccgccctccgccggcgtgttcgcgcagtcgtacatgacggacgtggcccggctcctggcgagcaccggcgcgccgctgctcgcgaacgtgtacccctacttcgcgtaccctaccccgacaaggacaacccgcgggacatccagctgaactacgcgacgttccggccgggcaccacggtgcgggaccagaacaacgggctgacctacacgtgcctgttcgacgccatggtggacgccctggtggcagcgctggagcgggccggcgcgccgggggtgagggtggtggtgtcggagagcgggtggccgtcggcgagcgggttcgcggcgacggcggacaacgcgagggcgtacaaccaggggctgatcgaccacgtcggcgggggcacgcccaagaggcccggcttgctggagacgtacatcttcgccatgttcaacgagaacttcaagaccggggagctgaccgagaagcacttcgggctgttcaacccggacaagtcgccggcgtaccccatccagttccattagtctggctgcgtcgtccatacatgcgccggcccgtacgtacacacgtgcactgtcaacctaaataagctgcgtatagtgcaggagtgaagtgtaacgtgggtacaatatacgtacacgtcgacatattgtcagcctaaataagctgcacgtattgcagcagtgaagtgtaacgagagtgcatgtcagaacatcgattcatgcaagagtagtgcgaccattccaggtggtgttatatatcgtctgtcatgaataaagagaaggaaattgaggcagtcnana

SEQ ID NO: 26731 - DNA, 1205 bp, Triticum aestivum
  Clone ID: PAT_TA_26731
aaataatcctagctaatggcagcagggagagcaaagtatcaagtcatcaaccagagaattctgtgacctgcttgatcccgcagctagccatgacgatcggcgtctgctacggcgtggtggccaacaacctcccgccggctaacgaggtggtgcagctctacaggtccaagggcctcaccggcatgcgcatctacttcgccgacgccaaggccctctccgcgctccgcggctcaggcatcgccctcatcctcgacgtcggcggcaccgacgtgctggccagcctcgccgccaacgcctccaacgcggcgaactgggtccgggacaacgtgcggccctactacccggccgtgaacatcaagtacatcgccgccggcaacgaggtcctgggcggcgacacgcagaacatcgtcccggccatgcggaacctcaacgcggccctcaatggcgccggcctcggcgccatcaaggtgtccacctcgatccggttcgacgcggtgaccaacaccttcccgccgtccaacggcgtgttcgcgcaggcctacatgacggacgtggcccggctcctggccagcaccggcgcgccgctgctcgccaacgtgtacccctacttcgcctacaaggacaacccgcgggacatccagctcaactacgcgacgttccggccgggcaccacggtgcggaccagaacgacaaaacgggctgacctacacgtgcctgttcgacgccatggtggacgccctggtcgcagcgctggagaaggccggggcgccgggggtgagggtggtggtgtcggagagcgggtggccgtcggcgagcgggttcgctgcgacggcggacaacgcgagagcctacaaccagggactgatcgaccacgtcggcgggggcacgcccaagaggcgtggcgcgctggagacgtacatcttcggcatgttcaacgaaaacttcaagagaggggagctcgtggagaagcacttcgggctgttcaacccggacaagtcgccggcgtaccccatccagttcaagtgatctagtcttctagtctagtcgagctagcttacacgtgtacgtacccaggtcttctagtctagtaagtacacacgttcgacacgtactccatgggagagggaagccaatgacttcctgttcctggtggtgatacatcatcatgttatgaataaagagagggaagcagttatgaatttgtg

SEQ ID NO: 26732 - DNA, 2345 bp, Triticum aestivum
  Clone ID: PAT_TA_26732
gagggattgggcagcattgccgagcggcctgtaccaaggcagcaaccctaaccggaagggtagcaagggctatcgcctccggtttgggcgccggggtcgtccttggaacgctcgccgccctttcgttagccgtcgccccgttccgttcctacctcggcgtggatcgccagccccctcccgccgaggagcggcgggcgcgcccctccgccggtcctcggccgcccgcctccgggccccccatcgcctaccccggcgcgcgcccccccccccccggccactccaggcgcgcccgccgccgccctctggtacgcacccacccgccaccacctgccgacgtccaccgccgcggaccgtctcgccccgaggaccgggatcacgacggcgtccgcctccacggtcgcgcccccggccccggcctccgcgcgggccccccgcagcaccgccacgaagcggaacgcaatcgcaccgaccccgcggcccctccccgccgccccccccccgccgccgtccgtgtggccgtccaatcctgcccccgtgggcccgcggctctccacggtcgccaactcgttggccaccgacaccccgcccaccgtccccgcgcctatcctgccggccgccgacccgcctccgggccacggcctgggcggcgcccccccccgccgcagccagcccccgcgccgtagaagtacgccctcggcgccgacccgcgggccccggcaccctctctccaggccccgtgccgggggcgcgcccccaaccgttcgggcccggagccccggcctgcccgagcccccctgctggacgcggggtggcgccgcgtccgcggggctgggggaggcgggcgccggggtccgggcgctgattcacgcgcgccggggccgcggcgggcgcgggcgggggccccggacggtcgcgcggcacaaccgcgggccgctccaccggggcgggcggttcgcccaagaaccgcggctgcaatacatctgcgccgtgtcaaccacacgaggcgtgagccacggagacgactttcgtgctccccttcctgacaagcgcggctgataattagctccacatcttcaaactaaatctctagtagtattgggtagcactgaagagcagcagatacacagggagctaagctagcagcaatggctaggaaggatgttgcttccatgtttgccgttgctctcttcattggagcgttcgcttctgttcctacgagtgtgcaatccatcggcgtgtgctacggcgtgatcggcaacaacctcccgtcccggagcgacgtggtgcagctctacaggtccaagggcatcaacggcatgcgcatctacttcgccgacgggcaggccctctccgcgctccgcaactccggcatcggcctcatcctcgacatcggcaacgaccagctcgccaacatcgccgccagcacctccaacgcggcgtcctgggtccagaacaacgtgcggccctactacccggctgtgaacatcaagtacatcgccgccggcaacgaggtgcagggcggcgccacgcagagcatcgtcccggccatgcggaacctcaacgcggccctctccgccgcgggcctcggcgccatcaaggtgtccacctcgatccggttcgacgcggtggccaactccttcccgccctccgccggcgtgttcgcgcagtcgtacatgacggacgtggcccggctcctggcgagcaccggcgcgccgctgctggccaacgtgtacccctacttcgcgtaccgcgacaacccgcgggacatcagcctcaactacgcgacgttccagccgggcaccagcgtgcgtgaccagaacaacgggctgacctacacatccctgttcgacgcgatggtggacgccgtgtacgcggcgctggagaaggccggcgcgccgggcgtgaaggtggtgatttccgagagcgggtggccgtcggcgggcgggttcgcggcgtcggcggacaacgcgcggacgtacaaccaggggctgatcaaccacgtcggcggcggcacgcccaagaagcgggaggcgctggagacgtacatcttcgccatgttcaacgagaaccagaagaccggggatcccacggagaggagcttcgggctcttcaacccggacaagtcgccggcctacaacatccagttctaactagctatcttatactcctactactatatacctacatcttcatcctaaataagctgcaaaatgcggcatgcaagtgtaacgacacgtacatgtactccatggaagagtgcaaccatgcacgctttaacttcctggcgatgatacatcatcatatgataataaagagatggaaacagttatgaatttgtgatccaa

SEQ ID NO: 26733 - DNA, 534 bp, Triticum aestivum
  Clone ID: PAT_TA_26733
atcatgtctcagcattctcgacatcccgcggcttccggttcttttacattcaatcaaaatccacatccatccaaattgtctctgctccattttagatggtatctttattagatttcacctgcttccttttctggccggtttcccttctagcctttgcggccctgattgatccacgcggcgaaggcatccagggtcctccagtcagagcggtagtgcttctgcgtgaactcgaggaactcacgccaagtgaagtccgggtacgcgcgcgggcggccgtcgacggcgagcagctcggccggcggcgcaacggggcggtccagctgcgggttgaggaagaaggtgagcgacctgcgggccaggctgctgttgacgacggcgcggtggaggcagctgatgtggcgcccgttggtgagcgcggagaaggtgtcgccgatgttgacgacgaaggcgtcgctccggggccgcacggcgcgccacgcgccgccggtgaacacctccagcccgccgacgtcgtcctggtggagcagcgtcagc

SEQ ID NO: 26734 - DNA, 593 bp, Triticum aestivum
  Clone ID: PAT_TA_26734
atcttttttacaaacatcaacacatgggccctcagtgagggtcactacaagtctagcataaatgaacaaaccttcgagtctggagtacaacaaatttggaacaactgcagattaccacatacaaatttggagccatagaaaaagacaccaaagactggcatgcactggattacacagcacttccatttgctcggcccgcttctgtctgaaccacttctgcttacttctgtgggtaagtttccacaccagattataggcaagtttccacaccagattataaaacaagcacactccagcaaaagaaccgcaaactaagcagatcatttctgttaatcgacaagtagcaagatccgaggccaacatcagacacactcgttaaggtacgctggcaccaccttggggttgaaggttaccgtccaaccactctgacaaactaaggtttgacatatccgattcgcttcgcggctaattgaggttaactgttggtttcctgcagggtttttcataggctgactgggattggcaacacgagtatcacaacagcagcaacctaccatacgggataatccggcagataaccatcaaccctaact

SEQ ID NO: 26735 - DNA, 566 bp, Triticum aestivum
  unsure (1)..(566): unsure at all n locations
  Clone ID: PAT_TA_26735
atccccnnggggatcctgaaanattccggttggatnntttcaacaagtttttgtgtggaantttntgcaagtgcctaatgcaaacgttntctgctggaaccgtgtgtgatgttagttgatcgaacatgcctactttctagaaactgtgcgggttgtttgagttcatcgcccacggtgctgtctgagtaaccgtctgcaatagaaatccccaataagcagggtaattagcctactattgataatccatgtactaatcaaattgatatttcttataaaacacactaggtatttcatatccgtataacaacaaccatgatttcataatcgaattacatcagatagcttcggcactcagttacgccattacacaacagcaccaagttccacatgcagcatcaaaaacctttggaaaatagcatcatacacggtaaatagatagatgaatctcatctgggaaactgcagaagcggaaggaaaatattgagccttcaatgatgttgaatgtccttgcaactttaggccagtggctatggacaattgcccgcccaacctgaatcctcttcagc

SEQ ID NO: 26736 - DNA, 924 bp, Triticum aestivum
  Clone ID: PAT_TA_26736
ggtcttgaatgtccaaaagaacttatttattacatgccgtagtcgacgaagtacattgtacagtaataaacagacttattattacaggcagtgaaagctctagctgccgcaacccgtaaagtgcggcagcctgagaaacccgagccgcttcttctccatgtcgaagtcgagcacgaagtcctccatctgggctcctccgaggatcaccgccggcgccctgccgtcgccggcctccacccccttcatctccacgaacgcaacgcacgccgtccccggcttgacgtccaccatcgagttcttcccggtcatcgcccagtcactcccgccgtcgactgccagcccaacgttcggcacccagtacccgccgaggttgttgcccagcgacttcgtgtcgtagcagagctcgaacggcgccacaggcttcacggcgcgcgccacgggcgctccgttggcaggctgggccgccagggccttggtgaacgcgcccacgaacgggcggtacacgtcgcggcggagcaagacgtagggcagcctcgtgctgagcatcacgccgccggtggcgagcgcccgctccgatacggggacgcgggtgtcctccactttgatggacttgagccgagatgtagtgcgcggggctgccgcccttggtgacgagcggggtgtaagccatcgactgcgtgaattgcggccacgggagcccgggccgccgccgaagatggccacgccagggccgccggtggggaggcagaggaggaacctgttggcgaccttctgcgtggacgccacctgcgccggcagcgccaggccggagttcgcgagcccggccacgcccgtggagccccggggcagcgacgccaggagcttgctcggcgcgcacgccgccaggaccccgacgttcacctcgctaaccggtcggacgcagga

SEQ ID NO: 26737 - DNA, 1439 bp, Triticum aestivum
  Clone ID: PAT_TA_26737
tttttttttttattttcattttccattttatttttcttttgaaatgactgttcaaaagtacttattcctttaactattacacgcagtagtggacgaatccacctgacgttaaacagatttattattgcaaggccgccgcaacccgtaaagggcggcagcctggtaaacccgcgccgcttcttgctgccatgtcgaagccgagcacgaagtcccccatccgggcccctcccgaggatccccgccggcgccccgccgtcgccgccccgcactccccccatcgccgcgaacgcaacgcaccccctcccttgcttgacgtccaccaccgagttcctggcggtcctcctccaatcactgccgccaccgtgacccccctggccgttgggcaccgcgtacgcgacgcggttgttccgcacccacttcgcgccgtagcacttccccaatggctccacggcctccaatgcgcgcgccgcgggcgctccgttggcagcgtgcgccgccagggccttggtggacgcgtccaccgccgggcggtagatgtaggcgcggagcaagacgtagggtaccctcgtgcggagcatgacgccgcccgtggctcgtgcgcggcatccggcccccggaggcggggggccccccttcgatagggggacgcggatattctaccgctttgatggaccgtgaggggagatgaagtggcgcggaaggacatcccacgtggaggaagcggggtgtagtccatggactgtgtgaattgcggccacgggaggcagggccgcccggccgaacgatgaccacgccaagtccgccggtggggaggcagaggaggaacctgttggcgaccttctgcgcggacgccacctgcgccggcagcgctaggccggagtccgcgagcccggccacgcccgtggagccccggggcagcgacgccaggagcttgctcggcgcgcacgccgccacgaccccgacgttcaccttgctcaccggtttattcccgtcggtggtgttggccacgaacttcgtgtggaagaggctcccggcggcgcacgcgccggtgaccgggttgtatgggtaggccgtgcacggcttgtcgtgcctgtcgctgccgcagctgggcgcggggcagcccggggcagggtaggcgttggcgaggaggcaggtggggctgctgcacgggatctccgccggcggctggccgccgtcgcacgtggaccagacgagcgggccggcgacgtcgaggacgaggttggcgccgtcgtggaaggggattgtgtagagggaggtagcggtgtccttggtgaccggagcgagcaccggaagacctttggacgacgccagcgcagcgagcgaggcggccaggacgaggaggaggactcgtgccatctttgctggcaccaatggaccgtggaattatttgccgatgcctggcccggccggccctcgag

SEQ ID NO: 26738 - DNA, 1139 bp, Triticum aestivum
  Clone ID: PAT_TA_26738
ccgcgccccggttgttacgggaaagattccggtcctgtttcctggcgcaccgcggcgaccggccgacgaacatccaccgcctccaagccgcctctcctcactgcagcagcgtagcgacttcttcctccagctgcagagcctctccgcatcaagagttccttgccatggagcatggactgtggtcgagcggagctagcgacaagagcaaggccatggttgagcaactgcagagatatggggtaatcaaatcgagcaaagttgcggaggtcatggagaccatcgatagggggctgtttgtgcctccgggtggttctccctattttgatagcccaatggcaattggctacaatgcaaccatatctgcgcctcacatgcatgctgcttgcctggagctcctggaggatcatctgcagcctggtatgcgagctctagatgttggatcaggcactgggtacctaacagcttgctttgcacttatggttggaccgggaggacgagcagttggtgttgaacacatgccagagttggttgcttcttctaccgaaaacatcaagaaaagtgcagcagccccacagctgaatgatggatccctcagtattcatattgctgatggtagggaaggctggcccgagcttgcaccatatgactgcatccatgtcggagctgcagcaccgcagattccaaaggcgttaatcgagcagctgaagcctggtggcagaatggtgatcccggttgggaccatcttccaggactgaaggtgcttgacaaaaagctagacgacggtgtcagcataagaaacaagacgtctgtgcgctatgtgcctctcaccagcaaggatgcccagttgcactcaaattgatcgccgcatcctgccaaccaaatgctatcttcaatgtgtgaacctaaaacctcattatcaaggcgttatgattggacataaaatctaccaagctgtcgttgtaaaacgctgggattcatggcaatgtaggatactggtacttcatcaaagtattgaagtgtgtgtttgtgtttgaccatctttttgtatctgctagcatctgtgagcgtgaagcatgctttctcgttggaactgctctcacaatgttgcctgtaaattcaagcaacccaaaatggggggg

SEQ ID NO: 26739 - DNA, 1069 bp, Triticum aestivum
  unsure (1)..(1069): unsure at all n locations
  Clone ID: PAT_TA_26739
ccataagaatatttgtttatttgtttttttaatgctttcaaaataatgtttgcagcatgcttgtttcaacaacctttatcagcggactccaaccgccaactgtcggttatttatcatctgacctttgagacataagcggctacaaacttgagcaatcgactagcactccgctatacaaatcgagagatcgaggatcaataatggccccaaatcgtactactttcaagaaatgccagtaatgcttatcgggttattatgtttggcataggctacaaataggtaatatgcatttctaacacgcccaaaactatgctgctgcagatctattgttatcaggatcttcttctatattcaaagcttggagcagcttcggccatgattcggggattcctcctggtaaattgaactccaagagtttcccccgtgctctgtagaaatcctccactggttcacacaaatcatgataaacacgcaatcgctcctttaccacctcttcggtatcatctgctctggtaattaacttcgattcgcaccgtggaggaggtagtagtggaggcatatacattcgaaggcccgccattctcaccctcaatgtcaatggaggccacattgaagtttcctccacactggctgcacttccttctaccaatgcattttgcaagcagagccacttctagatacacataaattcccgccccgtctggctctgcagtagtaaatatttatcataaaaacctcagctaataacaaagttcaatatgtctccacatgtctcggtatttcacacatgcaagttcaaggtgaccttaaaatataaacgacctagcatcccttttctatgctgctaaattcactactgatctcgtacctaaacaaacatagcttcatacgccctactagtgcaagtcgatcattcntgatcccataaattataaataacaaaacaaataaaacttaaaaaatgcaatctaaggttcactgctacgtaccaaatcatggtaaacacgcaaccgctcctttaccacctcttcagtatcatcggntgcggtaattaaccctcgtgccgaat

SEQ ID NO: 26740 - DNA, 930 bp, Triticum aestivum
  Clone ID: PAT_TA_26740
gcggccggtgccagcctccgccgacgcccgacgccctcgggccggacagctcgtatacttcagttctcttcttcccccttttccacccgccatcctctccagcctccgccgacgcccgacgccatggggcaggcctgggcgtctctgcaagagaagctccaagggcggcactggaaggagaggcaggtgcggaagatcaccgacaaggtgttcgaccggctcaccgaggacacccagaagcccgagaaggacgccctcaagttcgaggaggtctacatcgccgtcctctgcgtctacaatgacatcaacaaggtacttgccacggggccgaactaacgaaccccccgtccaaggagaggctcaaggaactcatgagagagtttgacatcgacatgaacgctttcctgggccgcgaggagttcgcggagttcatccggaagctgaccgccgtgtcactctgcgcgatcagactcaacctgatcatcacgttggccgccgccccctgcgcgggcgctggcgacctaaagggcaccccagggcgggccctggcgacggaaagggcatccgcaaggtgcccaatgccatcgaagcctccggcataacgtgggctaggcgttctaatccgccgccatcacgatggcttgcagtggacatcccatcagccgcaggaactgtagatgcaacggggagccgctcgggttgctgttgttccatcaggcgacgagggaggggtataaaggtgctgtgatttgctgggattagggtgatgccctgtgggacttatagtttttctgtaatatcttcctgtctgtgcttcttggtgttgttagcctggtgtgattcaaaaagacagtattagctgcttgttgacatgataaattcttggactaaataaagccgtggtcctgctaaaaaaaaaaaaaaaaaaaa

SEQ ID NO: 26741 - DNA, 230 bp, Triticum aestivum
  Clone ID: PAT_TA_26741
acaagaggagcagtggcagggagagaaggtgaagactacgccatgtgagttgctgatgttgtgccttatgcggtggggataagggatgtgtgatgtgcttgtgtggtgaaaggcgaggagtggcttttcctttttgcgggaggctgttcatttttgtctattctatttttatattcaagatacatacaattatttatcatcattataatcgagataataaatatttattt

SEQ ID NO: 26742 - DNA, 522 bp, Triticum aestivum
  Clone ID: PAT_TA_26742
cgcgttcgcccacgcgtccgcgcgccttgccaagtcgcagccacccactggagctcgtcagttccgtgggtgccacccgtgcggcacgatcgacccagcccaggtccgccatggacgcttgctctccggccctcgtcgtcgtcggggcgctgctcctcctcctgggggcctcggcgccgacggcgtccgcggcgcgcgccttcttcgtctttggcgactccctcgtcgacaacggcaacaacaactacctcatgacgacggcgcgcgccgacgcgccgccctacggcatcgacttccccacgcacatgcccacggggaggttctccaacgggctcaacatccccgacatcatcagcgagtacctcggggcagagcccgcgctgccctacctgagcccctacatgcgaggcgagaacctgctcgtcggcgccaacttcgcgtccgccggcgtcggcatcctcaacgacacaggcgtgcaattcgtgaacatcatcaggatcgcgcagcagctgcagaactttc

SEQ ID NO: 26743 - DNA, 403 bp, Triticum aestivum
  Clone ID: PAT_TA_26743
cccacgcgtccgcccacgcgtccgccgcaggccatcgagcagctactagctagcagcgatcaagccaagctaagcttagccacgacaaagatatggctgcgcttggcgtcctcctcgtgacgatggcagcagccatggtagcagcggctgcggcagcagcagcaacggcgagggctcctcgtcccttcttcgtgttcggcgactccctggtggacagcggcaacaacaactacctggccaccacggcgcgcgccgactcgccgccctacggcctcgactacccgacccaccgcgccaccggccgcttcttcaacggcctcaacgtccccgacatcatcagcgagcacctcggggccgagcccgtgctgccctacctcagcccccacctcgacggccacaagct

SEQ ID NO: 26744 - DNA, 440 bp, Triticum aestivum
  Clone ID: PAT_TA_26744
cgtccgcggacgcgtggtcgagcagctactagctagcagcgaccaagccaagctacacaaggacatgggtgcgcttggcctcctcctcgtgatggcagcagccatggtagcggcggcggcggcagcagcagcaacggcgagcgctcctcgccccttcttcgtgttcggcgactccctggtggacagcggcaacaacaactacctggccaccacggcgcgggccgactcgccgccctacggcctcgactacccgacccaccgcgccaccggccgcttctccaacggcctcaacgtccctgacatcatcagcgagcacctcggggccgagcccgtgctgccctacctcagcccccacctcgacggccacaagctgctcggcggcgccaacttcgcgtccgccggcgtcgggatcctcaacgacaccggcatccagtttgtaa

SEQ ID NO: 26745 - DNA, 500 bp, Triticum aestivum
  Clone ID: PAT_TA_26745
gggcagggcccgtacaacgggatcgggctgtgcacgccggcgtccaacgtgtgcgccaaccgggacgtgtacgcctactgggacgccttcccccccccggacgtgcgcccacgcgtccgcgtcgccaacttcatgcacggcaccaccgaccacatcagccccatgaacctcagcaccatcctcgccatggacaacaccaggaactagtcttcctctgcttgctactaggactagtccatggatctgtgccgccaacctacatatatagctacatatatatgatgcttaatttgttattggtctctccctatgtacctggactggagcgggtggtcaagagtttttgataggtccgtccttggtttagctgagacttgagagtaatttgggtgtttattttctgtttgctgctccagattgtttagcagagctagtggctaggaacttgtaagacagtggtttatgctggaatgattgatccaagaattcgttgtagcttg

SEQ ID NO: 26746 - DNA, 874 bp, Triticum aestivum
  Clone ID: PAT_TA_26746
cggacgcgtgggcggctcggtccccatcggctgcgcgccggcggagctcgccacgcgtagcgccaacggcgagtgcgacctggagctgcagcgcgccgccgcgctctacaacccgcagctggtgcagatgaccaaggacctcaacgctcagttcggcgccgacgtgttcgtcctggacatgggcgcgcggcgcgtgctggtgacggggacgggcccgctgggctgcgcgccggcggagctcgcgctccgcagccgcgacggggagtgcgacagggacctgatgcgcgcggcggagctgttcaacccgcagctgtcccaggccctggaggagctcaacgcgcgctacggcgacgggaccttcatcgccgccaactccttccgcgtccacttcgacttcatcagcgacccggcggcgtacgggttccggacggccaaggaggcgtgctgcgggcaggggccgcacaacggcgtcggcctctgcacggcggtgtcccacctctgcgccaacagggaccagtacgtgttctgggactcgtaccaccccacggagcgcgccaaccggatcatcgtcagccagttcatgaccggctcgctcgactacgtcagcccgctcaacctcagcaccgccctccacatcgacgccagcctcatggactgatgatatgctactaggaagctacgtacgtgtcgatccgtaactttgttgattgtttggtgttgcatgcatgccgtggttcatgccactctcggttttgaatgtggtgttagttgtgtgttgctaattggaggtcaataatatgtgtaaccagtaatggtgtacgtgcaatgaaggtgtcatgcttgaaaacataatgaccagtgagatgtatctgcc

SEQ ID NO: 26747 - DNA, 3547 bp, Triticum aestivum
  unsure (1)..(3547): unsure at all n locations
  Clone ID: PAT_TA_26747
cgtccgcccacgcgtccgcggacgcgtggtgcgcgccttgccaagtcgcagccacccactggagctcgccagtcccatagtcactagtcgcgcgacacgagtcgtcgtgcccaggtcctctctggcgagttagccatggacgcttgctctccggtcctcgtcgtcggggcgctgctcctcgtcctcctcggggcctcggcgccgacggcgtccgcggcgcgggccttcttcgtcttcggcgactccctcgtcgacaacggcaacaacaactacctcatgacgacggcgcgcgccgacgcgccgccctacggcatcgacttccccacgcacatgcccacggggaggttctccaacggcctcaacatccccgacatcatcagcgagtacctcggggcagagcccgcgctgccgtacctgagcccctacatgcgaggcgagaacctgctcgtcggcgccaacttcgcgtccgccggcgtcggcatcctcaacgacaccggcgtgcaattcgtgaacatcatcaggatcgcacagcagctgcagaacttccaggactaccagcggaggctggcggcgtacatcggcgaggacgcggcgagggagcgcgtgagccagtcgctggtgctcatcacgctcggcggcaacgacttcgtcaacaactactacctggtgcccttctccgccaggtcccagcagttcgagatccacgactacgtccccttcatcatctcccactagctagcgtacgcgcacgatcgagcgcgcgacccgtgaaccgcctcgacagcccaggtcacgacggcgatggccggcggaccggcgggctggggctcccctgcctctgggcgggagtgccctgggcgccggcgccccggtcccgcgcgccgcgtccgcgcgctcggcgcccctctggggcgcaccgccaacagcaactggccagaggaccaacgtcgcgcgccgcctccccgccgtccggcatccgaccaccccacgcaccatggccaccgggccccccctccaaccgcccactcaccatcccggtcatcatcactgacgcagctcggcgcgggcgcccacgctgaccgtcacctgtcccccgcagctcccccggcgccgcacgctgctcggtgggcgccgactgcgcgtcgtcggggcggtcggcaatcctcaacgacacccgggtatccaattccgtcgaacaccgcgaagggtgaccgggcagctgctctaggagggtgagtagcaggggacaacctccgcgcgctggcccgccgcgtccctggcggcggcggtcgtgaagggggcggtggcaccctcctggccaggcgtggacactacctggtaagacctgttttcaacttcatgccaggtctcccttacggatcccggcacggttctcccctcaccggaagcgccggttacgaaaacttcgatgatcccctacatatcctgagtgcagcagagttacctggcaacgtcattgatgcaagtctctcaaaagcagaagagatgctcggcgagctgttgaaaccgcgggctcaatcacaggacggatgcaggcggagcgcaacgccgcgagctcggcgtgctgaactcaccgcgccgagaggagagcccggctctaagcctgcatcccgcccaccacccgggtccgcatcaacttcatcccccccccgctccaggccgcctccttgggatgaaacgaagctaacagagaccgggggggggttaccggcttccgcatcggccaagccagcgtgctgcgctcaggcagggcccgcacaaccggcctttgcaagggcgggtgtcccacctgtgcgcgaacagggaccagtacgtgttttaggagctcgtatccaccccacggagcgcgccaaccggatcatcgtcagccagttcatgaccggctcgctcgactacgtcagcccgctcaacctcagcaccgccctccacatcgacgccagcctcatggactgatgatatgctactaggaagctacgtacgtgtcgatccgtaactttgttgattgttggtgttgcatgcatggcgtggttcatgccactctcggttttgaatgtggtgttagttgtgtgttgctaattggaggtcaataaaatggtgtaaccagtaatggtgtgcgttgcaatgaacgtgtcatattgcagcgctagcgtctaggaacttgtaagcacagtggtttatgctcgtaggtctctcccttcttaagttgggacttgcaaaaatttgaggatttncccacatcatttctntttttgtaagcacatggcaaacccggtttcaaagtaaagacctgaggaagaatgtagattgatcactgtgatttcaagtccttcagagctggacctgttaagacttgagacagatatatgcagggccccaggggccttccaggtccccctcttaagtgtgctgaggcacatcaatcaaacgccaacccacctgctattggcactaaatgaggaaggaaaaagaacattgtccctgaaggcttgagatacacaaacaggcaactgagtttgggaaaggtggttgtctccttgacgcacaccatggtgcccttgtctactctctctcttcttccttggacagacaccttatttactggtagcaggttctctcgtaccatttttcggtggagttgtattggcatctttgactgaagtttctttcaactgggtcgttacatgtcaaggaaggggtttttcctatcttcgcgcagcttcggcgcggtcgacgctcatgtctgttggcctggtttctggggccacgcacgtggtcggggcctgtgacctttcgccccatcgcggccttcctccgttgggcgcggtccatcagcctctgcacgcgggcaattggatgtgcgccagcaattgtcgcttatctactatctatgctacagatcgacccatagacagggaaaggaagcgatggctggtggggagaggagccgggggacgtgttgtgacgggacaagaggcgcagtggcagggagaggacccgtaggcctcgccttcggagccccgcgcctcgtgcccgttccgccggggccacggggtgcgtcaggcgcgtctgtggtgagaggcgaggagtggcttttcctttttgcgggaggtttttcatttttgtctattctatttttatattcaagatacatacaattatttatcatcattataatactaganaataaatttaaaaaaacaccaggaactagcacgtctacctctacgctacgtacgtagctagccagtaggactagtccatctgtgtgtgccctgccgacctacatatatatagctacatatatatggtgcttaatttgttattggtctccccctatgtgcctggaccggagcgggtggtcaaaagtttttgataggtccgtccttggtttagttgagacttgagagtaatttgggtgttaattaagagagattgcntnttttctgtttgctgctccagattgtttagcagagctagtgcctaggaaattgtaagacaatggtttctaccagattgatcccagaaa

SEQ ID NO: 26748 - DNA, 680 bp, Triticum aestivum
  unsure (1)..(680): unsure at all n locations
  Clone ID: PAT_TA_26748
tttttttttttggctcatgaagtgaaactttcttgattagcttaactttttttgtagacaaaagaaggatcgatcacatcaaccctcccggacgcatttacagacacgaaagacctaacacttaaccaaattcagagtaagaccgataagcgataaagcaaacctataaagcagacctatatgctaacacgacttgcagatagataaacgactactataactttgtcctgaaccgagagcaaagacgagagagactgcagcatcatcatcatctccaaacatcgatcgaggcgcatcgaccagcccttacggcttcccgctccccttcttcttccagaacctgcggtagaactgcacggtgcggccgttgagcggctgcgtcggcctgttgttgcgccggtagccttcctccaggggcgcgatcagggcggcagcctgccccaacgccatctccctcaccctgccgtggatgttccagatgatgttctcggtgcacggcggcgtggtcagcgacccgacgtaccggtagtacatgttggcgtaacgccggagcggncacatgttcacgactccggcggggatcggagcacctttctcggccctgcaggcctccacgtagagctccgatagcttgtcccgcagctgcatgaggaaggggtctggcctgccgagccggtaca

SEQ ID NO: 26749 - DNA, 533 bp, Triticum aestivum
  Clone ID: PAT_TA_26749
aatgatacatatggtgagatgaattaaccgggggattgtacaatggaacggacatggatcaaacaccaccaccagcgacgacgacgaccaaacaatcagatctgtccatccacgcccaacacacacatactgctactggataaccgaatcgaatgccgaatgtaatcatcatcaaagcaacaaaaagaaggaagatgaacagctcgaagaacaccaccacaaaaggagagggggcggggcccctcggataaattaaatcgcagccgatctgcggatctctcagtagaaggcggcggcggcggccacggcggcggtggcggcccacgcggcggcggggtggacggtgccggcggcgccggccggggtggtgggcgcgtccatggacggggcgggcgtgggcgccatcatcgacggctccggcggcgagctgatctcgggggtcggggccatggtcgagggagtcggggcagggaccatgggggcgggagccggtgcggcgggcgccggcgccgggggaggggtggccggggcca

SEQ ID NO: 26750 - DNA, 779 bp, Triticum aestivum
  Clone ID: PAT_TA_26750
ggttgggcttttttggggtccgccaataatgattacatatggtgagatgaataaactgggggattttaaccgggggtttgtacaatggaaccacggacagggatcaaacaccaccaacaagatctgtcacgaccaaacaatcagatctgtccaaccccgccccaacacacacatactactacatgaaataaccgaatcgaatgccgatcgtaatcatcatcaaagcaacgagagggagcgggtccctcggataaattaaatactcggtatcacttgcagccgatctgctgcgggggcggatctctcaattaaatcgcggccgggcggccaatctcgcggtggaagcccacgcggcggcggggtggacggtgcctgcggcgccggcgggggtggtgggcgcgtccatggacggggcaggggtcggggtcatcatcgacggctccggcggcgagctgatctctggggtgggggccatggtcgagggagtcggggcagggaccatgggggcgggagccggtgtgacgtgcgccggtgccgggggaggggtggcgggggccacggccggcgggggagacaccggagccggggtcggcggcggcatcgtcggaggcggggacaccggggccacgggggcgggcatcgccctggccgccggggcctgggccgcggcggccgcggaccgctcggtctgcgccagagccacgagcccggtgccccccattggaggagtgaagcttgagcttgggctgtggcttctgcttttgattgaggcctcgtgc

SEQ ID NO: 26751 - DNA, 541 bp, Triticum aestivum
  Clone ID: PAT_TA_26751
gcgtgttgcctgacttcattcagtaagcatgaagttttggtagctgaaaacatacaaaccgcacaaacaaactggtggtttcagacgagaaacgagaggcctaaggcgtcatgtcccatctatccgatcagctaatctaacctcgacagaagaatcattcagtccatcagtttctttaagcagctgcagtttccttgtcgccatcgctagcttgcaccgtcgcagttcctccatcaccgtcccaaggttatctgccccctctttcctggcgagcaggactatcctgattgcgatcaacttcctgcacacaagtcgcttgactgttctcactttcagaaggttgtgtgatttgcaccgctgcagtttcttcctcgtcatcagaaatttccatcactgcagttccttcatacccgtcagaagtttctctgcgcactctttcctggggagcaggactatcctgagatcgatcaagttcccgtacccttctggcttgactgctctcagcttcagaaacttgcgtcgctgtagcgatttcgtcttc

SEQ ID NO: 26752 - DNA, 544 bp, Triticum aestivum
  Clone ID: PAT_TA_26752
ccacgcgtccggaagagaatagaagggagagggcggcgacgagggcgcacgacggcacgggcacgccgaacgctctcgcaatgcatcacgccaagaccgactcggaggtgacgtcgagcatggcgccgtcgtcgccttcgcgggcgccctactacgtgcagtcgcccagccacgacgacggggagaaccactccaagacggccgcctcctccttccactcctccccggccgcctccccgccgcgctcgctcgggaaccactccagggagtcctcctcctcgcgcttctccggcaaggtcccctccgccggctcgtcccgccgcggggtcgccggcggaggcgggaagcgcggcgggggtggcggcggcggcgaggcggcgcgccgcagcccctggatgaaggaggcggccatcgaggaggaggggctcctcatggaggacgacgacgacgccgacggccgcgccggcggcttctcggcgctccccaaaaaggtgcgctacgggctggccttcgttggcgccttcctcgtgctcttcaccttctt

SEQ ID NO: 26753 - DNA, 1029 bp, Triticum aestivum
  unsure (1)..(1029): unsure at all n locations
  Clone ID: PAT_TA_26753
ccccgcgtccggtttttgcagnagctagtttatgaaacatgccaaaggtactttacgcgatcatctttcttccaaggccaaactatctcccggttttgggttgaggcttcacatagcattgggtgcctccaagggaattctgtatctacacactgatgcaaaccctcctatatttcaccgtgatgtgaaggccagtaacattcttttggactcgaaatttgttccaaaggtggctgactttggtctttcgaggcttgccccagtgccggatattgaagggacattagcaggtcatgtttccactgttgttaagggcacaccaggatatcttgatccagaatacttcctgactcataaattgacggataaaagtgacgtgtacagccttggtgttgtgtttcttgaaatgttgactgggatgaagccaattgagcatgggaagaacatagtgagagaggtaaacaaagcgtaccaatcaggcaatatttctgaaatcgttgacagacggatgggcctgtgtcctccagactgcatcaataggttcctcttgctagcaaccaagtgctgccaggatgagaccgacgcgaggccttccatgtcggagattgtccgagaactcgaggtcatcttgaggatgatgccggaggcggatcttgttctgatggatactacggacacagactcaggtgacatgagtaaatccttgtcaacttcttcagcaaccggaacttcctttgtcacacaaacctctggcagtgttaatgcaagcagcggcgtcctctccgaggtgctggctcctcgctgatcttggcatttttcataggattttaagttgtaaatgcgatgatgttttgtacaattgacttgttacgctcatgtcgtttgtgttgtaaattaattaattagtcagctttgatgtaaactagagaatgtgaatgagaatagctgaggaatattgacatagcttgagctttccagaaatttagaagcttcaaaaaaaaaaaaaaaaatcaaaaaaaaaaaaaaaaa

SEQ ID NO: 26754 - DNA, 855 bp, Triticum aestivum
  unsure (1)..(855): unsure at all n locations
  Clone ID: PAT_TA_26754
ttgcggaanagnaaatacatcgcaaggcacaatgacgccgacaaacgtgagaaatggagtaaagtggatttcgaggtgagcatatcagatgatggcgactggtttgactgtgaatgtgggcagttcgcccacatggggatgcaatgttgccatggtctgaaggttattttctcaatgtggagatacccaagcggcacatcattaagaggtggatgaaagatgcaagggacattttgccacaacaccttgctcactttcagaaagaccaggctgccaatcaattttcagcagccggagcttgactccgtacctacatgccatgggacttgtcaggattggggactcatcagtcgcgacctacgagcttgtgctcgctaggattaaggatttaatcatggaggcatcgccaccggctgaaaccaaggatggcctagggatcgaggataggcttgctgctgaatcaaaccggaaaaacattggatcagcttgctctccataacatcgaaggagaaatggtagcaaatgagaacagcatgaccggttctgacaattgggatgccctcgctggactgtcagctccgagcaaaaagtgtggtgttgggcggccttgctcaagtagagtaaagacgccatacgaaggattcagtaagcaaatgagattctgcagtatatgcactgccaggccataagaaggccacctgcccagagaggggcgatgtgccaaagcagacttgcaagccggacaccgccgtacttcctgcacgaggcccctcctagaaaatgcatcttaatactttttcccggctatgtgtaacgttagaataataataatcgaggattttctaattgatggct

SEQ ID NO: 26755 - DNA, 1174 bp, Triticum aestivum
  unsure (1)..(1174): unsure at all n locations
  Clone ID: PAT_TA_26755
gcggtcgggcctctggtccctgcctccgctcctccgtcctctcctgcgcgcggtccggctagtccggctggcacacatgtctggaaggttgctacacaatatatgttgcctgagctagctggcaagagcctgactccaaaactaagcattgttgttgccgatgcatttgtagccaaatttggcgagtatgctggttgggcgcagaatgttctctttattggccagctacctgctaaaaaacttgtggccaccgcagttaccattgccttgctgcgaacctaccaagaggaaacgtgcgacaaagagtctttgtacgctgccaggtgttggtccatatagcgcagcctgcattgctctgttctctcttgttggagaacgggctattcctgtttacccacatgtctgttgagttgctacacaatatatgttgccgagccaagctggcatctcctcggaaccaaaactgagctattgttgttgccgatgcatttgtagccaaatttggcgagtatgctggttgggcgcagaatgttctctttattggccagctacctgctaaaaaacttgtggccaccgaaggttaccagtgacactgcgaaacctaccaagaggaaacgtgcgacgaagatggttgaaatacaggcatgagagagcatggatagcaactgtagcaaggaaaatgttggagaatgtcagagcaggtcagcggattgattacccgaaatcctgttgaaacgaagtgctggaaaatgttttgaaccacccaacgctatcctctgaaaatgatggcaactttcttttggtagaattcgttggaagggccgtgtttccttccaagtagagtaatcattagtacttgagcaaagtaacatttgacattccattcacatcttctgatgacagatagcatgagtagtcatccccatcttaattttggaagaggaaggctatcttagtgtatgattggcctaccgcgtcctatataaaagggaggtgtagaggctattattatattgttagccaaatggcggtgaggaattttgaacacttgtgttgtaaatcatgtagtttccctcgaaaactgatctccattcatgtactnattcaacaggtttaacatgctgaatatgttcatagataagggagagatatctcnaatcnatcagaacgagag

SEQ ID NO: 26756 - DNA, 1235 bp, Triticum aestivum
  Clone ID: PAT_TA_26756
ccggcgctcgagctttatcttagcaaactactagctaggcggcctcgaattaagatggccaaggttaacgccggcgccgccctgttgtctctgtgcctgttgctcgcctgttctgccggaggcacacaggccgcctacgtggacgtggagggcaccgtgaggacagaagtagagaaggccatcaagagcaaccccggcatcggtgccgccctcgtccgtctggtgttccacgattgctgggttaatggttgcgatggatcggtgctcttggacaagacgacatccggtggcaataccgagaagaaggcgatcaacaatatcggcctggacggcttcaacctgatcgacaccatcaagtacaaactgggcaacagcgtctcgtgcgctgacatcgtcgtcttcgccgcgcgtgacgcggccaggcaaatgagcggcggcaaattcacctactccgttccggacgggcgcatctcctccatcgtctcgtctgccgctgccgcacccgcaatcctcccgcaatccaccttcgctcaacaacagctcgtggacaacttcgccaagaagaacggcacccatcatcctctcctcagcgcactccatcggcgtctcccacctctcgtctttccaaggaccgccccaaacgattcaaccgcgaccccgatgcgacgacagctacaagcaggcgctcagttaaggacgtcaaaggttcaggcgaagaacaaaagccaatctgcgccgatcgaggaagaaaagaacaccgcgaccgacatttgaacttccatgaagaccaccgccgggtacgaccccacaggtgtgaacaccgcggacaaagggctcggacaacaactactactaccacgccctacagaagaacatggtcttcatcaccgacgactgggttatgcgcacggacagcaatggcggggacgacatggccgtgtacatgaaaaatgccaccaagtggaacaaagttctccccgctgccatggtcaagctcagcaagctgccggccgagggtagtactcgttacgagataaggaagaactgcagagtcaccaaccaagaactactattactaggaagcaacggcatcacctaacaggctacaggtgccatggaatgcaatgatttgtattttcgaagtttctgttccatccctaatttcgtataaccacaatactcaactgcaaaaataaaacgacaataaaaagaacgaaaaatatatttggcaaccc

SEQ ID NO: 26757 - DNA, 815 bp, Triticum aestivum
  Clone ID: PAT_TA_26757
agtcaaacgtgcaagcagcctgtagtttatttctggaacagctaatgatgcagaccttggtccagtgatcagtagacaggccaaggaccgcatctgcaagttagtccaaagtggcgctgacagtggtgctcgacttgtgctggatgggagggagattgtggttcctcaatttgaggatggcaactttattggtccaactgtgttggctgatgttaaaggtgatatggagtgttaccaggaggagatttttggtccagttcttctcttgatgaaggcagagagcctagatgatgccatacaaattgtaaacagaaacaagtatggcaatggtgcttccatctttaccacatctggtgtctcggcaaggaaatttcagacggacattgaagctggccaggtgggtatcaacgtgccgatcccagtacccctgccgttcttctccttcacgggcagcaaagcatccttcgcgggagacttgaatttctacggcaaggcgggcgtgcagttcttcacccagatcaagaccatcacgcagcagtggaaggagtcgtccccccagcgcgtttctctctccatgcccacctcgcagaagtgaagtcacccgagctaactcatgtatgtggaaataaaccccggcattgatgtggaatttaagcttcacaaggagctgcctttcgttaagggtaactcttgtgatgtctttcattgtgctgccgataataagaaagaaaatcccagattagacgaccgaatcacacacgcaggagagcatgtatttgtacagggaccaaatcaatgtgtccatgcaatggctc

SEQ ID NO: 26758 - DNA, 2438 bp, Triticum aestivum
  Clone ID: PAT_TA_26758
gacttccattgcgctccgtaccctaccaatgatgtgccgtgccaatgagccggtgacagaaccaccactagcgtgcctttcggcgcatggcactggagttggttcctactaataaggaaagcgtctctagtaatatatagttggatcaccgatgcttagtcaatggatactgtgcgatgcaacggtgacaacactatatagtgtcacacaatgccgatgcgtgacgccgcccatactagctcgttataagttgctcgaaataaaatacaatatgagcagtatgacgacaatgttgatatctgcattgtgtggatgtcgatctgatcgtcgtgctagcgaatacgacaccaacaaccgctcctcgcctgtcgccactccgctctcccctcccctcttcctccctccctcctcgccaccgctccgctccactccacacccctgttcccagacgcaaccagcgccgccggaccgacgatgcttcgcgccgtcctcctccgctcagcctccggcctccgccggtcaccgatggccgccccataccacctcacatgcttctcgccgcctcccgccgagacctcgccggcctccgcccgtcagcgatgcccgaggagcggcgacgtcgtcgagcctagggccaccgagcacgtccacggcaccaaccccgcgagaggggccccggtctccgcgtcgcctccgtcgacggttcagggacgaagcccatcggtggaagctgccaggaccgccatccctggctggcggagctcgccggtaacggcgccgcagcgcatcatgcttcaaataccaggaggctcatccgggccaacatggttaagctggcagagaacattacaaccgagcagggaaagacgctgaaagatgtggggtgatatgtattccgtggtctaaaggtggtggagcatgcttgtggaatggggtcactgcaaatgggcgaatacgtatctaatgtttctcatgggattgacacctttagtattagggagccacttggtgtatgtgctgggatatgcccattcaatttccctgccatgattccactatggatgttccccatagctgatacttgtggcaatacttttgctctcaaggcatcagaaaaggatccaggagctgctatgatgcttgcggagctagcgatggaggctggtttaccaaagggtgtgttgaacattgttcatggtacccatgatgttgtcaacaatatttgtgatgacgaggctattaaggcagtatcatttgttggttccaatacagcaggtatgcatatatattctagagcatctgcgagtgggaagcgtgttcagtgtaacatgggtgcaaagaatcatgccattatccttcctgatgctgatcgagatgccacattgaatgctcttattgctgccggttttggtgcagctgggcaaaggtgcatggcattgagcactgctgtttttgttggaggttcagaaccatgggaggatgaactagtcaaacgtgcaagcagccttgtagttaattccggaacagctaatgatgcagatcttggtccagtgatcagtagacaggccaaggaccgcatctgcaagttagtccaaagtggcgctgacagtggtgctcgacttgtgctggatgggagggagattgtggttcctcaatttgaggatggcaactttattggtccaactgtgttggctgatgttaaatgtgatatggagtgttaccaggaggagatttttggtccagttcttctcttgatgaaggcagagagcctagatgatgccatacaaattgtaaacagaaacaagtatggcaatggggcttccatctttaccacatctggtgtctcagcaaggaaatttcagacggacattgaagctggccaggtgggtatcaacgtgccaatcccagtacccctgccattcttctccttcacgggcagcaaagcttccttcgcaggagacttgaatttctacggcaaggcgggcgtgcagttcttcacccagatcaagaccatcacgcagcagtggaaggagtcgtctccccagcgcgtttctctctccatgcccacctcgcagaagtgaagtcaccggagctaactcatgtaggccttgttcggttgaggtggtttttgaaggggaatggcagggtttgaggggggattagatcccctacaagccaaaatcctttcaaatccactccaatccccttgggaggaggattaaacgaacaaggccgtatgtggaaataaacccaggcattgatgtggaatttaagcttcacaggagttgcctttcatcaagggtaactcttgtgatgtctttcattgtgctgccgataataaggaagaaaatccccgatttcacgcccacagcagagcctctagttggcctggctccgtattggggccaaatcaatgtgtacacgcaatggctcaaaaa

SEQ ID NO: 26759 - DNA, 772 bp, Triticum aestivum
  Clone ID: PAT_TA_26759
gactaacagtctgctgcttcggcgtgggtgctgccagacaagtaatggggagcatgtctccaggagaagagtggctccccgttcttggtgccattggctaaggtgatgtactgcaggttcatcctgtatataaccatacgatattcggcaggcggtcacgctcttaattatctaaaaatcacacaacaagtctctctctggctggtccttggatttctgcccggccctgagcatgcagcaactgtggctgatcagcacgatgtactgcgacgacaagttcggaaccttgggcatcccatcagatgtcgttgcgagcatgcgagccaagatgatcggaggatcgagcagcccatcggtgcaagacgacatcaactctttcctcctggatgatgatttcagcataccgttctcggtggacgacatcgccaggctgatggtgcacgtggacatagcagacatggatctgccgccgctgatccaggagaagaacggctccccgttcaaagcctgaacggttccggtgatgtacatacatagcgcgtgatatatatacatacataccacagttttggcttggtttttttgggtacataaaaatcggtttcatctcccttttgtggctggtttttgggtttttgttttccttgtcttggattttgagtggttcttggttgcgtttgcgtgtgccgacctacttgtacaaaagtgagctgtatatgtaatgtaactatatgttcatccagtaaaacaaggaaagagattttgggttttg

SEQ ID NO: 26760 - DNA, 973 bp, Triticum aestivum
  Clone ID: PAT_TA_26760
gcggggggggacgcgactgggcgtttttcggcgccggcggggcctgttgggggcgcgccacgcgtccccggctggccctaaatcttcatcccgtcgaagccgccacaaggaggcggcgacataggcgacccttctcttcgacgccggcattgaagtttggtggagtgcgctccttctcttcttcccattgatgtccctgtcaacaacgcaacttcggccgagcgctcctaggagatggattcatctagagaccggctcctagccctagcagaggaatatccggagtatgatatggagctgctggggcacgtcctcgacaacgagaatcttcgagtcaagtacatcccggaggcaataaaagtgctcttcgagacgccgtccggctttgcgatcttcgccatcgactctggctacctctatgacaacgacagggacttcactggcattgacacgatctgggttcactgtgtcaagaaggaatctgcggacttttttctctggccaaagggattcctaaagcttgacaaggcgaccaaggccatagccattaattctgatggtattcataaaagccttgctgaatttatcgagcagaaggttgggatggaggatatactattggtcggtgaatctgcatacgtagaagttattgaagcacacgtgggagttacatgtagatgcgatgctaatgcaattgagctgatgtggggcctgcaaaacctattgcatgatttagtgcctgaagaggaatcggagttcggaaagaatgaccgcaagtactatagtcaaaaattacttgcctacctgcgtcacattgacaatgaggtcaggcctgaaatgatcaatggagagattgctttattggcttccatcatacaccgttgtaatgttaccaacaagaattaccgcgacaacatgcataagccttgataaaggtcctttacaagaaattctggcctcaaggactgaccaa

SEQ ID NO: 26761 - DNA, 683 bp, Triticum aestivum
  unsure (1)..(683): unsure at all n locations
  Clone ID: PAT_TA_26761
gacttccgatgcagcatcatattcgaactataaactttacacagtgtgcaacaaactcgccaatacttctgccaacataaataaatatacccaacaaggtacaatcagactgaagaaaactaataaaatgaacctactactaacttctccactcattcaaaattcatctgtngaactgtccgacaatgctgaaatgacgccacagcataatagctctagaataagcacaatgtaattctatcttggaaatgaactaaagtgtacagcacatttcaaaactcacaaagttcagaaagcttaagaatctgctatctttagatgatcttggaacaaacacactgccgctgctcctttctgtgtttaacataagtagcttgagaagactgacatgtactttccccaacaacgaggagtccttttcatggaatgcttgtgcaaactcatcaaacgtaaagggatgaacatccatactaccaaaatgtgtgtagacaaaccggacaacctggaagagctttttcaccatttcaggtgatgactcccaaggttttgtgggaaatggttgtttcatcctgacacttggtggaggaaacctggcaagtaaatctttacaaagggggcacccatgtctcccagttgaagaaatatgagctgaacgtcttaacggattcggacgcgtgggtcga

SEQ ID NO: 26762 - DNA, 794 bp, Triticum aestivum
  unsure (1)..(794): unsure at all n locations
  Clone ID: PAT_TA_26762
ataaaatgaaaatcactaaaaaaaaaatacatatttagaaaacaagatcatggatacatgacagagttagaataacctaacaagatcttcggaggaatggctagcacacgattaactacgaggacagaggtacacggcgggggcttcccggtgagacagagttagacgaccgcactgttcggcgaggcgggaggtagacgatggcagctgtcaggatccaacgagacgcgaggtagatgatggcggctggccggtgactcagaggtaaacgacggtgcctgaaggctgtccaatacacactactactacaatgaccacccaagacagagaataaacctccggccgccctcccttgcgtccatgcgccgcccgctcctccttttccccgcaccggcgtcgtcccgccctgacccccaccccggcggcggcagcgacggccgtgcgggggaggccactgcgcccaggccctcccggggctgtgccgccgcgatcgcgcgcgatgtcttcgcctccatggcatccttgctctgtcgggtgtacaatgtctaaaatttccttgatgactaccatcatgtcatacaaagatagacagaaacaggtcaagtacgtaaatccggtagactgattccacggaaaaaggatcttacatggaagataagataacatgaactgtggcaagcagattgtcaatggcacagtcagggctgggagtaaaaattacctggtattcatgtgtacatttaatgagatggtaataggatgtggcagggaaagggcnagttggntanaagttg

SEQ ID NO: 26763 - DNA, 775 bp, Triticum aestivum
  Clone ID: PAT_TA_26763
aatcccatcgtcgtcgtccccaatcaatcaatcatcatcaacaacctaaacctccgctccgtctgcgcctccgcgcaaaaccctagcggatccgtcgatcgacctcgcggagaggcggagaggcgggagggggtccgaagatgcagatcttcgtgaagacgctgaccggcaagaccatcacgctcgaggtcgagagcagcgacaccatcgacaacgtcaaggccaagatccaggacaaggagggcattcccccagatcagcaaaggctaatttttgctggaaagcagttggaagatgggcgaacattagctgattacaacattcagaaagagtcgacgctccatttggtcctgaggctcaggggtggaactatgatcaaggtgaagacacttactgggaaggaaatcgagattgatattgagcccactgacacaattgatagaatcaaggaacgtgttgaggagaaagagggtattccacctgttcaacagaggctcatctatgctgggaagcaactcgctgatgacaaaactgctaaggactacaacattgaaggtggttcagtgctccatcttgtgcttgctctgaggggcggtcagtagatgcaacctcgacgtggaccgtataggccatttctaccagaacttgttgcagacctggatctgtgaatttgccggttgattgaagtgcccatgtattgacgcatttgtgaagtcagctgtcacctgtactttgatggaaattgttgaactatatgcttatccgtcatcatctg

SEQ ID NO: 26764 - DNA, 991 bp, Triticum aestivum
  Clone ID: PAT_TA_26764
tacccccgcccccgcgccgcccccatccgagcgcgcacgacctacaacctaaacctccgctccgtctgcgcctccgcgcaaaaccctagcggatccgtcgatcgacctcgagaagagacggagggagggggtccgaaccggcggtgctgcgcgaagtgacgacgctggcagccaatcacatcaccagcgagcgacagtgaacctacgctcccgtctccgcctccgcgcgaaaaaccctagcggatcctgtcgaccccgcgagagaggaggtaatgggggtccggaagaagcaagatcttcgtcaagcacgctgtaacggcaagaccatcacgctgtcaaggtcgagagtggcgccaaggttcggcaacgtcaaggccaagatccaggacaaggagggcattccaccagatcagcaaaggctaatttttgccggaaagcagttggaagatgggcgaacattagctgattacaacattcagaaagagtcgacgctccatttggtcctgaggcttaggggtggaactatgatcaaggtgaagacacttactgggaaggaaatcgagattgatattgagcccactgacacaatcgacagaatcaaggaacgtgttgaggagaaagagggtattccacctgttcaacagaggctcatctatgctgggaagcaactcgctgatgacaaaactgctaaggactacaacatcgaaggtggttcagtgctccatcttgtgcttgctctgaggggcggtcagtagatgcaacctcgacgtggaccgtaaaggccatttctaccagaacttgtttgcagacctagatctgtgaatttgccggttgattgaagtgccatgtaattgacgcatttgtgaagtcagctgtcacctgtacttggatggaattgtttgaactatatgcttatccgttatcatctgatttctggttgctctgaatcataaaaaaaaaaaaaaggctttcttaacaagatctcattctt

SEQ ID NO: 26765 - DNA, 536 bp, Triticum aestivum
  Clone ID: PAT_TA_26765
ggtcctacaaaggcattggtgatgtcatcagccgttggattcccggtgaattcagctagcaaatcatatttttctccattaggttcatcaacccttcgaaaaatctcgtatttattaggataagccatccttaaagcgcccatgataggataaaatgtaccagcatagaagagaagccggaaagaataacaagtctcaaatgatgcagcatactgaagcctcacatctcttcccattgtttgcattacgccacttgatgcaggcatatccttcaggcgaggatttacaagaatcacaggtctgtcaccagcagcatcagtcatagctctcatatcatcaattatgcagtttccaacagcattctggggagcaatgagaacaaacatgtcatcttctttatcaacctcactagcacctactgctccaatattgatgaaggcgcccattgctccatagtcaccccgaaccatgaattccaatatttttctggttccagcaagctgaagtggaataccagcaaatgcgccttgccccat

SEQ ID NO: 26766 - DNA, 478 bp, Triticum aestivum
  Clone ID: PAT_TA_26766
gacgcggccagcgaacggcaggagcaagagcgagccgcctctggagtgcaagctgtacatcccttcgcctgactccgacgggcatcagctggggctggaagccctggcatcacccccttccagaaacagcagcagggatgatcctcctccggtggacgaagatctgtacaagatataaagtaataacagcagtttttgacgaggctcaagcctacctgtgtcgtctcgtgttgccatccatcttgttgtcaagatcgatcagtcagtcagtcagctggtgtttttgttttttcttctgatggcggaactaccaaagctagggttcttgttcttgctgttagcgaattgtatttagagagaggggcgtcgtgggaagcatgtaacgtgagttccatgatggtgttcgtgctgtaaactcggaacagttctctgggaaagatccacaccaaaatggaaatggagagatttgtcttgtcta

SEQ ID NO: 26767 - DNA, 1552 bp, Triticum aestivum
  unsure (1)..(1552): unsure at all n locations
  Clone ID: PAT_TA_26767
gcgtccggcagcggctccagacaggacaggcacttcatctgaagctggtggaccagatgggttgaagaaatgcaaatctgattctaaagctatttcaagtgttcttgctcctccgaaagatgtggaggacctgcaaacagaaggatatggaaatgtcaatattttcacatacaacgaactgcgagcagccacaaagaactttcggcctgatcagattcttggggagggtgggtttggagttgtttacaaaggcgtcatcgatgaaaatgttagaataggttttccatccaggcaggttgctgtgaaagaactgaacccagagggttttcagggagacaaggaatggttggcagaagtaaactatcttgggcaacttacccacgcgtcctagtcgaactgattggctattgctgcgagggttcacatagattacttgtctacgagtacatggcttgtggcagtcttgaaaagcacctttttcgacgggtttgccttaatatgccatggtcaactcgcatgaagattgcgctcggtgcagcaagggggcttgagtatctccatggagctgagagatccatcatctatagggatttcaagacatcaaacatcttgctagacgcggattataatgctaagctttcagactttggcctagcaagaactggacctagtggagaccaaacccatgtctcaactcgggtcatgggaacttatggctatgcagctcctgaatatgtgatgactggccatttgacagcacggagtgatgtttatgggtttggtgttgtacttctcgagatgattattgggaggagggctgtggacaagagccggccgagccgtgagcataacctagttgagtgggcacgccccctccttgtccacaaccggaagctcttcagaatcattgatcctagaatggaaggccaatactccaccaaggctgccattgaagtggccagcctttgctaccggtgcttgagccagaaccctaaagggcgtcctactatgagccaggtcgtcgaaacctttgaggaggttcaaagcatgccggaatgccaggacatactcctgcagaattgcatgaccggatctgtgacgctatacgaggtcccgaaggagcctgttgagcatgtcgagacagagaaggcgaagcaagaaccaacagcaaagactgatgccgtggcggtggccgtgccaccgccgaacggaaagccagtgccccagagcaagangacgccgccagcaaacggcaagagcaagagcgagccccctctggagtgcaagctgtacatcccttcccctgactccgacgggcatcaactggggctgggagccctggcatcgcccccttccagaaacaccaccgggcatgctccccccgcccctgggctttaattttttnaaatttaaanttattacaacaanttttttacaagntcaaaaaacccttttaancctttctcncctgttccanncaacctttttttnaaattatttggganacaatcaattcatannnggggtttttntttttttttttangggggaa

SEQ ID NO: 26768 - DNA, 1634 bp, Triticum aestivum
  Clone ID: PAT_TA_26768
cggacgcgtgggcggacgcgtgggagacctcgccagataatcagagaggagtctcgccgccggcgacggccgcccgcacatgccgatctccgccggcatccgcgcgccgccgcaaggggcgtccgtgtacgtccccgggagccggctcctccgcgtccccgttcctcaactggcggcgggcggcgtccggcgcaggaggctcggggtcgtggtggcggcggcctcctccgcggcgtcacccgacgagctccacgcgcgcgggaggcatctccacggtttccccgagaaatctttactttggaacttgataaaagatgtagaacctttggatctaagtgtagtccagagagatgttcctcctgaaactgtggatgcaatgaagaggactgtttcgggcatgttgggtctgcttccgtctgatcagttccgtgttgtcgtggaggccctttgggatcccttcttcaagttggtgatatcttcaataaagacagggtacactctgtctaatgctgaatacaggctttcccttgaaagaatcctagagttgtctgatgatgaaactgagtgcaaggaaagagatagcactgaatatagtcacggtgccctcgggtggggaggatctattttgagattatcagaagacgatgaagcggctaatgaatcagaaaagagggatgacaatttattatcggaaaatatgggtggattagatagcttaaacgctcaagcaaaagaacatattctccaattgcagtctcgcttggattctatggaaagggagctacatgaactcaagaagaaaaattcttccttgcaaatgcaacagtttgctggagaagaaaaaaatgagttacttgactacttgagatcattatcacctgacacggttatcgaactctcggaaccttcctgccctggtgtgcaggaagctattcattccgtggtacatggtcttctagcaactctctcccccaaaatgcatgcaaagccccctccaccatcagagaacatggctggtggaaccctgaattacgggaatggggatgatgaccgtgctgaactcgtggaggatgtatcgctcccatttcagcccctcatatctattccacgggatcatcttgcgcgtctattattctggtgtatgctgctgggccactacatccgaggcctcgagcgccggttagagctttcgcagctcctggaaatgtcatgtgacacaaggttgtgattcccaatttcccatggtgacaatagccatgcttaggcatcatgaagctttgccagtgggttgtcatcacccaaaacagaaacgttccctatcatctgtgaccaacaggaaagagaaggtccgcggaccagggtatctggtctcctattcgctgtcgccacaaaagctcgaaatggctgagttgcctgcggagtagcgggtagtacctgcgaagttaccaggtggttgtttcttttcgcttcctcgtggatcgtgctgtgcatatgttctggtagtgtagtaatcaacctttgcgactcttttgtcatctgtaaagtctggttatctatatgtataattctgtgattgtatcatagttgaaccgcattgatctaactatctaaggcccttgttatttgtgtcaaaa

SEQ ID NO: 26769 - DNA, 1112 bp, Triticum aestivum
  unsure (1)..(1112): unsure at all n locations
  Clone ID: PAT_TA_26769
gcggacaccccccccgccccccctccccccttcccgtccctacctccgccacacctagccccccaaaccccagccgcccgccccggcgcgggcgacctcccaccgaataaacccccaaaacctagtcgccgccgtcgccgccgccggcgccgccgcagcagccatgaacgccttccggttcctcggggacatgacccacctcttctcggtcatcgtcctcctcctcaagatctacgccaacaagtcatgctcaggggtgtcgaggaagacgcaggagctgtacctggcggtgttcgtggcgcggtacctcgacctcttcacagactacatctcgctctacaactccgtcatgaagatcgtcttcatcaccacctccgccgccatcgtctggtacatgcgccgccacccgcaggtgcgccgcacctacgaccgggaccaggacaccttccgccacgtcttcctcgtcgccgccgccttcgcgctcgccctcatcttcaacgagcgcttcaccctccgcgagatatgctgggcattttcgatttacctgtgagtcagtggcgattctacctcatttagttctgctccagagaagcagaaatgtacataatttaccgggatatatcggtttctcactgatggggacctaccccgcagtctacattctaaaccggatctagcgttaattcagagtgggtcaacaaatcatttgtatcccttggattgcaggtttggcccaaactgcccgcctggccatgctttgctcatgctacttcttgcattcgaagaacagcatgaacctcaagctgtctgccagagcagtttttgatattgcgatgaagagaacgccttgcagggtctggggtggattatcttggcaaaaagctatattacgtttgagatgctaacagtacaatagtagactagttccattttgtacctgggatggaggatcagcgaatccaaattcatttggcctgttgtttgcccgctctggttcacctgctgtaaacaaccagacgacgtgatctccagtgttcttgccctgctgtgtgggaacagctgtggcattgaaacaaacgatgcgatctccagtggtncttgcccgcgctatg

SEQ ID NO: 26770 - DNA, 658 bp, Triticum aestivum
  unsure (1)..(658): unsure at all n locations
  Clone ID: PAT_TA_26770
ggnaaattccccaaaccctcgcccgccgccgaccgacgacctccagatctccgctcatggatgacgacggtgccgcctccccgtcgccctcgccgtcaccgtcgcgctccccttccccgcttccggtcgccgaccccgtcaccgtcgccgccgtgccccccggccacctcgccctcgccatccctatccataagcatggtccctccagcagcggcggcggcgggggcgggggcagggaggacgcctggagcgacggcgccacctccacgctgatcgacgcctggggtgagcgctttgtcgcgctcggccgcggcagcctacgccacccgcagtggcaggaggttgccgaggtcgtctcctcccgcgatggctactccaagccgcccaagtccgacgtccagtgcaagaaccgtatcgacaccctcaagaagaagtacaaagtcgagaaggccaagtcggactcctcatggccattcttcgaccgccttgacttcctcctcgccccagtccagaagctcctgggcaattctggcggggcagcaggaaattctggctcctccaatcccagcaaccggagcaccgcacctatggccccgcgtgtcaacttccctcagcgcacccgcacggcctttccctcgtcaggtatgaagcggaggct

SEQ ID NO: 26771 - DNA, 2068 bp, Triticum aestivum
  unsure (1)..(2068): unsure at all n locations
  Clone ID: PAT_TA_26771
cgtccgcggacgcgtgggttcgacgtgatgacacaaatccttctaaggaaagcaatgaatttgtggagaatgtcctgaaagatattgagacacttggggttaaatacgatgtagttacatacacatcggattatttcccaaagctaatggaaatggctgaaagtttgattaaacagggaaaggcatatattgatgatacacccaaggagcaaatgaggagtgaaaggatggatggtgtggaatctaaacgtaggaacagtactgttgaggagaacttgtcgttgtggaaagagatggttaatggcaccataaggggtactcagtgctgtgtacgtggtaaacttgacatgcaggacccaaacaaatcacttcgagatcctgtgtactaccgttgcaaccctgatccncatcatcgtgtggttcagcaggctgaatatggtttataccgttcttagcaagcgcaagcttctgtggttcgtccaaaacaagatggtggaggactggaccgacgcacgctttcccactgtacaaggcatagtgcgtcgtggcttgaagattgaagcactgatccagtttatactggaacagggtgcttcaaaaaatctgaatcttatggagtgggataaactctggacaatcaacaagaagatagttgatccaatttgtggaaggcatactgctgtgctgaaagaaaaatgtgtgctttttacacttactaatggtccagaggaaccatttgttcgaatcttaccaaggcacaagaaacacgagggtgctggaaagaaggctacgacgtttgcaaacagaatttggctagagtatgctgatgcatcagtcgttagcgtgggcgaggaagttactttgatggactggggaaatgctatcattagagaaatcaagacagataatggaacagttactcaactagttggtgaactccatcttgaagggtcagtgaagatgacaaagctgaaactaacatggctatcagatattgaagatcttgtgtctctctctttggtagattttgactacctaattaataagaagaagctggaagaagatgaggacttccttgacaatctcaacccttgcactcggcgagaagctttagctcttggagacccgaacatgcggaacgtgaagaaaggagaagttatacagctcgaaaggaaaggctattacaggtgtgatgttccatttatccggtcgtccaaaccaattatgctttttgccattccagatggccgacagaagtccacgtcgattggagcctagcttctacaacgatgttagttaaattatggtacttttttgggcattaagttgcagccttattggtatcgaaactggtgttgtaatggctgaaacttggaacttcagattttggttctttagtgtctcggagttggttatccagtatcagttatgtaatttccttttacatgtttgagtatatgccaactgataccgggatatgtggattgtgaaacaaatatcaagatgagaattggcttaccataaccttaaccaacagaatttggactagagtatgctgatcatcagtcattagcgtgggtgaggaagtcactttgatggactggggaaatgctatcattagagaaatcaagacagataatggaacaatcactcaactagttggtgaactccatcttgaagggtcagtgaagatgacaaagctgaaactaacatggctatcagacattgaagaccttgtgtctctctctttggtagattttgactacctaattaataaaaagaagctggaagaagacgaggacttccttgacaatctcaacccttgcactcgccgagaagctttagctcttggagacccaaacatgcggacgtcaagaaaggagaagttatacagctcgaaggaaagggtactacaggtgtgatgttccatttgtccggtcgtccaaaccaattgtgctttttgccatcccagatggccgacagaagtccacgttgattgttactggagcctagcttctacaaacgatgttgcttgaattgcggtgccttttgggcattaatgttgcag

SEQ ID NO: 26772 - DNA, 1108 bp, Triticum aestivum
  Clone ID: PAT_TA_26772
ggcatccactacgctcacctgcgtagcgtgcgtgcagctggtgctctgtcttccactcttccgttcatcgtctgagacggtgtccactccgttaagatggaatcctacgccaacggagccaaattcgattgcctgctgtttgacatggatgacaccctctacccactgagcttagggatcaacctagcctgccgcaagaacatccaagactacatgctgaacaagcttcagatcgaggagagcctggtccccaagatgtgcctggatctgtacaaagaatacggaaccacgatggccggtctgaagcttatgggctacgatttcgactacgatgagttccacgccagcgtgcacggtaaactgccctacgagaagctgaagccggaccccgtcctgaggaacctgctgctttcgatgccacagaggaaaatcatattcaccaactccgacgaggctcacgcggcgaccgtcctggagaagatgggcctggaggggtgctttgagggaatcatatgcttcgagaccctgaaccagaagaattcaggtgacaagagggtcctgtgcaagccgtcgctggagtccatggaagccgtggtggagatcgccaagctcgaccccaagaagacagtgttcttcgacgacagcccgcgcaacatcgcctcaggaaaggcggcaggcttccataccgtcatcgtagggagctcggcgctcgtgcccggggcggacgtggcgctggagagcatccacaacatcagggaggccctgccggagctctgggaggcgggccggcgaccacgtcgtccacatccggtctgccgccgtcccggagaccacggtgctcccgtgagccgccggcgctgcctgccacatgattgatatgcttcgtccgccttgacttatgtattaacagaaaaatggcggaggcgaacggctgaatccagggaaaacccgtatatggtatggtttactcgaccataatccatggtgatcagtgatcactgatgaatgcgtaggtattgaatgtacaggtgtactacttgtgtagagatgtgatcgaaacacattaataataagctccgtaaattcgtaaaaaaaaaaaaaaaaaaaa

SEQ ID NO: 26773 - DNA, 703 bp, Triticum aestivum
  Clone ID: PAT_TA_26773
gtgcggccgtcgaggccggcgggcgggggacttctgtcttctttgtccaagacattcgagcttgttaagttctagtagttttatttgttgcagagttagtaccagagaaatggagccacaggaaggaaggaaagggataccatctctgctgtcctcgcagggggagtgcattgccaccaacatcacacagctcattggttggacaccactgatagaactgagaaacatcactgagaaagacagcataggtgctcggctgattgggaagattgagccgtaccagcccctttcctctgtgaaggatcggagtgctctcagattgattgaagatgcagaggagaaaggcttgatcacacctggcatcacaacactgctgggggtcacaagtggtaatcttggcatcggcgtggcgttcattgctgctcagaaaggatacaagttcatcgccctcatgcctgctaaactctcgcttgataagcagatactgatgcgataccttggcgtagaagtggtattagttgatgctgtacagcatggattcaaagctttacttgatagggtagaacagatgaagaaggatgtggaagatgtgtatgttctagatcaattcaccaatcctgcaaatcccgatgcccacttcaaatggactgggacctgagatatggaaaaatacagccaggcaaggggacatatttatagctgc

SEQ ID NO: 26774 - DNA, 825 bp, Triticum aestivum
  Clone ID: PAT_TA_26774
ctttggagctccttggccgtggcgatactggcggtggacgcgggagaggggggcgtgggggccgcggaggtggccgggacggtggccgtcggcctgctgacgtcaacgagcaggaaaagatcttcttgggtgacaatgctgatggcgagaaactcgagaagcggcttgggcctgagaaaatgaagatttgggacgaggcgttcgatgaggcagcagatgaggcactgccaaacccggagaatgataagcttctcgacgatattcataccgataacatgattgagtttgagccagggtacaatgtgagctttggtaatcctgatattgaggagaagccgcctatgtcattgcaggagatgctggagaaagtaaagccattcatagttgcttatgaaggcatccaggaccaggaagaatgggaggatgccgtggccgatatcattttaaaggcaccccatatgaaagagatgatagatatgtacagtgggcctgatgtcgtaactgcaatacagcaagaaggggagctgcaaagggttgccaacactcttccagcaaacatacccaattcagtaaagcggtttactgataaaactttactttctctcaagaataatcctggttggggttttgacaagaagtgtcaattcatggacaagtttgttcgtgaagtttcagagcaatacaagtaaaaggcttctgatgcactgttgtaagatctcatttagcccctaagaagatttagcggattttccttgttttgggagaaggtgtaatgttatattcaatccatgcagccagtttctttctacgggctggtagttaggc

SEQ ID NO: 26775 - DNA, 1756 bp, Triticum aestivum
  unsure (1)..(1756): unsure at all n locations
  Clone ID: PAT_TA_26775
ttcgcaccactgctccggcagccgtcgttcggccttgcccctctcgccgaaccaaggagtaccgggcgcggcggcggcggctgccgcccgcagggccagcatggcgtttctcttcaacaaattccaggaggcaatcaaaacacttgctaagagtccaagctttgctcgagacccacggcatcttcagtttgacgctgacgtgaatcgtttatttctctataccagctataatcgtttgggaaagcattctgaagaaaaggacgccgaggagattattgaattggctagcaaagcatctgttactgaccagcagaaacaagtgcagcaaaatgttcattatcaacttaagcatatatgcaaatcaatggatagcattcttcgtcctgatacaaaagatccatcacaatctccttctgatgcttataataattctcgacgaagtggcttgagtttggccgttggcacaggagttgcagctgcaaacaagccagctgttcctgctacgcgacctttaactcgaactgaattgtcaaacaaattcagggatcagtttggctacacccttgtcatcaagccgtcactaatacctcacaaagatgcagggcaaggtctgttcttgtccggagaagctctcccgggacccgccctaaccaccgccccggcccacacatgcccccctgcgcctcatcccttcttccctgcagacccccgcatcgctcccgtccccagttatcttatcacaagatatgacggaacaataatcaacgcgaaaccatggcatttaggtggtgaaacaagagaaatatgggatggttcagatccagtggattacaatacaacgccacccataaacccagagagcaactctgaccgggcatggaggatgcttaacaagcccctgcagaagagtggcagtgaaaacttcggggatgtgcttgaacggcgaaatccactagcctttggtcatttcgcgaaccatccaccgggaggatcgactcctaatgtcatgatctgcccatatgattttccactgacagagaaggacatgagagcatacatcccgaacattgcatttggtggtgaagagccggttacaatgaagaggtttggctccttctggttcaagtccagagcccctggtaaacagaccggggagtcaccggttctgaggacgcttgtgctagtgagtacgaggtccgtatgtgacgaagagctcttcctgaactaccggtacagcagctcaaaggggcggccagagtggtataccccagtggatgaagaagaggataagaggagatggagctaggtctgaacagacccgcctgtaatgttttgttcaaatgttcctgtggctctttctttcatcagtaaccggatttaaacagggcactggtgaactccagaagccgattcggctattctttctagtatgtttcagtcttccaccgcataggtagtgtctctgctgaactcttctcgcaggtcttttgtggcaataaaaagaacaccagttacgtctcattttctctgaggcagtatctgtattatccatccccgttgttgtaaggggatatttatgagcttatcactcaatctgtgtcaagtagtccgatacgtatttgctttccggaatattaacaagctatgccataattgctaagcgaactgcttctcgtcctaaataaatactacctccggtaacttaatataagacgttttttttaaaaaaaaaaagaaaaaaaacccnaaggggggg

SEQ ID NO: 26776 - DNA, 640 bp, Triticum aestivum
  Clone ID: PAT_TA_26776
gtcaattcttttgatttataagggattttgccgatttcggcctattggttaaaaaatgagctgatttaacaaaaatttaacgcgaattttaacaaaatattaacgcttacaatttgccattcgccattcaggctgcgcaactgttgggaagggcgatcggtgcgggcctcttcgctattacgccagctggcgaaagggggatgtgctgcaaggcgattaagttgggtttcgccggggccctcccactcccgccgcgctgcatcgtcggcccgtcctttctagtacggctcacgtctcgccgggctgggcgcccgcccccccctccagtcccttgcttttttctgtgtttcaggacacaaagttatgccttatttatttctagcatgaagtgcgcctaacatatccattaagttctatccatcatggcaaatcttgcagtggcagtagccaccgaagaacttatcgcaccaaggcttgtagaccttcttacccttccactgatacttgcatatatcctcgcatgatgattggacgcagaacaagatctgaaattgaacatcctcacagtctgcagatgcgctttcgaacaacacaagcatcaccagaaaacaagcgatgacagaccttctgctcgtgccga

SEQ ID NO: 26777 - DNA, 1547 bp, Triticum aestivum
  unsure (1)..(1547): unsure at all n locations
  Clone ID: PAT_TA_26777
gccggccgggtcgggaacggccccagccgccctcccccattcccaacccacaccaccaccaaatcacccatctcgcacggcagcccaccagagaggaagaggccgagggagagcggatctgcgcgatggcgacgctccagcaccagaaccagggggcagcggcgccgatgaccaccacgggcggcgggctgcgcgccatggacctctacgagaagctggagaaggtcggggagggcacctacgggaaggtgtacaaggcccgggagaaggcgacgggccggatcgtggcgctcaagaagacgcgcctcccggaggacgacgagggcgtgccccccacggcgctcagggaggtctcgctgctgcggatgctgtcgcaggacccgcacgtcgtgcgcctgctggatctcaagcagggccagaacaaggagggccagaccatcctctacctcgtcttcgagtacatggacaccgacctcaagaagttcatccgcggccaccgccagaaccacgagaagatccccgcccacaccgtcaagatcctgatgtaccagctctgcaagggcgtggctttctgccacggacgcggtgtcctgcaccgtgacctcaagccgcacaacctgctcatggaccgcaagaccatggctctcaagatcgccgatcttgggctcagtcgtgccttcacggttcctctcaagaagtacacacacgagatccttactctgtggtacagagctcctgaggtccttcttggcgccacacactactcaacgccggttgacatgtggtctgtgggctgcatatttgctgaattgatcactaccacggcacttttccctggagactctgaggtgcagcagctcctgcacattttcaagttgctgggcactccaaatgaggatgtctggccaggagtaggcaaactccccaactggcatgagtaccctcagtggaacgtctcaaagctgtcttctgtaattcctagtctcgatgccgatggtatcgatctgcttgagaaaatgctgcagtatgagccggcaaagcggatctctgcgaagaaggccatggagcacccatacttcgatgatgtggacaaggcgctgtactgaagctgtcttcgtggctagcaagaagcggatttcttgtgatttgtgcttgtcctgaagcatatcttttgcttccagggcaggcatctttacctctgttattccagctgccatttagttttgccccattgactgatggttgtcatggatagtgactctggagttatgcataattaaacgcctcttgccaggcgttaagtactgatcttgtgaagcactacttctgcttcaaaatcagactttacctctttttctagctgctatttatagtgtacgccattcatttttgtttctgatggataactgaaaaatcgtccttgatgaaggtaaaagacatggtgagataaccaaatttcgccntgatgctcaaagtcatccttgagctgaactggctcctgaataatggnaaattggcantcnatcctccggattaaaaaaaaaaaa

SEQ ID NO: 26778 - DNA, 1345 bp, Triticum aestivum
  unsure (1)..(1345): unsure at all n locations
  Clone ID: PAT_TA_26778
gaggaattcggcacgaggcccccttcttctttcttccgccccgagaaggcgagccgcctgtttcctccgccggtttgccctcctccgccctctccatataaaccgcccgtctcaaacctcaggcgcatcgcacacaccaaaacaaaagtgaaaaaccacatcctccctccctccgagacgccgcccggcccgaccaatggctcccaggaagttcttcgtcggcggcaactggaaatgcaacgggaccggcgacgacgtgaagaagatcgtcaccttcctcaacgaggccgaggtgccctccgaggacgccgtcgaggtggtggtgagcccgccgttcgtgttcctgcagcaggcaaaggggctgctgcggcccgacttcgccgtcgccgcgcagaactgctgggtgcgcaagggcggcgccttcaccggcgagatcagtgctgagatgctggtgaacctgcaggtgccttgggtcattttggggcactctgagaggagagcactgttgaatgaatcaaatgatttcgttgctgataaagtggcttacgcactcgcccaaggactcaaggtaattgcttgcattggtgaaactcttgaacagagagaagcagggacgacaatggaagttgtttctgctcagactaaagctattgcagagaaaacatcagactggacaaacgttgtgctggcatatgaaccagtgtgggccattggaaccggcaaggttgcttcccctgctcaagcacaggaggttcatgatggtctgaggaagtggctccacgctaatgttggtcctgcagttgctgaatctaccaggattatctatggaggctctgtaaatggggcaaactgcaaagagcttgcagctcaacctgatcttgacgggttccttgttggcggcgcttcactcaagcccgagtttgtggacatcatcaagtctgccaccgtgaagtcttcttctgcttagttgtttttgagatgcatgcagttgcttgtaggagtggattctgcttatctttataagactgtttgaccatcttgttctaattcgagtgcactgttatgtcgcattgaccatcttatctttagggtgatgcatgcttatgtttgcttgtttttgtctggaacgataatcggattacttatatgtaccaactatgcacaaattcgacaaaattcgcagaggcctgttgacaccaaaaagggaaacagttcctgtcctgaagtccgaagtgccgtacattgaacccgtaccggtgcctttaaaactctccccaacagccctgaaancccttccacngtanacaaggcnancattccttcaatnnnctatgaaggaccccct

SEQ ID NO: 26779 - DNA, 1045 bp, Triticum aestivum
  Clone ID: PAT_TA_26779
ctgaagatcacaagactttgatggggtcgccaaatgggaatgaaaatctggatgcatgtgaaatacatcatcaagaaactgcagtcaccagagagattgtattgggaagtggtactgcagctgtctgtgaaacttatattcccatgggctcaggatgtcacaacatgaaattggaatatccaagtgatacaacaggtggctcaggaactgaaggcagagacagcatgaaggatgaggagagctttagtctgaatgaagctccatgctatgtcgaacgacatgtgggtgcaagcagatcaatgcctgacaatatattggccaagaagaaggcgctcacatcgttgacagaagtatcgttacaacatcaaagtgaatcaatcctgaaggcggacttcgttttgcatgattctgagtcaagctacaaaaggcagaagattgttaatggagatgaacaactacccaacgagcgcttgtcgaagatacattccctgccagctggttggcatactccattcgatgactcacgttatgcatacaagggtctctcagatctaggttcgacgacaaaagccatctcagatcaagttgttcatgttctttcgtctgatgatgaaggctctccagaacatactactatgaataaggccccgttgaaggcagaacagggatcctcctcccctctgttgtcactatccctgtctacagcggcaaagacgcgcaaacttgccagttcggacgcaggaaatgatcgatcgctgtctctttctcttggcctccctctccctggtgttgcaaaaggaaaccaggctatggagataaagcagtttctgccggagaagcctggcataaatacttcttttcatctttagatatgcgggtgtacagttttgtgctgtgtttaactttatggagtttagacagggtagaagtatggtatagttgttaaattatgaacatcttggtcttattgcaccgctctatgcatctcctgcaactgttggttcatgctggtctggtgatggtattgactgcttttgtttgatct

SEQ ID NO: 26780 - DNA, 687 bp, Triticum aestivum
  Clone ID: PAT_TA_26780
cacaatataagatgttttgaatatttcaatatagactacatacagactgaaatgggtgaataaacacactaagacatgtctatatacatccgattcacacaaaaggttagagcatcttatgtttgtgaacagagggagtatttacttgtcacgctagtgcatttcgttttgtctcctaacaaaacagtgtctggtatttgagtaactgagacctccgcttcttataagccagtgtaagataacactagacttctggatcacccctacggtgtcattgccttgatatggacatcagaaggtcatgttgacgttgacgcactcttccttaacctgcgcaaagagctccgagttcagatacctctctgcaccactggaaaacattgtcacaatcatctttcccctgttctcctctcttgatgcaacctttaagcaggcagctgcatttgcccctgaagatatgccaacaagcaatccttcttcccttgccaatcttctagccatgtccatagcttcttgagtagttactgttacaatttcatctatctgggatctatccaatatttctgggacaaagccaggccctattcctaggatgttgtggaagcctggctcgccacctgaaatcactggactttcagctggttcaacgcatattaattttacagatgggttcttcgtcttgaaaaa

SEQ ID NO: 26781 - DNA, 1017 bp, Triticum aestivum
  Clone ID: PAT_TA_26781
cagggataaaagttcttcacttagcctttcagccaccacaaaaaattcctgacaagtcagagaacagaagaggggctaaaaacaagtaaacacatgatcgtcatggagattttgcgccaattgccgtttctttagaggtctacagcattccatcccacgggtatgaaaactcggtcggtattcctttgtactgatagggcacagctacgatgtcatggccttcatgaagttctcttgggaggagacatgttttgcaggagtctggtggttgtcgcgatgaccaccaattggagcaggacaccaagtgcaacacggatcacaacgagcatctcatagcttgtaatggctgctgtgttttgcttcgtgatcttcacgaaccagtctgcatgaataatgcccgtcacagagaatgcaatagcaatcgatgacaagcttgtgtacaaccggaagaaacactgccacagtccgcctccgcccaaattcccccaagcataatggccagtggccccacgggcaaggaacaccaccgcgatccggtttccctccgtacccccccccacagaaagcaacgcaaacccggcccccagcgacctggtgcagtgcctgctcgtccccgacccgtgcgaaccgagaccgcacgtccgagacgcccccgtaaccgtggtcgacgaccttgcggtagcaggagccgggcccgtccggttccgcccgcgccgaccctcccgcaccgggagtcgacgaccatgcggtaggagaagtcggagccatccgtgccggacggccggccgcgccgctgctgcatcgggatggacgacgacgacggcgacggcggtgctcgccggcacgagcatgagccgggcgaggcgggatctgcgctcgccgaccctccggcgccgggagtcgacgaccatgcggtaggagaagtcggagccatccgtgccggacggccggccgcgccgctgctgcatcgggatggacgacgacgacggcgacggcggtgcacgcggggaaggaagc

SEQ ID NO: 26782 - DNA, 606 bp, Triticum aestivum
  unsure (1)..(606): unsure at all n locations
  Clone ID: PAT_TA_26782
ctccaccagcttaaccacactcatctgatcacccatagctagctagctagcagcttaaggaactagcttgcagctaccgatcgatggctcgtctcaacagcaaggctgtggtggccgccgtggtcctggcggcggtggtgctgatgatggccggcagggaaggcctcggcggcgctgtcgtgcgggcaggtgggactccaaagctcgcgccgttgcgtggcnactgaaccggggaagggcgtcctccattaagcaaaggattgctgctcccggcgtgcaaggggctgaacggatggcccgcagcaactccggaccgcaaaatacctgcaagggcctcaaaacctccccaccagcatcantccatcaaatgggaagtctcccgggntttcccggaaattcgggtcagttgccttccccatcaacattcaacaactgaaacttcaacnattcaataaaacctcccaagttnatcaatggaccctttttggactaanncaagttnagggtgccaancanacgatgacnctaaaaataaataantgctgattgtattagnagttcaagncgtcctnaaaacgttgtanaaattttcanatttcnntcctt

SEQ ID NO: 26783 - DNA, 427 bp, Triticum aestivum
  Clone ID: PAT_TA_26783
cccacgagcctgcccccgcgtccgttttttttagtagctcatcagtatcgtatgagcaccccatcagcatgtccaccaactgcgacactgtcaactagttcaatatataacccttcctacgtgcatgcatggacgcgcttgtgtggagcttaatgtctatgttgatggagtgctcatacgatactgatgagctactaaaaaaataaaataaagttgcctgcatgtgttatttcagtagtgtgtctatgtctgtaccttgcacacacactgtgtgtgcatatatatttatgcgacatgtatgcacacgtccgtatgcgtgagtgaactgtcagttccttgctgtactccagtctagccgagatgtgtacgtgtgatgtgcctgacctacttgttcaggcaattaatgaatagtaattattttcctaac

SEQ ID NO: 26784 - DNA, 412 bp, Triticum aestivum
  unsure (1)..(412): unsure at all n locations
  Clone ID: PAT_TA_26784
agcttaaccacaccgccgacactcatctgatcacccactagctagctagcagcttaaggaacttccagctagcgatcgatggctcgtctcaacagcaaggctgtggtgtccgccgtggtcctggcggcggtggtgctaatgatggccggcagggaggcgacggcactgtcgtgcgggcaggtggactccaagctcgcgccgtgcgtgtcgtacgtgacggggaaggcgccctcgatcagcaaggagtgctgctccggtgtgcaggggctgaacgggcttggccccgcaacaacccgggaccgcaaagatagcgttgcaaggtgcctcaaagaagcctccgccaaccaagcaatcaaagttccaatcaaacaattggacaaagggtctcccgggcgtngcccgggnaaattgc

SEQ ID NO: 26785 - DNA, 678 bp, Triticum aestivum
  Clone ID: PAT_TA_26785
attcggcacgaggcttaaccacactcatctgatcacccatagctagctagctagcagcttaaggaactagcttgcagctaccgatcgatggctcgtctcaacagcaaggctgtggtggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcatggcccgcagcagctcggaccgcaagatagcgtgcaggtgcctcaagagcctcgccaccagcatcatgtccaccaactgcgacactgtcaactagttcaatatataacccttcctacgtgcatgcatggacgcgcttgtgtggagcttaatgtctatgttgatggagtgctcatacgatactgatgagctactaaaaaaataaaataaagttgcctgcatgtgttatttcagtagtgtgtctatgtctgtaccttgcacacacactgtgtgtgcatatatatttatgcgacatgtatgcacacgtccgtatgcgtgagtgaactgtcagttccttgctgtactccagtctagccgagatgtgtacgtgtgatgtgcctgacctacttgt

SEQ ID NO: 26786 - DNA, 571 bp, Triticum aestivum
  unsure (1)..(571): unsure at all n locations
  Clone ID: PAT_TA_26786
gcttaaccacactcatctgatcacccatagctagctagctagcagcttaaggaactagcttgcagctaccgatcgatggctcgtctcaacagcaaggctgtggtggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcatggcccgcagcagctcggaccgcaagatagcgtgcaggtgcctcaagagcctcgccaccagcatcaatccatcaacatgggcaagtctccggcgtgcccggcaagtgcggctcagtgtgcccttccccatcaacattccacaactgcgacactgtcaactagttcaatatataaccttcctactgcatgcatggaccgctgtgtggactaagtcatgttgatggatgccatacatactgatgactcaaaaaataaataaattgctgattgtantcatagtgttcangtcgtcct

SEQ ID NO: 26787 - DNA, 1350 bp, Triticum aestivum
  Clone ID: PAT_TA_26787
cttttaggttttttcccattttttaaatttttaaaccccggcccattttttttttttttccttttccccatattaaaaatttttactttcacatttacccgtatttttatttttttttttctttaatccgcccccccctttttttttttttttttttttttttttttttttttttttttttttttttttttttttttttttttttttttttttttttttttttttttttttttattaatcaataggttttatctcagaaatttggttctacaccagcggcaaatttagaggtacttgagacaataaaacttagcacacatatatcttagccagacggtttgaccggaacagttgagtactgataacactgccgacgactttccagttttattgcagtgtgtgtagtcaagcaagagctcctgcaggttgactagaactgatgagccacatcgccggcgcccggtggagcaagctgctggtagcctaggttcagctgaagcgaggcctgagcctgagcctgagcctgtgcctgcgcgtgcgcatgcaccgccgcctcgaagaggttggcagggaagaagcacttcatgtccagtgcggtgaaagggttcagctccggcgccaccgagggcctggcgatagtcacctgctgcaaccgctgctcctcctccgcaatcttggttctgagatcaatgctgtcactctgaagctctatctcccttttgaccatgtagttgatctcagaagataggagctcattcttcctggccctgatcttcgcaatgcctttctcaagccggctttcgagttgcttcagctccttgagtgacaggttcccaacagaatcaccaaccaagtgcttgttagtgctttgcagcatctggatctggtggcgcagctttgcagcttcttgctggtagtattgctgagcattgacttctatgagaggtaccccagaggttgagccacaagcatgtgccttcttgtacctgtcaattgtagccttgacactgttgttggagtactcgtagaggcggccgcggctggagaagacgatgagcgccacctcggcgtcgcacaggacggagagctcgtaggcctttttgaggagcccgttccggcgcttgcagaaggtcacctgccggctagtggtgttctcgatcctcttgatctcaatccttcccctccccatctcgacctcttcttagtctcagcccggaactctagctaggcagaagagagcagacgatcgactaggtatggggctctctgatacagctagctagctgtccttcctccctttggtttataatataggacccaagccgaaggcagaaaaaggaggggctccag

SEQ ID NO: 26788 - DNA, 1265 bp, Triticum aestivum
  Clone ID: PAT_TA_26788
ttttttttcttttttttaattattaatcaataggttttactgcacaattgtgtagcaattcgtcagaatatacgtgagtaattctcagaaatttggttctacaccagcggcaaatttagaggtacttgggacaataaaacttggcacacatatatcttagccagacggtttgaccggaacagttgagtactgataacactgccgaccactttccagttttattgcagtgtgtgtagtcaagcaagagctcctgcaggtttactagaactgatgagccacatcgcccgcgcccggtggagcaagctgctggtagcctaggttcagctgaagcgaggcctgagcatgagcctgagcctgagcctgtgcctgcgcgtgcgcttgcaccgccgcctcgaagaggttggcagggaagaagcacttcatgtgccagtgcggtgaaagggttcagctccggcgccgccgagggcctggcgatagtcacctgctgcatccggctgctcctcctccgcaatcttggttctgagatcaatgttgtcactctgaagctctatctcccttttgaccatgtagttgatctcagaagataggagctcattcttcctggccctgatcttcgcaatgcctttgctcaagccggctttcgagttgcttcagctccttgagtgacaggttcccaacagaatcaccaaccaagtgcttgttagtgctttgcagcatctggatctggtggcgcagccttgcagcttcttgctggtagtattgctgagcattgacttctatgagaggtacacccagaggttgagccacaagcatgtgccttcttgtacctgtcaattgtagccgttgacactgttgttggagtactcgtagagtcggctgcggatggagaagacgatgagcgccacctcagcgtcgcacaggacggagagctcgtaggcctttttgaggagcccgttccggcgcttgcagaaggtcacctgccggctagtcgtgttctcgatcctcttgatctcaatccttcccctccccatctcgacctcttcttagtctcagcccggaactctagctaggcagaagagagcagacgatcgactaggtatggagctctctgatgcagctagctatagctgtccttcctccctttggtttataatataacccaagccgaaggcagaaaaaggaggcgccccagttgggttttcctcccaggaggtaaagtaagaaacgagttgataggagccaagggaaggcagggtaaggacggc

SEQ ID NO: 26789 - DNA, 1163 bp, Triticum aestivum
  Clone ID: PAT_TA_26789
ttttttttttttttttttttttttacgcgagtaattctcagaaatttggttctacaccggcggcaaatttagaggtacttgagacaataaaacttagcacacatatatcttagccagacggtttgaccggaacagtggagtactgataacactgccgacgaccttccagttttattgcagtgtgtgtagtcaagcaagagctcctgcaggttgactagaactgatgagccacatcgccggcgcccggtggagcaagctgctggtagcgtaggttcagctgaagcgacgcctgagcctgagcctgagtccgtgcctgcgcgtgcgcttgcaccgctgcctcgaagaggttggcagggaagaagcacttcatgtccagtgcggtgaaagggttcagctccagcgccgccgagggcctggcgatagtcacctgctgcaactgctgctcctcctccgcaatcttggttctgagatcaatgttgtcactctgaagctctatctcccttttgaccatgtagttgatctcagaagataggagctcattcttcctggccctgatcttcgcaatgcctttctcaagccggctttcgagctgcttcagctccttgagtgacaggttcccaacagaatcaccaaccaagtgcttgttagtgctttgcagcatctggatctggtggcgcagctttgcagcttcttgctggtagtattgctgagcattgacttctatgagaggtaccccagaggttgagccacaagcatgtgccttcttgtacctgtcaattgtagccttgacactgttgttggagtacctcgtagaggcggccgcggctggagaaggacggatgagccccacttcggcgtcgcacaggacggagagctcgtaggcctttttgaggagcccgttccggcgctttgcagaaggtcacctgccggctagtggtgttctcgatcctcttgatctcaatccttcccctccccatctcgacctcttcttagtctcagcccggaactctagctaggcagaagagagcagacgatcgactaggtatggggctctctgatacagctagctagctgtccttcctccctttggtttataatataggacccaagccgaaggcagaaaaaggaggggctccagttgggttttcctccaaggaggtaaa

SEQ ID NO: 26790 - DNA, 782 bp, Triticum aestivum
  Clone ID: PAT_TA_26790
cactccaccagcttaaccacactcatctgatcacccatagctagctagctagcagcttaaggaactagcttgcagctaccgatcgatggctcgtctcaacagcaaggctgtggtggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggtgcaggggctgaacggcatggcccgcagcagctcggaccgcaagatagcgtgcaggtgcctcaagagcctcgccaccagcatcaagtccatcaacatgggcaaggtctccggcgtgcccggcaagtgcggcgtcagtgtgcccttccccatcagcatgtccaccaactgcgacactgtcaactagttcaatatataacccttcctacgtgcatgcatggacgcgcttgtgtggagcttaatgtctatgttgatggagtgctcatacgatactgatgagctactaaaaaaataaaataaagttgcctgcatgtgttatttcagtagtgtgtctatgtctgtaccttgcacacacactgtgtgtgcatatatatttatgcgacatgtatgcacacgtccgtatgcgtgagtgaactgtcagttccttgctgtactccagtctagccgagatgtgtacgtgtgatgtgcctgacctacttgttcaggcaattaatgaatagtaattattttcctaaaa

SEQ ID NO: 26791 - DNA, 747 bp, Triticum aestivum
  Clone ID: PAT_TA_26791
cctttctactatggccctatggggaaagagagagataaaatctctcatgtggcaatcatcaatacacacacgcggttgcactacttgtccagattactaacatgatagtacaccatctcacatactccatcagtgtactaacatgatagcacaccatcagcgtataacatagaactaatgaaaacacggcagattacaacagcaagccgctccggccggcacccaggcaggggagacatgggacggatcagccaaagaagggtgggtcatatccgttgctggtggtggcgaggatgtagtaggcgacgatgtggccgatggagccccaggcgaggacgtcgacgaggttgaagccgacggggtcgttggacttgaggatgccggcgaactccttggcgcgctcgtcgccggcctcgaagtgggtcttgccgttctgctcgggcacctgcttcgccacgttctcccgctggaagttgaagaagacgaagcggcccatcaccagcgacagccccgtgctgaggctgatcaccaccgacggctccagcgcggcccgcgccgccacggaccgcctcgccggcgacgaggccccccggaaagagaccgccgcgcgatgggacggcgccaggcggagcccggcaacggtgggcggggacagcacggcggcggtcgaggtggccatggccctctagagctgtgtgggtgttcaaggaccaacgtgcggcgagttcttgatctccggacgcgtgg

SEQ ID NO: 26792 - DNA, 847 bp, Triticum aestivum
  Clone ID: PAT_TA_26792
gccggccggtttccacacatcacactccaccagcttaaccacactcatctgatcacccatagctagctagctagcagcttaaggaactagcttgcagctaccgatcgatggctcgtctcaacagcaaggctgtggtggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcatggcccgcagcagctcggaccgcaagatagcgtgcaggtgcctcaagagcctcgccaccagcatcaagtccatcaacatgggcaaggtctccggcgtgcccggcaagtgcggcgtcagtgtgcccttccccatcagcatgtccaccaactgcgacactgtcaactagttcaatatataatccttccgacgtgcatgcaaggacgcgcttgtgtggagcttaatgtctacgttgatggagtgctcatacgatattgagctactaaaaataaaataaaagctgcctgcgtacggcacgaagctctgctgcatgtgtatttcagtactatgtctttgtctgcacgttgcacacacactgtgtgcatacagtatatttttacgcgacatgcatgcacgcgttcgtatgcgtgagtgaaccgtcaactccttgctgtactctagccgatgtgtacgtgtcatgtgtatgacctacttgttcaggcaattaatgaatagtaattattttcttaaataaaaaaaaaaaaaaaaaaggcccctagg

SEQ ID NO: 26793 - DNA, 867 bp, Triticum aestivum
  Clone ID: PAT_TA_26793
ggccgccctttttttttttttttggtcaaaagataaaagtagcactgatctcaaagcaaccacagacggtggatctacgcacatgatatcccgtgcacactaaaattgcttttctactatggggaaaagagagataaaaccattcatgtggcactgaatacacacacgcggttgcactacttgtccagattaatcaatctttcaccacctcacatacatacaaacatgatagtacaccatcagcgtataatatagaactagtgaaaacacggcagattacaacagcaagccgctccggccggcacgcaggcgggcaggcaggggagacgtgggacggatcagccgaagaagggtgggtcgtatccgttgctggtggtggcgaggatgtagtaggcgacgatgtggccgatggagccccaggcgaggacgtcgacgaggttgaagccgacggggtcgttggacttgaggatgccggcgaactccttggcgcgctcgtcgccggcctcgaagtgggtcttgccgttctgctcggggacctgcttcgccacgttctcccgctggaagttgaagaagacgaagcggcccatcaccagcgacagccccgtgctgaggctgatcaccaccgacggctccagcgccgcccgcgccgccacggaccgcctcgccgccgacgacgaggccccccggaacgagacggccgcgcgcggggacggcgccaggcggagcccggccacggtgggcggggacagcacggcggcggtcgaggcggccatggtcctcctccttcgctggagctgtgtgggtgctcaagctcaaggaccaacgcgcggcgagttcttgatctcggtaggccccggcccggccggc

SEQ ID NO: 26794 - DNA, 955 bp, Triticum aestivum
  unsure (1)..(955): unsure at all n locations
  Clone ID: PAT_TA_26794
tgtgggctgcgcgtgtcaagataccgagcgcctataaagcgtcaaggtgaaggagtttggatagtcgaatattcgtctgtcgaggtgtccagttcacttgtaccgtcgccctgatggtcccggtactcattaaaggtagttgggacgtgagcctcgaaaagtatgttttttcctctacagagataccgccgcatcaatcatgtgccggtaaaacacacacgcggttgcactacttgtccagattaatctttcaccatctcacatacatacaaacatgatagtacatcatcagcgtatagagaactaatgaaaacacggcggattacaacagcaagccggtccggtcggcacgcaggcaggcagacatgggagggatcagccgaagaagggtgggtcgtatccgttgctggtggtggcgaggatgtagtaggcgacgatgtggccgatggagccccaggcgaggacgtcgacgaggttgaagccgacggggtcgttggacttgaggatgcccgcgaactccttggcgcgctcgtcgccggcctcgaagtgggtcttgccgttctgctcggggacctgcttcgccacgttctcccgctggaagttgaagaagacgaagcggcccatcaccagcgacagccccgtgctgaggctgatcaccaccgacggctccagcgccgcccgcgccgccacggaccgcctcgccggcgcccggaacgagacggccgcccgcggggacggcgccaggcggagcccggccacggtgggcggggacagcacggcggcggtcgaggtggccatggtcctctctccctcggatctgtgtgggtggtcaagaaccaacgtgcggcgagttcttgatctcggtaggcgccacggttttttttttttttttttttttttttttttttttttttttnnnnttnttttattcccggggcccggccgnngccctcga

SEQ ID NO: 26795 - DNA, 988 bp, Triticum aestivum
  Clone ID: PAT_TA_26795
atagcaggacacaacgacaggacagaaactaagcacacacacacaccatcacactccaccagcttaaccacactcatctgatcacccatagctagctagctagcagcttaaggaactagctagccagctaccgatcgatggctcgtctcaacagcaaggctgtggtggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcatggcccgcagcagctcggaccgcaagatagcgtgcaggtgcctcaagagcctcgccaccagcatcaagtccatcaacatgggcaaggagtgctgctccggtgtgcaggggctgaacggcctggcccgcagcagcccggaccgcaagatagcgtgcaggtgcctcaagagcctcgccaccagcatcaagtccatcaacatggacaaggtctccggcgtgcccggcaagtgcggcgtcagcgtgcccttccccatcagcatgtccaccaactgcaacaatgtcaactagttcaatatataacccttccgacgtgcatgcaaggacgcgcttgtgtggagcttaatttctacgttgatggagtgctcatacgatgttgagctactaaaaaataaaatgaagttgcttgcgtgtgttatttcagtactgtgtcactgtgtgtctgtgtccatgtctgtaccttgcgcacacactgtgtgtgcatatatatttatgcgacatgtatgcatgcgtccgtatgcgtgagtgaactgtcaactctttgctgtactctagtgtagccgatgtgtacgtgtgatgtgcctgacctacttgttcaggcaattaatgaatagtaattattttcctaaaaaaaaaaaaaaaaaaggccccta

SEQ ID NO: 26796 - DNA, 672 bp, Triticum aestivum
  Clone ID: PAT_TA_26796
tgaatgaggtgaggttggtcgctgaggcgagcgagtgatggcacggggaggagctcacgtcgtcgcggcggcggctctgctgctcctgctgctcctcgcggcaggcggcggcggcgtgcattgcctgaggtcaagggcggtgagcggcgccacggtcctggagctgcggcaccacgccagcctcggcccaggcggcaggagcggcagcgcggaggaggcccgcggcgtcctggcctccgacgccgccagggtctcgtcgctgcagcggcgcatcggcagctacggcctgatcaggtcgtcggacgcggcgtccaagctggcgcaggtccccgtcacctccggcgccaggctccggacgctcaactacgtcgccaccgtgggcatcggcggcggcgaggccacggtgatcgtggacacggccagcgagctcacctgggtgcagtgcaagccctgcgacgcctgccacgaccagcaggagccgctcttcgacccgtcggcgtcgccgtcctacgccgccgtgccgtgcaactcctcctcctgcgacgcgctgcgggtggccaccgggatgtccggcggccaggcgtgcgaccagccggcggcctgcagctacgcgctcagctaccgcgacgggtcctactcccgcggcgtgctggcgcacgacaggctgagcct

SEQ ID NO: 26797 - DNA, 413 bp, Triticum aestivum
  Clone ID: PAT_TA_26797
gcaggccacaagatccactggctatgagtgtttttatagcaggttggtaagcattgggattttgtgggatttcaccgagtcgggaaggaagcttgcgtgggaacctacgaggtcgcgcgggaacgggatcaccgacgattcattggcaccaccatttggccaaaagaacgaccccgcgcgctgcgcaagcttgcactgtaagccatatgcggcagcggggtgacaagacgtgcgagaggaggacgagaggccatgtacacatatggttaataaaaaacgcttgcaatttaattacctactataccaccgtcctggtttaagtatgatttaactaataaaatatgaatgcatgtcgccaaagattatatagtcggatttgtatttgaacatagtttccaattaaataatttttt

SEQ ID NO: 26798 - DNA, 588 bp, Triticum aestivum
  unsure (1)..(588): unsure at all n locations
  Clone ID: PAT_TA_26798
ggacgttgngataagagataaaaaagatatgcaattcttcactctcttacacctaaattaagttcnatattagaaactcaggaacatacttgcgntcaaaacataacatagtactccaggagacttgcaagcctcaagtgggggacgtaaatagacccctactagtacaagccgcagcagaattattattttatttcgttccaacagcatattgtttcctcgactgtttctccgctcgaaagtccagaagggccaccacgcttagtatcttcatgcttaggattgctcaacttcatgcttaggatcttccaggacaataccagcctgacatgcttctccaactttcccacttgaccgttgtgtttttggaccaaaagctccactaaaagctgcttgttctgtccttggatgctttctgagattggaattttccgaactcaaaaccttatttgtgcctgcatttgtcactgccgagataccagcgttttcagcatggcttgtcaagttcactgcctgtgagactgcagcaacagcagcaccatatattttggcaggaactgtcaatgtacctcggccgcgaccacgcta

SEQ ID NO: 26799 - DNA, 388 bp, Triticum aestivum
  Clone ID: PAT_TA_26799
ctcccacctttccgataccgtcggcggattggccgtcgatgtaaaattgttcttcttgaatcgtgaggttagctagcggccgtaggaataggatcgtcgcgccatctccggcggcgcgtaggatgctcatccaagattgggactgaggcggcggcggctaaatgtaccgcaagaacgcgtcggcactcacctgcttctacctgtacctcctctggttcttcttcctgaaaaagtagcagagcaagcgatcgatcgagccggcgactcgtgattgagattgtttgggtttgatacatatataggtgtgttctcgttgattgattggaagttccgaagtggtgatctcggcgatggagctggatctgaacgtggaggagaagccggcggc

SEQ ID NO: 26800 - DNA, 652 bp, Triticum aestivum
  Clone ID: PAT_TA_26800
gcggaggacggaggcagaggccgccgtctctgccggtcgacgacggagaaacggccgcaaccgaggaggacggccatggaggggagagtgctgcctcgatccggatgaggggagtagcagctgcgacctcgatgcggatgaggagagcagcacacgatgccgggggaggcggcggtgcttccttgcctcatctgttctccttatctgaggtccgtccgcccgcccgcgcccacccgacgtcgtcatggaggctccgaccccgaggcaccctccctgcttccttctggttgcatctccccctgattctattttatccatgcctacacgatgcacaacagaactcctagcaggcttgcaatctcacgcgtaagggaagatgtgttcctctctggctagcacctgctcgatcaaatgcctagccatttcaaccgtttattgtaggaaatataaggtgcacccaaataggaggccattctgtgcagcctattcttttcagttctaggaatcctatggtagagggtggtgttagttctataaataactttcagacatttgtagttttttaggttgtagcgtgacaactttgatcaaaatttgtttcagttgactctacattccattcgttgattttgtgttcttgtcgacgcggccg

SEQ ID NO: 26801 - DNA, 532 bp, Triticum aestivum
  Clone ID: PAT_TA_26801
atctatcagatttttttttaatcttgcaccgaaaacataatgtgtcctgagaaacgtaactgtgtacagtacggaccgattgagcattgctaatactacaagcgatttcttgtggaaacattattacatcaaagctcaaacagaagaagagtgataatgcgtactactatcagtacatcctactaatacacaaacatatatcttcagattcggtgaacttcgtagtttggacagcttactgccatgcccggtccaagtgtgcgcttacctaggttgtcttcgcttgcaagacatgcacggtaccagcagagcaagcacgaaatccgacaatgaactgcaccggtggagagggaggagggactctcccgacacaactgttgcttctagtacagtcgccccagtttgcatctgatgaagggatgctgcacgcttggccaacgtttgagccttgagaggatggatgccgtcagcagttcgcgggtgcgtgcccgcagacccaagagcgacggttggtttgccagagttccgttca

SEQ ID NO: 26802 - DNA, 1012 bp, Triticum aestivum
  unsure (1)..(1012): unsure at all n locations
  Clone ID: PAT_TA_26802
gggttcaactcgctccccgccgcctacagctcacccacgcccgccaccctcctccggagaagcgtgattttggggcattagaggcaattgagatggtgcccgatggcagcgtcaaggaccaggaggcctcgagctcctcgtctccacccgccgcggcgagtgcgagggcggcgcggcctgactcgccagtcttctttaagacgaaaccaatattcatagagaggctgggtcaactgcatcaacagcaatttttgttagcaaccacctctatgtggcaaatgttggcgattcacgggctgtaatatcgaaggcgggcaaagctattgtgctctctgatgatcacaaaccagacagaagtgacgagcgggaacggattgaaaatgctggaggagttgttacatttagtggaacatggagggtaggtggtgtacttgccatgtctcgggcatttggagatcgtttgttgaagccgtttgttgttgcagagcctgagattcaggaacaagaaatagatgatgaattggagtatctgattttggctagtgatggcctgtgggacgtggtgtcaaatgagcacgccgttgcatttgtgaaggaggaggtgggctctgaagctgcggcccgaaagctgacacagatcgctttcacgcgtgggagcaccgacaatataacatgcatagttgtagagtttcaccgtgccaaataagtgaccaaggttgatcttcttatttctttttagcttattactagcacatatgcccgtgcgttgcaacgggatgtgaatcaaggctcggggacatatgatcctattcttccttagatagcatgtcaaactgcctttaggatcctacgcacatcagatagcattgttggtncttcatttacaattaancaggggtggcaaggttgaagccccccggatgtacatgggatcacctgccatgatgcaggtcgaactatggcctcttcatcggttgtctataatattccttcatttgttgtgcttggggtc

SEQ ID NO: 26803 - DNA, 808 bp, Triticum aestivum
  Clone ID: PAT_TA_26803
gccggccgggctgggaagtctgcaaccctggtaagttagggttccaaattctgtagcagcatccagattccggcgaaattaatcttctgttgaggcggcgcggctcagatccatctatggctggtgaagagggtacgatgatcttgtccgccatccattcccctgcgcgtaagttcggcatcaccaaaaggaaggtggaggagacggcggtggctggcgacaaggggtgcgccaccaaaaggaaggcggtcggtggcgtcggcggcggcaaggtggcacccaaggaggcggaggtccagcctttcggtggatctgaggtactgcagaccctgatcctttgccccgacatcagccagcgtgaggaactcgagatcctgatcccctacaacaatgatgaatccaagacctttggccacgacagcagcgcacctgatgattctgacaccgacggcagcgaacctgaggatctccgagaatatgtcgcggaatattgggagaacatgatggccgaattaggctttgaggagtccgatttctctgactaccaaggggtggcggagtatgcttgaattcgatgaggatttgcttgcttggccaacatctgttatctacatatctatctaggactacttattatctgtatgatcaatcaatacatgtcaacatctaagaccaaggtttgatgcctgatgttgtaatgttgttatccatgttgccttatgtgtgacaatttgtctgagcactctttgtgcaatcgtgctgaaataaccaattgtcctgtgaattttgctcaaaaaaaaagccccta

SEQ ID NO: 26804 - DNA, 917 bp, Triticum aestivum
  unsure (1)..(917): unsure at all n locations
  Clone ID: PAT_TA_26804
gggtcgnacccacgccgtccgggnaagtttaatcagctcgtgtacaattaccctatccgcatcccagaaagatttctttggtcattcgctctttgttgacgcaagaaggaatttgctttactctcaagcctgaatttaagttccttgaggttgcatatccgtatatagcaaaccgtcttttgacagatccaaatcctgctctccgtgaacggctgatacaggtgttattcaaagatggattgttccagtggaaacgactagaaaaccttatagttcttgccaaggaaaatgtgtcaaagatgagtaccaatcctgcactgaagagcaatagcctgcaaactgtgtcgagtcaaaaactggagaagaaactggatctcactgacacaataaaagatggagcacggctgttccttatcgattctgggatcaggagacaacttgtaatggctttcactgaggactccaggttgcacgtagacgagcttgttgatgtatacaaactggtggaagatcagatagatataccttcagttgctcttgaggttctccaagatttgccatcggtcgcacgcgatttcatgctttcgtggagtgattctgttctgtcagatcgccaaaactaacccagccaaaacgctggacagcaagcggagacctgctagttaggaacagcaagcaacttacctcgagttaatctgcaaatagagatatagatagatagacaagattcttcccctattctttggtggggcactcctgtatagcaagatttgctcgtgctcgacctgcacatgccacttgtatagtggaacacggacttgtatataactggagtttgtaatagtaattctggaacaaaaacagcatatagatatagtagtagttttgtttttgtaaaaaaaaaaaaaaaaaaaaaa

SEQ ID NO: 26805 - DNA, 841 bp, Triticum aestivum
  unsure (1)..(841): unsure at all n locations
  Clone ID: PAT_TA_26805
tnnnagcggccgcccgggcaggtcgatctgattccaacaactccaggctttgtgcatctgcatatgaaacacttaatgagattgcgagatgcagcagcattgcagacactctgaacatgattgtgttattattgcaagagatcttgaagagattaaaccagacctttgagtttcagatcacatcctctgaggacaaggaaaagcaaagtgatcttcaagccttgctgtgtggtgttgttcaagtaatccttcagaagttcagcaactgtgatgataagtcagtaatcattcagtttgctgaccaaataatggtgttatttctccgggttttttcatgcgatagttctaatgtgcatgaagaagcaatgcttgctattggtgctcttgcttatgctactggaccggaatttgtgaaatacatgccagagtttcacaagtaccttgaaatgggcttacaaaattttggtgcatatcaagtatgctgtgtttctgttggggtggttgcggacatctgtcgtgccctggatgacaaggtactcccttactgtgatgctatcatgtccgcccttctcaaggacctttcaagcccagagcttcaccgttctgtgaaaccgccaattttgtcatgcataggagatattgcacttacaattggtgagaattttgagaaatatgttccatacactgtgcctatgttgcaaggagctgcagagctttgttctcgcatggaccttcctgatgatgacagtacagagtataaaaatgaactcaggcgaagcatcttcgaggcctattcaggtatacttcagggagtcaaaaattcaaaatcagagctaatggt

SEQ ID NO: 26806 - DNA, 511 bp, Triticum aestivum
  Clone ID: PAT_TA_26806
atgcagcacagcaagcatcgcaatacccatcttaccatgctgtaccaggagcagccatgggagatatgagcttcaaggagtctattcaggcatatgcggctgaccaaggtttgttgtttatgcctagagttaacaaattctataacggcatgccagtgtacgaatttggcactgtgagcatttgcatagactctgtcaagcgactactctatgcgcaacttcaagagggaaccgaaagatggagttctgtgtctcttacacaactgctggaaatgaaccggatggcaagaccacgttaggagatcatctatagcttggaagtttcatgtgatcatttttcctgccagtgtaggtagtcttcaaatgtgtcttgcgagcattgttgtagaattacttgataaagaacaaagtttctgatgatgtatctgaatgtgattttccacatttcaacatggaactcggttgttattgccctagaatgaataattgatgcagaactgtttctacctgt

SEQ ID NO: 26807 - DNA, 1240 bp, Triticum aestivum
  unsure (1)..(1240): unsure at all n locations
  Clone ID: PAT_TA_26807
gaatgcggcgcgagtggcgctccagggcatgggaagttgtgggccacttgagagctacggacaggtggaaagaggatgcatcacggcaacgcatcgcaatacccagcttatcattcagtgccaggagcagtcatgggagatatgagcttcacggggtctattcaggcggttgcgtccgcccaaggtttgctgtttatgcctagagtttataaatccgataatggcaagccagtgtatgaatttggcaccgtcagtttcttcatagactctgccaagcgacgactctatgcgcaacttgaagcgggctcaggtaggtcgagttctgtgtctctcacacaactgctggaaatgaaccggatggcaagatcacactagcaaatcatctgaggcagaagcttacgctttgctatctccatggaagggtgtatttgatccagcaagttgggaagacttgatagtgcgttatatcattcctaaacttaaaatggcactccaggagtttcagatcaacccagcaaaccagaagttcgaccagtttaactcggttatgatttgggcttctgctgtaccggtatcccatatggtccatatgttggaagttgatttctttagcaagtggcagcaggttctgtaccattggttgtgttcagagattcccgatttcaatgagatcacaaactggtacaagagctggaggggtcttttcccaccagagttactcgccaataaacgcatacggatgcttctaacggctggtcttgagatgatgaaccaagctgctgaaggggttgacttggtgcagccaggggcaagtgagaatgtgggctacttgagagcaacagagaagtggcaatttgatgcagcacagcaagcatcgcaatacccagcttatcattcagtgccaggtgcaaccatgggagatatgagcttcaaggagtctattcaggcatatgcggctgaccaaggtttgctgtttatgcctagagttaataaatcctataatggcaagccagtgtatgaatttggcaccgtgagtatcttcatagactctgtcaagcgactactctatgcgcaacttcaagagggaaccgatagatggagttctgtgtctcttacacaactgctggaaatgaaccggatggcaagatcacctagcaatcttctaagctgaaattccattccattctattgcccgccagtgaaactccaaattggcttggaaacatgggtananannggc

SEQ ID NO: 26808 - DNA, 716 bp, Triticum aestivum
  Clone ID: PAT_TA_26808
gggccagggcgccgcggccctcggtcccgccgcctcacagggcgccccaacaacgaccaccatggccctcagggttgctccgtcaccgctcctcgccttcggcggcggcgccaccgccttcgccaccccgcttgcagcatcgaagagaggcgccggcctgccccccgcacgcccccgctcccgcccaagaagagaggcgccggcctgctcctcctaagcaagcgctccaggatctccgcccagctcggtggtggaggtggtggtgatggagagaccaagcctgacggcaagaagttcatcaccagagaacaggaaccagagcagtactggcagactgccggggaagaggaagggggagaaccccatgatgacgccgctgccctacattgtcatcttcggcttctccacccccttcatcatcctcgccatcgccttcggccaatcggatggaatcaaggcgcccctcatccgctgagctctcaatcgggctctcgtccttccccttccgggcgagagagatgatgacttgcttcccttcctatagagattactgtaaagctgtatgtaattcatttcttcgaagatctttatatagtggagtcaccagctgctctacattaaaaaaatcacatagtgctgcatatagagtgaaaagccctggagggggtaagcttgtgaacactttccacagttcaagatcgatcaaaaaaaaaaaa

SEQ ID NO: 26809 - DNA, 637 bp, Triticum aestivum
  Clone ID: PAT_TA_26809
acttaattgcccgaccttcagcttttggagttggagtcttttcttccatattccaaaattatatttgtgtatatttaatctataaggtccatttatcttttgtagattcgaaagaagcataattgaggtggagctgaattcttcagttggatgaaacaaatataattggaggattttacctagcaatacccatactttacattgatagattgaaaaatgtaataccatttagaacatttttttctttggtcgagttgatgcaaatgctatggtgtaatattctccatagacgtgttctctattgtaaaattgatatgaatgatatgttgttcaaccaataacattggtatttatttattgtaatgcatatgtatcctacactcatgtatattcatcttaaagccacagtaatcatggctaccggtttccagattcgaaagaagcataattgaggtggagctgaattcttcggttggatgaaacaaatataattggaggattttacctagcaatacccatactttacattgatagattgaaaaatgtaataccatttagaacatttttttctttggtcgagttgatgcaaatgctatggtgtaatattgtccatagacgtgtcctctattgtaaaatt

SEQ ID NO: 26810 - DNA, 1468 bp, Triticum aestivum
  Clone ID: PAT_TA_26810
cgagttcccaaccacatgggaacctaattcatctcatatgagaccccaaacctccgataacaacactggtgatgatgatctgggtgcaaatggtggtgctgacaactccagtgggaataccagtgacaacaacgttagtgccggtggtggcgacactagttccaacattcgtgaaactgagacctagaatcatagatggtggttgtaaccttggtagtgccttttgttgacttggagccagactttagaactaatgttggtgttggcaacaaagcagcattttgctagttgcaagactttagaactaaaggtggtgtttgcaacaaggtagcattttggtagttgcaagactttagatgaactgtgatgtactttccttgtaattctttgggtatgcaaaactgatggttatccttgtaagctgagaactgttatgtagattgtttctgatgaaaaaaaaaaaaaaaggcggccgtcgcgatttagcgacgacagccagccacgaagctagctcgtcatggccatgtccatcctcggcgctctcaagctcgccccgtccccgccggcgacgacggcgcagccggcgtgtcgcgccccctcctcgctgcacttccacctcgccaacgccggcgccgtcgcgctggtcgccgcctcgctgctcgtcgccgacccggccctcgccttcaggggaggcgggccgtacgggcagcaggtgacgcgggggcaggacctcaccgggaaggacttcagcggccagacgctcatcaagcaggacttcaagacctctatcctgcggcagaccaacttcaaaggcgcgaacctgctcggcgccagcttctttgatgcggacctgacaggcgctgatctctccaacgccgaccttagaaacgccgatttctcgctggcaaatgtaacaaaggtaaatttaacaaatgccaacttggaaggggcacttgtgacagggaacacttctttcaaaggttccaacatatacggggcagattttaccgatgttccactacgagacgaccaacgggactacctctgcaaaattgctgatggggtaaatacaactaccgggaacgctacgaaggagactctcttctgcaaataatgaacataaatgaaggagaatggggagactagagaattcagaggttgatttagttctcgaatagtactaccatgtttctctctttatttttcttatatcttccagggtggagagagttccgtgaacacacaaagaatatatgtatcgggtgaatagttgctgggaaatcaagtgcttagtcggatggtgttagcctggcaggcatatttagtccagggttagttttgccgaagtgtacgtaacaaagttaaagctgttaggtgtgacaaaaaaaaacactcaaatatatattcctttgataataatattgatacatggaaattccattcatctaaaaaaaaaaaaaaaaaaaaa

SEQ ID NO: 26811 - DNA, 1494 bp, Triticum aestivum
  unsure (1)..(1494): unsure at all n locations
  Clone ID: PAT_TA_26811
caagtcccccccgagcgggactcgccacgggggagcagcctagcgtttgcgattttgcagccgccggccccggagccccctgaccgacacggtcgccgccgccgccatgtctgccttcgtcgggaaatacgcagatgagctgatcaagacggccaagtacatcgcgacgccggggaagggcatcctggcggcggacgagtcgacgggcaccatcgggaagcggctggcaagcatcaacgtggagaacgtggagcccaaccggcaaggcgctgcgggagatgctcttcacggcgcccggcgcgctcgagtaacctctccggcgtcatcctcttcgagggagacgctcgtagccagacggcctgcccgacggccacaccccgttcgtcggacatccggtcaaggccggacaacgtcatcccgggcatcaaggtcgacaagggcaccgtcgacatcgccgggcaccgtcggcgagaccaccacccagggcctcgactccctgggcgcgcgctgcgccaagtactacgaggccggcgcgcgcttcgccaagtggcgcgccgtgctcaagatcgggcccggcgccggagccggtcggagcgcgccgtgaaggcaggaacgccgaggggctggcagcggtacccgctcatctgccaggagaacgggctggtccccatcgtggagcccgagatcctcaccgacggcccccacgacatcaaggcctgcgccgccgccaccgagcgcgtcctcgccgccctcctcaagtcgctcaacgaccccacggtgctcgtcagccccaaggtcctcacggccatcatggtcgcccccgccgtgcgggcgccccggcgctcggtcccggcggcggtgccaggggtcgtgtgcctcgtcgggccggccgggcgcggcgccggcgccgcggaacgtgggactccctgacgggcatagccagtgcccaagcccgcggaacctgacctccttgaacaagctggggctgctcaagccatggacgctcacattctccttcggccgggcgttgcagcagagcaccatcaagacgtgggccggcaagaacgagaccgtccccgacgcgcaggccacattccccgcccggcgcaagggcaagtccgagcccacgctcggcaagtacggcggcgccgccgccggcggggacgcccgccgcgtcctgagagcttacacgtcgcggggtaccaagtactaaaggcaccgtcgctcccgcgccattcccggacctaggacctcggtgcaacccgtgtgtgcgtgcgcacggcgcggcacatggattgcgccaagattcgtgcgtgcatgcagatatatatgctcttccttttctgccgtgtacttaaattctctctcccttccccttctcctatttaaccagaactactgatgatatataagtggtatatatgaaagtgtgaatgcaacgcttttagtataggtaagaccctgatcctgggggggccccccccaattcgcctn

SEQ ID NO: 26812 - DNA, 437 bp, Triticum aestivum
  unsure (1)..(437): unsure at all n locations
  Clone ID: PAT_TA_26812
tgctccaggacgcccagcggcagttacaggacactctcgccacactgccgccgacggggnaagnaaggccaggnagggnaccatggcagcagtgcagacggcttgcaggaggctagctagcgattgctcgatctcgattgggggataggcaggttgaaagctgtttattttcttatctggtggtagtgaagggaggcaaatagattgttcctagtcttcatcctctgctcgggatgtatgtatttagttctcgtcgtgaacgattctgaccattgttgcttacttcggtacgcatggcaaaccatgcttcttaccagaccagttgcattctgtctctactttggttggtctttgcagtgattgatgtcttggacaattgccataacttaattgtatgcccgtcacctgatatgagtgaaaaaatgtgaaaaaaaaaa

SEQ ID NO: 26813 - DNA, 597 bp, Triticum aestivum
  Clone ID: PAT_TA_26813
gtggaaaagccaagttagtgcatgttcaagttctccacttgcattaataagtgggtggcagttcaaggttttaatttctatcacactttgtgacacttccttcggatttcctttgatgaattaccttttcactctgaggtgtgactggtcactcactgtcaggaccgacaaagtgcatactgaagatgacgaggggatgggctagaccaatgtgttttagacgtcagaatcagaatcgtgtgggagttgtacatgtgcttgcgcgtgtgtgtgagaccaatgtgttttggacgtcagaatcataatcgtgtgggagttgtacatgtgcttgcttgcgtgcgtgcgttgcgggtgtgtgtgtatgtttagagtgtagattcactcattttgctccgcccgtagcccatattgaaatctctaaaaaagagttgtgtttaggaacggagagagtaattttcaatcccacccgccctttctcagaactctcctgttcttccctatatacttccaaatttcttgtcatcctcgtgtgttctgatcctccctaaacatgagttagctcaacagttggtataattaaaagctttattttggtaa

SEQ ID NO: 26814 - DNA, 651 bp, Triticum aestivum
  unsure (1)..(651): unsure at all n locations
  Clone ID: PAT_TA_26814
gattcatgaaattcggcctgcacaccttgaatcagttctttgatagttgtgggtgctctacagtcggtcaaagactcaagggatctgaaatatccaagatcaagtgcgtttagatcaggagaatttggaggctggtttattattttaatgtccagaccagttgtagccacagcttctgcaaactctgcatcacctggaagaatgtgcgttcttgcgttatcttgctggatcaatattggattagtatcatctgcgggccagacttcctttattccaggaaccactttttctatcatatacctcctcattacccgtcggttcacgttgacggacttgatttcaatggtccctcttgctctatactcacttcttctagcagcaggaatctcttgcacaaagggccagacaccaaattttacctgagaatgtcatattgccttcagcgtcatatctaggtcgagcaacagcggtcagaaacatcactttctccaatacaggtttttgttccccacagttcttgaccgggtcatcttcctcgggggaggaggtagtatgcatctggtcatttttggcatantacaaccccttttccgcaatatgcccaatgttgtggcnatactggagaatcttggcctcggtgnctgctaaggn

SEQ ID NO: 26815 - DNA, 671 bp, Triticum aestivum
  Clone ID: PAT_TA_26815
agagccgacactttttccctgtcatttcggcgaagcacggcaagttcatggtcctttcgctgggcacgggcaccgccaaggtcgaagagaagttcgacgctgccaagtgtagcaagtggggccttctcgggtggctctacaaagggggcaccacgccgatcatcgacagcttcagccaagccagcgccgatctcgttgatatccaggcatccgtgctcttccaggcgctacactgcgactacgacaggcgctacctccggatccaggacgatgagctcacgggcgaaacggcctccgtcgacgtgtccacgatggagaacctcaaaaggctcatcgatgtcggcaaggcgttgctgaagaggcaagtgtgcaaggtgaacatcgagacaggcaagaatgagcccgacctagagaggggcactaacgaggaggaactgacccatttcgcccgcgtgttgtcggaagagcgcaaagccagatcgacttgcggaggtggttttgaaacttagatatgactctatgaatattcacccctgttcgaatttgatgacctacgccatcaagtgctaatgcttatatgttatatgtgtagatattgttcttgtgtatacaaacaatgatatcgtcgatatttgttgtacacgctttaaataaagatgttgaatctcgtc

SEQ ID NO: 26816 - DNA, 694 bp, Triticum aestivum
  Clone ID: PAT_TA_26816
tggtccaagaagaagttgaaaagaagaccgcaaaaggttcatcaagctgtacaaatggacttttatggctcacgagggcaatggacttccttgttgaactgttccgtaatctgcttgaccatccagactggactatgagtcaagcatgtattgattcatacccaaaaactttgaagaaatggcatggctggctcgccagctccagttttacggtggctatgaagcttgctcctaacaaagagaaatttatggaggtaattagtggaacgggtgacatcaaagcagacattgagaaattttgcaccaccttttatccctttcttaaggagaatcatgacttcctggccagtgttggactcgatgacatgaaggcttcttaatgcaatacacatcgataatcatcacagaatatcaagtcttgctattttctcaaattttattgtggcatactgatcttcagaaaattatagacgaataataagtctgtcaaaatgtgtgggtgttcatgacccatagctacttacatacagaatgaaatgaatggatgcatggtatcaaaattaacttgtgaagtcacttggttgtcagccaagtcaaccattttacctgttgatgtaactgaggagaatgcagaggatgcagatatgtggtggtcttgtcattacgctaaaaaaaaaaaaaaaaaaggccccta

SEQ ID NO: 26817 - DNA, 1286 bp, Triticum aestivum
  Clone ID: PAT_TA_26817
gccggcccgtgcggactccgacacttcttcctcccccacatcgcacttcctcccctgctagattcctccctccaccgaccggcaaggcctctctcctgcacttccctcgcccaaggttgcaccagagaaggcggaaaacatcacagtttgcgaaatcgtggagcggtagagagagatggccgagacggtgttcgctccgtgtttggaagggatgaagcatgtcaggtcggacagcggggtcatgctcgccaagcccttccttgatgtctgcaagcaaatcttgcctgtcctgggataaatttggtgctgctatggcaattgtgaagagtgatattggaggtaatatcacgaggttggagaacaagtattcttcagacccgacaaaatatgagcacttgtacaccatggtccaaggaagaagttgaaaagaagaccgcaaagggttcatcaagactgcacaaatggacttctatggctcacgagggctattggacttccttgttgaactgttccgtaatctacttgaccatccaggactggactatgagtcaagcatgtactgattcatacacaaaaactctgaagaaatggcatgggtggctcgccagttccagttttacggtggctatgaagcttgctcctaacaaagataaatttatggaggaaatcagcggcacgggtgacatcaaagcagacattagagaaattctgccaccaccttttatccctttctcaaggaaaatcatgacttcctggccagtgatgggctcgatgatgtgattccttctcaattcaatacacaccgacaatcatgaaacatatgtagtgctccaatgttcgccaactgttattgtggccagggttacactgttttgcatactgatactaaagaaaattatagacgaataataagtcaaaatgtttgggtgttcatgttccatagcgactattatagaaaatgaattgcgagtatgaatgggatcaaaattgacttttgagagtcaccttgtcaaccaagccggccattttaccaattgaagtaactgaagagcatggagaggatgcagctatgtggtggatcttgatcgttcagtttactaaactgctgtgtaagggattctgtttactaaactgctgtataagtgatgaggcgaaggatgcaaattaagagtactgttggtgatgcgggatgactgagggacagtggaggaaatggagaaggcgaagaggggggggcccggcccggaacccgatcccccctatagtgagtccgtattacgccgcgc

SEQ ID NO: 26818 - DNA, 796 bp, Triticum aestivum
  unsure (1)..(796): unsure at all n locations
  Clone ID: PAT_TA_26818
tgatgtcagcagaggatatggcgttcctgatttnccggagcttgtttacttctttctccaactgcttcttgatgactccctttgagtgagctgtaactttatctgtcttgttgcagaatatcagaacaggaatccttttcttcactacagttgccttcgtcaaaatgtcatacatatactctgcagcagcttgcatgctagacaagaaatctagagcatccacgacaaaaacaatcccagctgcctgaggcaggacttcatcaagcttcgatttcagccttgcatgaccaggaacatcgataacatgaacaggttttactttgcctttcctttccagctccgagtgcagcacaaatgtagcattgttatgtgtcatcgaagtcacagttccctgatgtgatgatccatcgcgaagctgatagaaaagaacagttttgccgctgccactaagcccggatagaactatggtgttaggtttcgatgatttcagacaagaagctgcgaccagcaccagaatcgttaccgcaatcacggcgaccgcgacgtaaatctgctccgggggttgctggcggatccagtgctctgcttggcctgcccacgcctccgcttggcgaacccactcgtccatcgtcgcgcaagcacggagagggaaggagagggcgaggtgggggtggagggagcagctgtgtggcgccgggagatctcgggggaggggaggggaggtttctagaaggaaggtaggagaagcgagaggaggacgacgaggcgagggttttcgcaccccgaaccggccggc

SEQ ID NO: 26819 - DNA, 982 bp, Triticum aestivum
  Clone ID: PAT_TA_26819
cacacctccttctcgcggtagcgagtcagtgacgcacgctctccgtgccacaccacgaccgcaccgttctacccgcttagctacccaagagaccggcgtccggcaatggagtcgcgggtgaagcccgggttcagcggcgcgggcagcctgtccggcagccggaggagctacatgggggcggcggcgccggcgcccagcaagccggcggtggacgggtgcggcgtggcgctgcgcgtgttcatccttggcggcgacgctggtcgccgccgtggtgatgggcctggaccggcagacggccaccgtgcaggtcaccatcgccgacacgctgccgccgctgcaggtccccgtcacggccaagtggtcctactcctccgccttcgtgtacttcgtggtggcgaacgcgatggcgtgcgtcttctcggcggtggcgctggcggcgtgccgcagccggagcgcggtggtgccgctgatggtcggcgacctggtggtgcaggcgctcctgttctcggcggtgggcgcggcggcggagttcggcatcctgggcgagcgcggcaactccccacgtgcgctggggcaaggtgtgccacgtctacagcagcttctgcgagcgcgccatggccgccgtcatcgtctccctcatcgccgccttcgccaacctcgtccacctcatgttcgccatcctagacgtccacaaaaactccacctactactagtaacttagctcagctgctgctgatccatcatgaacgcatcggagatgtccgatcgatatgcatgcagatggtatacctgatttccgtgtgaactaacggtctcggtcttaggcgcgttggtttgatttaatggcgggagttgtcgtgcccatccattttggcactgtaatgttagctattgatacaaatgtatggaggattttactctgaagtatgaactaatatctactcctatgtatgggtcatctttggagctaaaaaaaaaaaaa

SEQ ID NO: 26820 - DNA, 1294 bp, Triticum aestivum
  Clone ID: PAT_TA_26820
cccacgcgtccggcggccaacctcctctcccgctccctcgtcccctcgctgacccccaaccccggcagccaaccaagccggagccgcgccgcatccgtctcgctgcgccgccgtcacgggcccgcggcccccctccgcgcctccctctccacggcctccccgtccacgcgcgtggccatgggggaggcgcccaagcactgcttccagcgcggcgccgacggccacctctactgcgagggggtgcgggtggaggacgcgatggcggcggcagaccggaccccgttctatctctacagcaagccgcaggtcgtccggaacttcaccgcctacgacaaggcgctccaggggctccgctcaatcgtggggtacgcggtgaaggctaacaacaacctcagcgtgctgcagctcctgcgggggctcgggtgcggcgccgtcctcgtcagcggcaacgagctccgcctcgcgctacgggcaggatttgaccccaccaggtgcatatttaatggaaatggaaagacattggaagatcttattttagccgcagagagtggagtatttgtaaatatagacagtgaatttgatttggagaatattgtcgctgctgcaagagttgcaggaaggcaagtgcctgttttgctcagaattaatccagatgtggatccacaggttcatccctacgttgccactggaaacaaaacatccaaatttgggattcgcactgaaaatttgcacttccccttagactctattaagtcatattcaaatgaggtgtcacccacgttggcggcgacatgttccaaaagattccctcgggggacaccatcctcatgaagtggatcctgcacgactggagcgatgagcactgtgcaacactgcttaagaactgctatgacgcgctgccggcgcatggcaaggtggtgctcgtggagtgcatcctgccggtgaacccggaagccacgcctgaggcgcaaggggggttccatctcgacatgatcatgctagcgcacaacccaggtggcagggaaaggtacgagagggagttcgaagccctggccaagggtgccgggttcggagccatcaagaccacttacatctacgccaacatatgggtcatcgagttcactaagtagatgcatgacaaagtccaccgatatcttgctcattgccgctcctaaatatgcactatcttctctttttccttgtgtcttcgttaacttttttatgttctaaatcattccaaatactattgtttgtatccttgatttgttcaaaatgtactattatgaagcttctt

SEQ ID NO: 26821 - DNA, 399 bp, Triticum aestivum
  Clone ID: PAT_TA_26821
cccacgcgtccggggaaggaaagggggagaaggagacaccgcgccgggcggaggcaatggcgacggcgacggcgacgacggcgtgcctgctggcggtctggtcgctggtcgccgccggtctgttcggcacgggcctcgcccggtcgtccgtggccccggccgccgtcgggaaggagcagcgcgagttcgactacttcgcgctggcgctgcagtggccgggcaccatctgctcctccacccgccactgctgcgccgtcaacggctgctgccggtcggaggcactccacacgttcacgatccacgggctgtggccggactacgatgacgggacctggccgtcgtgctgccgccacaccagctttgacatggacaagctaacgcccctgaagcccgctctgg

SEQ ID NO: 26822 - DNA, 549 bp, Triticum aestivum
  unsure (1)..(549): unsure at all n locations
  Clone ID: PAT_TA_26822
gccggccggtccgggctcatgaagtggatcctccacgactggagcgacgagcactgcgcgacgctgctcaagaactgctacgacgcgctgccggcgcacggcaaggtggtgctcgtggagtgcatcctgccggtgaacccggaggccacgcccaaggcgcagggggtattccacgtcgacatgatcatgctcgcgcacaaccccggcggcagggagaggtacgagagggagttcgaggccctggccaagggcgccggcttcaaagccatcaagaccacctacatctacgccaacgcatttgccatcgagttcaccaagtagatccatgccaaccgtccaccgctcgctttgagaccatcttcttcttcctcgctggcgctgctgaatatgtactttggcttgctgtttcctctgttttcctaattttgtcatcctagctctgaatcattccgaaaaaaaaaaaaaaaaaaggcgcctaacccattcgaaatgtactgtactattaatagtgctgctcttaaaggttgcatgtgatgcaatgacctgnna

SEQ ID NO: 26823 - DNA, 587 bp, Triticum aestivum
  Clone ID: PAT_TA_26823
cccacgcgtccgctcagtcgctgcctcgcaccaaaacacaactaccaccagcggcagcagttcgactccggagaggcagagatgggctccaccgcaaccgacatggccgcctccgccgacgaggaggcgtgcatgtacgctctccagctcgtctcgtcgtcgatcctcccgatgacgctcaagaacgccatcgagctgggcctcctggagaccctggtggccgccggcggcaagctgctgacccccgccgaggtggccgccaagctcccgtccacggcgaaccccgccgcggcggacatggtggaccgcatgctccggctgctggcctcgtacaacgtggtgtcgtgcacgatggaggagggcaaggatgggcgcctgtcccggcggtacggcgccgcgcccgtgtgcaagttcctcacccccaacgaggacggcgtctccatggcagcgctcgctcatgcggcgctcgcgctcatgaaccaggacaagggtctgatggagagctgggactacctgaaggacgctgggcttgacgggggggtggtcgtcaacaaggggggcgggatgggggggttggagcgccacgg

SEQ ID NO: 26824 - DNA, 570 bp, Triticum aestivum
  unsure (1)..(570): unsure at all n locations
  Clone ID: PAT_TA_26824
gagtgatgtcattgataccatcaagcatgctttngcgggctcnccgcagatcatatgcaagaagggctcagttnaaganctaagattatgcttcaccaaggatttgaagcctcgcgattgccttactacttcggcaatgtacaagaacctatcgaaatcaaagcaggccctcgaaaaatctccctgccaacatatgatcccatcgtactcacaaattcgacactggagattgtcccagaagccagcgacaacgggttgtacttctatacatcctaagatgccgaatattgctaggctatgaggaaacagatgccttcacggttctgactgcttgcaagaccgtagccacaggtgctgggcactgagatcctgctaaaacgggtctctgatttgtccacactatttgtaaaggacaacattccacattagggcaacttggttcgattatgttctggatatttgtaaaactgctggatatcaaactcagcttactcatttgtatgaataatggatgttaaatgtacatattagctcattggattgcttaaaaaaaaaaaaaaaaaaggcccc

SEQ ID NO: 26825 - DNA, 1908 bp, Triticum aestivum
  unsure (1)..(1908): unsure at all n locations
  Clone ID: PAT_TA_26825
cgcagctcggctccggagaggcagaagctagcagagatgggctccatcgccgccggcgccgatgaggatgcgtgcatgtacgctctccagctcgtctcgtcgtccatcctnccgatgacgctgaagaacgccatcgagctgggactcctcgagactctgatgtctgccggcggcaaggtcttgagctcccgcgggtggctggcaagctcccgtncgcagcgaatcncggagcgccggacatggtggaccgtatgctccgtctgctggcctcgtacaacgtggtgtcgtgcaggacggaggagggcaaggacggccgtctctccaggcggtatggtgctgcggcccgggtgcaagtacctcacccccacgaggcggcgtctcgatgtcagcgctcgcgctcatgaaccaggacagggtcctcatggagaggctggtactatctcaagggatgcggtctcgacggtggcatcccattcaacaaggcatacgggatgtcggcgttcggccgggccgggagtaacgtcagtcgcccgctcacaccaaaaacaaccaccagcagtagctcggctccggagaggcagagtcagaggcaaacatgggctccaccgcagccgacatggccgcctccgccgacgaggaggcgtgcatgtatgctctccagctcgtctcgtcgtcgatcctcccgatgacgctcaagaacgccatcgagctgggtctcctggagaccctggtggccgccggcggcaagctgctgacgcccgccgaggtggcagccaagctcccgtccacggcgaatcccgccgcggcggacatggtggaccgcatgctccggctgctggcctcgtacaacgtggtgtcgtgcacgatggaggagggcaaggacggccgcctgtcccggcggtacggcgccgcgcccgtgtgcaagttcctcacccccaacgaggacggcgtctccatggcggcgctcgcgctcatgaaccaggacaaggtcctcatggagagctggtactacctcaaggatgcggtccttgacggcggcatcccgttcaacaaggcgtacgggatgtcggcgttcgagtaccacggcacggacccgcgcttcaaccgcgtcttcaacgaggggatgaagaaccattccatcatcatcaccaagaagctcctcgagtcctacaagggcttcgagggcctcagcaccctcgtcgacgtgggcggtggcgtcggcgccaccgtggccgccatcaccgctcactaccccaccatcaagggcattaactttgaccttccccacgtcatcagtgaggcgccgccgttcccgggtgtcacccacgtcggcggcgacatgttccagaaggtgccctcgggcgacgccatcctcatgaagtggatcctccacgactggagcgacgagcactgcgcgatgctgctcaagaactgctacgacgccttgccagcgcacggcaaggtggtgctcgtggagtgcatcctgccggtgaacccggacgccacgcctaaggcgcagggggtgttccatgtcgacatgatcatgctcgcgcacaacccgggtggcagggagaggtacgagagggagttcgaggccctagccaagggcgccgggttcgccgccatgaagaccacttacatctacgccaatgcatgggccatcgagttcactaagtagatgatgaatgacagcgtccacccatctgatgcatccacttgatgtgtactttctcttggtgtttccttaattttgtcattctctgaatcattctaaattctaatgtttgtgtcgtcgattgattcgaaatgtactaccattaataatgttaattgctcttaatggttgtgtgtattaaaatacaccctttgttgaagaaaaaataataaataattctgggcggccgctct

SEQ ID NO: 26826 - DNA, 1144 bp, Triticum aestivum
  Clone ID: PAT_TA_26826
gcacccccgcgtccgctacgacccacccagcagccagagggagggaaggaaagggggagaaggagacaccgcggcgggcggcgtgcaatggcgacggcgacggcgacgtgcctgctggcggtctgggcgctggtcgccgccggcctgttcggcacgggcctcgcccgggcgtccgtggccccggccgccgtcgggaaggagcagcgcgagttcgactacttcgcgctggcgctgcagtggccgggcaccatctgctcctccacccgccactgctgcgccgtcaacggctgctgccggtcggaggcgctccacaccttcacgatccacgggctgtggccggactacgatgacgggacctggccgtcgtgctgccgccacaccagcttcgacatggacaagttaacgcctctgaagcccactctggacaaatactggccgtccctctactgttcgacctcttccacctgcttcagtggcaggggccccttctgggctcatgagtgggagaagcatggaacatgctcggcccctgttgttcatgaagaattacagtacttcaccaccgcccttgatctctactacaaatataacgttacagaaatgctggcgactggagatatcctggtctccaacggtaaagaatatgcactgagtgatgtcattgataccatcaagcatgcttttgggggctcaccgcagatcatatgcaagaagggctcagttgaagaactaaggttatgcttcaccaaggatttgaagcctcgcgattgccttactacttcggcaatgtacaagaacctatcgaagtcgaaacattggcctaaaaaatactccctgccaacatatgatcccatcgtactcacaccttcgacactggagggtgtcccagaagcctccgacaactggccaaggtcgcttacttcctagccatccgagcaacctacatctacgcggacgcatttgccatcgagttcaccaagtagatccatgccaaccgtccaccgctcgctttgagaccatcttcttcttcctcgctggcgctgctgaatatgtactttggcttgctgtttcctctgttttcctaattttgtcatcctagctctgaatcattctgaatgctactggttgtgccgtcgatctaccc

SEQ ID NO: 26827 - DNA, 1776 bp, Triticum aestivum
  Clone ID: PAT_TA_26827
ccgccccacactcctcccgcccgcacacacccaaaccagcacccatacccagccgccggggcccggaaaggcgggggaagcagcagcgccgggctatgcgcccgaccgcaacccgccctgcggcggccggccggcgtgcacgtcccccgtcccccctcgtccgtcgtccgtccgccggcctaggagcaacaccgccagcggccacggcccccgggcgtcccggggacccgggaggccctgaagccccccgcgccggccgccgcggaggccgccctcccggccaccgcggccccgcccggggcggacgaccgccggcggcacatggtccggcacctcccccgggtctccggcgggggtggaggcccgaagagcggagggcaggccggccgccggcggccgcggcccgtaggcaagccccgccccgcccgcgacgtcgtgccccccacccgaggacggcggctccatggccgcgcccgagcgcatcatgggggccgagagtcgcccaaggaggggctcgtactacctcaaagatccgctccttgagccgcggcacccggctaaacaaggcttacggggacgggcagcgattaccaacaccgcgaccaaggtaggcgtgcagcaaccacgcattgaacgcgcggatgaagaacctcatcatcatgagcaccaagaagctccaccaggactacacgcccaaggcgggccgcgtcttccacgtcgtcatgggccttctcgctcacagcctccccctgcagggcgaccacggtccaccgagccagcgaacctatctacggccgccgccaccaaggccttcaagaccccccccccctccggctacccacgtgccgccgcggcaacctagagaagccgccgccctcggccaccactttcatgatgaagatcttgctccacggctggagcgaggagagctccgtgctccaccggaacgactgctacgacgcgcaggctgctcaagaactggtgacgacgcggtgccgcctcatcggcaaggtcggggagctgtggcgtaggatcctgcgggtgtaccccttggaggccacgcccaaggccccagggctgttgcgacggcgacatgatcatgctacggcgcacaacccccggcggcagggagaggtacgatcgggagttacgagggcctacttcaagcgccccggcttcgccgccctaacgacctcataaatttacgccaacgcattcgtccatctgtcttagccaatgttacatccttgcatgccaatccttcctctgtcttgtgttttagttcttcgtcttctttgctcattctgtccgctgctgcatcaacctgttgcagtatgttacttgggcttggcttctggttctatcttttccgtaattttattgtaatgctaacacttaaagtctttctgaatactatctgatttgtgtcgtcgatctattcgaaatgtactcctgtattaatagtgctgctcttaaaggttgcatgcgatgcaataacaagatttcgctgctttgtttttgggattttacatttgaagagcgcattttgtggaagattcgtgtgggaaaactattcagttgtatgttatgtgggtcatccccatcaagcatggggttttttatttgttagaatagagtccaacaagtttagtgattgtattagagattgaatggacttactggactgttgtcaattcttgtttacgatataaagggtccgacccctcccaataaagttaaagaatagtcgtttactttagtcgacgcggccgcgaa

SEQ ID NO: 26828 - DNA, 784 bp, Triticum aestivum
  Clone ID: PAT_TA_26828
gcacgagcggcggaagcctccactccactcccatccatccactcgcagctccagctcctcgaccaagccacgaccagagccaccgcggccagcgagcgagagcgagagtgaggcgcaggtgttcgatcgatcgacgagatgagcgtggtagtcctggacggatccacggtgcggtccttcgtggcggacgaggcggccttcgcgcgcagcgtggacgcgcgcttcgccgcgctcgacgctaacggcgacggcgtgctctcccgcgccgagctccgccgcgcgctcgagtccttccgcctccttgacggcgccggctttggctccgccgagccggccccgcttcccggcgaggtggccgcgctctacgacgccgtcttcgagcagttcgacgccgaccacagcggcgccgtcgaccgcgccgagttccgcggcgagatgcgccgcatcatgctcgccgtcgccgacggcctcggctgccagccgctgcaggtcgccgtggacgacgagggcggcagcttcctgctcgaggccgcggagcacgaggccgccatgattgccgccagggtccaggaagaacgcgacaaggccgcggccgaggaggcagccgacggcaagtgatgacggcgccgacggctgcacggtgtgtacgtgtcaaaggtggagacgtgtgagacgagtggtgtgccgcgtgcgtgtgtccggactccttttagtgtaatgtaccgaatattttatgaataaaatcgtttccgattctcctaaaaaaaaaaaaaaaaggccccta

SEQ ID NO: 26829 - DNA, 2337 bp, Triticum aestivum
  unsure (1)..(2337): unsure at all n locations
  Clone ID: PAT_TA_26829
ctcgtccttccacggtcgaccaaccccaagaaaatcccctcgatttcccctcccgacgccgcgccgggcaaaatcgccggtcattttcccggggcctccgcgcctccacgccgcccgctccatcggtaactccgccgatttatcccccgccctcccctccccccaccacctcccttctccttgagagtttctcctagctctcgctatccgctcctcgcgagcgatggtgggtgacctgtccctccttcgcctccgacctccggcctcccgcgtcctcgtcgacgccctccaagggagctccatgtctcttctgccgttccaggggacggggtcccagtaggatgagggtagaagcgccgctttgcagctcgccccgcagcggcaccccctcgagggtgcttatccggcccagtaggccctgcagaacatggtccccgggatgggccgggctgccgccgccgcgaaccccaccttcgacaggcgccgcgctgttccacgtgcagaattccggccctgactcggttcatctttacgttggattcgccgtgctatgtacgttgatagagataatcctaaagttactaaggacagggtccggatgtcaaacaacttgacgcctttttgcggactgatctttccgctcttcagatgctgtcacgtaatatgggtagtcaaccatatacccctgatgacaagttatctgtctatgagtttggattggaggagcctctgcagtatctagcaaaaaatcaacttatcatccctgatgacaagttatccatctatgagtttggattggaggagcccctgcagtatctatcagaaaatcaacttatcatccctgatccacttttggaatttgctcagtcccaaggtgcccttgctatagatgaaaatggccgggtcatcttcactggcagtggagacgagatgagagacttactttcggttttcttagagttcaatgtacctaaacgagaagcaagtggttgcaaggctgcatatttagttccatacttcgacaggaaaaggggccgaaatagtagtcaatccaattcaaaatcagcaagcaccgcagttgatgctccaaaaagcaatgcaaatgtgaaagcaaaatctccatcgaagaagaaacagaaaggaaaaaccatcaatgaacgtgacatgtatcagaacaattatttccatgccagcgaagcttttttctcaatccttttggacaaggacagacacagctcgacaattctctcactgaagaaagcaggccctgagatcactgaactgttgacacagtgctcaattggcattgctggaactggcctggctgttcttctgtcggtcgtgtgcaaggttgctatcggcgggaggactccttttgccgccacccgtcttctgcacacaggcgttgggtttgggctcttctggctatcccatgcggtaaatggactgcgggacacaatcaccagcgtatttagaggcccggttgacacaaagttggaggatgaggttgctgtgaagatacaaagaagcatgaatgacattctcttacgggccgtaactctcctggcaatcactgctttgaggtttgcatgacctcctatgctgctgtaacttattagacgcacctcggtgtatggttcgacttttggttcaggaatacagttcctgtaggactaagtgccaaataccttcatgattcatgatggcctcatagaaaatgtgcgacgttgtaaattgtacagaattttgctggcagctcggtgtatatggaagatagattttacctacgttaattaatgatcatcaatactttgtatttgcttgttccactttcttacacttcagaaantatattctgaacacaggttacaagcaaagaaaccaggtgggaaacagtaccgcagagttgagtgggcgaccccaaacgccagaaccttaatctggcaaggccgtccctctttccaagttgttcttgatctcgagcgtgtatttgccaaaggccctctcgatcttcttgttgaagtgctcgttccggtcgttgatcgagtcaacgtccttgtcttcgttgaacttgcgcctcctgctgaacgccttgcgcttctcgtcccgctccttgagctcattaaccattcggtcgatgtttggttccgccaccctagacaccttcccatattgaagacttgaagcctcacggtagaattcaggatcggtttctttcgctctattgtatgcatccatgtcgacttctatgtttttggtcctcttcttgtatgcatcatacaaggttttctggttgaaaacatcccagccatgtggtgcgggttccggacgcgtggg

SEQ ID NO: 26830 - DNA, 1427 bp, Triticum aestivum
  Clone ID: PAT_TA_26830
cccgggccgcgtcccgcgcgccccccccccccccgccccctccgccgcccccgcctcgtcccccgccctcccccgccgccgccgcggccccgactccagcccccgcccccgcccccccccctccgccgcccccgccgccgccgccgccgtccgcggccgcgtccgccgggcccaggccacccccccggctgtccctccgccgtccgccgccgccgcccccgccgccggggttctcgggggtaacgttgtcttagcttgacgttcacgggatgccggcacctttgcatcctatggctgcttcttctagccggacatactccctccctggctctcagcttcgctttgctcccccccccccgccccaacgccacctcccccttgggcgacctcgtgtctctcagcaccctccccctcctcccccacccccagtctccctggggcgctccctctcccccttccctcgacctctcccctccccgcgtccgctccccaaaaagtcctaggcggtctctcgccttactccctgcctcctctcttctcttctctgcgtcctcctcctttgccatagacaatgcaaacgctccatcctcctccacaattgacaccaccatcaccgaccgcatattcatggactttagcatctgcccaagcttctttagcaatgaccgcacgttaggagctgaacttgcttcatgccctgattccgagcccctcggacgtgtagtctttggtctctatggtcggctactcccgatcactactgccaacttcaaaactacctgcactacttctgcatatcgaggcacacttgtccacaaggtgcttcaaggtcagttctttgctgctggccgacaaggttctcggcgtgataagggcgtggtccaacctccctcaaagcttgtgagaaatgttgagactgttgatcctaaagcgtatcaactaagacatgcaaggcctggcaccctatccttgtgtcttgagcagaatgacgacgacgatagcatcaaactcagtcctgattatcacaatgttgaattcctggtgaccacagggccagggccctgtccagagcttgatgatcagaacattgtttttggaactgtattagaaggaatggacgttatcaccagcattgcaaccatccctacctacaaaccaggtgaaaggatccaattcttcaatgattttgcacagctgattggcgatgaaagagctcaatctgctagagccatgtgggatcgcccacagaaaaccgtgtatatcagcggttgcggggagctcaaagtgaccaagccatccctttcccctcctagcttgccatgataagtactgtatagatgcaattttccctgtaattactattccatgtagctgtatctctacctataatataatattctgtatctcccgttcctaaaaaaaaaaaa

SEQ ID NO: 26831 - DNA, 988 bp, Triticum aestivum
  Clone ID: PAT_TA_26831
ggaaaagatcctgtgctcggagttgacagtgttggtacagtatccgcagctctggtgacttatgcttctatacaattgttgaagccagaccttatcatcaacgctggtactgctggtggttttaaggccagaggagcaggtattggggatgtcttcttagcttcagatgttgctttccatgacaggagaatacccattcctgtttttgacagttatggaattggagcacgaaaaacatttcaaaccccaaacatagtgaaggaactcaatttgaaggttgggaaactgtcaactggtgattctctggatatgtccccccatgatgagacagcaatactgagcaatgaagctacagtcaaggatatggagggagcagcggtggcgtatgttgctgacttgttctcaacacccgctatctttgtcaaggctgtgactgacattgttgatggggagaagccaacagccgaggagtttctgcaaaacctgatctcggtgacgatggcgctggaccaggcagtcttgcaagtggtagacttcatcagcggcaaatgtatctctgatctctgaacgccgaacactccgccatgctgttctggggtccacaaactgagggagcctgaatatatattgttggatgtataatgtttcctggggggtttcacacacgattttacattatcgtaacccctatgtaaaaatttcttggcgattactcggagccattgtatgggattttgtagaattttacaaactgtgcagcttagtgaagctcggcttaataaggtggtgtatggttacactggaataaatgatgggcactggaactcccatggattcagcacaatggttgatggatcttgccagctccatcacatggtgcttcgcaagtgcagtgagtagtaaaggcactcatttttgggagcagctgtgccatatgtatgctgtaccatttaactgcaataattttacagtactgtttgttggactc

SEQ ID NO: 26832 - DNA, 1536 bp, Triticum aestivum
  Clone ID: PAT_TA_26832
tttttgggttgttctcccctttttttttttttattgtctagttctcattggattattagatacattgatcactggatcttcaatgtttcaagttagcagtccaatatgaacatcaaaatcaatatcccaaactggagcttatgaaatttgctctgtaacaaattaatattttgcaatagtaccatatcaggccgaaggaagaaaacaattgcaacaaatgagtgtacaacaacagcggaagaagaagaactagtatatcttctatggtcatttgtattcttggaaattgacatggccggtggcttgcgcgtgttccacagcttccttttgaccaatgacaccaatttggcacacgccgcagcgcaatgtaaagtttgcggtgtctgtgtagctcctcttcctatgtgcctccttcgctaagttaagagcaaggccttctactggaccaatggaacggttctggtcaacaacgtagatggtctgatcaaattcttctggtgccccttcagctggagacattgctaaagcatcgtaatgcaacccatcataaatgagcattgccctctcattgtagttcttcccctgaccatacagatcacatcgtgttgtctggatgtcatatgcagcaatttcacgcccataatattcttgacagaattgaaagttctatggcacctccccacgtctctgcctccacctgccttgcacaattcgcgtcttggggctcgccaagaaatgcttcgttgtacttttcaggatcacttgcaaccgctgctgctatgacctgtctgagctcagaagccttatttttgttatgctccatcacataaccgaccgcattgaagaggcacctgttgtgatatggaggcagcagcggtgccatatgttgcttcacttgctcgcagacacccgccacctctgtctcaccggtggcagggcgatggtgttggcgagaacccaacagccgaggagtttctgcaaaacctgatctcggtgacgatggcgcttgaccaggcagtcatgcaagtggtagacttcatcagtggcaaatgtatctctgatctctgaacgccgaacactccgccatgctgttctggggtccacaaactgagggagcctgaatatatattgttggatgtataatgtttcctggggggtttcacacacgattttacattatcgtaacccctatgtaaaaatttcttggcgattactcggagccattgtatgggattttgtagaattttacaaactgtgcagcttagtgaagctcggcttaataaggtggtgtatggttacactggaataaatgatggccactggaactcccatggattcagcacaatggttgatggatcttgccagctccatcacatggtgcttcgcaagtgcagtgagcaatgaatactttccaaatgcagtgagtagtaaaggcactcatttttgggagcagctgtgccatatgtatgctgtaccatttaccgccattattcctccggtcctgtttgtttgactcaaaaaaaaaaaaaaaaaact

SEQ ID NO: 26833 - DNA, 1156 bp, Triticum aestivum
  unsure (1)..(1156): unsure at all n locations
  Clone ID: PAT_TA_26833
cttgnnccctattaaccctcctaaagggaacaaaagctggagctccaccgcggtggcggccgctctagaactagtggatcccccgggctgcaggaattcggcaccagaatctttaatagtaaactgagctatggtcatttggtgtatcttgtttatattatgaccaagtgctgaaatagaaagtgatgaaattgaaggcctttgtctttgttccatggctctcaagtctgccactccatctactatgggatcacaccaattgctagatctaatatgtcatctgctcctgtactaattagtatctcacgggccttcaggttctgatgcaatttagaaaatccctctttaagcaaaagtctggttgacaatataaaactgtagctctgaatttagtaatcacttaccctcacaagcatgttgataaattagcaagatgactagctacctagcatatattacttttcctttttttagaaactctaagttgttggttctaatgtcttactgattagaagcaataataaagattacctatggtgacatgacttgatattctgattgacttggtgccttctcttacaagtaaacatgtgtagctacttcgttccctaattttactgatgcattttattctggtatgtatctcattttcgaaagtggtacatgtgttgtattagaaaacactctatattggattacctttttcccttttctacttccttaacctcaagttctccccggnatctcttttgagctctgacgtagcaacaagacaatctagctagggtactctgcacataccttncctgngaggcacattgctgnacccttggctctggncttatttggaaggagncacattgctggcatatttggcctatatgaaaacgaatgccatttngacaaccttggacntggggaaaaagggaggcaaanggcantaaaaacttaaccanggcnaagtccnaactttggcattggncttttgggaaagccnnaaaggaccanccnngaanaatcnanganggnttaagcttccaggntntnnaggcntntntttnngggccgaanaaattttaccnnaacctttttnnaaantnngnnncnnnnggngnnntttncnnaaantngnggaancccnnaanttttnnngggg

SEQ ID NO: 26834 - DNA, 398 bp, Triticum aestivum
  Clone ID: PAT_TA_26834
gactttgcagaaggtgttcatgggggcgacggtggtgtttggcgcgacatccgggatccctgcggatgttcagctcagaatattgctcggtgccggtgctctggtcagcgccgctctggcctatgtcttctacgaccgccagaagcatttcgtgtttgtggactacgtgcacgctgacattgattgattagggagataaacattagttatttttgtgaggatctggtgtggtgtggtgtggagacatcccacgatcaatcatgtgcataacctagccaaggagtacatatagctttcagtgggtacatgagattggcccagtatgttgtttataactttatactaggcgctgtatgagcacttaccaggctactttgtaagaaagaaaagtcgggatg

SEQ ID NO: 26835 - DNA, 1836 bp, Triticum aestivum
  Clone ID: PAT_TA_26835
cctcgaccctccctcccccccccccccaggccggccggtccgcagacgcagtcccggtgttgccgccgccattcgcatccatccccctcccctcctcgcggcgtcggaccctgccccgcttgccgcctcccccgccctcccaggccgggagcgtcggcctccgcgtggccgcgccgacgtcggtccccggcgaggcggggcgggcggaggagccgagcacgagcccgagcacctcgcctgaatcgtccgggcgagaagttcgtgtggcgggaccactggtacccggtctcgctcgtggaggacctggacccgcgcgtgcccaccccgttccagctcctcaaccgcgacctcgtcatctggaacgaccccaactccggcgagtgggtcgcgctcgacgaccgctgcccgcaccgcctcgccccgctctcggagggacggatcgacgagacgggcggcctggactgctcctactccggctggtccttaaccgggcccggggcctgcaccaggatcccgcaggccgcgcccgaggggcccgaggcccgggcggtgcgctcgcccagggcctgcgccaccaagttccccacgctcctctcccaggggctgctcttcgtctggcctgacgagaatggctgggacaaggccaaggccaccaagcctccaatgctgccgaaggagttcgatgacccggccttctccaccgtgacgatccagagggacctcttctatgggtatgacacgttgatggagaacgtctctgatccctcgcatatagaatttgctcaccacaaggtcactggacgaagagatagagccaagcctttgccattcaaaatggaatcaagtggcgcatggggatattcaggggcaaataccggtaatcctcgtatcactgcaactttcgaggccccttgctatgcactgaacaaaatagagattgacacaaaattacccgattgtgggagatcagaaatgggtgatatggatttgctccttcaacattccaatggccccagggaaaactcgttctattgtctgtagtgctcgaaactttttccagtttacaatgccaggaaaggcatggtggcagcttgtccctcgatggtatgaacattggacctcaaatttggtctatgacggcgatatgatcgtgcttcaaggccaagagaaggttttcctgtctgcatccaaggagtcgtctgcagatgttaatcagcagtacacaaagctcactttcacacccacacaggccgaccgatttgtcttagcattccgggcatggctacggaaattcggcaatagccagcctgactggtatggaagccctagccaagatgcattaccttctacagtcctttcaaagcgagagatgctagacagatacgagcagcacacgctgaaatgttcctcctgcagaggagcgcacaaggccttccagactctgcagaaggtgttcatgggggcgacggtggtgtttggcgcgacatccgggatccctgcggatgttcagctcaggatattgctcggtgccggtgctctgatcagcgccgctctggcctatgtcttctacgaccgccagaagcatttcgtgtttgtggactacgtgcacgctgacattgattgattatagggagataaacattagttatttttgtgaggatctggtgtggtgtggagacatcacacgatcagtcatgtgcataacctagccaaggagtacatatagctttcagtgagcacttaccaggctactttgtaagaaagaaaagtcgggatgaaaatcgatagatagaccatatcttttgtctaaactcgagacctcggcgcgaccacgct

SEQ ID NO: 26836 - DNA, 664 bp, Triticum aestivum
  unsure (1)..(664): unsure at all n locations
  Clone ID: PAT_TA_26836
gntatgttggacgcccggnaaacaggcgactttgctttccgagacaggacttcaaagcagccatagattgttatactcagtttgttgatgtcgggacaatggtgtcgccaacggtttacgccaggcggagcttgtgccacctgatgtgtgaccaacctgacgctgccctccgggacgcaatgcaagcgcagtgtgtgtatcccgattggcccacagctttctacatgcaggcggtcgccctgtccaagctagacatgcagagtgacgccactgacatgttgaacgaggcctcacaacttgaagagaagaggcaaaagagcgcaagaggtccatgaatgaagagcatattaaactcggagaagtcacatccatcccatatatatgtatgtagtcggaagtttgcgctgatctgagcggtataggagctagaagatctgcgggaagacgtttcactgaaaagtcctgtgaatgcgattgaaggaactcgtttggtttggcatacctgtaataggtagtgcatttttgggcccatatttgttgtatataacgtcagttgaaacaggcagcaaacgcgggcgttcgtttgaatgtgtgttgctggttgttggaaagggtccttgttgtagctaaagcaaataaacatacctatatcctgtttgtacag

SEQ ID NO: 26837 - DNA, 692 bp, Triticum aestivum
  unsure (1)..(692): unsure at all n locations
  Clone ID: PAT_TA_26837
gnaaggctggaagctatattctgtttagtgatagattacccatcaaagcagaagtaattcaagattttcaatggtattccataaatgcagatgaataagactcgatattaagtatacgactttgtcctttctgtacataccaataagaaaagctagagaaattaaaaaaaatcatctcatactacatttcctgccggtgagcttgtcaatcaagctgccggtgagcttgtcaatcaagctgaggtgaaaaaatattcagaggtccaccaggcagtaacccataatgctttttttatagctagcaaagtgaaccatatagtagatgggaaacaatataataaaggccaaataaagcaataatccattcattatgtcgtagctaaaaagaataaataaaataggatgtaaaaaaacaaattaaaaacagagaaaagaacaacaaatagaaaatgggaggagatagaacaagaaaatctaaatctaagaaaatgagagcataccaggcaaaatgacagtagagcaaatgtgcgcagaaaaaaaaaaaagggggagttgaaatacccacggatgggttggagacggcaaggtcatcgagaagtacgcctagctctcacgaaatgtgaaaatttggaagcatgagcatcaaatcaggtattctacttgctcccaagcttgccgcagagacgaccgac

SEQ ID NO: 26838 - DNA, 664 bp, Triticum aestivum
  unsure (1)..(664): unsure at all n locations
  Clone ID: PAT_TA_26838
caccaggggnngtggggaggatggtgaaaaaccaccatcctcctgacagaaatgaattcagcaaccttattgaaggtttatgttctgttggcagaacatacgatgcattggtatggctagaggagatggttgaccatggagaaacacctgatgtcccgtgtttggtcttgtttggtttcatcatctttaggagtaggagaaagcgttatggttgcagctatgtgagaattaggatttaagacaacagtactcttgcagcacaccaaagacaatgcaacggagttgcctgtgatggtaataacgctgaagagaaaaaaaaagacagtctgcctgtagagattaacctgaattctttccagtttgtatcggtatnaaaggggaggggaattgagctagctattttgtgtcacccacaccaggagggtcaaggagtgctgcttgcttntgtttcggcctgaggcatgtttgatgaacaagtggagcttccatcacaatgaaaaaccatgtgcttttttggaccttgtggtgacaaggttgaatnttanttaccctttaaggaaaaanaaaacccccnggaaaggggactttttttttccccccccaaaacccatattggattttnngggggccnccaaaaaactcccnggtttaattttttnttttt

SEQ ID NO: 26839 - DNA, 1014 bp, Triticum aestivum
  Clone ID: PAT_TA_26839
gcacgaggggcagccagcccaccacccctcatcctccccgggcgcccgccgaggccgcggaaaaaatggaggtcctcgtctcccccaccgcggcctcgcctccaaaaagcagtgttgagtgagagagggagaggaaagcatggaggtcctcgtctccacaaccgcggcctccgctcccttatcctcggcccgcgtccaccgccggccgctccctgcctccgtgaccttccgcgccccggcccgacgaggctggcgctgccgctccgccgcgccgaccaggcctgacccggtgccgtccgaggagcccgcgtcggcgtcggggtccgccaccactaccgtcgtcacggacaagcccgacgcgccggacggggaggtctccggtggatttgtggaggtgacgatggaagatgcgccggtgtcgtcgcccgaggcggatggcggcgtggacgacctactcggcaagttggacatccaagtgacacccactactgtcatcctcggaggcggtgctttgattgctctgttgatcctatctaaaatcatttctggaatggattctgttcccctgcttccaaatgtgctggaaatcgtaggaactggctactcagtctggttcatcacacggtacctcctctttaaggaaagcagagacgaactgtttgcgaaatttgaagatctgaaaaacaatatcatttgagcaggggaagagtgatgatctttagcatacgtttaggcttcacagccagcttattattttaggccgtcttcttttttcaactattgctgaaagaaagaaacaagttgtgttgtaagctgtttcctctcatcaatcaactgtaatgagagatctgagttttactagtgtgcttgctcgaaactcccaattgtgtttgctcacccagcgttcatgatcctgactagaagcgccaaaatgttaaaatgtcggatggattatttgcttcagcacagcacttgttcacccgtttctcttaaaaaaaaaaaaaaaaaaaaaaa

SEQ ID NO: 26840 - DNA, 673 bp, Triticum aestivum
  unsure (1)..(673): unsure at all n locations
  Clone ID: PAT_TA_26840
tccgattctacccctgcttcctcccccgtgccgtcgcccgctcccgagccttggggagctaatgccgatggggccttctcgcaccagatcccgtcggctcgtggtcgcctgcgcagcctccggcggtgggccgccggcggagaagccgccccagggaccctccctgccgccgctgtcggaaatacgttgggggcagctgctggcgccgtccccggacaacgctgcggccgtggcgctgacggccgcgctggtatgggccggcgcagctctgctgctgcagctggtactcatctccgcctccatcttcgccgccgccctcaagtactccttcgtggccgcgctcctgctcttcgtcctcatcgcgctcctgtgagtggcgcgtgctccctccttctcatccgtccgcgactccacccctgcacgcgctttgcagaacatttcctaattattttagctggaaacatttcctagttttatcttgtgtgtgcttagcccgccggactaaactgcgtcaaaatttcattcgccgttgtggcatcttgtgtcatgtgcaacttgcaatgaaatatatgtatatgtatactcagcaaggactaaggacttgttttgaaacgtgaactcgctgacagtttagttcaaaaaaaaaaaaaaaaaannaaannnnannnnnnag

SEQ ID NO: 26841 - DNA, 1009 bp, Triticum aestivum
  unsure (1)..(1009): unsure at all n locations
  Clone ID: PAT_TA_26841
cctcccgacctcactcccactcccgccatgccgctaatccaagctccccgcgcgtcctcctcctccgccgccaacgcttcacgccgcaccacccattccccgcttccaccttcgccctccccgtccgccgctccaccgccctccgggcacgagccggtagccccagaccgccgccggcacacgctacgtaccgacagccgggagacgcgccccgtggcaaatccgcgccccgacgctgttctccgtggacgacaaccccaccccgctgcaggtcgccacgagcgtcatgctcacggagggtgcggtccggcgggatggagaagcccaggaacctgagcgaggaggccctggaagcgctgaggatggtgagcacctcgccggtggagactaataagccgccgtcgcccgtgcaggcgctgctcgggggaatcgcggctggggtcatcgcgctattcctgtacaagttcgccaccaccgtcgaggcctcgctcaaccggcagaccatctccgacaatttctcggttcgccagataacagtaacaataagaacaattataaatgggctgtgctacctagcaacatttgtgtttggaatcaacggagtgggattgatactctattccctccagcttacttttaactctctcatggacgatgagactagcagctcatccgttgagaaaatcagcgagcagtccagcacaatggcttcatctagtagctccacaagtgacagcatatcggacagtagtgacttgcagcagatatcgagacaagaataaaaactcatcggaatagctgagtcgatgcaatgcagttgccaaaattcaagagtagatacataataggataatcctcgtgaggagccattattctcatcttaggctgtactgtcgttttggagtgcaaatactatgctaatgaaatttcaattaggctagtagtattgaacgcaaaataattgggaagacatgaatgcatcggcaaaatctcncagaaaaaaaaaaaa

SEQ ID NO: 26842 - DNA, 604 bp, Triticum aestivum
  Clone ID: PAT_TA_26842
gctccccggggaccgtggaagggtacgcctccgcccacgccgaccgcttcgccgccaagcttccctggaaggagactctctccttcagccacaaccacgacgatgtcggcgcccgcggcaacagccacgtcgtcgtggactacttcacctccgccctaggcgacgacttcaagcacctaggggaggtgtaccaggagtactgcgaggcgatggaggaggcgtcgctggcgataatggaggtgctgggggtgagcctggggctggggagagggtactacagggactacttcgccgacggcagctccaccatgaggtgcaactactacccgcggtgcccggagccggaccggacgctgggcacggggccgcactgcgacccgtcggcgctcaccatcctgctgcacgacggcgacgtggacgggctccaggtgctcgtcgacggcgcatggcgcttcgtgcggcccaaggaccggcgagctcgtggtaaacatcggcgacaccttcgtggcgctgtccaacgggcggcacaagagctgcctccaccgcgcggtggtgcaccgggagaaggagcgccggtcgctggcctacttcctcgccccgcggg

SEQ ID NO: 26843 - DNA, 943 bp, Triticum aestivum
  Clone ID: PAT_TA_26843
cggacgcgtgggctgctccactccctcgccccgttcgcgttcgcgccgctcgccgccccgcccccgccgccgctgctcgacctcctcctcgccgcggccttcgggcaggagctcctgctcttcgcgcaccgccgcccctccaccgccgccggcatcgagaaccgctacttcgacctcttcctcgtccccgtcgccgtctgcctcggcgccaccctgctcgccgcgcaccgcccgggggccgcgcctcctcgcctcgcccgcgccgcgggcctcgccttgcagggcacctggatgctgcagatgggcttctccttcttcaccgacgccatcgccgccggctgcgcgctccacgcgcagagccgggcggactacaccatcaagtgccgcacccacgaggactaccaccgcgcgcgctccgtcgccacgctgcagttcaacggtcacctggcgctgctcgtgctcgccggggcggcgacatacgctgctgtcatctccagagggaacggcagtccaccgagcggctacaggatgctggacaaggaggtccagatggagggcatgccattaacatctcagttcacgctggattctgatgaggagaaggaagatgaagggatcacaaccgcagtgcctccgtcggcgaatggggtgaactcacatcagcagatctccgagcagacacctgatgatcccaagtgatggggatggagttgggtgcttttgatgtagaatagctcattggaggtgaatatcacagcgagaagagtgatacggcatcatgtttgcgtgtttccactgcatttcagtaatacttgagatcaccttaggtgtgtgtaggagcgtgcacaatttgatttgcatacatcaaagttagcctttgtacaatattgtaatgtcgtcgattcagatagttttctgaggaataaaaagttagttcatgttt

SEQ ID NO: 26844 - DNA, 776 bp, Triticum aestivum
  Clone ID: PAT_TA_26844
ctgaaacagtgcgccggaactctgcatagatttcaggccggaggacggacggcgatgactacgaggagatggtggaagcggcgcgacggcagcgacgacgccgacgatctcgtccccatggacacccaagagcaggaggagctggtccgttccctggagcagaagcaggtgcaccaaagccgccgttggaggcacgtctttgcgggattcctcctgagctacacggtcttcctcgtctactccagcttccaccatgcctggtctccctgggagctgcgataccatgcttactttatggaagatttgccttcgccgatggtcatcgttgcagattggatagctgcccttgcatgcttattcgcagttaaggggctactacaagcatccaactcctccaagaagtggatgtggtattcattctatgttggcatggcggttgccatcttctggacatactacctcttgaagttaccaaggatccgatgggatgtagtgtggctcccgcttggccctttgattgcttctgcattgagcatctatgtggaccatacgctaatgaagtcgatgcaagatatcagcaccttgaggggctacatgtacaacttcaagtccctgtgatgctaagcatacttctcgtctgggtcttgcacttggctgcactgtgtacatgggataccccatcattcgtttctacttgcgacctctcgttctcgacttcagaacgtcgagtcaaaattagtataacagtctagtttccccgcaaaaaataaaaaaaa

SEQ ID NO: 26845 - DNA, 524 bp, Triticum aestivum
  Clone ID: PAT_TA_26845
acgttctttggtgcaatccaaaggttagttcatgtctcatggcgtcggctgtttgcgggtgttctcatatacatgcatatacatatgcatcttgtcatcgtcgtgtatatttgtatttctcgaagaaggaaaattggcatacacacgtgccttgagctcgcactcggacatagccgccgatcgagcaggaaaagtaaatggaagtaaccgccggccagccgttctatactttgggggcggatggagtgggcgtggttggaggtttcaggtcttcgtacctcgcgtatggtgaaagtgggcgccctggatcagcagtgggggcggcggtggcgggagcgccgttggcgttggaatccaacagcggcgaggagggctcggctgccgccgcctcggcagtggtgctggttgctgcctccggagaggcggcagtgggcggcggcgatggagaatcgccgtcatcgtttttcttgctgctgctcctgctgggtgtcggggaagacggtggcttcagcccctcgtacgcc

SEQ ID NO: 26846 - DNA, 1439 bp, Triticum aestivum
  Clone ID: PAT_TA_26846
gccggccgggctgcgacgcaaagcgcgcaaccccatcatcactcaccacaccaaccgacccgtctcgtctcgcgttccactcttctttcttttgtttcgctccgtggtcccacgtgctcccagccatgtgcggcggcgccatcctctccgacatcatcccgccgccgcgccgggccaccggcggcaacgtctggcgggccggcgggaagaagcgggccagggccgatgccgccgcggggaggccccgccgcgcgcccgaggagttcgaggaggagggcgacgcggagttcgaggccgacttcgaggggttcgtggaggcggaggaggagtccgacggcgagggcaagcccttccccgtccgcaggagcggcttctccggagatggattgaaggcaactgctgctggtgatgatgactgtgcttcagggtctgctaaaaggaagagaaagaaccagttcaggggcgtccgccgccgcccttggggtaaatgggctgctgaaataagagatcctcgcaagggtgtccgtgtctggcttggtacttacaactccgctgaggaagctgccagagcctatggtgttgaggcccgcagaattcgtggcaagaaggcaaaggtcaatttcccagaagaagctcctatggctcctcagcaacgctgcgctactgctgtgaaggtgcccgagttcaacaccgaacagaagccggtactcaacaccatgggcaacgcagatgtgtattcctgctctgctgttgactacaccttaaatcagcaatttgtgcagcctcagaacatgtcgtttgtgcctacagtgaatgcagttgaggcccctttcatgaatttttcctctgaccagggtagcaactcctttagttgctcagacctcagctgggagaatgatatcaagacccctgacataacttctgtgcttgcatccattcccacctcaacagaggtcaatgaatctgcatttctccagaacaatggcatcaattcaacggtacctcctgtgatgggtgatgctaatgttgatcttgccgacttggagccatacatgaagttcctgatggacgatggttcagatgagtcaattgacagcattctaagctgtgatgtaccccaggatgtggtcggcaacatgggcctttggacctttgatgacatgcccttgtctgctggtttctactgagggaatcgaggtcgctgggtgcctgtatatatagacaaaggaataagtattcaggacatcaacaagtgcttgtgtctggtgcctctagaattgagcagtagcgatgtcagtctatggttatgtctagcttaaatggtcaggtgactgaggtcttttgcaatagacctctgtcttgtgcccccagactatattatatctatatatgagaccagtatgtgatggggaactgcttattttgtattcatgtttcta

SEQ ID NO: 26847 - DNA, 2118 bp, Triticum aestivum
  Clone ID: PAT_TA_26847
gcagaaggaagaaaagaaagaggagagaaagcccaaaaaaccatcgtcatcataagtcaaagagtaagaggcatcactcagctgaaaattctgattcggatgacgtaagtgatggcaagggagaggcacaactcttcatcatcttctcacacacacacacaccaacaccacaccaaccgacccgtctcgtctcgctcgcgtttcactctttccctttcctttcgcctcgctctacccgcggtcccacgtgctccagcagccatgtgcggcggcgccatcctctccgacatcatcccgccgccgcgccgggccaccggcggcaacgtctggcgggcggacaagaagaggagggccaggcccgacgccgccgcggggaggccccgccgtgtgcccgaggaggagttccaggaggaggagggcgacgcggagttcgaggccgacttcgaggggttcgtggaggcggaggaggagtccgacggcgaggccaagcccttccccgtccgcaggagcggcttctccggagatggattgaaggcaactgctgctggtgatgatgactgtgcctcagggtctgctaaaaggaagagaaagaaccagttcaggggcatccgccgccgcccttggggtaaatgggctgctgaaataagagatcctcgcaagggtgtccgtgtctggcttggtacttacaactccgctgaggaagctgccagagcctatgatgttgaagcccgcaggaattcgtggccaagaaggcaaaggtcaatttcccagaagaaggctccatatggcgtcctcagcaacgctgcgctactgctgtgaaggctgcccgagttcaacaccgaacaggaagccaggtactcaatcaccatgggcagacgcagatgtgtattcctgccctgctgttgactacacccttaaatcagcaatttgtgcagcctcagaacatgtcgtttgtgcctacagtgaatgcagttgatggcccctttcatcgatttttccctctgaccagggtagcaactcctttagttgctcagacttcagctgggagaactgatatcaaaaacgcctgacataaacatctgagcttcgcaacagttcccatcctcaactgaggtcaatgaactctgcatttctccagaaccaatggcattatgttcaacggtacactcctgtgatgggtaatgctaatgttgatcttgccgacttggagccatacatgtagttcctgatggacgatggttcatgatgagtcaattgccgagttcaacgacgtgtcatatccagtactaaatggcaccggcaacacggggctgtgttccttcgcaggtgttggccaccctttgcatttggaatttgacggcatcgcagcccttcggttgtctgtagaggaatggagatcgggatgcgtctgcgagatatacacagaactagtgtccggggcctctaaaggcttgggattaggccgggaaaatgatagcaatacccctgacataatttcggtgcttgcatcctttcccacctcaactcaggtcaatgaatctgcatttctccataacaatggcataaattcaacggtacctcctgtgatgggtgatgctaatgttgatcttgccgacttggagccatacatgaagttcctgatggacgatggttcagatgagtcaattgacagcattctaagctgtgatgtaccgcaggacgttgtcggcaacatgggcctttggacctttgatgacatgcccttgtctgctggtttctactgagggaatcgaggtcgctgggtgcctgtatatatagacaaaggaataagtattctggacatcaacaagtgcttgtgtctggtgcctctagaatcgagcagtagcgacgtcagtctatggttatgtctagcttaaatggtcaggagacctaagtcttttgcaatagacctctgtcttgtgcccccagactatattatatctatatatgaaaccagtatgtgatgggaactgcttattttgtattcctgtttctaccttattgtaattgctacaagtggctgtaaaccttttaactttgaagccagtgtttggtatgttgtgcttgaaaaaaaaaaaaaaaaaaaaaaaaaaagggcgg

SEQ ID NO: 26848 - DNA, 873 bp, Triticum aestivum
  Clone ID: PAT_TA_26848
attggatttgtgaaacaaagcagccaatttaatatctaatgccctggggaaaaaaatatgttctaatatcgcaagccagtcgtccgctggcaggtttcactgtttgatgttttgaggtttctaacattcatttattcttttgatgttcgagccaggccacaagaaagagaaaaccgagacgatgggagctcaaactcgccaggagaagcttcttcccatggtggagatcagtgttatctgcccggtctaaagtcaagatcatcccccacaaatgggcacgtccttctgaatgcttggatctcgagatggcttggaagaaacctactcaaggcttggatggtgagacagcttcgaagaaggaaaccgtcgaggatgggtctgctgctgcaggtcacggcgttaagggccgatttcccatggtggtatatagtagcaagcccggtgagctgtttactacaataccgcttgctgatatacccaaatacatgaagcaacaacagagaaggcaatccagaaggctgtttagtacagcggttaattatcagcccaggatggtgattggtacaggagtgaatcctcaacccggaagaaggctgtttggtacagcggcattgatgctgctcaaagtgttgaagaaggcatgaggagtagtatagaaaggtaaggccaccttgaatgctggttttcttgttcaaatttgtgagcatgcatggtctcgtgctagggaacgtacatatatatggtcatctgatgcaccttaggtctgaacaaatcgaagcatctgcagattagcccccggttatgtatgcgccagtcatcttatggtcgtgttttttgtctgcgcatgctggtcgcggcggtgatggttgggtc

SEQ ID NO: 26849 - DNA, 582 bp, Triticum aestivum
  Clone ID: PAT_TA_26849
gaaactattggatgaacaggcaatgattcaaaagaaaacagctgacctgtgcctcccaatctgctgcaaacgaagtgtttgtggcagggatcgctggggagttttaaccatcgccgagaatcaaggcttgcagcaccgcccgggggacacgaagaatcaaagctcgccgccccgctaaggagaagatttttaacgatatggaaagtttgatgcgcggaaagaatcaagcgtccattagaaagattatatcctagatcgccccgtgcaagctattacaaggaaagtggtgttgtacatatggatactttagatctttagtcgtccgcttggctgatatttgattgttggctgatttgttggctgattgtatcctgattagaggaaagtgtcgaataggaaaatcggttggggaggctggctcgctagaaaaaccggtgggcgatacccgcgatggttaacataaaaatcggtggggaggggaaacgaaactcctccctccggagtagagatagcctttggagtaatttaaatttatgacaatataattatcatatttgaaatttcctgagttatggccttacc

SEQ ID NO: 26850 - DNA, 1105 bp, Triticum aestivum
  Clone ID: PAT_TA_26850
gcacgacgcgcgcccgcgaaccccgctccccagccatccagcggccggggaacccgcaccagcagcgccagcgagaggggaacaggagagaggggaaggggggctgagggccggcggcgatggggctgggcgtgagggcggcgccgttcacgtacgtggcgcacgcgctggccgtggtggccgccgccatggtgctgtactggtgcatccacttccgcggcggcctcgccttcgaagccgccaacaagaacctcatcttcaacgttcatcccgttcttatgttgattggctttattattcttggcagtgaagttataatggtatacaaggtgctacttacggtgatccatgatacaattaaattgatccatcgaatactccatgcgtttgcgctcgtgctcggtgcggtcgggatatactgtgctatcctgtatcgcatggaatctgggcttgcgaaacttaccattctgcaatcttggcttgggatagtaacaatttctctatatggtattcagtgtatagttgggttattggccttcttccttcccctaggctgcgccaaatgtgtggaagagtgctcttccttggcacgcactacttgcgatattcgtttacattttagccctggcaacggcagatcttgggtttctgcagaagctcaccttcctccaaagctcaggcatcgataaatatggaccagattcatttctggtgaacttcacggcattggttgttgtgctatttggtgcctctgttgttgtagatgctgttgctccttctcctcttgaagagccacagtgttatgcttgcattccacaaaactcgcatgtatgaactgtactgtatacacaaaatttcacaaagtttgcactcactatagtgattcgataccagaatcactccgatatgaaaataattgacctgataagaaaatgttgtgcatcttctgtgtatatgtaaatacatacagccatacaggtacatattgcttttccatgtatcatgtataactgaaacatatatgtaagcagctattttacaaattacatatttttcgtgactgatgtaagcagctattttacaaataaaaaaaaaaaaaaaaaaa

SEQ ID NO: 26851 - DNA, 505 bp, Triticum aestivum
  Clone ID: PAT_TA_26851
caacatcttactctcagtggcaactggcaagtgagtgtggagcgatagcagcaatggcggcctcctcgtggcaagtggctcttctcgccgttgcgctctgcgtgctccctgcagccctgccggcggcgagcgcggcccgggccttcttcatcttcggcgactccctggtggacaacggcaacaacaactacctcctgacgtcggcgcgcgccgactcgtggccctacggcatcgacaccccggaccaccgcgccaccgggcgcttctccaacggcaagaacgtcgtcgacctcatcagcgagcagataggctccgtgccggtgctgccgtacctgagcccggagctggacggccagaacctgctcgtcggcgccaacttcgcctccgccggcatcgggatcctcaacgacaccggcatccagttcgccaacatcatccggatctcgaagcagctcacctacttcgagcagtacaagcaccgtctcgccaagctgtacggcccgga

SEQ ID NO: 26852 - DNA, 626 bp, Triticum aestivum
  unsure (1)..(626): unsure at all n locations
  Clone ID: PAT_TA_26852
caacacacgaacgtcgcggccacctcctcctcactccatanaagtcgaccttggnnttgcgcaaacatgnggcaacngcccnntgccgctgccacnngcatgtgcaaaggaaaccagggtgatggacgccaccctcgccggagcagccaagatggtgaagaggagagagcggcccgcggcggccaaggacgtcgtcgaggagaaggaggtggcgtggccggagtgccgcgtcgaggacggcggggtgcggttgaaggtgctgatgacgaggaaggaggcggcggagttcatggcgaggctggaggagcaggcccccgcggaaagtgaatccaggacgggggagggcctcgccggcggcgtgatgagcccgccgtgcgaggttgcgtggaggccccgtctcgcaaccataccggagacgcactagcttcctctatgtcggcctctccgcgcatggcttgacttgaccacgtcggccgttttgtacgtgctgacgttggctagtagctgtacagatattcagatactagcgctagatattcggatgctcagatcatgtacgtggttgttcctcttgttttctgtaagattaaccctggccaaacacttttgttaggacttgacaatgg

SEQ ID NO: 26853 - DNA, 786 bp, Triticum aestivum
  Clone ID: PAT_TA_26853
acttccccaccggaagagaaagggaatacgactagacctagacgagagagaggccatgaccttgagactgggaggcaacgcgaggctggcctgcgcactgctgctggtgctgctctgcgtggcctcgcggatccagggaggggcgtcccgaggcggaggtggaggccgtggtgggaggataggaggcggaggcagcagcgatggaggaagcactggcgggggaggcagtgccgtgcccggggccggcggcggcggcggaggcagttacatgcgaggggccggcggtggctacgtgccaacaaggggctacggcgggcggaacacgactgcgacggggtcggacggacgccgcgccgcgggcgagccgcgtggccgcgtcgtctggttctccgctgccgccgccgcgctggtggccctgagcatacttacgcaagcatgatcgatcgctggcgatgagtgaaatacggaatttttattttgtatagcaatttagaacgaggctgaagatactccttccgtcccaaaataagtgactcaactttatactaactttaatacaaagttagtacaaacttgaatcacttattttagaatggaaagagtattttttaatttttaataccagcttgtaaatagattacggagcctttttctttccctctttaccttgtaaatcgatttgagtacagtgtggtggaaaatcggaacatgttcttcctggagcagaatttcgattttgttcctttgagatttttggaatttgtgacaactaatttgattagacgg

SEQ ID NO: 26854 - DNA, 844 bp, Triticum aestivum
  Clone ID: PAT_TA_26854
cgttcgttcgagcacgttaacaccacgaccatcccgtaccgttcacatataaacgacgagattctctaaaatctgttatctcgccaggttgatgtcgaggtgtcccagcctcttgctcatccgggagcgtcaagaccggcgacaggatgaggcggggtcgggatcaggcgcgaccgccggcgatctcgtcgggctccggctgagccggcagccctcaccggggcgacaacaacggccggcgctggccgtccccagcacgtggtcggcgagggccccggccggtgagctccccgagagcagcggctgccggccgttcgtgggcctcgagttcttgaagtgctgcctctgctgctgcaagacgatggacggcgacatggatgtattcgtgtacaagtaagctagatcacatggacgttcctcattcaatctctatactaattgttgcttggcttgagctgagagtcttacggttcttggggttaattctgcaggggagagcaagccttctgcagcgacgagtgccggtgtcagcagatagcgagggaggagaagcgggagaccgagagcccgtgcaggaagcgagttgtagcgttccgatgacgctgtgcagcgccgggcaagaaggtcggaggaccggaccggcacgcgagggtgcttgtagcacgtttttgcaagttagaattagatccttgctgtacttgcagtaagccagtgataaactaaggatgatttttttaggaacaaattaaggatgattagttaggacaaatttcaagtcctaaatttgtagtacaactgtacaagtaggctttgggttgttaagaaaggattcaaagttacccct

SEQ ID NO: 26855 - DNA, 1178 bp, Triticum aestivum
  unsure (1)..(1178): unsure at all n locations
  Clone ID: PAT_TA_26855
ctcaacttctctccctcaacggccctaaagaaaacaaagtggatattatccctaccatgcgtcccgcgcccgcaccctttcctcccacctcaagaaaataatctcctggacctggacaccaacagaacctcaccctcgttcggacatactccactccactaactgagcttcgccggcaatggccacccttgtcaagcacctcatcctgtgctccagcactaccacatcgtcctcggcttctccgtccccgtcgaaccgtcgcccgccgtcgtcgccggatggcgccgacaagcgcgcccacctgacgcagtcctccacgcgccggctcgcggttgccgcgtcaacggcaatggtcgcaacggcggcactttccgcccggcgacccgcggcgccgcccccagccatggccgcggaggcggccgcggtgcgggcaccggcgcccccgggaacagtgccgaggtggggcacgaggtcgtacgtcagagagaggttcttcgagcccgggctgaccacggaggaggccgcggcgcgcatccggcaaacggcggaggggatgcggacgcttcggccaatgctggagaccatgtcgtggaagtacgtactgttctacgtgcggctcaagtccaagtacctcgacctcgacctcaccaccgccatggccggcgtccccgagccgcgccgccccgagtacgtcctcgtagctaacgagctcgtcgacaatatgaccgagttcgaccggtttgtgcggactcccaaggtgtacgagtcgtacctctactatgagaagaccctgaagtccctggatgacgtggcagagttccttggatgatcgtatatactgtgttcgtaggtctaggaatgtattcccgtcgattccttccgtgaagtgttaatatttactgatataccataaacatgattatgtaaattgtcatgttgcttcagcaaatatgcatgtactagatgcaaaaagtcattttggttgacgagcacctgtgcgctcgttatttggttcgtttgttgcgcatcacaaccgtccaagttagtgtagtcaaggctgtattcatcaagtatttgtgctttgatttctccgattaacaaacaaaccccggaccagcagggtgggggggcccggtaccatnccccaaagtgatctatancgcgccacgggntcgtta

SEQ ID NO: 26856 - DNA, 570 bp, Triticum aestivum
  Clone ID: PAT_TA_26856
ccccgcgtccgcccttggttcccctccttattcgacctcacctcaccttgccaccagccatggctgccgtgaccgccgcggccatctctctgtcctcctcctccgcctcctcccctgcggctgctgccaaggccaaggcggcgtccccgtcgtcgtcgccatgcaggcacctccagttcctgtcggcagcgagcccgcggcggcggtggcgggccggcgcccgcgcggtacgggcgcaggtgtccaccaccgagaccgcggcggcggggccggcgaagacgtccaagaagcaggacgaggggctggtcaccaacaagtacaagcccaaggagccgtacgtcgggaggtgcctgtccaacaccaggatcaccggcgacgacgcgccgggggagacgtggcacatggtcttcagcaccgaaggcgagatcccgtatagagaggggcagtccatcggcatcatcgctgatggcgaagacaagaacggcaagccgcacaagctcaggctatactccatcgccagcagcgccctcggagatttcggcgactccaagacggtatcgctttgcgtga

SEQ ID NO: 26857 - DNA, 849 bp, Triticum aestivum
  unsure (1)..(849): unsure at all n locations
  Clone ID: PAT_TA_26857
gcagttttatcgtattactatagatagagtacatctgtttcagatttcgatcctaacagaaaacgaatggaatcaaataagatattcccccaacaggcaaaaaaacaacagctgtacacaacccgtcgctgcatctggcgagatctcatctcgtctcagcatccgtcccagcaanaacctctgacacacccgtcaccaccatgcngggcctatatgtcagtaccgaaagggccactccaaccagcgacataaaatggtccacctgggcccgcgccngggcccatcccatcnctgcgaggccaccaggtacgggtgtgtccngtcncngtcactgcccactacacncgagtcaccngacacncgaccccncgacgacggcgacagcacgcaacncgagccagggtcatgggcaagtgatccaggactcngcacngacacagacatggtcaactccagcgacctgggcacatcnngcatggtcaggccacaggcaggcgaggaggtcagtcacagggcagcacagcaggcaggcgtagcaggntcngtagggcagcacacagagcagcagtccagcagggcaggggcggccgcagccagcccggcggccgccgctgcccccctcacccttcccggcagccggctcccccaggcatcaccaggccccagggtgcagttcccnggcactgccccngccacgttgtcgcncagccgaggccgtgctggttccacactgtgctgcacggcacttcacgtcgccggcngaacacgaggaggaacggcgggagagaccccagctcgtatatcctggcctcctgcttctgcacgtccatccagtactcgagcatgcag

SEQ ID NO: 26858 - DNA, 570 bp, Triticum aestivum
  Clone ID: PAT_TA_26858
gccgttccatctcatcttcgactacacattcttctgcgcccttgacccgtcgctgcggccagcgtgggcggcgaggatggaggagctgctgcggccggacggagagctcatcaccctcatgtacctgcctcaagaccaggactcggggccaccatacaacacgacagtgcacgactacgaggaggtgctgaaccccctgggcttcgtcatccaatccatcgaggacaatgacgtggcggtcgagccacgcaaggggctggagaagatagcaaggtggaagaagacggcagctggagccgaaacgtcgacatcagacgtgccctctgataatctctagtttcctttaaagattaattttaaggttttttctttcccttaaaaggttacagtggagaggcatgtcatgacacaacacttcttattatagttacttataaggtcaatgtatggttatcatgttaatggcacattttaaacaatgtgtgtgtgtgtgtgtgttttctcttgagtaaagtatccttcaccgatcgtgaaccatgtggctcagccatgggatttaaaaaaaaaaaa

SEQ ID NO: 26859 - DNA, 772 bp, Triticum aestivum
  unsure (1)..(772): unsure at all n locations
  Clone ID: PAT_TA_26859
cttggtctcgtcccgagcgcacctgtcctcctacctcccgcccctcctcccctccgcgcgaccccggcccaggacgacccgcagcggcggcggcagctacaggcgggccgccgttcgcgccatgggcgccgcgccgtcttcgccctcgccgtccggacaagccccagggaaagcggataacgcgtctctgagtgatgaggagttgaagaagcgcctcacaaaagaacagtattacgtcactcggcagaagggaactgagagggcattcacaggggaatactggaacactaaaaccccaggcatctaccattgcatctgctgtgacacccctctgtttgagtcatcaaccaagtttgatagtggtactggatggccgtcctattaccagccggttggcgacaatgtgaaaagcaagcttgatatgtcgatcttcttcatgcctcggaccgagtccctgtgtgccgtctgcgacgctcacctggggcatgttttcgacgacgggccaccgccgactgggaagagatattgcatcaacagcgcgtctctgaagtttaagccccagtagtccctggaagaagaatcaagatgcaagcaccagtgcgtcccatgtaaattttggttttggtatgaactatttccagtgtagtagcctagtccgcccggtctgcgcatgtaaattgataatttccaggtttgtaatttgtaaagccatttgtccgaaacaactgcatgttcctccatgagcataccnttggcctttaaaaaaaaaaaa

SEQ ID NO: 26860 - DNA, 760 bp, Triticum aestivum
  unsure (1)..(760): unsure at all n locations
  Clone ID: PAT_TA_26860
cacgcacctcctcgncgggcgagcgcagcagaaaggcgaccctctcctggtctccggccccgtcgccacctcgtctctccccctctccacccgccgccgcgcctcctccgtctccctccccgcccccaagaagggaggcattggtcacggcggcctgcggatcgagtgcatccgtatcggtggtgttgagatcccaaaccacaagagggtggagtactcgctgcagtacatccatggcatcgggcggaaccgctcccgccagatccttttggacctcagcttcgacaacaaggtcaccaaggacctctccgaggaggaggtcatcacgctccgtaaggaggtcaccaagtacatgattgaaggagaccttaaacggttcaaccgtgtggcgattgagaggatgaaggagatccggtgctacaagggcatccggcacaagctcggcctcccggtccgtggccagaggacaaagaacaactgcaggacgctcaaggggaagagggcttccgtcgccaagaagaagtcggcttcgtcctccgacgaataagtgacactgccatgtgtatttgcctcctgtttggtttttgtttgctacatcacggcgctaccaccattcggtactccgtttcaagtttccattccgtcgtagatgaattgtggggatatggtcggatgctgctgcaaagtttatagtcatgacatctcttctgttatatatgcactgattctaaatcatcatggttacatgttgtttcgtccc

SEQ ID NO: 26861 - DNA, 913 bp, Triticum aestivum
  Clone ID: PAT_TA_26861
ttcggcaacacgcacctcctcgtcgggcgagcgcagcagaaaaagcgcacgcgcctcctcgtcgggccagcacagcagaaatggcgactctctccatggtctccggccccgtcgccacctcgtccctccccctctccacccgccgccgcgcctcctccgtctccttccccgcccccaagaagggcggcattggtcacggcggcctgcggatcgagtgcatccgtatcggtggtgttgagattccaaaccacaagcgggtggagtactcgctgcagtacatccatggcatcgggcggaaccgctcccgccagatccttttggacctcagcttcgacaacaaggtcaccaaggaccctctccgagggaggaggatcacttacaacggttcaaccgtgtggcgatcgagaggatgaaggagatccggtgctacaagggcatccggcacaagctcggcctcccggtccgtggccaggaggacaaagaacaactgcaggacgctcaaggggaactcgggcttccgtcgccaagaagaagtcggcttcgtcctccgacgaataagtgacactgccatgtgtatttgcctcctgtttggtttttgtttgctacatcacggcgctaccaccattcggtactccgtttcaagtttccattccgtcgtagatgaattgtggggatatggtcggatgctgctgcaaagtttatagtcatgacatctcttctgttatatatgcactgattctaaatcatcaaagttacatgtgttatacgttcctctgttatatgcactgatggtgaaccatctgggcatcttgcgcgtttcgtcccaagcgcgaatgttttcttttgtcgcggctctgcttgatgcaaagacgcccaaccagctactgatgactgggttagcttaaaaaaaaaa

SEQ ID NO: 26862 - DNA, 1087 bp, Triticum aestivum
  unsure (1)..(1087): unsure at all n locations
  Clone ID: PAT_TA_26862
aaaaaatcacgtactttacttgatacgcggtacatacatgtggagcaaactcttatctgtctaatgactctagtttagactaaaaacgctggaaattatttgttcatacaaattccaaaccaataattaagcccccctttccgngggaaccaccagaccatgtgaaccaaggaggcttgagtcaatagatttgttctctgtggccacgccaccaccttgaccagaagtaatcccatcgcgggtggatcttggacatgcggccgccgtaggcgtactcggcgcgtcgggcgttgcggaaggcgcagcagccgcaggagcagacggcgatgagcagcagcagcagcacggcgttgacgatggtgacgttgtgccagtggcggcgcagctgctccatcacgccggccctgcacgagtcgcagccgtagcagagcaccgccgggtcgttctgccaccggaagcagtcctcgtcctgcaccgccaccaccgccgggcccgtgccccgtcagcccgtcgccgccgtagacgcaggacgtgggcggcttgcagcatccggactggacgggcgtgaggtcgcggcgcatgtagtcgtacgggcgtccatccggccaccggggggcacgccctggagctggccacgcacgccagcgccgtgcgccagtagcggtcggcggacacgtggccccgcagccacggcgagtagtcccgcatccggtactcgcggtacggcctcccggggaccgtccgccccccgccgcccgccgtgacggcgaggccgaacacggtggcgccgaggaggaagagcacgaggaggaggacggcgaccaggtagagccagagcgcccaggagacgtggtagcgcgcgccgacgaagcccgggagcgagactaggaaggccacgaagccgacggcgaggagcggggcctgcagcgcggactggcacgtggggcccggggcagcggaggcggcgtgcgccagccagaggccggcgccgatgatggggatggaggcgagcagcgtgagcagttgagtagccgatcaccgtgttgctcaggtgtacgcctgctgctgcccgtgattcatcctgatt

SEQ ID NO: 26863 - DNA, 1515 bp, Triticum aestivum
  Clone ID: PAT_TA_26863
ctcggggtttgtgttggtgtttctgacttatctcacatgctctgacctcagctccaatctgagaccctagtccctcgagccgtcgccgtgccgtagctgatagcatcaccgtccgacgccccccacccgctcccaaccctcccgcctctcacgcgcgccgcccccatcgccgtccccgctgtatccactccgtccgcagtcgacgagttttgaggtggacatgcattttgcaaatgtcaggctctaatcagatggcttcagatggtaaatttggaaaaggtcctcgggagctcactggggctgttgatttaattagccgctacaggctgctgaaccatcacagtttcttttgtaagaaaccattgccactggctatctcagatacacattatcttcagaatgttgtgggtgatactgaaatccgtaaaggagaagggatggagatagatcaactcattcagaatccagacctgagggagaagaagactgcttatattaaaccctttgacatgggaacactaggacacgcatttcagttgcgagaaacagcgccagtagatctgccttcggctgaaaaaggtactccaactatatcgggaaaatcaaaggttaagtccagggacaaagtgaagaagcataaaaagcacaaggagaaagacaaggacaaggaacacaagaagcacaaacatcgccataaggatcggagtaaagataaagacaaagacaaagagaaagagaaagagaaagaaaaagagaaggagaaggagaaagacaaagacaaagacaaagaaaagaaaaaagagaagagcgtgcatcatgatttgggaggtgataattccaaaaaacatcatgagaagaagaggaaacatgatggaatggaaaatttggcggctgtacgtaaccacaaaaaaacacaaaagcgcaaaattcaatgaaatgggcagtggactttgtttggcgtaagatgtgacaaattcgtttccgtgttagttctcgtaatatgactccatgttttatgctgttaatgggcgactctgaaggttttcttgtcaataccacttccgatggagttactgatggaatttcctttatcaagatgatccggttacaagggacgcgcccaatcagatcatgatacaccgtaaatcaattctggggaaacttgaacttgtcatttggagttatttgattttttttgtgtgtgtgtgtgtgttagttctgtgcccattagcaattcttgagtgttgccctcctatatgccctgtcctgtaactcagacagaagaaaagggtttactgtcaaagccgcatgatgtgaccgtgtacaacaggagacgtcacgtgtagaagagaaaaattagccgtacacattccatgatccagcaaattcaatggtggtgatgaaccttaaggaactcgagcagtatgttctgtgtaccaatcatgttttcttaatcaaacaatcccagtttaaacatgctatgtcagattgaccgcaaatgagaaaggactagta

SEQ ID NO: 26864 - DNA, 906 bp, Triticum aestivum
  Clone ID: PAT_TA_26864
ccaccaccccaacaacgcgacctaggataccgcccccccccccctcccgccgccgccgtcgcccctgtgcccctccccccccccccctcccccccccccccctccgccgccgcctccccccccctcccctcgctccctcctcctaacctctccgcccacgccatccctccggcgcctttcccatccctcagacgctcagcaggccactcccgagtggtcgcgcgagcctctgcgtcaggcgcagccgccgaggctgagacggtgttcttcgacggcggcgcgcactacggccgaccttgcggcgaacctcgtcctcgggcctggaccctgctgtggctgcccctgaccctcgcttccgtgtcccgtgcgctcctcctccggtaccgcttggacctcccggcaggcgtgaccgtcatctccggggctctgccggtggcgaccgcgcggacttcccctgcccgtcggggcaggataggtagcagctcgtaccgcggttcaacggccggcgggcggagcgtgccaaggcgctgcgaggcggcagaatgctgccgctcaagggccgccgccgagggcgggctcgtggcccggtaaggccggcgagcaaggcatctgctgtgttcagccgtggagcgattttcctttttcttagctcggttgtttgtctgttgtacgtcgtgatgtgaaaactgaaacttctgacggaagctcgatcaggaatacgagctggtgttcttcatcttgctactgtatttttagatcatccttgctactgtggttactacagctgcgagtaccattttctgctgatatttaagattcttgttttgagtaggtttgctgagcattgtgaagactggaaattctgaagaaagctcaatcagtaatatgagctggtgttcatcttgc

SEQ ID NO: 26865 - DNA, 985 bp, Triticum aestivum
  unsure (1)..(985): unsure at all n locations
  Clone ID: PAT_TA_26865
cgagtctcataagtagagcgcatcatttaagacaagcaaagcagtgctcaatacaaatccaccatgaagacctttctcatccttgccctccttgctattgtagcaaccaccgccacaattgcagttagagttccagtgccacaattgcagccacaaaatccatctcagcaacaaccacaagagcaatgttccatttggtacaacaacaacaatttccagtgcatgcaacaaccatttccaccacaacatgccatatcctgcagctgcaaccatttccatcacaacaaccatatatgcagctgcaaccatttcctgcagcctgcaactaccatatcctgcagcctgcaactaccatatcctgcagcctgcaactaccatatcctgcagcctgcaaccatttctgaccacaacaatcatatccacaacctgcaaccacatgtattctgcaaccacaacaaccaatttctgcagcangcatgcatgcatgcagcagcaacaacaacaacaacaacagatccttcaacaaatttttgcaacaacaactgattccatgcagtggatgtttgtatttgcaacaacacagcatagctgcatggaagctcacaagtttttgcaacaaagtacttaccagctggtgcaacaatttgtgtttgtcagcagctgtggcagatccccgagcagtcngcggtgccaagccatccacaattgttgttcatgctattattctgcatcaacaaacaaacaaccaacaaacaaaaacaacaaccgcctgaatcgccacagcatccggcgtgccctctcctgcctccgctccactctccatcagcgcccgnggcccctctccagctatcttccgaggcccctgggggccccggctctcttcacccgttggngataagactccgtaaaccctggttgnatggaaccccatgcangnngtggtccgcngaanacacttgatnncgtctggggngnaaatnnnaca

SEQ ID NO: 26866 - DNA, 1048 bp, Triticum aestivum
  Clone ID: PAT_TA_26866
cagaagccgcggtcttcgcggcgctttggatcgacgccgcggcgcgcttcggcttggattccggcccaacgcagctccgtcgggagccacgcttttgccccctccgtttctttgcagcgtctccgcttttctcggcgtcggtttgtgtccaggggacgccgcgatccggcgtgcagcaccccaccacgcggaggtggcggcacactcttgctggcaaccactgcgcggtagcaacctggccggtcttctcaagttcagaaccttcctgagcggacgctgagcgcagaggacaacaaaccagatccccccagcgagctgctgtccagatccgtcacgagcactcacttcgccccggctaccaggaaggtccccccggaaacgtctgtctaaacccagcaagatcctggagactcaacgacctcaaaaggggaccccaaggaaagccccctgctgcgctgtcgtcgacaagttttctgttggggtcaagcgacgtgcacaaagggttctcctaccgaatgcctgctgctgctgcttctcgttctggctgttccactgaagcaccgaccagcacagctaggcggagagctcctttggtgccacttcaggctgtcattatagccgctgattgcaatcccaaatggctaacaaagcacataccaaccctggcaagcacaaggcaagtccccgtattgtgcctcaaggacaacaaaggaagctcgttgaggttaggtcaagtggcgaatgtccgaacagcgctggccattgggataaaggccaaagacagcataatcaataagactgttgacgaagtgctgaaggattattataagccagtggccgatgaacagtaaattaccccccattcccagtccagtggcatgatgagctagatcttaacctctgtgtgctcaacattacaagaacatctccaagggggaggtttccttttttgcggggacatggggaggggtctctggaatgtttgcgaattgtagtgcatcagtctaatctcaagacttttggggtgacatcttttgctggcaaaact

SEQ ID NO: 26867 - DNA, 502 bp, Triticum aestivum
  unsure (1)..(502): unsure at all n locations
  Clone ID: PAT_TA_26867
cacactcgatccctcctctgacacggcgctacagcggggggagcggccgctgccgcatcccatcggtctctggtggtcaccggctcgtcgccgatgagccctcctcatccgaagaggagacggcgatggtggaggcctggcgcagcgaagtggttgtcgaagccgaggttcgccggagcccatgagcctggngctggcnggctgggacggcggtcgagggccgcgacggcgcgtccgaagaggcggccgaagcgctgctccgtgcaaatgctcgggcccgcagtagcctccagtggtggtggagagttaacgccggcaccttccatccctgctccaaggcagatgacgccggaggcgccagtgggcgctgacacgaagccaagcgcggcctcttcgtccacaatggcgcgcatcgggacgggcgcgtatccaggagggccacggctcgggccaacagcctcgccgacgggcgtcggcgtcgcgggcgggagccacgcggccg

SEQ ID NO: 26868 - DNA, 428 bp, Triticum aestivum
  Clone ID: PAT_TA_26868
cgggtccacggcgaaacgtaagaagataacgttcgcggatgaagctggaggatcgctctgctctgttaaggtgtttagtgatggacagacctctccttctgcatgccagggcgagttatgaacatcattttggctgatagtgtcaggcagttctttcataataagttggttttgataatgaagaatcaaaaaagatggccctggttttttttgttcaaagagagatagatggccctagagttgggaaccaagtaatgggggaatgcttctgtgtcattgtgtctatacttttttcttctagcagtgtatgtttagatggttagagtccatgtgaagtggcttctaaactgttccatcagaatgccacctgttgtaagtttgtagacaagaatcgacttgctgcagtttgatgttgcgggttgaatttg

SEQ ID NO: 26869 - DNA, 770 bp, Triticum aestivum
  unsure (1)..(770): unsure at all n locations
  Clone ID: PAT_TA_26869
cttaagcatcttactggaggaacctatcatattganaaacaaanatttcattattctatatagaggcaagggttttcttccaggtggagttaaacgatctgttattgagcaagaggctcgggtagatgcccagcaggtgaatgaagaagaagcccgattaacggtgatggactcgcttcagatgtttgctggtttaccatctgaggaaacttctgcgggaactttcagagaatatctggatttccagcttaaccatgtgcatgaaataactgaaaacaacttgggcatggtagaactagaggccgagaagcatagactcgagaaggagctgaaagaccagcaacggagactttccattcttacgaagaagattgaaagatccaacgaagcgctggcgaagcttcatagttcttggaacccttcagggcaatctgcagataaagaacttttgacagaggaggaaagaatgatatttccgaaagattggcctaaaaatggatgagcatgtgctccttggaagacgtggtatctttgacggtgtaattgaagagattcatcaacactggaaacataaagagattgtgaaagtaattactaagcagaatcaagcttaccaaataacgtacacatcaatgctgcttgaggttgagacaggaggaatgctaatagcaacacaaaagctcacaaatagccatgccataatactttaccgtggaaagaattaccgccgcccaacaaaatcatcacccagtaatctcctgacaaagaga

SEQ ID NO: 26870 - DNA, 664 bp, Triticum aestivum
  Clone ID: PAT_TA_26870
aggaattcggcacgaggccgtggcgcatccctgtttccccacagcatccgctcgagcgccggcaaggcccgcccggtccgaatgtctgaccccgggcatcccacctcgaacggtgaccaccggcactacgccgacaacggcatgcaccaacgggcacttcttctcaggggactcgtacggagctgtgtcgcgcaacggcggcagctcgacggactcgccggaccggggaagcttcgggaccaaggagacgtccctgagcgagctggacatctacgggagctcgcggtacgaggcgatgctgctgcggggggaggacgtgaggaacacgagctggctgcacggcgggttcgacgacgacaagcccgaccagagccccctgttcgaccaccggttcgagccgctcccggagcccttcagccccttctgacgccgacggccgcctccctgcctctgtatgtaaagtctgtccccggtcatcgcctgattccccacgttccttcgttttgtgttgcaagatgtgtagtatgtatgcccttgttgggccgaaatggatagggctccgggtttgtgtaactcaatttgttgttgccgtggggccggagagtaggtttttcttcacagaagattgttgttgtactaaaatcgaaaaagtacagatagatac

SEQ ID NO: 26871 - DNA, 1071 bp, Triticum aestivum
  Clone ID: PAT_TA_26871
ggggggttcagatcaccgggcgagcgagcgagcggaggaggagggttcagatcagctcatcgctccctccctttcttccccggatccagccgctcccgatcgagatctgccccggcgggcgatgagagcatgacccccgcgcaggaccccttctacatcgtcaaggacgagatccaggattccattgacaaaatacaagatacttttaatcaatggaagcaagcacctgaaaatacaggagagtatgtgcatcttaccagagaactgctaaccacctgtgagagcgtccaatggcaggtggatgagttagagaaggcaatttctgttgctgagagagatccagcttactatggactaaacgaggttgaaattgggaaacggaggaactggactagcaccgcccgcaaccaggtggtatcaatacggaggaatgttgaagctggaaagcacaagactgcctttggacgttcggtcaatccttccgaactaggcagatccaagcagcacatttctcaggataacgatgacttcattgcttcagaatctgatcaacagatgctcctgatgaagcgtcaggatgatgagttggatgcgcttagtgctagtgtccagcgaattggaggtgtaggtctcacaatacacgaagagcttgttggacaggaaaaacttctaggtgaactaagcctcgacatggaaactacctccaaccggctcgattttgtgcagaaaagagtggctatggttctgaagaaggccagcttgaaagggcagatcatgatgatagctttcttggtggttcttttcatcatccttttcgttttggtattcttgacttgagagatggagtttaagttgcgtgagtatttgccatcaggtgtataattgattcgtgtaattggggccggtatagttttgttcttcgggatctgcctctgccaagtaatatcaaagtcatttttcctgttatatggcgaacttcagttgcatgtttaacgatatgtgttgttccccactatattcaatatagaaactcaccgaaagagaacagatataaaggaatggaactaccgc

SEQ ID NO: 26872 - DNA, 954 bp, Triticum aestivum
  Clone ID: PAT_TA_26872
ttgatccgtcgcccgcagggccacagcagccgcggcgaggtcgtccgtcggattcggaggctcagttattactgaaaagataatacagtacctatggcttctctggacgccgtgcgaggagacctcgccctgctgattctgtacctgaacaaggccgaggcgcgggacaagatctgccgagcgatccagtacgggtccaagttcatcagcaacggcgagccagggcctgcgcagaacgtcgacaagtccaccagcctggcccggaaagtgttccggctctgtaagttcgtcaacgaccttcatgctttgatcagccctcctgccaaggggactccgctcccgctgatcctactcgggaagtccaagaacgcgatgctgtcgactttcctcttcctggaccagatcgtgtgggcggggaggacaggaatatacaagaacaaggagcgggcggagttcctcgggaggatagcgttctactgcttcctcggctccaacaccttcacggccatcatcgagctagccgagctgcaacggctgtccacgtcgatgaagaagctggagaaggagctgaagcaccaagagctgtacaagaacgagcagtaccgcatgaagctgcacaaatcgaacgagcggctgctggcgctcgtcaagtcgagcctggacatcgtggtggccgtggggctcctgcagctggccccgaagaaggtgaccccccgcgtcacgggcgcgtttggcttcgccagctccctcatcgcttgctaccagctgcttccaagcccaccagcaaagcagagcaagtgaggactccgactccaagcactgtttaccaggaaaataatccccccggataggtttgatttggttgccacatccccttgtatggcagactagactaatatatgtaatcatcatcataataattgataaaccatcccactatggataggtttggtc

SEQ ID NO: 26873 - DNA, 625 bp, Triticum aestivum
  Clone ID: PAT_TA_26873
cgagttgagccgttctctcggcttcgggaaagggtccgaaagagtagggtggtggggaaaaacctaactattctttcaacaaacgctgagttcgatggttttgatacccatgttgggacagttttgcttcagttccgccatgccatgtgttgcctatcgtagtaggatggatgaggggggaaaattataactagtgtttcagttgcctatcgaagtaggatggatgagaaaagaaattgtaactggtgtttcagttgcaatttggggccaagatcaaaggcttgctatttttttactcagaggcgattcatccggttcgctgaaggcccttaccattcttctgcgttggtttgagcaaagtatgccaccgaagttctaactgtaatttcaagactatagataccaccagacttctagtaaatactcgtatcagagaagctcatatgttgttcactagatttttttcatatttttaaaaatggtgttttactttatgagttgttcgtatgcatttgcgctgtaattatgtttcaagatgaatactagtttctatggtagtgaaattttaaaatctgatttgatgaacttgtgttcggtcttaataatagttgacagtgtgcccatt

SEQ ID NO: 26874 - DNA, 551 bp, Triticum aestivum
  Clone ID: PAT_TA_26874
aacataatcttagtttctgccttcacattgtcagaaaatcatccatccctaatatacaacttaacatgaaactggattaatcatcagtaactccacaacgaacaaaaatgatttccgcaaattgctttgcttcgcgtaattcatacggaaaaactcagcatcagcgaccaataaaacagcattgtggtacagtgcagtgttatagaaaatgctgttccaggcacatcttcttcaaccgaactgcaccaacccgacagaccagccacagctacaggcttattcttcatgagttttgccagcaaaagatgtcacccaaaagtcttgagattagactgatgcactacaattcgacaacattcagagaccctcccatggtccccgcaaaaaaggaaacctcccccttggaagatgttcttgtaatgttgagcacaccaggaggttaaagatctagcttcatcatggccactgggactgggaatgggggggtaatttacctgttcaatcgggccactaggcttataataaatcccttcagcacttttcgtcaacaa

SEQ ID NO: 26875 - DNA, 894 bp, Triticum aestivum
  Clone ID: PAT_TA_26875
gcggggaatctctctgtgtgtagatatccagctgcctacactgtcttctccaaatagcacaacaacaatggctccttttcttaacccctctccagaactcaagcatgccctcctgtggtcagtaccaatactcatcatagctcccacagtgatcttcttgtacatgcaagctgttggcaagaagaagaacaccatccgtcttcctccgagtcccctgaggctgctaatcatagggcatctgcacctgatggtgcacgagccccaccgctcactgtagaggctggctcgcagcctgggccggtcatccacctgcagctcggtggcatcgcggccatcgtggtttcgtcgccggaggctgccaaggaggtgctcaagacgcacgatgtccattgctgcagccgaccctcatcaccaggtgcaaaattgattacttatggccaacaagacatcgcgttctcgccgtacaacgcgagctggcgtgagaggcgtaagctgttcgtctcagagctcgtaagcagcaagcgcgtccagtccttcgcttacgcactagaagctcaggtcggcgagctgatccagtcactctcactacggtctccgcctacggaggccgtcaacctcaacgagaccctcttcacgctcattgacggcttcatcggcagggtggcgttcgggagcatgaacggcgccaagctcatgaagtatgccaagttccagcaggtgttcagcgaggccatgatcgccctttccgccttctccgcgcaggacttcttcccggcgtcaccgatgagccggtgggtcgataagctcgtcgggctggaggcgcgataccaaaggatattcctagagctggactcgtacttcgagatggggctcagccagcatatggatcctggg

SEQ ID NO: 26876 - DNA, 627 bp, Triticum aestivum
  Clone ID: PAT_TA_26876
caacctcagttcttggctccgttgtgcggctgtacgtggctcgcgcccttgatagctaggcgcgcagcgcaatggcggacagcatgcaagagtggccggaggccgtcgtccgcgtgcaggcggtcgcagagagcgacgtggccgccatcccgggctgctacgtcaagcaaccgcgcgaccgcccagaccacgtcctccacgagccctccgacatgagcattccggtcatcgacctcgcctgcctcctcgctggccgcaccgacagcttggccaccgacgccgttgccgcggcgtgccgggactggggcttcttccaggtggtgaaccacggggtggcgccggagctgatgcgcgcggcgcgggaggcctggcgcggcttcttccggctgcccatcccggccaagcagcactacgccaacctgccgcggacgtacgaggggtacggcagccggatcggcgttcagaagagcgccaccctcgactggggagactactttttcctccacctcgcgccggaggacgccaagagccccgataagtactggccacatcccggtatctgcaagtatgtccctatgatcaacatattttttaaacagttttgctagaactcatctaaaaaaaaaa

SEQ ID NO: 26877 - DNA, 443 bp, Triticum aestivum
  Clone ID: PAT_TA_26877
acaacggagttcagctagtctgggcgcgacacctgtgtcggcgaagagctcgtcgtcgccgtcgtggtcgggtgcctcgccggatgcccagggcagcgatgccgcgggttaacctgtacgcctggatggcaacgcggaacgacggcggcggcggggaaaaataaagtggttgccgctaatttagcaactttctttctgtattgttgaacaatgcatgcggaacggacgtgtggtttcccttttgcgattgtttttttttctctccatataaattggacgtgggtttgattgtttcccttgtgcacgggcgtgggttgtttctcttgtgggagcgtgggcctggcagagttttcgtccgccatgttctcttgtttaatagtagtgtagatgttgatactatacttggcaaccatttcagcaataaaatcttatagttctgattg

SEQ ID NO: 26878 - DNA, 698 bp, Triticum aestivum
  Clone ID: PAT_TA_26878
gctgccgggagtatgaggaagttggagtggaggactgactaccgaggatcacaaagacagtaagtaatggggactgagactcagaaggtaccgtgcgttggcgaatatagtgaatggaaattcagaactgtcaaaatttacatacaatagatggcgtggctaacagaggaaaaagtgcagatggtgggggataatatggtactactgattgtgccactgagggaatgcagtcgcgggtatggctaagttttaatcgcacaaacgtacagatataacatataagtcccatgggccatggctatagcacattaatcattaggtgattctcggataattgatactgaagacttgacatatttttttactcacccagaattggacttcatgccttttctagttcaaccagaaaactctggatccttcatgttgtgaagtggtgatgttgcaattaaaaaattaagaaaacagtcaaatttactactctttatctagagaagatggattgtgtgaaggagtatcgttggcactgactaagatctgtgcatccatttcattgcagccaggatatctgaaggaacttcttccagattcagctcctaaccgacctgatactttggatgccctttttgacggtgatcttccctccagtctactttgaagtgatatcggaatttaagttatcaattgcattccatgtg

SEQ ID NO: 26879 - DNA, 481 bp, Triticum aestivum
  unsure (1)..(481): unsure at all n locations
  Clone ID: PAT_TA_26879
gccgtcgcagccgtgccccccgcatgcctccgcttccttctgaacgcgccaacctgtgatctccgctctctctgaatcacaagaagatacggggtcgtagctggtcgagtggtcttccatggtggatcactcgcgcgctgcgcgcaggcgatcgaagtgcgtagtagaacgtcgagaaagatgggcagatgccacgcacgtagtacctccatatttctttccttttttttcttgaaagaaacggtattgaagctcctccatatctcaatgcctgtattctgaattgagatatactcatcctacagtttctgtagtacaaaatggagtaataatcagggccgtacaaaatggagtaatactcatcctacagtttctgttcagtctcccctgctagtaatttcttttttgactgaaaaaaaaaaaaaaaaaaaactcgganagagagagagagagagagagagagagagagagagagaggggg

SEQ ID NO: 26880 - DNA, 618 bp, Triticum aestivum
  Clone ID: PAT_TA_26880
gatgtaatttatttttctggtggagtacaaacttcttagcttgccttgaatgttatgatgcaaagccttaacaataaagttgattctttatgctaagaaaagttctttatccgtctggttgagttgtatacagtgtcttgttctcctaccaaaaaaggctgggcatgtgatgattcttgtttgtatcacctcgatatatcaattgaatgaaatgtcctttatcaaaaaaatgtgatgattcttgttttgtctgcagtgtacgtgtaatccaggaccaagatatgccaaccttccatgatgctccgtgcaagatttcattcacccttttctgctcgaggtagataaggatcactttatccgatgacgtgtagtcacataatactctaaataaagccaattgggatatcttcgttctagctaccaccatccatgtgaagctagcaaggagtacacttctagcgtactttgtgtgcacaactacacattataaggagtcgagcctgattgcctataaatacagattaagctgaggacatgacagttcatcatctcacagtcacacaggcgatctaatcagtcccacaggaagcaagcatcacacggatgagttccgtggac

SEQ ID NO: 26881 - DNA, 564 bp, Triticum aestivum
  Clone ID: PAT_TA_26881
cccgccaccccctgcaatgatatatctgaacttatccttcagtttttggcgtcgtcatccgtgcaagaattatggaggaatttcctggttcatgagatgtcgaggtttgcacgcgtcactggagtggcaatgaaagaacaactaggggggagaccctaattgatcacgagttgatgtctgtaatccttcgtcgatattctcagatcgaccggcaatatgatccagaatgcccatatcttacctggcgtcaccctatcgagccagatttcccgacgcttgtcctggcagagtacgatttcctccacaccgtgtcgatccagaaccagcttgttgctgattctcttaagtatgatctcacttcagtggagctgttttacacacctgttccacggccagagggctggatggctgttttcttcaacatgctgactagggtcatctgggtgattgacccactgtaccacaacaagttagcctgcccacccacggggcaacgcgatgagattatagcatggaagctgcatgatgcattgttcacttgtctgaatgaattctacactggat

SEQ ID NO: 26882 - DNA, 603 bp, Triticum aestivum
  Clone ID: PAT_TA_26882
ttccttgcgtattgttcgaccccccgctctcgtccaatccaagtccctttcatactaagtgacaccttctgaacatcggagtttttttcggaaaggaagttgaaacctcagcctctgcatcattctgaacattggagttaacggagctggctttgcatggcttttcctatgtgccaacccaggtcttgtgatatagatgtgtcatctctctcagcatgacaagttcacaggtattctgcttttgatgaacttcctccacacctgcagtgacaagaaaacgctgaagaagtggttcttcatcgacaagacagtgggctaagaaaatcctgctgaaagagagacgaccaccgtactgaccacactttttcttcgtccgacccgatggatttgagcaacggctcaccggtcatcagtgatccgatgtcaatgagccagtcgttgatgggagtgctgccttccaacatgatgccgttttcagtcaggcccggaggttactccggcgctggtggcgccggcgtaaacgtcagtaggcgcaagatcgaggaggtcctcgtgagcgggctgctggatgctatgaaatcctcgtcgccacgtaagaagcac

SEQ ID NO: 26883 - DNA, 968 bp, Triticum aestivum
  unsure (1)..(968): unsure at all n locations
  Clone ID: PAT_TA_26883
cgcatttgcccgtaagcttctggcttcaccgattctggtagaggctcttcactttcagtatgatgagagggatcccaattcagccttcaactggttagagagatggaccataagccgtgtctggaaacccgtttaccaaacaaagagaaatgctattgctgatgccaaaccgcagacaaagagggccagttacgctatggaaacagagtcagggaaattgaaacgcaatgctcggaagagttctgcattgtcagttgagcccatccctctgacaaacatgccattggaaactgaaaaaacaagaaggaccccaaggaaattcactagcactcctgctgattcagtgcctgatagccaattaactgaacttgagaaggttaagcgtagccttcggaaggtaactaattccatggccgaagcctcaaaggtatctagtcctgcttgtgatacccctgaccacccagagatcgaatgtgagaaaccacaatgtactgcacaggaagttccagtttatcctgagattcaagaacctaaccatgatgatcagttagaaaatgcgaaggtggatatctttgtacctgatctcaaacctgaaggggaagttactccatatgcagtcacaagtgaagaaaaacttgatgagccggccgttgttgctacagcagctgaagttatgcccctgcaagacattgacaatgaagaaaatgctttggtgaatgatgcggagcagagatccagagaagaacctctctccgctgaaagccttaaaggtggtaacaggaaggtcttcgttctcaacgaagccagaatatccagagaacggctccaaaaactctccagctgtgcccagctacatggctgcaacaaaatctgcaaaggcgaagctgcggngacagatatcacctagacttagcgctgattcagcagaaaaactgtctacacacgccgncattcccttcctttcccct

SEQ ID NO: 26884 - DNA, 820 bp, Triticum aestivum
  Clone ID: PAT_TA_26884
cgtccggctgctgctaccacactaccagccagccagaggcagcctcctctccctggaatggaggcgtaggagggcgtccgagccagacagacggagagcgggagctagggttccgcccgcgcatcctcctcttcctcctccgggtctgaagtctccggcgggcggcgggctaggaggcggctccgatggggaagtccccggccaagtggctcaagtccgtgctcttcgggaagaagacctccaggtctggctccgccaaggccaaggatttatcgaaggccgggagcaacagagggtatgttgctggtgggaaggagcccgggttctcggagagctcccctgtgatctccgagccggtgctcgttacaccgcgcaacaatgacgccgtgccggaggtggggaagggtgagaattccagctcgcaaggcgaagcggcggtgcagcacgaggtgaaccatgatttggagaagcagagcactgccggttctgatgtgctgtccaatgacccggagcggctgaaggaagaacaagcagccgttaaggcccaagccgccttccgaggctacctggcacgtcgggctttccgtgcattgaaaggaatcatacgacttcaggcgctgattcgtggccatcttgtaaggaggcaagctgcttcaactctccgtgctacatggttgattgtgaagttccaagctattgttcgtggtagaaatgtcagactctctagtgatgcaattcaattcagttggaagcttgccgagcagaagtctgtgggtgctaaaccagatgcatggagggagaggttagcttcaaatgcatt

SEQ ID NO: 26885 - DNA, 2452 bp, Triticum aestivum
  Clone ID: PAT_TA_26885
cgccgcccgctggcgtctacgtgcacccgccccccccgctcgccccctcgcccgcctaatggaccggcatgacccagctcgtccccgacgtcaacctagcaggggctcggatccggccgcctgcgcctgtcactccgatggcgggaactaggctggcgggcggccggcctccaccgacggaccaggggcctgtcgccggccaagtggaagaagtccgcacccattgggagcgtgaccgccatgtgtggctccgctaaggcattctattgatggcagcccggggaagtctggagggtttgttgccgatgggggtgatcgcgtatgtgctctctgatccatggaaagacctaaattcagctggacggaaagcacacgaatggtttcaacttgtcaaccaatgggtgaaacttcgtagctggggacgacacctactaccttgtgaaggagcagagtcacgcatcaagtatgccatcgagggcgccggccgagggcgaggagtatgagtaatattcctgcacgagtgtagcgaaggtggccgggtggcctccagtcggctcgtgcggcgtgcaacatggaatcatccgactgcacaacctgatgtaagaccgctcttagttgtggagcgtggtcatctgattgtaaaaagttaaatggacagtagaatcacaattagggcttgggggaggggattggtgcaaatcttgttatggattccaagttagttctaagtttgcagctagtacttccatgttggccgatcccgaagcttggagggcggggttagcgtcaaactcttttgcccgtaagctgctggcgtcaccgatttcggtaaagactcccctccttccgtatgaagagtgagatcccaattcaagggtccaaaaggttagagagttacagaatctggcgtggctggaaacccgttgatctaacaaagggaatcctcattagtgcttccatgacccagacacagagagccagatacgcgacggaaacagagtcagggaaattgaaacgcaatctatggaagatgtctgcactgagacttgagcggatccctctgacaaacatgcagttgcaagctgaaagaacaacaaggcccgcaaggaggttcactaccgcacctgagcccacagggcctgggaacctggtcacggaacttgaaaacgtgatgcggaaccactggcacgttctcaaagcgaccaccgggccaatggttgtaagtgatcctcctggagttgacaaggacaagcggaagctcgggaaggtcactcattacttgcccgaaccgacaaacccagataaccctgaaactgatacacctgaccacccagagatccaatgtgagaaaccacaacgtactgcacaggaagttccagtttatcctgagattcatgaaccacaccatgatgatcttctagaaaatgcgaaggtggatatctttgtacctgatctcaaacctgaagtggacgttactccatatgcagtcacaagtgaagaaaaacttaatgagccgaccgttgttgctacagcagctgaagttatgcccctgcaagacattgacaatgaagaaaatgctttggtgaatgatgcggagcagagatccagagaagaacctctctccgccgaaagccttaaaggtggtaacaggaggtcttcgttctcaacgaagccagaatatccagagaacggctccaaaaactctccatgctgtgcccagctacatggctgcaacaaaatctgcaaaggcgaagctgcggggacagatatcacctagacttagcgctgattcagcagaaaaaactgtctacacacgccgccattcccttccttcccctgccaatggtaagcagaactcgcactcgccgcgtacacaaaggccaatccatcctggtaccaaagagggagcgaaagtcgacaagtctatgctgtcatcaagagacgcagctgagagaccgatgaaagctgaatggagacggtgaagacgcggatcctctgttccatttgagtagcgtggcgacggacgtttgggtggacggcagcttgctcctctgattgttttgcttctgatgtaaaaaatgttctctctggtctgctgccgcgacatcaaggggacctgcttaatttgttgtggtgttgcctacctggtgcctgagtttgacttatttttatagggttttgcgacggtcgtgccgcctttggcttgtgtcttgtatagctgaagtttgttccccagtttgttttggttcgcctttgagataccgtgcgttgttaagtgagatcgagagacagacagagatgctgatgttagtgagtaccggtcgtgctgcctttggctgtttgggatgcgttttctttgctgacagtgagtgatccatgacataatttggttatccatccccttgttttcccagctcattttcttgtcagtgagatttcctgtcatagtaat

SEQ ID NO: 26886 - DNA, 658 bp, Triticum aestivum
  Clone ID: PAT_TA_26886
tttttttttttttttttttttcacaatacttcaccacaccgaggggtggcttatttcccgtgtgacacacggttacgtaaaatgtacacaggtttaggaaaatcctactagctcacaagacaacatcaaattgtacaaattggatgcaacacttagaaacaaagctaactacctaactgccccctccagccggattgctgtttcagtaggaggcactgcatgaagcaccatacttgggtttctacacgtatttcgacggtgaccaacatacaccacagttggtgcatttcagctacctcctcagtttcttcggtatgtcacccctgtctggtgtgattccgtgactcccataaaatccatgacttgcgccagaatagcatcattaattgagatgccgcatgttgatccattaaacaccgtcaccacaggcatgaagcaattgaacaaattttatgcaccttcagtgaatgacagaacaacattttcgtgtgctcaaagttgccacactcgcatagaaaccgatcacccctccatcaacggtgacctcatacaccaccttgcaccattttgtcaagcctctccggatggtgccgctgcactaggtacttcacgcgttgctaaactggttcaaccttgtactgccctgcttcgtacagta

SEQ ID NO: 26887 - DNA, 629 bp, Triticum aestivum
  Clone ID: PAT_TA_26887
tactgcagcagggtcgaccaccgtgagctcatggaccacgtgttcagcgagagctacaggcctatgataccggagtccggccagcaccatgagaacttctttgctgacttcgccgacctcgccgagctggagtcagatcccatgagtctcatcttctccaaggagtacatggaagccaggccaagcggtggtgccggcgatcatggtggccaggagaaggcggtggccaaggagctggatccgttcgacatgctagattggtccactacttctagcaccgcagggagcacgtttgagcaagggaagagaggctaaattacttgaggcagggtttacgcatacggttacacacagttgagaacttgagatctccagctaaataaccttgaagattaattaactaccacaaggtcagcaaggaagaaagatgagacttgtttttcttctactttgttacttttcttatgtttgttctctgcttcttcttattattgcttgtgagagagattgattttttgttcaaagtctaggatatgaacggccttaggtttgtgccaacttgtacttatgcatgcgatgaggatcatctatccctcgatactgccctcttcatctgaaaaaaaaaaaaa

SEQ ID NO: 26888 - DNA, 600 bp, Triticum aestivum
  Clone ID: PAT_TA_26888
ccggtcttcacatgtgtcttgtgattttgacatatgatatatgtatatgagaggtacaatgtattcttcacttgaattacttaaagacttgatcaaccatgacctaacatatggacccatcatgatcgcatcttcaagttatatttaatattcttctctttaatcatcctttcaagatttgatccatcatggctcacctctttagcccaaggcaccaggtcatgtcctacacctaccaacaaagccgcttgtcgaataacggtgatcacctccaaagagcaacaactccgaacgactatccttgtcgaggcaccaaccatcctcgagtgcctaaaaagagttggcaggtggatgtcgtgactcagacagacccaagaaagtcatcgtcctgggctcacctgcgactgtgtacatagtgctcctgatgaacaatccagaacatcagggagcaccaaaggaatgctaaagccgtgtctcgacaaacaatgctcccaaaagaggaacgatcgacaaacgacgatcacctccaaagagcaacaactccaaacgactatccttgtcaacgcaccaaccatccttgagtgcctaaaaagagttggc

SEQ ID NO: 26889 - DNA, 633 bp, Triticum aestivum
  Clone ID: PAT_TA_26889
catccggggccatgtcgcctggttttgacacggtggagaggcccactgcgcagtctgctctcacccagcaacgacacacaccagctgcagaaggcatacctgttgatgtcataatgagtgatcggactccacttcctggtctgaattcattaggaacaccatatactgctgtttctaacaaggaaaatgtcaataatatcgactctgccaacatcgactctgccattgggtcctcccaactgactgtgttacgaccaccacttcaatcctacagaggcagcagttcatatgctaatgaagattgtgattggctacacacaaatgatacgtaccagagacaaagctttggaacaaggatgaggccagacaacatactcactgcgccgtcatgtggacacaatcccgtcgacaaatataatggtgctttaattgactactgcttggttcatactttaattacggagggtccacaaaacatgcttcttgatgctgtgataaccaacgatggagatacaatccccgaatcgacagagctaccgagcgatgacgaatcaagtgaaatactcaacaataatgaagtggaggaaaataattgcacggagagcccagaatatacaccaatccttgaagaaa

SEQ ID NO: 26890 - DNA, 452 bp, Triticum aestivum
  Clone ID: PAT_TA_26890
caagcttccgattattacctatagatcctacctaacatggcagatgacctgtccgttgataacagcgaaccagccatcctccttcttctccatttctcgccatgtcgcagcgatctcttccagatcctgctccgtcgcatatccgctgtccagagcccgctgtttgtagtcgctttgcaccgtccgatcggcccagagtccgcaccaccactgtctctcttctggtgtgctgaatgtccaggcggctacgctagcctcgatatcgcttcttgggaaacccgcttgcaaggctatcgcatgcacgtacctgcccatgtttggatgtgccttgagcccgaacgcaatcttgatgtatagttccttccacttgtgcatccctgggtgctctggataccagtccatggcgctgtagttgcactctcggactgcgacgatgccgcctggcttggtca

SEQ ID NO: 26891 - DNA, 593 bp, Triticum aestivum
  Clone ID: PAT_TA_26891
tcttaaattctcctttgttgaccttgccttgacatcgcctcgatgtctcgcaattcttccgcactgttgccaccggattcgtcggttgatgagaaggcgctgttgccgtgagtggaatcgacgccgatcatgcaggggcagagataggtggtggtacccatcatgcgttggtagatatgtttttgcaagtctgtgttacacttggtattgtgtgcgtatgtatgtagttagacaagtaaatctgtttcatggaggagagagtgcagctctgtgaagagttcatgaatacttctgaaagaatgatcagctgacagtctataaaaggtatagaaatggcatgcttggtccaaagtacaacagtttgttggcttgcttcggacagtctttcgccgtgctatatttgtcaagaggtaatattttgtattgtctacacacattactagctggcctgtgctaaatgttcggtcattatgcaggtaatgacatatgagaagcaaagaggatcaaatgattccacatactgggtattatttgaactgatatggggggctacttcagattccttttcagcaaaatatgggaactccattttc

SEQ ID NO: 26892 - DNA, 560 bp, Triticum aestivum
  Clone ID: PAT_TA_26892
aaaactggtctctatgctacgaagtgaaacaagagccaaacctcagaaagacaaatttacgtctcctaataatgccaagttagcttctacaaaacaagaagttaataaagacatacgcaagaataatggcaggccactcagtcagaacggttctgctgtaatgaagaagcaaatgccaagagacataaaaagggaatcagcaactgaaggaagctcaccgccaaagctttataagagttcaccatcaacgccagcgagaacttcaccgccaaagctcaggagttcaccaccaacgccagcgagaacttcaccaccgagaatcagtgtgccagcaaaggcaaatgctacctccagtccagtttcttctgtgcctaatattaaaagaagagtcacagaaaccgtgtcctgggatacccttccaacatgcttgatcaaatctggaaaggcggttgtcaggaggaagactattgctcttatagtagcagcagaggctcaaagggaggctactgctgctgcatctcttgtgaaaggccttggaatttttaccgagatactgaaat

SEQ ID NO: 26893 - DNA, 470 bp, Triticum aestivum
  Clone ID: PAT_TA_26893
gggattccccacctgatttgtatccagttgcctataaggctttgcagctcattgcaagaataggttcagataccaagaaaacactcaatctgagagaggtggtgagaaatagccatgcatggtctctcctatactttctgccaaaatagcaggcttgtcgatcaaatgcataacaagataacatgcaggtgatcaggcttcgttagttaggcccatgtgtctaaaaggataaactggtccctcgcttctactgttcaaatttggtaatctttcttgactctaattagtatattttgagctgttattttattcgaccaaacgaatacctccctattcaataatttttctgtagcatgtttcctttgggtaggaaggattgaggtaggatcaattttattaatagcatagtacctgtgcattactgtcattataagccaaaacaaactgtacaaaaaaaaaaaaaaaaaact

SEQ ID NO: 26894 - DNA, 910 bp, Triticum aestivum
  Clone ID: PAT_TA_26894
tttgacttcaacttgggcaattgtgggaattaggttgggtaagcaattgccgtttcctccaattatctgatggcctggtacccaggttagtgaatagtttgagaaataatatagttacagatttaagccgacaactaagtaggaagctagcctcgtgctaaactttattccatgggtgctgccacctttttcgtggtcacaaaccctttccacgggtacaactattcatactaccttgcctttagctttgatgggttcttgttggcctttctttctctaactcctccagtttatttgctgttcctactaagttgtgaatctagggaagtttatttattgtggaggatgatagctttggatccttcgaaatattagtatagtcgaggaggggcgcgcgcccggcgcgggcctcccgctgcctcccgcctcggctcctgccgccggcccaggtactagttgatcctgcgaagtaaaggaaaattttattttcttgcttgacttcttgatttaccaaaatcaagctcacattaaggtcaaacaattgggcgcattgggctccttgattcattttgcaagtgctatgtgctaactgctgcagtcaaatggaagagctcttcagttgacatgtgatttgaggacctatttagcctcagaaagagcatacgctcaatgtattttgtccttagggtgagggaaggtgatacctatcgcaagatcttaagcatacaagtcaggccttccaatgcggtttctggaagtggtgcctcttctgggaactggaaaattatacctaactgctgccacacttagcacatagtatgtttagactactgtggtgtgttccatgaacttcatggactaagtacgttggtgatggtatatgaaccagtgcccattgttaacctgccta

SEQ ID NO: 26895 - DNA, 485 bp, Triticum aestivum
  Clone ID: PAT_TA_26895
cagcaacagcagccgcagcagcagcttcgatgtaacagtagctgctgagcagggacagtccagctctctgaatggtcagcacctcggcggacagcagcagatggagacgacagccgccgcagacggcctggcctccccgtcgagcgcgggcaactcaaacatcgtcaccatcgaagccgagcttcaggagcttctctacagtgcgaccacgacgaccaccgacagcgtcgtcacacagcaagggggtgtggactggtggagctatgatcagggcaagtccccagtgaattgctgggatttcacccctgaaaccagctcggttctccaggactacgcagctgtggtgtatgacatgtgaacaaagtgtgaagaggaccaagttatttaggggtggtaatagggatttgtgtaggcttggatcttgtaagagtccaaagaaactgtaacgaacttcttgtgagaaatatgtagtagtaagctgctgt

SEQ ID NO: 26896 - DNA, 623 bp, Triticum aestivum
  Clone ID: PAT_TA_26896
gccttcctccaccttcccccgtccgtgcccggcccccccccggcccggccgctccgtcgccgcttccccccttggcctcgcccccgcttatgtgcgccgccctcgccgccgttcgcctgcgccgccgcgtgtcccctgccggccccccggccagggccggcgtcccccgccgcccccttgcctgcccgcgtcccccgtccgcaggccgcgcgccgcgcgctccgcccccctgcgcctgggccgggccggtccgccgcgtgcccggcgccctccccccgccggcgcgcctgcccggcctggtccgggccccccccccgtcccacgcgccctccaggctcctgtccgcgcccctcccggcgctggctcgcggccctgccccccggccgcgctgcccccgctgccgtgcgtctttgccggcctgccatgttcgggctgcaccgctgttcgcccgttccgctgtgatcgtgtcgttccttgctccgcatgttcggtcagccctccctggctttctttccttgcacaacaatttctgtcacgcatcacagctggtcgaccatccatgcatggatctatgatgatggcacgtgtactgtcatgttacagtatgttttacttttactact

SEQ ID NO: 26897 - DNA, 1594 bp, Triticum aestivum
  unsure (1)..(1594): unsure at all n locations
  Clone ID: PAT_TA_26897
gntgccgtttacagcggcgaaatttttcgttaccgcgtgctgaattaagcggagcaagtctcggtgcaccttttgacttaacaaaagatatctgttcggacccaaaatttccaaaggatatacacacattattatgtttattattgactatcacaccagaaccctgaaaaagattcatgtcctaacacccacaaaattgtatgcggctaacagcctcttcttgagatcgtccgtctttcatatcgaagttgatgcgctcaccgtccttcgtgcgttcccaaggatgataacaatgacagtcacatcgtcatggtactttcttctgctcccaacaggtatcctcatcaactgttcggctgttaaagctgcttctttggcagctttatgtacaacttgctcaatgagatattttgcaggatcgccagttggattatcatgcataaattggtaaaccaactgaacaacttcatcattagtgaagaaatcaaacaagccatcactgccaagcacaacaaacagatcgtcttccgtaaccttgtgactcagtgtgtgtggatttgtatatacgtaaggcgggctgcacaaattacgaactcggagaatccccatgagtgcatcattgaactttttctgtttaaggtagccaactccaaaagcacgagtaaccttcagcttcccttttactttgttacccatcacaactttagagtcattaggatggtcagctaatagtttttggtattccaatggattttcaagtgagtggatctctgtcaattgagtagctttcactgtatccatttctgcatatggcatggaagcaagcacagctctactatccccaagatttagaatgcacaaatctgttccctgaagaagcacaaccaggacacaagatccaactgaaactaaatctggtctatcatccatatcttgttcaaccatgcataagaaatcattctcagcttgctcaacagcagaagtgaggcaattcagcacaccaggctcgaaaactttcagaaagttttacatcttcattctctgcaatttccatggctagtgttaactaacttttaaccccattaagggagtcctctgatgagctatataggccatcttgttgcttgatacgacactctaacaagtaaaggtaatatactatgctaccatatagagccaccgccagaaaatcagctgcatctcgtccattaaatctatcataaattctacaaatgaaccatccatttttctcatagcacacagcttggactcaatcctctccagctgctccaccagccatctttacctcggaaccaatcagaaaattggatgatagagttgttggagcactggatctccaaatattttactgatttcaaatatggaactctcagttaaggcggggctgccttgtgaggtggatatcaaatccaaccttcacatagatggagaagagacgatttttctgaaagaatttggtcatagcaacctgcagtccaccattgcaaaagacaacaagggagttcagtaatacttgaactgaactacacgaaataaatagtgtaccataagagattcacttgcaggaatatgc

SEQ ID NO: 26898 - DNA, 419 bp, Triticum aestivum
  Clone ID: PAT_TA_26898
cggcacgagctggctcgcgcggccgagggactagcgtcggcgacgttcgactggctggctgttgggccgccatgggagggagacgcccgctctctgagctgcgaattggattcttcggagattttgagtacgtacgactagctagtaagtatatgtggcatgttacacgcgatgctggatggctgctgccgagtagtagtagtggacaactagtagtgtaaccgtaacaagtgagatgttatctaacttaatccatccggccggagtattaaagggaaacacgtagttgcagaacactccggttctaatctacggcttgcagctccctgattgtaatttgtgttgacctgtacaaccttttctttctggccgcacgtacgtaatgttttagagcatctccgacggacgggcggggcgct

SEQ ID NO: 26899 - DNA, 1096 bp, Triticum aestivum
  Clone ID: PAT_TA_26899
ttttttttacaaaatgatacttcaacatgaccttgttccctgagttgctcttcgcaatcttgataatattgtcaataaagtaacaatgcaaggaggagcacaaagagcattcaaactattcagggtgactcatgtacattggccttcattcgggttttgtggatttatgttttattctgcccgcgttgctcttgcattcctgactgataatatcgtctgataaagtaacaacgatgcaaagaggagtacgaagagcattcaactattcacggcgactcatgtacgttgtggcctacgttcgggttttgcggaattatgttgaactgggcgggcgatcgtccccgagaatacagaggaagagccaccggatgcagcaggggaaggcgaggatgctacaaagttgaatgctggtaatgatgccgaggggtggtgtccgtgatgccctagtacctgcgaagcgagacgggcttgccgtagagaaaggtgctgctggacttcttggagtgttgccagggttgtggttgcgagaaccgaatggagacctagcaaaagaggctgttgaaggggaaatactgtggacatgatgcaaggggcgtcccaggagtgccctggttggaaccagcatctgactccccagcaaactcgctgaaattgacatcaacggtcattctcgggcacctgtctaggaacacttccatcagctcgtgttttgtggcggctgaggcatggcagcacgcagtgaagcctgcatgctacgtgttctgatttcttcttcggcattcaaaatctgcttcagcatctgcacaagatcatgctttttcttactcaaggtatccagcttgtcggtcaactctctcttcctttcttcaactccatcaggttgacccacctccgagttggggtcgaagccttcgctttcaccttgcccttcttcggggtcaccattgccgccggcatcggcatccgccggcgaccccccccccccccccgcccctcgccccgatgctgctgctgacccccgtccacctccggcgcctcccccacggccacgggccccgcggcgccgtcgtccgggcaggagttggcctcgtgcccg

SEQ ID NO: 26900 - DNA, 806 bp, Triticum aestivum
  unsure (1)..(806): unsure at all n locations
  Clone ID: PAT_TA_26900
ctccnttttntttttaaaaaagtcattccgcacaaanggaaaagggttggtaattacatatgcacacgaatcattcaggagggccacagcaagcagggcgttttcattaggcgtcagttcaaggtgcatgccagcaaatagctgcagcccacaccaggttcgagcaacagtttcaccaggttcgagcaacgttgacagcaacagtttcgtcagtagcaccgcgagacggaggccagaacgggtgtgtgctcctcacaccaggttcgagccaccatcgccgggccctgccgtcatcggcacctcctcgacgtgcaacggcttcttgtagagctggagcagcagcgacgagcagacgacgctcaccgatgaggcggccatgcaggccccggcgagccacgggggggagccggatgcccgtgaacgggaacaggacgccggcggcgatcggcatgcccaggacattgtagcccagggcccagacgtagttgagccggatcttggcgagggtcttccgcgagaggtcgattgccgtgatcacgtccactaggctgctcttcatcaagacgatgtcagcggcctcgatggcgacgtctgtgcccgcgccgatggccatgcccacgtccgctgcggccagggccggcgagtcgttcaccccgtcgccgaccatcgccacggcaagtccttgcgtctgcaagtccttgatctgctcagcttttccaactggatcaatctcagcaaatacggtgctgatcccgacttgctttgctatggatttggctgtagcccagttgtcgcccgtcaccatg

SEQ ID NO: 26901 - DNA, 423 bp, Triticum aestivum
  Clone ID: PAT_TA_26901
atgggggccacggcggggcgaccgggagcaacgtgaccgttgatccaatggaggccgatgaccaggagagcaagaaaaatggcggcggcggcatgtcgtgcgagcagacgccggcgtcgagccctttcaacgggctagagagcctgaacctgatggacaacctcaacacggacggtggttggaaggatttgctagagcaagtgtcatggctgaactcaagtgagctgtgatgggtggatagaacatatatgatcaagaatgccaaacataaccagtaatgagattgagaatactaattgtttgattggatgcacattttagccatgtacaaaaaaagaacggaagaacatatacacatgtacacactcactgcaattaatgttcttttatgtttaattagttaaaaaaaaaaaaaaaaaaact

SEQ ID NO: 26902 - DNA, 698 bp, Triticum aestivum
  Clone ID: PAT_TA_26902
ggctgcggttgggctggttgtagtggtcttgaccgctcctcggcggattacatcgggtatgaattatactccatgcctgttgtaaactgcagtattaaataattctatcaacctgccaaatagcctagaaaagaagttcaaatgccatgagatgtgctatgagctcgagccatgcaatatcaacacattttggtaggagcagagtgtgcttgttatttgattcatgccaactatttggccagtttaatgtttgtgctattatggttcattgtgcccattacgtaagcgcatttatatctgctagaacaagaatttcatttcaataatcaactgaatgtaactataattgcatctcataaaccataattcatgccaacttttttgctagtataatatctgtagtatcatggctcaccgcacccatcgcgtaagcacatcctaatctgctagaataggaatttccattgactaattaacttaactgagtgtaacaataattgcatcttacaaaccatttaatccatgactatatattgtctacatttttgtgcaagctcaaggctacctgtaatttataacctagtttctgtccattattttttttgttacaaggcatttcttgttaagtaaccacatgatttgtcgttatagtaaataatttggggctgaatctgcccgtgcaacctttttcctgcttt

SEQ ID NO: 26903 - DNA, 688 bp, Triticum aestivum
  Clone ID: PAT_TA_26903
gctcacacttactctttggttcactagagatagttcctttgacgaggatccaaagctccttagttttctatcccagacatcactgagctatgagccagctgatcagaactcttacattcctttgccggcctcagataacatgtactggttttcctacgatcagtctggctttgacatacgatgtgctagaatgcacattcttgggtttagttttcgtgcaagcagcgatgaagacagtaagagtacatctgctgcaccagctgatgaccccatagagttgcttgggaagccactgcgaattgggagagcagatgatgtctttgggaagatatttgccaacagcttgcatgctcttcaggtggttcagttttactactggaaagcacctgagctggcatcaaggagaaaccagactactggtggttcagaaacagtttgctatcctactatacaagtacaacggtcaagtggaacggaacttccattaccgtgtaaccatggacttgcacaaaccatatttggatcatatggcaatgtggattctgttattgattggggatgatgttgtgttagctcttgctatgtggggagaattattcagaagaattgaagagaaagttgtcgatattcttgccaaattggctgtccaatggaaccatttttgttgtagatccctccgagcccaccc

SEQ ID NO: 26904 - DNA, 646 bp, Triticum aestivum
  Clone ID: PAT_TA_26904
ttggcaatgttcgcaagaatatattccttgcgtacaagactcttggtgtggtttttggtggcctcgttacttctcccctctatgtttatccctcaatgaacttgtcatcaagaacatgagctcactgcatacagtcacaatttttgtgaccctgaggtacctgctggtttccaaagttgatcaacgggaaagggtcctgatcaagaggctcggacctaggggggtgtaccagtgcaccgtccagtatggctacgctgacaacctgagcctcaaaggaggcgatgatcttgtcgcacaggttatgagatgcctgaagcggcacattgcgatgagcaccgaccggcgttcatctgtctctacggaggaagagatcgccaacctggaggcggcgagtttggccggggtggtgcatgtccggggcaagatgaggttctatgtgggtgacgatgccggctgttttgacaaggtcatgctccgattctatgaattcttgcatagcatctgcagatcggcactgccagctctcgggatgcctctgcagcagcgagttgagatcggcatgttgtacaaggtttgaggcgctgcatcaactgttttttgtatgaatctcatgaaaatggtcactctccatactataccgtcatgt

SEQ ID NO: 26905 - DNA, 330 bp, Triticum aestivum
  Clone ID: PAT_TA_26905
tcatcccctgtctctctctatcctttctctgtgaaaatccgaagatctctgaagcgaatcgaagagaaatcgccgtgctcctccacagccaacgagaggatgggcgacgctgcgctgatgaggagatggtttgcagagtttgcatgagcccttgctaccgcgagagcaggtcaagcgacattagcatgtatgtctgggagtttaaaaacgcagggataaatcagcagcctgtattttttcatttttttcattgtatgatccttattttttagtttgtactcatcatcacagaatatattattttttgaagcagtggggagcccctagttt

SEQ ID NO: 26906 - DNA, 583 bp, Triticum aestivum
  Clone ID: PAT_TA_26906
aaaataagcggaaagccactcttgaacagcgaaatccctttgatctgatccacgctatgtactacacctccaaattactccgggtaaaactacagccggaggaaaaaaaagaaagggggaaaacgggatcggaacgggaggcgcggtggtcaggagcagggcgcgggggccgccagggccagctcgcgccggcggccgaacacgatggcgcactccgggagctcgccgagcccagcgaacagcgcgtcctccccctgcagctcgcgctcccagtcctccggcggcggcgccacgtcgaacgccggcacgtatagcgccgtccggggccacgtcgggtactggtcgaaccacccgaagtcgaagctctcctcctcctcttcggccgccgcggtcaccgtcgtgatcgccgcggggtcggccagaccgatgacaggcttctgctcatgttcctcctcctgctcttgctccggcgcttcaggcccttgctcgggctggcactccaccggcgtgccaggctcgggcttggggtccaccagccgcggggaggacttgttggggtggcagccggtcttgggcgccaaga

SEQ ID NO: 26907 - DNA, 504 bp, Triticum aestivum
  Clone ID: PAT_TA_26907
tcatgcccacgggggcggtggtgatccaggtggtgccgtacgggaacctagagcacatggcgaaggtggacttcggcgaccccgtggcggacatggggctccggtacctcgagtacagcatcacggcggaggagagcacgctgctggagatgctggggccggaccaccccgtgatcaaggaccccgagtcggtgcaccggagtgggtgggacaaggtcgccgagtactacctcggcaagcaggacgtgcgcgttgacgttggagcgcttcgcgcccacgcttgctctggccatcgaacatcttcgacagaagtagaaaattgcatgggccaccgagaattcgtttttttttgttggtacagtttcggggcattctatggcctctgaatttggtggagcatacatacatagaagaattgctggtatattggttgatttatttacctcaagtgaatagaaaaattaacttgtttcagtaaaaaaaaaaaaaaaaaaaaaaaaaact

SEQ ID NO: 26908 - DNA, 277 bp, Triticum aestivum
  Clone ID: PAT_TA_26908
aatgccaccattctcgagctttgttgttttgcgtgtattagatttggagttgtatgaatatggtggtgctaaggaggaccatctcaaccttcaagagttggggagtttgcttcacttgaggtacctacgtctatttggaagaagaactgttgagttgccggaagagattggaaagttacagtttttgcaggtgttggttttgcctggacgtacaagactgccggcaactgtgattaagctcacaagattaatgtacctactgattgatggtgggagg

SEQ ID NO: 26909 - DNA, 366 bp, Triticum aestivum
  Clone ID: PAT_TA_26909
ctcaacaaccacagcaggtcaccggctccgccggcgccaggtgacggcatgatccagattgatgtctggggcgagctgtccaactccacgggcaacgagaagcatggcagggattaacgatataccatcccgatcgatcgattgctcatctgactgaagttgtttcgatcttcttgtgtttgcggtcttcgatctagctcttgcttatgcagtgctatgttcggttcctacaaaattgcaccaacattgtactattgttacttctatgtactaatgcaatggatatgtgcctgctgtacctgaaattatttcgacttgtattaattgtttttggcatgcatgtcatctttagaatgatttttctac

SEQ ID NO: 26910 - DNA, 543 bp, Triticum aestivum
  Clone ID: PAT_TA_26910
gctcagaaaaaataatattagtgcaagtttaaccaaaagaccttcaccactcaaatacatcctgtttttttcgcaaacctagaatggcgcaatgaaacatcgagcgtcccgacggaaccaacaccccatgacgacttgagtagcaactgttactgtattctgacgacacaacactctagacaaaagctcgcctcatattaccagttcacctcatctcttaacggtggctgaacaaagcacggcctacgatgccagttgcctcaatgtaacgatcaacacagcgtgacacgcagctgctctcgcttccgctcatgcttgatcctggcttggtcacacactttgcaaagcacttgttcccgacggtctcaagaagctcctgggcataggcctgcgcgagctgcgccttgatctgctccatgagcgcctccgggttggggggcgaccctgacgacgacatcgacggcgacgagaaggagtccatgccgaattcgccttgcttgccttccaagaattcactggtgctcggtggttacggtgcgttct

SEQ ID NO: 26911 - DNA, 991 bp, Triticum aestivum
  Clone ID: PAT_TA_26911
taatgggtttgctcagaattttttttgataagagctagtttaacttatttgttgttcagaaataaataatattagtataagtttaacaaaaagaacttgaccaattctaaatacatcgtgtttttttcacaaacctagaatggcgcattgaaatcgcaagcctaccgacgcaaccaacaacgcatgatgacttgagtagcaactgttactgtattctgaccacacaagactctagacaaaagctcgcctcatattaccagttcacctcatctcattactacccagcttcttaacggtgactgaacaaagcccggccgacgatgccagttgcctcaatgtaacgatcaacacagcgtgacacgcagctgctctcgcttccgctcatgcttgatcctggcttggtcacacacttcgcaaagcacttgttcccaacggtctcgagaagctcctgggcataggcctgcgcgagctgcgccttgatctgctccatgagcgcctccgggttgggggacgaccctgacgacgacatcgacggcgacgagaaggagtccatgccgaattcgccttgcttgacttccaagtattcgcgggtgctcggtggtttacggtgcgttctgcgccgaaggtttctggggacggcgggttataccaaggtcggggggcggcgcaaaggcacggacgcgtgggcggacgcgtgggccaccggccagcccctcggcccccaccacgcgatgcaaaggtaaaagttaataataatggaactgcagcaagcctagaaaaatccacaatgacctgtgcactcgcttaccccttcccaaaagatttgtacaatttgcagccaggcgaccacttttaatgctgaaaacctcaaccgcccataagcttgctctttctcatatttcagacgagaacacagctaaacaggccaaagcttttcaagtgggaaagcaatcctaatttatactatggctatttctcattaaccaacact

SEQ ID NO: 26912 - DNA, 566 bp, Triticum aestivum
  Clone ID: PAT_TA_26912
gggtgcctcctccacaactccgtagattggctttcccggcaattcaaagttggttcgagacattgccgtcatggattaatccttcatcccttcctctcctctcctatctggagataacgttgtttgaagtgcgaccggaggtcatccaatttctagggactctacctgctcttgtttatctcgagatactggatcattctgtgttccaagaagcgcatgaggtggaagcgcccgtcctttcctctaatgttgcattattcccatgtgcgacagagtgccgcttctatggtattggtgccgtgccatctatgtttccacgaggagctgcgccgaggcttaaacagcttaggttcgctttaccagcgaagtgggtctcccgtgaaaacattgatttgggcatgaggcaccttccttccctccagcgagtcactgttacagtttcccaaggagaagctaacgatcaggaggtggatgaagcaaaggctgctgtgagggccgcggtggaagaccaccccaaccgtcccgtcctcgagatttaattgacccatcacgcacgcataggaaaa

SEQ ID NO: 26913 - DNA, 651 bp, Triticum aestivum
  Clone ID: PAT_TA_26913
tccctggcgcatacatgcttccaaatcttctgcaaatcaggagttcatgatcaagaaatggttgggagccatacatgtgaatcagagacagtcaaaagtaatcgtctagcttctcaaaaatgggttgctagtgttatcaaggaaaaattacgtgacagtccaaactacaggccaagagatattgcaaatgatctccagcgtgaatacggactaagcctgaactattctcaagcttggcgaggcaaattaatagctcgaaaagaactttacagtccacatgaagaggcatgtaatcagttaccttggtttcgtgatagaattttcgcaacaaaccctgggagtatggcgacagtagaggcattggaaggttcaaagttccgcttctttgttgcattccatgcctcccttcatggttttgagaatggttgcaggcctcttctctttcttgacctgataactgtgaaaccaaataagcattggaaactattaggtgctacttctgttgatggtgaagggtgatgtgttccccgttgcattatctgtagtggatgacgagagtcaagaaaattggcattggtttcttgaacagctaaaggcatcgttgcctatgcctggagacataacattcatatcaaatggcagaagtggtct

SEQ ID NO: 26914 - DNA, 592 bp, Triticum aestivum
  unsure (1)..(592): unsure at all n locations
  Clone ID: PAT_TA_26914
tcagaccagctcataccggattcgtcgaactacgacctccaccggatcatgggtgcggtgcctgttacggcggtgaacttttacaagctcctttcagagaagcaattcgttttgctgtatccgggaggcgcgcgtgaagctcttcataggaagggcgaggaatacaggctattttggcctgagcagtctgaatttgtgcggatggcatcaaggtttggagcaacaataataccatttggagtggttggagaagatgatatatgtgatatgttgttagactacaacgatcttatgaagcttccattttatgacatccttgacaagaagctaaatgaagaggggctaaagctaaggactgattctacgggagagataaagaatcaagatatgcatcctgtagtgctgacgccaaaaatgccaggaaggttttacttcatctttggggagcctattgaaacaaaagggagggagaaggagctaagagacaaagagaaggcccancacctctatttgcatgtcaaatctgaagtggagagctgcatcaagtatctgaaggagaagagagaggaggatccctacaggagcatactgc

SEQ ID NO: 26915 - DNA, 652 bp, Triticum aestivum
  Clone ID: PAT_TA_26915
cggcacgagccacacattgaagttcagttctgatcaaaggcgatgaccttcacggaagagcaagagcaagcacttcagcttctcagctccttccaacatctagaatttcatgattgcaacaatctgcagtccctccctaaagtgctatgtggcctttcttctctcaagagactaacgatctggggttgtgagaaaatcctttccctgccgcccgaggagggcctccccgcttcactggaaatcctagaagtaatgtattgtagtcctgaggtaattgagcaggccgagaaattggcagaaagggacccatggttttcggtagaaatatatgagtagcagagtcgtaaatgtatctcttctctgcatctctctcgaccatggatggtcgcacaatcgcaatgagctgatcgtggtggcaaagggccagagtggcagctgcagggtcaaggagaggaccttgatttggcatcatccttatcatcatcttattcctcagctgacaagtgagcaacaggaatcccttgctctcctgtgccttaaatgtattgataatcttcttcagacttttggatagacttcttaagaaacatgaaacaacacttttgatggtagctctctgacaatttcaacgtagaacaatatcaattgaaaa

SEQ ID NO: 26916 - DNA, 562 bp, Triticum aestivum
  Clone ID: PAT_TA_26916
atcgctttgatctactccacttagcattgctccaacttccacgagccgagtagatggccactcaccccaatttccatacgactccatttggtgggtccgtacagatgaccgagtttaaattcagtagcttgtactggcgccacatttattcgggaccgagcccaaaccaatcaaacatcatagctgcagatgctactactgagtggggccagacattagctaacaactggactatatatgatggggttggcctcaacgccaagctagtggcccgtgcacaagggctgcatctctacgctggtacttggcacaataccttcaccattgtgttcgagattgaagggttcaaggaaagtacacttcaggtaataggagcatctgttgagaaagaaggtgagtggtctattgttggggggactggtgaattcgcgatggcacgtggtgttgtaaacaaaaagctgcacgggaacatagatggtggagacataatcgagcttaccatccacggtttctgccggaagcagatcgctctcacgaaggttggcccatggggtggcaatgg

SEQ ID NO: 26917 - DNA, 661 bp, Triticum aestivum
  Clone ID: PAT_TA_26917
gtgaaaaggaacctgtaatatttacattgcattagaaaatttcagcaaaatctcaatactgcaccacaaatacagaatctgtctgggtggttacatatcaacttgagagcgattacatactacagatatgactttacaacaattggctacaaatgaatggatttgatgtcagagcaacacccatttaagttacaacagcgcttttgcaattgcaaacagctatcatgcctaaactattttctccgagcggtgctttggcagctggtctcaagagctaatgttagcatgtcagtgcaaaactggtcgtctggtttcaaccatagagccttgtggtagtaagttatggcagcttcaaaatcatccataagttggtacgtataagcaagaccagaaaatgcactcagagtttttgttggaaaagtgagcgccttttcataatatgatattgctttcttatattgcttcagtttccgcagtgtgtgtccaagattcaccattgttggttcccacatttcatttggggacgatgaagtatgagtcagtgttaactcaaaccactgaactgcattttgatactctttcatattataagctacaacacccagctcgttatatataagtggatcagatggacaaaatggacttcgcttgcatgaagaac

SEQ ID NO: 26918 - DNA, 616 bp, Triticum aestivum
  Clone ID: PAT_TA_26918
aaccaaacacgattagagtgttgaaaaaacataagaacgcctcgatgatactgtccgagtcttttgtggggatgactttgataggtcacacattatcaagcataataaccagacaggcagatggatttctacattcaaggcaatctggggctggaacgacaccgacctgtttatcggaaacatgagaagggcaatagatattatctcagttggtggcgatgacagtagcctctcagcttcgaacagcgcaagcctggagagtgaacacatgacggccattccgtgcaggttttctgcgcatccatataaagttgggcatcttgcttgcgcaagctccggtggtaaggtgttcttttggaccagagcttgaatcaacaagatctccggtggctggcttgcggattgttgccgcttctgttggtagtcatgctaggaacctagtgcttgtttagtatccagctgaagattagcatagtgtaccatttttctttctaatgttgtagtggtgggaggagttgacgctgtcagagaaacgctgggcagctgggaaccggtttttactggctgagtgttttcgagttcgtatccttaaaaaaaaaaaaaaaaaaaaaaaact

SEQ ID NO: 26919 - DNA, 567 bp, Triticum aestivum
  Clone ID: PAT_TA_26919
tcctttaatcggaggacatggcaacctgaggactgtagtattggctcatggctcaacggtaaaaatactgtggttcgtggagctccagtagtaatcacttctttggatgacttggcacctccaccccttctccagagatttgaattctcgcttcacagaagctgcatattctcacgaatacctccatgggttaaaaaacacgagaacctaagcattttgaagattgcagtgaaggaacttcagatgatttgtgttggcattctcagaggattgcctgcccttactgctctgtcgctgtacgtggagacggcgcccgttgacaagatcatccttgacatggtggggttctcagttctcaagtacttcaagttgaggttcctgactggtatagcttggctaaaatttgaggaggattccatgcctaatctctcgaagctcaagctagttttcaatgccatcccccagatcgatgaatatgaacatggtattatcagcatcggccatatgccaggccttagagatatcactgtgagatttgggggtattgctggtggttctgagtatgac

SEQ ID NO: 26920 - DNA, 541 bp, Triticum aestivum
  Clone ID: PAT_TA_26920
cttgaggcacgcgtactcgctgccgcgtgaccgcccgatcaagctcggcgacgtccgtccgcccggcgggcgccgtcggcgtccgcgaatgatcatcctggagaggacaaacagccggaagatcctgaacctcccggaggtcgtcgcggcggcggaggcggcggggttcaaggtgaccgtggccgggcgcccgaaggccagctacgacgagttcacgcgggagatgaactccttcgacgtcatggtcggcgtgcacggcgccgggctgacaaactgcgtgtacctgcccacgggggccgtgttcctgcagatcgtgccgtacggccggctggaggagatcgcccggaccgacttcggggacccggcccgcgacatggggctccggtacatcgagtacagcgtggcggcggaggagagctcgctgatgggcgtgttcgggaaggagcaccccatgatcaaggaccccgccgccatccacctgagcggctgggggaacgtggcgggagtggtacctcggtaagcaggacgtgcggatcaacgt

SEQ ID NO: 26921 - DNA, 694 bp, Triticum aestivum
  Clone ID: PAT_TA_26921
cccgtttccgcgggaaaattgttgtagagcagtagaactgcggatctgtgattaaggctgttgtactcatcgatgccctaaatttgcagtgataagtaggttcgaatatgctggtagcacaattatcagttgtgactgcctcgttaaaaatatagtgtacaaattagcttgcttgctgatgcagattaacagagaaccgaagtatcactgtaacagaaaactttacgcctgcataatttctttgtagcttaacagttgttaaattctgggttcttacctacggatgagatgagatcaatctcaagttctcacttaattggtgtttgtgttcatattcccctttgcaagttactgcggttgcatgtcttggctcagatatgattaacttatcttatgatcttatctgtacaaaaccatgaaaccagtcagtattggtaataaaaaggaaacttggattcagtaaatatctgactctgaagagcttaggcctttcatcatggcatgtcaggctcgtactagacaacctttgcaattataaccttcaaatgctgattaccaaacttccgatgtaacactgtctatgtgcagtcagtttatgcacttgtttccactaatagtaaaatgcaatggtctctcttcattttaaagaatacaatacagtagtcttcaattgttaactgaactttacttaatc

SEQ ID NO: 26922 - DNA, 288 bp, Triticum aestivum
  Clone ID: PAT_TA_26922
ctcatcggcaccatgaggtacgacatcaagaaggacatcggcggggtgatcgaggagcgagcgagggagaagcaggtgtgggaaatggtggggacgctcgtggggaacgcgctcaacaccatgccgtacctcgtcgattatcagcccccaccaaccgcctagttaaaattggtgcttgctaaatacaagcacgtggttggttgcaattatatatgcgatatccagaataaagtttgcacactagcggaataaattcttggagatttcctgaaaaaaaaaaaaaaaaaa

SEQ ID NO: 26923 - DNA, 766 bp, Triticum aestivum
  Clone ID: PAT_TA_26923
ttttgaaggaaagccaattctccagtggtcgtagtagtctttttcctgctcctcgtcatcgacatcgaaaccacaaggaaagggaaaggaaacaaacccgaacaagatcggcgaaggcccagagtaggtgacacgtcatgggtaccagcttcgacgtacacgtaaacacagtacgatcaacaaagagaattaaacgcgacgacaagtccacgacacacggcgaagacccctagtagaacccctgcaccggccaccggcggtcggggtccggcagccacgacgaccgcttcttcttctgctgctgccgctgcttgtccttcctcccctcctcagggccgtcgccgccgacgtctcccccctccttctcgccgtccggagctcttggagtcgccgtccgaacgagccgccgcagtacccgccggcgaccaacggcccctgccgaagacctgtgcatcgaccgcacgtactgggagcagcctccacgccgccggcttctgctgctgctgctcccgcggcgggggcgtcagggacgcgctccgcttggacggaggaggcgggtcctcggcgccggctgggtcgtcgtccgggaggcgcgcggactgggacagccgctcgtaatccggcagcggcacgatctcctcctcctccgacgcgcactccccgtccgcgccggccttaccgccgccgacgctgtccatgagcagcagctggtggtggctcttcgacctcggcttctgccgccgcgcgccacacctcttgcctccgc

SEQ ID NO: 26924 - DNA, 698 bp, Triticum aestivum
  Clone ID: PAT_TA_26924
tttttttttttttttttttttcagtctaacgatccaactcctggtagtattactcaaaaagcagaagataatatttacttacagcagtaatggtccaatgcaaaacatcaaatctcgttacaaaccattggtgcatttgttaaaaaatgtagcatgaaatacctaaagatcaaggtttgatacgatataccaaaagcaggccatataagttgtttacactgctttaatacaacatagtactaaactatgtagttggctatgattagcttgctccaaacaccttgtcatctgatttgcttgagtgttgcgatggacgcatcttcgttccctcatgatgtaagtgtagcaaagtttggtgaggttaggcctcaaagagggccaaacacgttgacgggccgtgttgctcttgtcgctgctccttgagcgcttggaggaagggagagaaggagcgtaacagcaacaaactgtccaatctttcttggagaagttcttgttgaccggagctttgtagtagaacgacgcctcctctagcaccactgggccctgtggaacagagccaacatttatattatttttgcagtcgttggatccagtgtctttattttgatctttgatttggctggttaaagtgaacaacttctgcaaatcactttcatggctttcaaaaagcattgcgagtagctttgtctgacaccttg

SEQ ID NO: 26925 - DNA, 697 bp, Triticum aestivum
  Clone ID: PAT_TA_26925
tgctcaataggctcacttagtaatatccaatgccctcgcagggtcttaaaaatggctgcagagcacagatgaacatctcattcattttctatggattctttacagtcaagcacagagtatccgaaagtggaaaacgcgatgaatatttgtactgtgtccggttagacaaggtttacgtctgacaaattgctgcactatgttgatgcaacctaatacttccatgaataattggtatttggttggcatgcccatgccctaccagtataccaccatctgtgtcggcttgctcagttgctctagtgtgttcctatcatggcacatttgtttgcagtctttccatctctggaagccgctaaagctggcactgatgcctggttcaggatcaagacacagacatgctactgctccttttgtggccaaactgttcattagctcctaaagctatcgggattcaggatatgctcttctgtcctgcggagtttctttgcagttatgctcttggagttggacagctcgagatgctctctgataaagaaaatccaggttcaaagatatcatggatagtcagaaatcttggatacacatttcagttcatgttttgcttccttttatcacaaggtccagcgatgctgacggtatggcagcactgcacatcaaaagccgtatgatttttgcctcttgactgctctggtctctg

SEQ ID NO: 26926 - DNA, 1307 bp, Triticum aestivum
  Clone ID: PAT_TA_26926
gcgccttctgatgggcaagtaaacatgaaatcttttatcctcagaacatattcagcaacagggatcacatcgatgcgctcatcatttgctctagtttaacacaaggcccaaactcaggggctgcaagttcaactccaagaaatacaaccaccatcaattttacatgtgctatttacacaagggtatagtacttgtgttttgtatgctacctagttcgaaactgatatctttatgaagacgacaacgtgcagtaccaagatatagagaacaaaagcggacctaagaatcatgagccttttctggccttctgttctaaaaccaccggattggccgggtctccgggcagctttggagccagaatcttcatccccgctcagaagccctccgccgaaccggttccgtgctgcacctgcttcgctggagccgctgtgaagatttctctgtatactgttcaacctttccagatccttttctttggcatgtatatcagtgatgagcctttcagcttgagcttgtttagctgtcaactgttcaatgaggctatgtaattgtttctccagtaccttctccctctgggcaggacttggatttttcaaagattcttcttcaaccgaggaccatactttctccaatctttgtatcttgtcttccaataatttcaactcccccttcttctcttccaagtctttagacttgagattcatcaacgattcagcttctagcagagcatttccagtagcttccgaagcagccattgatgctttatgttgagcagcctcttgctccatgatagcattgtcaacctttgcttttaaatccagctctgcaatttccatttccttcaaattactctggagcacagcagcctccatctgcttctcctgaatcctcggccggcaatcggatatcgccttctcataggcggtattttcctcttgaattttcacctctctatgcagtgcctgctctttggtggaggagtgggcgttgagctggagtgcgagggcggcagaggaggcgagcgagtgggcgtgcaggtgcggcagccgctgcgccacgttcggcgggggcacgcgggcgcgcaggtcctggatcgcgcgccgcagcgacgatgcccgcgcgtccagatcggcggcgcggagccgctgctccggggtcatggccgcggcgcgctcgcgctcggcggcggcctcgtcgtcgctgtcgccggcgccgccgaccacgtcggccgcccacgccaggatccccgccatggctccgctcctcctctgttctgttcgaggggacgcgaaatcggcctcgtgccg

SEQ ID NO: 26927 - DNA, 413 bp, Triticum aestivum
  Clone ID: PAT_TA_26927
ctgtgtttctgtatctatccaggggctggcatttttcgataaagggtgaattttattgactcgaaataaagcatcaagttgatataaacacgatgaaaacatacacggcctctgcataattaagacgcacataaccaataccaacacacacacaaaatacccgctagcaaatagcaaggccatataagaccaaagcattgcataagcgagagaaaaacccgaagcgaagcgaacaaatctgcgatcgacaaactacaacaatgaccatatccacaccaaccatctcatgatatcataaggacaacggggttcttcaacagcaacgccttcatgatgagagcaacgctcgagagccgccgtcatcggatccaaccaccaaaggtaagactctaggttttcaccctgaagacagt

SEQ ID NO: 26928 - DNA, 518 bp, Triticum aestivum
  Clone ID: PAT_TA_26928
ttttttttttttttttttttatgcacaacaatcattagaatcgcttcattctccttaccaccttacaaacaataattaagttatgtttcagctacaagtttgtttgctcgcatcgagaagaaatggaatcaatgtcaatggtagcaggactgcattgtgatctgaagcctgtcgaagttatggggccgcgagaagtggaaaccatgacatagctttcatcatgaactggaatcattgacggcacaaaccggaacatcacttacactttatacattgttttcatgactggacgatgtagagatcttgctttgctatgtagtagcatcccatggaagtccctggatgcacggtaaactgctcccggaactggccaacccgcttgcttggaatgtcaatatcaatttcctccaagctgggcatcccttcagcttgcaacccttcaccaaatatcaggaattggttgcccgtgatgaatgatccagacacacggatagcaatttctgtttccccattcgcgc

SEQ ID NO: 26929 - DNA, 798 bp, Triticum aestivum
  unsure (1)..(798): unsure at all n locations
  Clone ID: PAT_TA_26929
tagcaaacaccattcctcaagtgtgtgccacaccacaacaacgtgagattacattccttattcggagttgctttgctatcactgatagcaaactataaaccgaaccactcaatctggacatgaattccttgatggcttagtgataaacctctgatgtacaacagcagttctgatcagcagggaagtaacacttgccataccattcttctgcagagagaatttagatacacaaagaaaatggtatagtgagttgacttcctatcaatcatgaatatgatccgccaaatgacatcaacaacctcagctggctgctatcgcgacgagcgtgacgagcggttggtgctgccctcattgcgatcctttttacgcaaaccttcgaagctaaggaaacacttgagaggtctgaccttccaacggtttctgcgagctagttcgatttggatggcagacaaccgatcaatgacaactctaaaattgggcctatcagcaggattttcactccagcatttctcaatcaactctcttagcccgtaggcataatgctttgcaggagctctaaacggtggcctttctttagaactatgggccttctcaatttcatcaatcttcttatcctgaaaaggcaggcatccttcaatcatctcctggagtatcaaggcgaacgagaagacatcaactttattatcatactcctctttacgcaggacttctggagctacatacctacaggcattgccaggagaagtaactggtttgtcctctctgacttttcttctcacctcggccgcgnnnangcta

SEQ ID NO: 26930 - DNA, 590 bp, Triticum aestivum
  Clone ID: PAT_TA_26930
ttgaactactagctagattatacttccagagagcagagaagcaacaattagcagcctaggtagcaccatttactttcaccaatcgaccggccagccggcaggatagattagacttctagagagcaaagaagaaacaattagtgcaggtagctggaagaagaagaaggagaggatggggagggggaagattgcgattgagaggatcgacaacgcgacgaaccgtcaggtgaccttctccaagcggcgcggagggctgatgaagaaggcccgggagctcgccatcctctgcgacgccgatcttgcactcatcgtcttctccagcaccggtcgcctctatgacttcgcgagctccagcggaatggaggcaatactagagcgctaccaggaggccaaacaggagcattgtggagtgttgaatccaacatcagaggcaaagttatggcagagggaggttacaaccttgaggcagcaagtgcagaacttacaacacaataataggcaactattgggagaggaactatctggttccactgttcgggatctgcagttcctcgtgaaccaagtagaaatgagcttgcattccgtacgaa

SEQ ID NO: 26931 - DNA, 764 bp, Triticum aestivum
  Clone ID: PAT_TA_26931
gacgatacatgggctttagttacctcatagaactgtgtacatgtttattgatccgcgggattgtcgtgtaaaacgtgatctggatgatggcattaccctttactctgccctcgcacgatatgtccatgtatattcagtgcgctctttcactagagaacaatagtagttgttgtaagtttctcctaaagtttctgccgaaaatcaccatgttacagccactggttcctggaaactgcagtggggaagaacccatttatcaatttcagaaccagcatttttgggttgcatattttgtaatgtgttcgactgtttggaactagtggaataaaattgcagacaccattattaaatttcacatgtcctgtgctgcctcgttgacctctagttaggtagcagttctatgttggtatcgtgctggtcaacagaaagtgcattggcgtcctgcggcatctaccacaacgcaagcttcgctgcgaccttggtatctagcctcttgcaaattttctttagcttgtagtttgcggccttgctcgttggcttgttcttctactgtttcctgattctcatggacgtacaaatatccaattttaaaagaaaggtatttcccctaaaaaaaggtatttgtctccaactggcattatgtcttgctatggtttgtataaattgaagcgcggttcattctttagttcagttttgttgttggattgatccaggtgaggccgcaccatataactaagctctagttattgtcatcaatcatgatg

SEQ ID NO: 26932 - DNA, 527 bp, Triticum aestivum
  Clone ID: PAT_TA_26932
ttgcgtctcatgtggttagtttccatggtgaagaagtcatttcgtggcggaggcattccggagcctcgtcgtgctggagctttcagtcggagggaacatgaggttggttgagtttgagcagggagcaatgcccaaactccagcagcttctcctcaagcattggtggaataaagaactaggtttcttggagtggactctctcggaagcatcaaggaagtagggatcaccgagcatatcaccgaggagttgcgagcccaggtcgctttgaatagaaacaagcccatcctgaatacagtcccaggtcgctttgaatagaaacaagccaatcctgaataaattataagctctctctcttcatggcagggcaggcatctgttgtaaacgtatttgtattattattttttctgtatcttaatttggtcgatacaatatgcatgcgtacctgtatattgtcatgggtatagggtaatacttactaatacatgcatccttcttaaaaaaaaaaaaaaaaaaaaaaaaaaaaaaaa

SEQ ID NO: 26933 - DNA, 835 bp, Triticum aestivum
  Clone ID: PAT_TA_26933
cttttttggtgcttttttggcggtccaggtgccgcggagattgccgtatggtttgcggtagtcgcaggccagggaaatacaatgcgggtttttgttttttttcttggaaatacaaggtagtcatatgcaaatgttactaactacaaataacaccactcccttgtactgtttgaaaaacaacacaaactgagaagataaacagtacgttggctgcttgccatgcttcaaactccaggtgattacactaattcaagcacatgataccagccacaagtttactacccaaataacaaaaatgcagacatgggaggctgaggcatgactctcagctttccgaaagactggactcgaccgttttctatgcgttgagcacatggtcggtctggagttgacttgagcacggattggcgttccggaatgggatctgacatgttgacttgctaatttctagctgttctgcagaagatataggaagttgcaatgtcaacagaacctgtctgctctgacggcaatttggggagagatttccgttgggacttcgtcgaggcacgtgctgccttggggcctttttgggaggccctttagtggaggctctgctgaggttgtggtcttggaggattgatacttactgctgtgcctgctgggggtggggtccttctgcgacccagccttgggggccgggggctcctggtaggggctgggcatcggtgctgccttgaaattcaaacttttccgtagctgtctgagttcagcttcttccatccccgttgattttgcctgcatgttgtttttctccaattcctgtgcatggatcttctcctcgagcttcgagctc

SEQ ID NO: 26934 - DNA, 583 bp, Triticum aestivum
  Clone ID: PAT_TA_26934
actggtctaccgcggtctaggcggctgctcgtcggccgatcctctatccgatccgactccggagtgctgggagggggcgccacgctgacggctccagccgcggcgtcggcgggcgcaggcggcggaggagatggcgcacgagcggcgcggcgcggcggcggcgtccgcggctgcgcacgacgctgcaggggaagcactatttgttgacgtagtacatgaagcccctctatctggtcagcggcagcctcgaagcatagttggtggcactctgtactgtatcttattggcaggttatgctggtgttgtcatagcagctccatggatatttgttcttataccagacatgatccttccattgctatgcagctgcaatgttctgcttcttattattacaggtatattccaacaatattgggtccatcaggtcacaaaagtgcgactacagggctactatgatttaagccaaaaactgaagcgcattgctcgagttccatttgccgctattgcttgcggtactgccctattgctcttaattctagtttggcagcctcaagtagaagtattatcaatttcagttttgctc

SEQ ID NO: 26935 - DNA, 627 bp, Triticum aestivum
  Clone ID: PAT_TA_26935
catcacgagcggtttctacacgaaaatacttggaccagatggtgctaatgccatgtcaagaagcgtggatctgactgataacttcagacaaccagtctcttcaacagtgcaaccaagtagagtttcaccaaggaagatgccttctgcgagctcaggttctgccaatggaaatggaagtcaagaggaaaatgccagttcaagtccagatgcaccttcaaataattcagaaagatttgcacctccaaagcagttggcaaggacactgtcttcaccatcacgtggtctactacgtccttcatcaccaaccaaggcttcatcaacatcatcacttgcctctaggaggttgccgagcccattgaggattcgaccttcaacacctgtctcaccatgtagttctggtagatccgattctccctcttctcttctcagctacattggtgatgcaacaagaggaaagaagagcccaagccacatggaagatgcccatcagttgcgcctcctgtataataggaacttgcaatggcgttttacaaatgcttatgtggatgaaatgctatcaatccagaagatgggtgccgagactatgctctacagtgtatgggatagtaattcaaagatgtctgactc

SEQ ID NO: 26936 - DNA, 837 bp, Triticum aestivum
  Clone ID: PAT_TA_26936
tttttttcctctcaagtgcaagcaatacttaacattgatgtttactgaacagtttggcttcagcagtacagttacatataatttacatacgcacgcagcgcaaacagcactacgttcggccaaggctcacacctacgtgttgtactgatcttacttcccaggtatacaagagcatataaacaggggcaggataacggtccttctagggttcaagaatgacgagagatacgccctcgctgaaatcaatcgaggcctgtatcttatcttcgactaagagcatatcaattcatcagttatatatacacaaacgcaccgacaaaacatcgctgggctcacagcatggcctgttctgtcattgagatctgatcttccggtgtgaagttaagagaaacaaggaaagaatggcgctatggcttctccggcgagtcacgctctttcgctctactcccggacagcagtctctccctgattgctttgaaagactgcagctcctcgagtgcatcagatgtcatgcgagacatgagagaactggtcgaggctacagtgttagactacatcgctgggctcacagcatggcctgttctgtcattgagatctgatcttccggtgtgaagttaagagaaacaaggaaagaatggcgctatggcttctccggacagtcacgctctttcgctctactcccggacagcagtctctccctgattgctttgaaagactgcagctcctcgagtgcatcagatgtcatgcgagacatgacagaactggtcgaggctacagtgttagactacatcgctgggctcacagcatggcctgttctgccattgagatctgatcttc

SEQ ID NO: 26937 - DNA, 663 bp, Triticum aestivum
  Clone ID: PAT_TA_26937
tcctgtgtatgtatgcgaacaagtctccgcatcaaacatctttagatgattttttttggaaaccaacatctttagatgaattgaaccagaacaaaattactggatatgattctgaaggctttggctttctggaagcacttaaccttttccacttttttttagagaaaacgcaaaagactttgcgtttcatttcattgaacaggaagagaacaacagtacaggtacaacctcccagaacaacagtacaggtacaacctcccaggaggagggacgcgcatacacaccaccgtcctcaccgaacaagcagagctcaccggatcaatgagaacacgtgccgtagaagggtccattatttttgtagttccagctcggcgttgtcatgcctcagtaacggctgaaatattcacaatcgaagccattggcatcctcggttttatgaagttgcagaatgtgtgcgatatttaattcgaggaattaacatggggcataatacgtcataaattttcctagcagcacaaaaggtctaaagcattccaaacaaggtggtataaggcagtacatatgaacacaataccttgtgcatagttaggccaacgcatccaaaacaggttctcttgtaagaatacacatagttttgctggtgtcgttgaacatggcagcagt

SEQ ID NO: 26938 - DNA, 516 bp, Triticum aestivum
  Clone ID: PAT_TA_26938
ctgctcaccggcccatttcgggccatcgtggccaatgggtgcattgggtttgtgctcaatctccatgatggaagccaggaccagaagaaagcaaaccagagccagatactcgtggacttgtatgacccgacgacaaagtatgacgagctcatctcaactaaactggacactggctacggcccggcagaggtcagatatgcagtgctcagcaacgccatcgaatgtgacgttgaggtgaaacttgtccttggagatgattcggctcctgcatatgcccacgggacgatcacggcttgcagtgagctgctgaaacaagacatcgtgctcttcgatggcgagatcatggatgcgacctcgccggagctgatccttccactggctagatcagtcctagcagcgccactgaagtggtccctaaagattgaggtggttctgagagggtcctctggtgaagagcttgcgagagatcatgtcatgttctatcctgtccttgacgacgagcatgtatcgcatgct

SEQ ID NO: 26939 - DNA, 477 bp, Triticum aestivum
  Clone ID: PAT_TA_26939
tgtagcatctttttgtttttgtgcctgcttgaaattggtattccaatagttgagtactgtattgggacctatctggaagtttcagattagttattcacattgatggcttcactaagaaaataaaataaatgttgagactttcaaacatactgaaccagcctgtcagttctgctgtctttggatttatgtatgcttaattaaccacaaggtgctattttctaaatgtatattatacaggcgatggcatactatccatattttttagcgagataagtacttgtaaatctttcatggtagtatgaaggttatctctagggactacgataaatcctgtactgtataactgatgaatcacacactaaaggaccctaattatttacatgcctcagctaatcctgtagttctgctgattttgttcttataacagataaaaaattattttgagttctgccatacatctgttagctttctgttgtt

SEQ ID NO: 26940 - DNA, 489 bp, Triticum aestivum
  Clone ID: PAT_TA_26940
tcaaaattgcacaagtctagacccctttatgccatatactttctatttttcttcatcggagttcgactgcgcattaacccaacgtgtgcatgactcgatggtccaggaaggaaatcgtttcctttcatcagctagaaaaactgccaacgtttcaaaactgcaacttgatgaagattggagtatatcttaataagtttaccctgttggggcacatcacatacacacatttgctcaaatccactctggcccatgtagagctgaaacccagtttagttccttgtatcacttgtcgctgaaaaccgtttgattgttttcacggaaatgatttacaagttcagcaagtgatgaggtgtgagaataacatattcattagggtaggcgtctcctgccctatgctgaatgtggtgcaatttttgacgcagattcataatttgcagcttagcttatctcttggccctccaattaaaatataggggttgaacttcacca

SEQ ID NO: 26941 - DNA, 555 bp, Triticum aestivum
  Clone ID: PAT_TA_26941
cgctggtgcccccatctacctcgccgccgttccccaatacctcgccgctgatgccctggagctggctggcaacgctgccagtgccagggacaacaagaagacccatatcatgcatcgccacatccagctcgccgtgcgcaatggcgaggagctatatatctcatgttggttgtagggaacacaagacagacaggagctttggagcaagtccgtccatgtcggacccttttcatttatttatttcacgaattccttttcatttattcatgagcgtacttatgctactattcttgtttgaaattccttttatgtttgcatgaccggagccatgaggattgctactccgtaagcagcagcgttctcctagatgacaacttgcccgaatgagctgatgatggtttcttggaaatatgtagacccatatgattttttattgggacagatagtgtaggcatattagcctatggcattgttactgcagattccagtgttcacattttccaccttgatttccttttcatatggatttagtaagacaaaaaaaaaaaaaaaaaa

SEQ ID NO: 26942 - DNA, 303 bp, Triticum aestivum
  Clone ID: PAT_TA_26942
acgacagcaacagcctgccaccgtcggcaccgtctcctatgtgagccagccggccataaaaacttattaatcactaagtaccggctactcgatctgcttcatgaattcgttttgctctctgtttgagtttttgttgttgttttggtttttgcgagcgatttgggtttctgttgttgttttgttttttgcgagcaattcgagtttttattgttgtggtacattgtcaagcctccgggttacctggactctgcaagaacgaagatagtatgtgatgtgtttgtgactaaaaaaaaaaaaaaaaaa

SEQ ID NO: 26943 - DNA, 1017 bp, Triticum aestivum
  Clone ID: PAT_TA_26943
acaaatccgcctggctccccgcccgctccctcgtcgcgtccctgtctccactctccagcgcccatttccttcacttctcatggcggcggcgcggcccgcgctcccctcctccccgacctcgctgctgctcgcgcgctccacctccgcccccgacctcgccgcccggaggccgaggcggtggctcgtcgccgcggccggcgtcccggccgtggcgggggcgctggcggcctcggcctcgacgccggcggcgtccatgctgctgcgggacggcggcgccacgctgctcgtcaccgccggggcatactccctcgtgcgcgccttcgacgcgctcaccgagcgccgcctcgtccaacagagcttgagcaggaaggttgtgcatgtgctatccggggtctttttcatggcttcatggccactcttcagcaattctaccagtgcacggttcttcgcagcggtagttccgttcctgaactgcgtaaggcttctcacctacgggctcggcttctactccgacgaagctctagtaaaatcggtgacccgtgaaggaaaacgagaggaattgctgcgaggccctctgtactatgtcatcgtgctactgatcattgttctagtcttttggcgggactccccgatcgggatcgtttccttgtcgatgatgagcggtggtgacggctttgctgacattgtcgggagaaggttcggctcgctcaagctgccattcaacaagaagaagagctgggtcgggagtgccgcgatgttcatctctgggttcctgctatctgcactgatgctgtcctatttctcgtggcttggttacatccatgtcagctgggatcaggcgcttggtaaactggttctcgttgcgctggcagccactgtggtggagtgtattcctgtaactgatgttgtagatgacaatatctctgttcccttggccaccatgttggtagcctttctgttgtttggcaacactgcaaattgaatatatgaacaaatgttttgagctcctcctgtaac

SEQ ID NO: 26944 - DNA, 693 bp, Triticum aestivum
  Clone ID: PAT_TA_26944
ttcttttttgaggtcactgcaggaggagaataaagttctccataaggaagtaagcccgttatatcacctttggtccaaccggtctaaattgtttcgtatagcatattttattgacagaggtccgtgtcccttccccacagctcgtggagaagcagaaggcccatgtggcgcatcaagatcaaactcagccttaaaccagctcttcatcttcttccttcatgctgagggatgctccccctgccgcaaataccagcattcattcagcggcaacaggcgagagggcagaggatgcggtagtgcagcagcaggccccgcttcgcattggaggcctgcctccatggatgcttagccacctcaacgcttgaggaaggaagaggtttaatttccaaagcagctgaaacagcattaatcggcacactagcaattaagctgctatggttatgtttgcttgcccctacccttatatatatgatttgcaaggtaaaaaaatgagcagagagatcaggaatgctggttcactgtataattttgttgcatgttcagcaacacgtaccagttgatgcaaaaaaaaaaaaaaaaaaaaaaaaaaaaaaaaaaaaaacaaaaaaaaaaaaaaaaaaaaaaaaaaaaaaaaaaaaaaaaaaaacccaaaaaaaaaaaaaaaaaaaaaaaaaaaaaacgggccccccaaaa

SEQ ID NO: 26945 - DNA, 1197 bp, Triticum aestivum
  Clone ID: PAT_TA_26945
cggacgcgtgggcggcaaggtgcagctgaagcggatagagaacaagataaatcggcaggtgaccttctccaagcgccgcaacgggctcctgaagaaggcgcacgagatctccgtcctctgtgacgcggaggtcgccgtcatcgtcttctcccccaaaggcaagctctatgagtacgccaccgactccagcatggacaaaattcttgaacgttatgagcgctactcttatgctgaaaaggctcttatttcagctgaatctgaaagtgagggaaattggtgccacgaatacaggaaacttaaggcgaagattgagaccatacaaaaatgtcacaagcacctcatgggagaggatctggattctctgaatctcaaagaactccaacagctggagcagcagctggagagttcattgaagcacatccgatcgagaaagagccatcttatgatggagtccatttctgagctacagaagaaggagaggtcactgcaggaggagaacaaggccctacagaaggaagtaattaagctgccaaacaaagcacctataattacttaaacactgcccgttgctgatctaatccttcaattttctctagctggtggagaggcagaaggcggcggccagcaggcagcagcagcagcaacaacaacaaatgcagtgggagcaccaagcccagacccaaacccatgcccatacccaaaaccaacctcaagcccagaccagctcatcatcttccagtttcatgatgagggatcagcaggcccatgcccctcaacagaacatttgcagctacccgccggtgacgatgggtggggaggcagcagcggcggcagcagcgccggggcagcaggctcagcttcgtattggagggctgcctccatggatgctgagccacctcaacgcttgaggaagaggtttaattgccatagcagctgaaacagcattaatcggcacactagcaattaagctgctatggttatgtttgcttgcccctacccttatatatatgatttgcaaggaaaaaaatgagcagagagatcaggaatgctggttcgctgtataattctgttgcatgttcagcaacacgtaccaattgatgcaaacatgcatgcttagcaaccaaccaattaccttagcatggatgacttgcttggcttaattatggaaagctaggttgcatgatgacgtgtgtatat

SEQ ID NO: 26946 - DNA, 1363 bp, Triticum aestivum
  Clone ID: PAT_TA_26946
cccggtcgacccagcgtccgggccattttaggcgtctcagccaatagacgctcgacagcataccgcggccggaaccacactcgatcgcaccctcccccaattacaccacaaatccatccatcctcttcctctcgtccgcttacgcgtggatcccatctcccctcaccgccgcggcgagccagcgacgtctcgcctcctcccaccccggccgccgtgcgcgccatagacacaagagccgacagctagatcgcgaaatcaggatatgggtcgcggcaaggtgcagctgaagcggatagagaacaagataaatcggcaggtgaccttctccaagcgccgcaacgggctcctgaagaaggcgcacgagatctccgtcctctgtgacgcggaggtcgccgtcatcgtcttctcccccaaaggcaagctctatgagtacgccaccgactccagcatggacaaaattcttgaacgttatgagcgctactcttatgctgaaaaggctcttatttcagctgaatctgaaagtgagggaaattggtgccacgaatacaggaaacttaaggcgaagattgagaccatacaaaaatgtcacaagcacctcatgggagaggatctggattctctgaatctcaaagaactccaacagctggagcagcagctggagagttcattgaagcacatccgatcgagaaagagccatcttatgatggagtccatttctgagctacagaagaaggagaggtcactgcaggaggagaacaaggccctacagaaggaactggtggagaggcagaaggcggcggccagcaggcagcagcagcagcacacaacaacaaatgcagggggagcaccaagcccagacccaaacccatgcccatacccaaaaccaaccttcaagcccagaccagctcatcatcttccagtttcatgatgagggatcagcaggcccatgcccctcaacagaacatttgcagctacccgccggtgacgatgggtggggaggcagcaacggcggcagcagcgccggggcagcaggctcagcttcgtattggagggctgcctccatggatgctgagccacctcaacgcttgaggaagaggtttaattgccatagcagctgaaacagcattaatcggcacactagcaattaagctgctatggttatgtttgcttgcccctacccttatatatatgatttgcaaggaaaaaaatgagcagagagatcaggaatgctggttcgctgtataattctgttgcatgttcagcaacacgtaccaattgatgcaaacatgcatgcttagcaaccaaccaattaccttagcatggatgacttgcttggcttaattatggaaagctaggttgcatg

SEQ ID NO: 26947 - DNA, 795 bp, Triticum aestivum
  unsure (1)..(795): unsure at all n locations
  Clone ID: PAT_TA_26947
cctgcgagctctacacagcatcacaccgcatttctcattcttcctccccacgtcgccgtagcagctagctagccgggagggaggggccgccgccgccgagtgagggagccgggggaggcgggttggaggcagggcggagatggggcgcgggccggtgcagctgcggcggatcgagaacaagataaaccggcaggtgaccttctccaagcgccgcagcgggctgctcaagaaggcgcacgagatctccgtgctctgcgacgccgaggtcgcgctcatcgtcttctccaccaagggcaagctatacgagtactccagccaggacagtagcatggatgtgattcttgaacgttaccaacgttactcatttgaagaaagagctgtactggatccaagtattggaaaccaggcaaactggggagatgaatatggaagtttgaagataaaactcgatgcactccagaagagtcaaaggcaactcttgggtgaacaattggacccactcaccacaaaagaactccaacagttggaacaacagcttgatagttctttgaagcacataaggtcaagaaagaatcaacttctctttgagtctatatctgagcttcaaaagaaggagaagtcattaaaagatcagaatggcgtcctgcagaagcacctcgtagagacagaaaaggagaannataacgttntgtcaaatattcatcaccaanaagcagttgaatggagcaacanatatcaatcaccaggagcagctgaatggagcaacaacagctcaccgtcacctacaccagcgac

SEQ ID NO: 26948 - DNA, 1162 bp, Triticum aestivum
  Clone ID: PAT_TA_26948
ggcacgagctctctctctctctctctctctctctctctctctctctcctcgtgccgaattcggcacgagcggagatggggcgcgggaaggtgcagctgaagcggatcgagaacaagatcaaccggcaggtgaccttctccaagcgccgctcggggctgctcaagaaggcgcacgagatctccgtgctctgcgacgccgaggtcggcctcatcatcttctccaccaagggaaagctctacgagttctccaccgagtcatgtatggacaaaattcttgaacggtatgagcgctactcttatgcagaaaaggttctcgtttcaagtgaatctgaaattcagggaaactggtgtcacgaatataggaaactgaaggcgaaggttgagacaatacagaaatgtcaaaagcatctgatgggagaggatcttgaatctttgaatctcaaggagttgcagcaactggagcagcagctggaaagctcactgaaacatatcagatccaggaagaaccaacttatgcacgaatccatttctgagcttcagaagaaggagaggtcactgcaggaggagaataaagttctccagaaggaactcgtcgagaagcagaaggcccaggcggcgcaacaagatcagactcagcctcaaacaagctcttcttcttcttccttcatgatgagggatgctccccctgccgcagctaccagcattcatccagcggcggcaggcgagagggcaggggatgcggcagtgcagccgcaggccccaccccggacggggcttccactgtggatggtgagccacatcaacggctgaagggcttccagcccatataagcgtactattcagtagagagtaacaagttgcaccggccagtctggtgtatgttgcggttgctagcacgcctgaccccttggaggggaaaggaaaagaaatcagagtaaagtagcaagctgcagcgatgtgtatatttcactttgtccaccccagtttccctcccagctgggctaatttaccatgtaatctatatgtagcttgagtgatgaattttcaagtttccatgatacccgtctctagtgggatgttgtttatgtgaattaacctatcaaatatgagcattgtgtatattgtgattcttgaaaataaataaatcaggatctttgtctttt

SEQ ID NO: 26949 - DNA, 1397 bp, Triticum aestivum
  unsure (1)..(1397): unsure at all n locations
  Clone ID: PAT_TA_26949
gcggcgtacgccttcgagctccactcagcatccccccgccttcctccccacgtcggcgtagccgcacgcgtccgggccatcctccctctcctcccctctcttccacctcacgtcctcacccaaccacctgatagccatggctccgccgcctcgcctccgcctgcgccagtcggagtagccgtcgcggtctgccggtgttggagggtaggggcgtagggttggcccggttctcgagcggagatggggcgggggaaggtgcagctgaagcggatcgagaacaagatcaaccggcaggtgaccttctccaagcgccgctcggggcttctcaagaaggcgcacgagatctccgtgctctgcgacgccgaggtcggcctcatcatcttctccaccaagggaaagctctacgagttctccaccgagtcatgtatggacaaaattcttgaacggtatgagcgctattcttatgcagaaaaggttctcgtttcaagtgaatctgaaattcagggaaactggtgtcacgaatataggaaactgaaggcgaaggttgagacaatacagaaatgtcaaaagcatctcatgggagaggatcttgaatctttgaatctcaaggagttgcagcaactggagcagcagctggaaagctcactgaaacatatcagatccaggaagaaccaacttatgcacgaatccatttctgagcttcagaagaaggagaggtcactgcaggaggagaataaagttctccagaaggaactcgttgagaagcagaaggcccacggggcgcagcaagatcaaactcagcctcaaacaagctcttcatcttcttccttcatgctgagggatgctccccctgccgcaaataccagcattcatccagcggcaacaggcgagagggcagaggatgcggcagtgcagccgcaggccccaccccggacggggcttccactgtggatggtgagccacatcaacgggtgaagggcatccagcccatacaggcgtactattcagtagagagtaacaagttgcaccggccagcctggtgtatgttgcggttgctagcacgcctgaccccttgggaggggaaaggaaaagaaatcagagtaaagtagcaagctgcagcgatgtgtatatttcactttgtccacctcagtttccctcccagctgggctcagatggctgtacgagtaatttaccatgtaatctatatgtagcttgagtgatgaattttcaagtttccatgatacccgtctctactgggtgttgtttatgtgaattaacctatcaaatatgagcattgtgtatattgtgattcttgaaaataaataaatcaggacctttatgttttgtgatgacgtgtgtatatatatatatatttttatattttatcnaaatctaaa

SEQ ID NO: 26950 - DNA, 632 bp, Triticum aestivum
  unsure (1)..(632): unsure at all n locations
  Clone ID: PAT_TA_26950
ccgaggtctcgagttttttttttttttttttttcgaatgtatgcccggctctttattcacggagggggcggccggaaagcgacgcccactgcccattgatttatactgttgacacaaaagtattcgatcgatttgattgcacatatagctaaactgctaaagtgttgcttttgcatagagatatttttgttggctcgtgggaagatcctctgattattctcaaccggatgacttcccgcctagccagctgtctgatctgtggccgtccgatcgcagcagcacaacgcaccgccgagcactgatgacaccccagtgaagctcccttacagctctcatggcgcaccaggcagcgcgacaaaagttgcaacgtagcaccgacaatgtccggcgaagctccattacggctccggcggagctctattgcatccccgtcacagcttccactgcccaggcggcgctccattgcatccctgtcacagcttccatagctccggtgttagcccaaaatactagcgagtagcgagtagctagctagctctctctctctctctctctctctctctctctctctctctctntntctctctcncnccccccccccccccctctctctctctctctctctctctctc

SEQ ID NO: 26951 - DNA, 619 bp, Triticum aestivum
  Clone ID: PAT_TA_26951
gcgatgtggacgggtctttgtttattcaggttcagacattgcacaactgaaggcaagtgtttcacagcttgagaaagtttactcactaatggctgactgtatacaactctagaaagtttcttgtgctagcatctacaagaactaaattatagacatgagtgctgatttgatattgaaaattgctctacaaaattaactacttttacttccctgatttatcatctatcgaattgtttcatagcagttcagtggtgccctatctgaattctcaacctgcatgaaacattgcactgggcagaaaataattgtagaaaggaatgtcgtaagtggctggcactgccatcaggctatcacacactgcacttaattgggcttgttggaccatgcagggcatctgcaccagataatagaagccctgcaagggtggtttgcttgtgaggaggggttgattttttgagttgcagcctgaatgatatgtatcttatgatacagaggaaagaaaaacaatatgtttcttaccttgttggttggttgtctacacgcacatttcctatgaaccatgccttaataatcgaaccgccactgtaatctcacatcgtgatcagtcctcacttgatga

SEQ ID NO: 26952 - DNA, 611 bp, Triticum aestivum
  Clone ID: PAT_TA_26952
ctcgagttttttttttgtctcgtgtttgctctttttttttttacttcacaatccacacatctcaatggcatcatatatatgttccaaataagcatagaacataaattgtagagcaatgcaatcataggtacacacccacaccaatagtaatgactaataagcattgaaaagtatacatgaatatatagtttggtgacaaattcttcacaagaacgacaatttgttccacaagtaacccaggaagtttatcagaactctctgtgattgtatccccatcttgtcaaagtatgcagcaaggacatgtctgttgcaccttattttcgtctttgcgattgccagatgactgctgcctggcagaagagtcgggcgatagtttatcatccctcaccctgttgaagatacccgtatacttttcgcctgatgccgcgttcgcctcatcccactcaccaaatggtgggacagccacttcatcgtcaggattgtagctttggttgctctgcctcgttctgccccttccaggagtgtgctggccctgcgcttcggacgaaggcctcctctctggagtgtgcgttccagttcccggcttgcgaacgttgcgcatcgtaatagac

SEQ ID NO: 26953 - DNA, 528 bp, Triticum aestivum
  Clone ID: PAT_TA_26953
cgcccccgcgtcctcgtccgcgacggccccagaggcctcggccaccgtggcctcggcgaccgttgcccctccggcgtcccccgcgccgcgctctccgtgctcgccgccgtgcctgctctggccgggccgcccatcctcgagggcggccccgtccccatccggctcgccgcgcgcgccccggcccacccccgggtcgtgcgcccggcgccctccgcggccctcgcgctccccggcgccgtcccctccggctgcgcccggcttctcgcctcggggcacacgcaccccgccgtgctgcccccgcttccgctcggcgcgatcgccctgcggctgcccaccgccgcctccagcccgcgcccgctcatggccgcccgcccctccctcgactccttctcctccggcgccccgcgggctgccgccccggcggcggccctcatcgggtcggtcctcccggcggtcgccccgctcccggtcctggccgcggtccccctccccgcctggctcccctactcccgggcggccaagctgctg

SEQ ID NO: 26954 - DNA, 565 bp, Triticum aestivum
  Clone ID: PAT_TA_26954
aacaaacaatgcctctcgatacctcaacatactcattagcgctcctgcgcgtcgacgggcgaagatggaacgagcttcgtcgtcttcacgcccagattagaacccaagatgccgccgacggttcatcatatctcgaaatgggtcatacaaaagtcatgtgtgtcgtgacaggtccttcggagcagcagcagaaacgcggtggacagcaggctcctcgtgatatggcggcgatcaacgtcaatgttgtagttgctgggttctcgagcgtggatcgcaagaagagagggcgcaatgacaagcgcatacaagagattgaaaccacgattgagaatgccctggcttcgaacttacatacgcatttgttcccccactcctcgatttcgatctcgcttcacgtcctttcgcaagacggttcgctactcgctgctctactcaacgctacgacacttgcgcttatcgatgctggtttccctatgacggactacatcgctgcatgcacagcgggctcgacctctacatacgccgccggcgacgactcggccgatcctttactcgatctgaacac

SEQ ID NO: 26955 - DNA, 574 bp, Triticum aestivum
  Clone ID: PAT_TA_26955
gctggttgaaatgtggaggctgcgcagcgtcgcggccggccacaacctgagcatagcatggcagctcccccagttcatgctcatcgcctgctccgacgtgttctgcggcatagctcagctcgagttcttctactcggaggcccccatgtcgatgcggagcctgtgctcggcattctcgttccttgcaatgtcgcttggttactacctgaactcgatgatcatctcggccatcgctgctctgtcgaagagcgggggcgggcagggctggcttcccgccgacttgaacgacgggcatctcgactactacttctggctgtgggcggggatcggcgcggtgaactttgttgtgtacacggcgttcgcgaagaattatacggtgaagaaagtcgagctccggtgaacatggtttgctgtcggttatcctctttgttgtatatgcaccgtctacaaaaccactttgacgtaattaaatatcgccgaaattcctgaagttgtgttcatttgaataaaaggtgcctttggaacacaaaaaaaaaaaaaaaaaaagggcggcccgctcgcgatctagaactag

SEQ ID NO: 26956 - DNA, 2163 bp, Triticum aestivum
  Clone ID: PAT_TA_26956
ggcacgcgggggagcggagtggacccgggggaggccgacggagaccgagggcgaccagctgcgggcgtggaacgggaggaaccggacccgggggaaggtgaggtgagagagtcggagggagccccgctccggccagcctccgtcggcacccacggccggcagcggcagcggcagcggcacgccatggacgcggaggccggagaggcgcccctcctctcccaccagcacagccccaaccaggtcccgtcggcaaatcacaacggcaaacccttcaactggaaggctcctgctattatcttggcgtttgagttcttggagagcattgcctacgctggtattgccctcaacttggtagtatatcttgggaaggtccttcatggaactacggcttcaaatgccgcgaatgtcgatacatggaacggcaccacgttcctcacgcccgttctcggagcatttcttgctgatacatactgggggaagtacaagaccgtcgcaatctccataatattctatcttactgggctgctcatcataactgcttcggcgatcattccatctttacaacccgccgcatgtgaaggaacttcatgccctcctgccacagggtttcagaattttgtcttctttactgcactataccttgtctcggttgggactggaggggttaaatcagctttgctcccacttggagctgatcagtatgatgattcaaaccttgagcagagtaaaaagaagcaggctttctttagctggttcttcattgccattaaccttggcgtcttcatctcggggacagttgttgtatggatacagcaaaatgttgcttggtctcttggattcggcatctcatcgatatgcctcattatcgccacagttgccttcttggcaggaacaccaatctacagggttcaacttcctactggaagcccactgaaaagtcttgtagcggtgtttgtcgcatcatttaaaaagaggaaagtggaggttcctgctgatagctcaatattgtttgatgggaatgaaaccgacttaaccaatgaggcaccaaacaaattggcacataccgaaggattcaggtgcttagataaggctgccgtagtcttaggggaccaggagataaaggagagcctttctgggcgtccatggatgctatgcacagtaactcaggtggaggaagtgaagatccttgttcggatgcttccaatatggttcaccagcgtgttctacgcagcttccatgtgccaaacggccaccaccttcatccaacaggggaacaaaatgaacacaaagattggatccttctccgtccctcctgcttccatgaactctgcctcggtggtcttcatgatgatctttgtcgtgatccaggacagcattgtgatcccaatggccagacgatacaccggaaacgtcgccgggctcacgcagctgcagcgcatgggcgttggccggttcctggcggtcccggcgctggccgcggccgcgctggttgagatgtggaggctgcgcagcatcagggccggccacaacctgagcatagcatggcagctcccccagttcatgctcatcgcctgctccgacgtgttctgcggcatagctcagctcgagttcttctactcggaggcccccatgtcgatgcggagcctgtgctcggcgttctcgttccttgcgatgtcgcttggatattacctgaactcgatgatcatctcggccatcgctgctctgacgaagggcgggggcgggcggggctggcttcccgccgacctgaacgacgggcatctcgactactacttctggctgtgggcggggatcggcgcggtgaactttgttgtgtacacggcattcgccaagaattacacggtgaagaaagtcgagctccggtgaacacggtttgctgtcggtcacaggcgtacgtttttcatcctctttgttgtgtatgtaccgtctacaaaaccagttcgatgtaattaaatatcgcccaaaattcctgtagctgtgttcatttgaataaatataaaaggtgcctttggaacagaaaaaaaaagtaaaaaaaaaaaaaaaaaaaaaaaaaaaaaaaaaaaaaaccaataaaaaaaaaaaaaaaaaaaaaaaaaaaaaaaagaaaaaaaaaaaaaaaaaaaggtaaaaaaaataggggccccc

SEQ ID NO: 26957 - DNA, 639 bp, Triticum aestivum
  Clone ID: PAT_TA_26957
accatgtgagtaagaaggaactcgtcgttggctggctgatggtcccgtgagtaagaagggaagcggctgcgagcacgccaccggtgttgggtcgatggtgtcgtgcctcggcggccggggtgaggcagagtagatgggaagcagcggctcccctatcccccgagctccagatccttggcggcagcagcagcaaggttttcctctggaatatggataattttaacatggatactaaaccagaagaacatacgaactttcccacggacataagattcagaccgaattcgactcagttggctacatcatcttctgatggaactgttcaactatggaacgttgttgaagcattttcttctactttctcaatatgtgtttctcattagtaattgtgaatttccttatttgctgcaagttctggcttttttttgggtgcatttcactgcctactattgacactggaatgtaaacttttgctctttgattgtggcaagagatcattgcaaacttgagttactctcctatgcatgttactggacctttggatgagatgtggatggatcagatttagaaagataataggaggcacatagataacctgttgacccgtgagttggctattccattcatgtgtctcatgtc

SEQ ID NO: 26958 - DNA, 927 bp, Triticum aestivum
  unsure (1)..(927): unsure at all n locations
  Clone ID: PAT_TA_26958
ccgcgatagatataaccaggatcggaaattaagaaccacataagttggatagtttgtaacctcaggctcagatcaccggaagcagctcttgtacctcctttctccntatgtctgccttctgttttggcctgtaattactgtctaagcaggccaccacctttgctgcagccaatcattttatccaagcgggtcttgaaactaatattgacttcatactgagcccccaatacacgaagccgttttaaccaaaagaacttcttggccagctcatgtgtctctgcctttttaaccacaaatactttcttcacgtgcgttgagaattgctccctggatttcttatcaatagcccctcattttacccaagcgggtcttgaaactaatatggacttcacactgagcccccaatacaggacgccgttttaaccaaaaggacttcttggccagctcatgtgtctctgcctttttaacctcaaagactttcttcacgtgcgttgagaattgctccctggacttctttatccaatatggaggtgatcgtaacacggtttataatggcccgtggattcaggccaacccaaccttgtgcgtgtaagggctcaaaccccttccagattgtgcatttttggttatttgaaagatttcatcgctatgcgtatcttgggcaggcaggttctcgggagtgcatcctatcttgggtatataccttccttggtctcctcaataggcttgtgaagctgtttggcatcggagccgagacggcgcacggtcgccggccgctgcacgagcctcgtcaggtccgggtgtttcctcttccatagccccgacacgaacctgtaggcgcccatggcggcgggtgtctccggcggcggcgaggtgaagtttggagatgggcaaaatggtggcagtcggatgggctagggctctgga

SEQ ID NO: 26959 - DNA, 1807 bp, Triticum aestivum
  Clone ID: PAT_TA_26959
gtacccgccacactcctaaaccctagcgcctccgccccttccggcccaaacgcgttagccatggcgaccacagacgcccccgccgccgcccccgccgcccccgctccagcacccgcggtttccctcgaccagaccaaggcaaagaatctcctccaccaggtggagttctacttcagcgacagcaacctgccccgctacggtttcctgcggaaaacaatggaggagagcgaggatggattggtttgcttggctctaatctgccccttcacgaagatgaggtcgcacctttggcggatggcgatggtgtagttgtgaggggcgaccttgacactttggatcgcgtgtctgaagaagctgcgaaggattgttgccgtcgaataaagggtggccgagggagattcaataacaattatagaagcaacgggggcggaagggattggaagaccaacagaggtgcgggcagaaggcgcgacccgtggtgggaagcaggttggtcgccactatgtcaaatattaatggactaactaagtcaaggagaacggctcgtctccttagatagcctggaccgacatatagcatcttttagccccagcgaggaaacgaaaatacgtctccggtgcctgcctgctgctgcctccacagctttggaggcggccgttcttgtgtactggtttaaattttacctgtgctttttatggtccgaacgacgggtgtgatgagccaggttgtcaattgatgaagagtaggaaaactttaaataagaacggacttgatgctggatacccagcagggctgatcctgtctttcaagctgaagagtattctagctgatggtgacacagtcctgaagggtggggacaaaggtgatgactgtttttcaagctgacggcctattcaagctgatggtgacacagaacaaaatggtggggacaaagttgataatagcgatgatgccaagaaggaaggggcttccgactcttcggaggaatcggggaaagcttctgaagagaaggcccctgagaacactgatgccaaggaagagaagtcagctgatgctgaggagttgaaggggtcggatgcacaatctgttaaaaaggatgataaaagcctttcagaaaatgacaaggaaccagtttcaagggaggacttcaaagaatattttgccaaatttggcacagtgcggtacgtggacttcagtaagggggatatttcaggataccttaggtttgaggaatcgacggctgcggaaaaggcccgtgcatttgcagctcttgcggatgaaggtggtttggttatgaaggggcaccttgtcactttggaacctgtgtctggacaagctgagaaagattattggagtggaataaagggcggccaagggagattcaataacaataatagaagcaacaggggaggaagggactggaagaacaacagaggtggcggcggaaggcaccacggtggtgggaagcggggtggtcgccactctgacaaccatgaaagggctaacaaagtccaaaagctcgattcgtctccttagatagcctggatcggcttataccatcttttagccctagtgaggaaaagaaaatatgtctctgggtgcctgcctgctgctgcctccacagctttggaggtggccttcctgtgtctggtttaaatttaacctgtgccttttaaagtctgaatgacgggtgtgatgagccatgttgacaatggatgaagagaaggaaaactttatatgcggctaaaaaaacagcgccagagaattggaagaagggtgccaccgacctaaaggccaagcatatggg

SEQ ID NO: 26960 - DNA, 545 bp, Triticum aestivum
  unsure (1)..(545): unsure at all n locations
  Clone ID: PAT_TA_26960
acaaaccagctactcaggtacgcactacactagacgctcctccctatttagcaaatatgccatcctttgtggcgcgtcgngaaaaaaccagagctcgtgctaccggcgcaagcaacaccgcacgagactctggctctctccgacgttgacgacgccatagacctgcgatttctgcagcctgccatcgagttctttcgtgctgtcgacatcgacattgatgaccacgggctggggcggcctgccacagctgccaaggtagtcaaggcggccctcgcgaaggctctggtgcactactacccgctggcaggccgtctccgggaggctgctgggggaaaactagccgtcgagtgcacaggggaaggcgtcgtgttcgtggaggcggaggcagacgtgtccatggatgagctcggcaagccgtcgcctctgccaccatacccgtgcgtggaagaactgttgtgcgaggtgggcgaccctagggttgttcttggagttcccttgttcttcatgcaggaggcactggacttccgatgggcgaaacgagttgg

SEQ ID NO: 26961 - DNA, 525 bp, Triticum aestivum
  Clone ID: PAT_TA_26961
gcctgtgaggaggatttcagggggagatcatactatgactatgacaagaggctgagatttgacttgcactgtattgaaaagcaggttcaggagctccaagccaataaacgccagagctttgaaaaagatgtaagatttctactttctagcttttttcacaaaatttgctgtagacttttattctgtatggtagtcgggtttgttataggaatgagctatagaccttttgttcaattttgtttgagatagaatacaaattatgtgtgatattcaaagtttatagagcatgaccacagcaaaaaaaggcgatcaacataggcaatatgttttctgttaacaattcaatttctttttttaattcaatgcctgaaattattccaatttgcagtgcatacttgccgctaattaagaactacagatatatgctttcacatgcagtcatggctttgctaacatgtatgtgtcagtttagaaatacctcatattgtttcgattcttggcttcagggaaaaagtgatagattgc

SEQ ID NO: 26962 - DNA, 727 bp, Triticum aestivum
  Clone ID: PAT_TA_26962
atctcctcggcgcttacccaccatctcctccatatcctccggcgaaacccagccccagtccaccccaccgtccgcatccatggcgcccaaggccgagaagaagccggcggcgaagaagcccgcggaggaggagcccgcggcggagaaggccgagaagactcccgccgggaagaagcccaaggccgagaagcggctgccggcggggaagtcggccgccaaggagggcggcgacaagaagggcaagaagaaggccaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgaggccgccaagctggcgcggtacaacaagaagccaaccatcacgtcccgggagatccagacctccgtccgcctcgtcctccccggcgagctcgccaagcacgccgtctccgagggcaccaaggctgtcaccaagttcacctcctcttaggctgttcgtcttcctgtgtctcgtagttagctgttcgggtgtgtttgtggccgtgttatcctgtaagaatcgcaccgcgatgtttctgtatctcgagaaatggtaatggtgcctgcctcaatgttcagtacgtacatgctagtcttattttgttctggtcttgaaaaaaaaaaaaaaaaaaggccccta

SEQ ID NO: 26963 - DNA, 853 bp, Triticum aestivum
  Clone ID: PAT_TA_26963
gccccatctcctgctcctcgcagcgctcctccagcagctttccgccacctccgccggggatgtcgcgactggcagaggcggcgagaaggtgcacgtggcgatctactacgagtcgctgtgcccctactcggtccgcttcgtggcgaaccacctcttcaaggcctacagggacggcctgctcgacgccgccaatctcaccctcgtcccctatggcaacgccgtggtccgcaatgacggcaccatctcctgtcagcatggccccgaggaatgccttctcaacaccgtggaggcttgcgccatcgacgcctggccggacgtgaaggtgcatctcggcttcatttactgcgtgtcggacctggtgttgaagaacaagcaccgggagtgggagtcgtgcttccagaaacaggggcttgacccaaagccagtcacggagtgctacaagggcgagcgtggccacaatctatcgctcgagtatgggagacagacagctgagctcgtgcctcctcaccagttcgttccatgggtggtggtcgacggcaagccgctctacaacgattacgggaacttcaaagcttacatctgcaaggcgtacaagggctatcccctcctcgaggcgtgtcgaagcctgggcctggaggcacacgacgatgtgtacggccgactttgatcgtgatgatgatgatgccatcgccaagattaggatggtcctgccggatggtgataataatgattgataaatttatgtttcctctcggggatcatacatctgaacatagggcagttcaatctctctgttaaggttaataaatcaagtggttgtgctctaaaaaaaaaaaaaaaaaaaaaaaaaaaa

SEQ ID NO: 26964 - DNA, 1176 bp, Triticum aestivum
  Clone ID: PAT_TA_26964
gttcggcgaacaccatgggcgaacaccatggcgcgcggcctccgccatctcctgctcctcgcagcgctcctccagctcctttcggccacctccgcggcgacggccggcgacgtcgccactggcaggggcgccgacaacgtggacgcggggacctccaccatctcctgctccttgcagcgctcctccagctgctctccaccacctcctcggcgaccgccggcgacgtcgcgctcggcagcgccaaccagaaggtcctcctcgaagtcaactaccaagccctctgcccctacggcgtccgcctcgtggcaagccaccgcctccaggccaacgcggacgtcctcctcgacgccgcggccttcacccccgtcccctcgggcgacgccaacgtcgacgggcgcggcgccggcacatgtcactcacgggccggaggtatgccttctcagcaccgtgcaaggcgtgcgccagcaatcgcgcggccggacgtgagaggtgcgcctcggcttcagtttactacgtgtcggacctagtgatggaaccaacaagctcccgggagtgggggaagtcgtgcttccagaaacaggggcttgacccgaggccagtcacggagtgttacaagggcgagcgtggccacaatctttcgctcgagtacgggaaacagacagctgcgctcgtgcctcctcaccagttcgttccatgggtggtggtcgacggcaagccgctctataacgattacgggaacttcaaagcttacgtctgcaaggcgtacaagggctatcccctcctcgaggcgtgtcgaagcctgggcctggaggcagacaacaatgtatacggcccactttgatcgtgccgatgatgatgccatcggcgacattaggatggtcctgccggatggtgataataataattgataagttattatttccttttggggatcatacatctgaacatagggcagttcaatctctctgttaaggttaataaatcgagtggttgtgctcttagattgatctggtttgttcggttgacatatggaatcaatacccagatccttggagtacatgctctgttgaaaacaaacaggcagcatgaaaagtttcggtcctctagactatgttgaatgccaaatttatagtttgggaagcaaatttggtggtggccgttttttttgaggcaacc

SEQ ID NO: 26965 - DNA, 309 bp, Triticum aestivum
  Clone ID: PAT_TA_26965
ccagcctctgtcgttcgaggtcaccggaggaaagggcaggacgatcacaatgtataacgtcgcgccttcggactggatgtttgcgcaaacgtttgcaggcaagcagttcgtcgagtaggtgaaagagggttgcaagctccaacgactgtaattacaactaaaagggttactaaaatgccgtgacccaagaacgtgaatggttttcgctctgcccgccacgcacgtccaacatgattattgaactttagggcgcagttatctgcaagtttcctgaataaaccacgtcagtctaaaaaaaaaaaaaaaaaa

SEQ ID NO: 26966 - DNA, 545 bp, Triticum aestivum
  Clone ID: PAT_TA_26966
ggcaaaacgcgcatcatcatttgcgataggcaaaacataataaatatccggttaaacatacttaaccagcaaatctcaggtacaacaaataccccccctgatgaacatagtttaagaagctaacctacaccgcctgtcaaccctctttctttcagcgtagcgtatcttacagaattcccctgtggcctgaccaaacttccgcgataacacagcaccatcaactcacttgcttcccaccagcagatccataagcagcttcctacaagacttcttcctgtgcagacttaagacactatagatatataaacatgagatgtgcaagaggctcccggttcttccgtgtgatttaagattaatagggagatgatcacatgttggcccccctcgagatcaggatgggtccgtatggttccacctgtgtgaccttgatgcgatcaagcgttgccaagacacatgtttgatagaataggcgggaagcctgtgctgtattcatcccataagttagctggcttagcgattcagacggcggggcatccgggctctcg

SEQ ID NO: 26967 - DNA, 824 bp, Triticum aestivum
  Clone ID: PAT_TA_26967
gacagaaaccagaactgatactcaacatcttacatagttggtccgaacagaaatgcttaacatgctagcaaaccaccagcataacaatgtttcacaagataagctaatagtcagtacacgaatatctgggtcaagatgagtcgcaagctagagctgactcttacatagtagatctcacgtctcaaagcatgagattcagcttgttctcgacaaggagggaccaagcaacaacaacctcgaccttacacatgcctacaacacatgaacccttgcttgtttggcagtattgttggacagggaactcgacatgaccctgtgcaccaccatgcctccacgactgggcttgtatgacaactttcagtgttgattgtagttcagctgaaacaacattccttgccagaccaaagtagccatctgatccaacagggcttttttttttcagcatcagaacgggaacaatcaagcaacaacacttccctaggagtgggatcatctggagcagacaaggagcaagaaacccggcatccatatttaggaggccatgagccatcaacaatgtggacacccatgatagtggcctggattgctctaggaagttgctcaaggcttaactgtgcagaacaagcatagccaaggaacataggggtggtatcctgcacggcgcgccaatcatagacgcaagagagcaatgcgccttggggatccggctccgctccaggatacacagtttttagttcaacttcaaatgtcaccgggttgcaggccaaaattgcgcgagacgggccagtcaagcgcaaaaaagcctcgtccgaattcctcagccc

SEQ ID NO: 26968 - DNA, 664 bp, Triticum aestivum
  Clone ID: PAT_TA_26968
ctccgcctcgtctatttagctcgtcagtgcgggtgcagatctaaactgtgtcctacgtggggtagtgggctagtggctgtccagcttgtcctgcgtggactcgtggcatcggagtttcgaaaagggcgtgagcatcccagccagcgagccgaagcaccggcggcaccatcaagaagggtgcgaggccgacgacggcggcgaggagtcgccggcgctcgccgcgctgtacctgtacggggacgtgctcgagtcggtggtggagcgcgtgccggcgcccgacctcgccgccgcggcgggggtctcgcgcgagtggctccgcgcggtgcggtccgcgctgcgccggcgcccgcggcggctgccctggctcgtggtccacctccacggccgccgccgccggaccgcggcctacgacccgcactccggcgcgtggctcaccgtgcaggccccgcgccacgccacgccgtcgcacgtgcgcctcctgcgcggcgcgcgcggcgaccgggtgtgcgcgctctcctgctccggcctcgacgtcgccggcgaccctcttgggacgtccgcgtgcgtcgccatgaaggcccccggcgtgtggcgcgtcgacccggtgctggcagcggtgggcgaccgcgtggtcgccctcggcggcgcgtgccaacttgcgcta

SEQ ID NO: 26969 - DNA, 1771 bp, Triticum aestivum
  unsure (1)..(1771): unsure at all n locations
  Clone ID: PAT_TA_26969
gcacgaggaggacgaggaggagaaatggagcaaagagctggacgggttcacgccgccgggggtcgggtacgggagcatcacggaggagaccctggagaggatgaggaaggagaagctgtccaaggcggagcggaagcggcgggcgagggaggccaagcaggccgaggccagggaggactccgccgtggtgtgcgcccggtgccactcgctgaggaactacgggcacgtcaagaacgacagggccgacaacctcatcccggacttcgacttcgaccgcttcatttcgtcgcgcctgatgaagcggtcggccggcacgccggtcatcgtcatggtggtggactgcgccgacttcgacggctccttccccaagagggcggccaagtcgctgttcagggcgctcgaggggagggggaactccaaattctgcttctctcgtccggggtcagctgggacgtgaacagcacggacatcgcggtctcaggtctaggctggtactcgctgggcctgaaaggcaacgccaccgtcgccgtgcacactttcgacggcatcgacgtgacgcagcgcgacgcgatgatcctccaccgtgccaagttcctcgagaggccccggttcttgctgcccatcgccatcgcgaacgccataggcgaggagaccaggaagtacagcgagagattcgctgcccaacgcctgtgcgatgacgccggctgcgacgatcacaacattgacggaagccgcagttccgggaactacattaggcatattaaggatgacaggtgttttgcctgaaatgtatgatacgagtgagtggggtcctggcttgctgcatccatatattatgtcaatgaggttaaacaccgaggaacggaagatggtagaaatcaggaaggaacttcggccacggaccttcagggtgaaggctggacaatctgtccacattggagggttaacgcgcctggatctactagaagcttcagtccagactatctatgtaactgtttgggcatctgccaatatttcacttcatcttggaaagactgaaaatgccgaagaactgcgggacaagcatgttggcatcagacttcagccaccagttgcggcagagcgagcgaccgaactgggccagtggacagagaggcggatcgacgtgtctggggtcagctgggacgtgaacagcacagacatcgcggtctccggcctaggctggtactcgctgggcctgaaaggcaacgccaccgtcgccgtgcacactttcgacggcatcgacgtgacgcagcgcgacgcgatgatcctccaccgtgccaagttcctcgagaggcccgggttcttgctgcccatctccatcgcgaacgccatcggcgaggagaccaggaagaagaacgagagattgaacgcccaacagcagagcgacggcgaagacgatgacgacgacctttccgacgacgaaagcgcctagtgactgtgaggtgacaatagtgagaactgttaggagataggagtgagtgaggaatagctgttgtttgtgagtagtactccagcaaatggttccattgtggaactgtgatgatgtgtattgcacccaatgggaatatagaaaaaggccactgataattgagaggaaggagatgccattctgccccccttgcacacaatacaatacagtatacaattgggtctgtctcttttcaaagggggccgtaccaatcgcctatagtgatctataccggtactgcgngtttnaagtctactggaaactgcgtaccacttangcttn

SEQ ID NO: 26970 - DNA, 313 bp, Triticum aestivum
  Clone ID: PAT_TA_26970
gtcagggaggtgcgaggttgggtatgttggcaatggcagccacggtttcagcgaagggcgcccatgccatgtgcaatgacagcagcattgtcactgggatatgccattagcatgacacaggtgccttagtgtgtgttctgctctaggttgtgcaggacaagtggttgatccatagcttctttgtgtaaggaaaattttgcagactaactttctaaccatgtaatagttttgtataaagtattgctaatttacataacttctattcaagtcctatctagattgaaatcttaatcttgcattttgtttctgacgt

SEQ ID NO: 26971 - DNA, 1111 bp, Triticum aestivum
  Clone ID: PAT_TA_26971
gcggcggtgccccccgccgcctcctcccccgcccgcgtggccgccgcctccttcatggccctggtcttctgcgtcccggtggccgccttgcgggccctctggctcggcctcggcacgacggccggcgccgcccacgcggccgccttctccctcctcctcgccgcctgcttcttctccttcctctgcgccgcggccgccgatcccggatccgtgccctctgccttctcccccgacgccgaggacccgcaggggacagggactgaaatcaaggtattgtgacaagtgttgcatccacaagcctgcccgaacccaccattgtaaggtctgcaaaaggtgtattctgaaaatggttcaccactgtgtctggcattaacaactgtgtgggctatgcaaattacaaagcctttatcatctgcgtcctgaatgcaaccattgggtccctttattcatcggtgatatttgtatgtgatcttctacgaacagagcatgactttagtattctttatgtgaagatcatccatatcttggctggtgttgtcttattctccttgtgcttgacaataggttctttgttatgctggcacatctatctcatatgtcataacatgacaaccatagagtatcgagaggcagttagagcgaagtggcttgcaaaaaagagtggacagaagtaccgccatcggtttgatcaaggcacgaggaagaatattcaaatgatcatgggcccaaatgttttctgctggctttgccccaccgcgacaggacatcttaaggatggcaccgagttccagaatacgaacaactgatcagagacgaagaacagcattgctgcataaacacaacatgtagacgtgggaatttatctgctgaccagattgatcatttctgccattgcgttgttgtcacccaggcagaggtgaagagctcgggcagtttcacaatcttgtaaatcatgtaaacctcacctgaaattatatgtgtgtgtatgctgtaaagtagtttgggttttgagtactgttgtgtactgactgagtcattcaattgcaaatgtaaccagaatatgtttgtcaccatttgaggtgtgcaaaagggaatggaatttggatatatg

SEQ ID NO: 26972 - DNA, 640 bp, Triticum aestivum
  unsure (1)..(640): unsure at all n locations
  Clone ID: PAT_TA_26972
cgccgncgacgcatggttcagcgcgtggggcccgggcagctctgtctgggactacgacatggacagcgctcatggcctcttactccagtctcgcttcgccggtgatcaggccggcatggattacgtccccactgcgccggaagcccacgtggcaccggcggcagggacaggcacggcctgtgccgctcccccttctcctgttcctccccgtcctcccttcatgtggaaggactagacacgcatacccatctctgaacatctcacacatagaacctacctacgctgtgagatgcacacaggctgcagatttttaacagacagcttgtggcatcatcacatcgcaggaacatctcacaatcttttcttttctctctgatcgattttctcctgaaaatcgcaaggaagcccccagctgcattttataggctgggacaaagatgggctatatttgattctccatccttgtagatccttccgtgatgattctaagatgagttttagacattagatagctagtgctcatcagttgtttcctgcatctttagttgtgttgtgtatggctttagggttcctaataaaggttctggaagaggagacggtttttatgctcnccctcttgttcttacctgnaaaaaaaagt

SEQ ID NO: 26973 - DNA, 729 bp, Triticum aestivum
  Clone ID: PAT_TA_26973
accctccccaccttctccggcggcgccgccaccaccttctccggccgcatcccacgacaccaccttctacgccagccgccaccctttctttctccctcgccatcagcggtcatggcgggatccggccgcccctcggcccccaacgcggcctcagccaccggatccagccgccacgaccattgatgcggccataaacgacgaatccggccaccaccgaccctcagtgtggaatccgtccgctcgcacagcccgacgctagatctggcgaaatccacaccggtgcctctgctgccctcggtggatccagccctggtcgtcctctccctctccggcagggaggccctgtcgagcaactccctcacttgccaacgggaggaggccggtcaggaggcatgctctagcacccctccgctccccacggcggatccgatgagcaaaccaacctactcattcagcaaaaatccgcgcgcgtgcagccgggctccttcccccaccgcaaaaatctgacccccgtcgcctcctcctcattcaggtgaccttcccctacctcctttacagcaagacgacgaggggctcttctccccaaccaaaccgccgacccctttcctcttattccgacgaggtcccaaccaccaacggcatgcagtatggaggcgtgatgccatgtagctcaccatgtgcatcccatcccagtattattgctgttcagaatatttccaattttttcag

SEQ ID NO: 26974 - DNA, 778 bp, Triticum aestivum
  unsure (1)..(778): unsure at all n locations
  Clone ID: PAT_TA_26974
gcggaggcgngacggctggctgtcgcaagagaagtttcttgngattacatctttctgcaaactgaatattgttcgacgatattagactttgattcgtaccatggattttcttgaaccaacattagccttagatgagacacattatcaagagggttatacaaatgggtatgatgatggcctggtatctggaaaggaagaggcaaggcaggttggcttaaagaatggtttccaggctggcgaagaactgggattctatcagggctgcttggatgtgtggatgtcagtaattcgccttgatcaagatgcattctcagctcgggtgaggaaatacatggagcaactagctgcacttgtgagcaactatcctttgtctgatccagaggatgagcagcttcaaggcatgatgagggagataagactgaaattcagcgttatcacgggaagcttaggagcaaaattggggtatgaaggtcgccccacatcatctgagcaagacatcgaggatatgtagcttgtttggaattatcgaaaggtcccttgtggattatgaaatctcagtcaccactttgaaaccgatatttggtgtcaatagagtttccttttgattttgtacttatgatgttcagtttcacgtattatgctgccactgggataacggaggatatttggagcactgtatctagatgtatgtaacagaggatttttgcagtcatgttgtttatttttgtggtcttctcctttcaagatgagatgattttcttcaaaaaaaaaaaactcg

SEQ ID NO: 26975 - DNA, 502 bp, Triticum aestivum
  Clone ID: PAT_TA_26975
atcccggtatcaagttcggcgaggtcggcaaggttcttggcgagaagtggaaggccctgaacgagaagcagcgcactccctacgaggccaaggctgccgccgataagaagcggtacgaggaggagaaggccgcctaccagaacgccgaggaagaagaggaggagtccgagtagaggctttcgcctcattcgtgcttccaccaacagcgttgaagatgtcttgtcatgggcggctaggctaccaagcctgtctcgatttcatttgtgatcttcctacttcttaatgggttcgttatctctcgcggaggaaggtcttcggctagccaatctgtggttcatttcgaaaaggacgctggcggtcagtgcaaaccacgctgatggcgggcggtcatgatgtttgggcgtcttaccctcgacgtcgtgaaaggaacatcacgaagctcatgaccaagtctatgtacactagcaattgcggtatggaaagtctttgctgcttctaaaaa

SEQ ID NO: 26976 - DNA, 973 bp, Triticum aestivum
  Clone ID: PAT_TA_26976
tcgaccacgcgtacgctaggaacagcatgcgcagttgtatgcacatatattaataactgcggatcttaaacagggaaaaccaccatcaaaggcagccatgctgcgggcctttggacaacctgtggagggtcagaaacatgcatgggaggaggtttggcgtgctgctgttgacagataccagaaccaaatgtcaccactgggctttgagacaccttttagttcccagaatggcccgttagaaccatctcctaacagcatgaagaattttgaggagtttgagctgaaggaggcacattcagagctcgttgatgcacagactagcaaatggcagaaccagaagtcaccaatgactggctttgagacacccatcaagtctgtgataggtaattgcgcagctcaaggtttggatgttcagaatggcggagaggttcagctggcagtcagttgtgctgacaaactagatcaagagccacctgatgacagaaagataaagaatacaatctatggtgggctagagtctcgttgcggcagcactccctcggaaagttcagaaagcttgacggaacaggactcatgtgtgaaatgcggtaaagatgggcagttgctgaaatgttccagctgcttcttagccgcccatgctacctgttttggttcatcggtgacatttgatgactctggccactttgattgccctgtttgctattgccgtaaagccgctaaagcattggaaaaggctaagaaaacatactctgaagctagaaaaaaattatctgttttctgcagcggctggaagcaattttctaaggaacacagtgagctgatgaatggctttcacacagctaaaaagcaaggtaaccatcagtctgaagcagctgagctatgtcgcaaggatggagagcctagtcatctgaaagaaaatggtacaagtgatgcttgtcctgagaatgcagtcaccacaaagacaaccattttt

SEQ ID NO: 26977 - DNA, 656 bp, Triticum aestivum
  unsure (1)..(656): unsure at all n locations
  Clone ID: PAT_TA_26977
gatatacaaagcatcttatgtttatgaaccgagggaatgatatacaaagcatcttaaatttatgaaccgagggagtattttatttaactaaaaactgtgtttcactgtacatccgcacatgcacgttgtgggcccagaggtgatagtccacgcgacagctcgagctcgtccaaccccaccggcgagcacgcgaggatgacgcggcccagcggctcggcgcggaccgagggcgcgcacggcacccactcccaccgctccacggcgccccccgtcttcccctcctgcagctcgtagagcacggcgccgttggctggctcggccgaattgtacacgtaccctccggtggcgttgccgcacaccgcgatcgacgggagcgtctccccgtcgtcctcctcgtcctcgtcgtgggggaaaagcctcgccgacatctcgctcggcattgcgtcgtggcccgcgccgggaggcagatccagagtgtcgccgtccacctcccatgcttggatgacgactttgttctttgccccctcgccttcgcgcttcgctccgaaaagacgagctgctcggcgccggcgcgaccaggcgcgacgccccacgtggaaacgccggcgtctggtttgaggcgacgggttggaccccaccgncgcatcgacggatcg

SEQ ID NO: 26978 - DNA, 960 bp, Triticum aestivum
  Clone ID: PAT_TA_26978
tttattgagatcagatgaagtttagtctggtcttgctctgaatttctttgcattgtttggtatccaaattagcgttaggtttcagatagcagagtaattgatgagcggcacacatgaccatgatgagcggcacacatgagcacatacggttctttgaacaaaccacacacacacgcgcgcgcacacacacgcaaacacagactcagacgtgcacagatttttgaggtactcacaaacatgaagcacgtactttgttgttcagtaaaatatgcgttagaacctttttttttcttaccagataatttagcaggcatacatgaacaaatgagaaatgagtgattctaacatgagaagatgagggatgacatatgcctactcgtcatgaagcatatcagcatgtggattaataatagaaaggggaggaaacttgcttctctgcatttttattatagtttaaaagggcaaattgtcgacattctaaatgttaggaaaggaacctacagagtccatgtgtaagtattcagattaatgctctgaaagtattataatccacactcgaatgtattaatactcacacaatagacaggccatggcaggcagcaaatgtatatgtcaatttatgatgtttttcacatgataataacactatcagcatgctaattatatgttgtggaggtggcgaggtactagatccgctatcatcatagtaccgattgtaaaacaaaatacatccagagctgaccgagatagaccagcaaccattaccatagacaatgccttttcaggttttcccttgtattaaactacaggttacgctcgctattggttcggtgtccaaacagtttcatgttagatttagtagtataattaggtgacacaagaaactagacaaaggctggtttgatccatacacatatggactgacaacaacaaccaaatctttagataggaaaaaatagc

SEQ ID NO: 26979 - DNA, 772 bp, Triticum aestivum
  unsure (1)..(772): unsure at all n locations
  Clone ID: PAT_TA_26979
gccggccgggttcagagaagaaacaacaagagcttgagagactcttggcatcacacccacacgccccctccaacgcagccagagagaaagagaatggcgagccaaggtgttgcctccatgttcgctctggcattgctcctcggagccttcgcctccatcccacaaagcgtcgagtccatcggggtgtgctacggcatgagcgccaacaacctgccggcggcgagcaccgtcgtgagcatgttcaagtccaacggtatcaactccatgcggctatatgcccccgaccaggcggcgctgcaggccgttggcggtacgggcgtcaacgtcgtcgtcggggcgcctaacgacgtgctctccaacctcgccgccagcccggcggcggccgcctcgtgggtcaggagcaacatccaggcctacccgaaggtttcctttcggtacgtctgcgtcggcaacgaggtcgccggcggtgccacccagaacctcgtcccggccatgaaaaacgtgcagggcgcgctcgcctccgctgggctgggccacatcaaggtcaccacgtcggtgtcgcaggccatcctcggcgtgtacagcccgccctccgccgggtccttcaccggggaggcggacgcgttcatgggccccgtggtgcagttccttgcccgcaccggcgcgccgctcatggncaacatctacccgtacctggcctgggcctacaacccgagcgccatggacatgagctacgcgctcttcaccgcgtccgggcaccgtggtccaggac

SEQ ID NO: 26980 - DNA, 1458 bp, Triticum aestivum
  Clone ID: PAT_TA_26980
tctatggcaatggaacagtgctagcttggtgtgaataattttttatggagctgtaataattagttttctgaatgttaactaaccaaagttacatgtaccttgcgcgcaggcgtcgagtccatcggggtgtgctacggcatgagcgccaacaacctgccggcggcgagcaccgtcgtgagcatgttcaagtccaacggtatcaactccatgcggctatatgcccccgaccaggcggcgctgcaggccgttggcggtacgggcgtcaacgtcgtcgtcggggcgcctaacgacgtgctctccaacctcgccgccagcccggcggcggccgcctcgtgggtcaggagcaacatccaggcctacccgaaggtttcctttcggtacgtctgcgtcggcaacgaggtcgccggcggtgccacccagaacctcgtcccggccatgaaaaacgtgcagggcgcgctcgcctccgctgggctgggccacatcaaggtcaccacgtcggtgtcgcaggccatcctcggcgtgtacagcccgccctccgccgggtccttcaccggggaggcggacgcgttcatgggccccgtggtgcagttccttgcccgcaccggcgcgccgctcatggccaacatctacccgtacctggcctgggcctacaacccgagcgccatggacatgagctacgcgctcttcaccgcgtccggcaccgtggtccaggacggctcctacgggtaccagaacctgttcgacaccaccgtggacgccttctacacggccatggccaagcacggcggctccaacgtgaagctcgtggtgtcggagagcgggtggccctcaggcggcggcacggcggcgactccggccaacgcccggatctacaaccagtacctcatcaaccacgtcgggcgcggcaccccccgccacccgggcgccatcgagacctacgtcttctccatgttcaacgagaaccagaaggacagcggcgtggagcagaactggggactcttctaccccaacatgcagcacgtctaccccatcagcttctgatgagctagctgcgtatgcgtagctagtgtccgtatgtccgtccgtacgcgcgcgtacacgcgtataagagcgtgtatgccgtacgtatgtgcacattatgtattgtacagggcttgggttggggtgcgaccgctgaggcagctcagacgcgtacgcgatagtagtggtttgctatagtagtgtatgtgtatgatttacgatggaaggggggcagatgtaaacgctctcccttcgtcgattcatcatgcatttgatacgcacacacatgtgtgcgtaagtagaactatattgtagggttcaaaatttcgtcaaaacttgacgaaatttgtccaaaataatatgaaatatatcggcgagaccgaagtattcctataaaaaaaaaaaaaaaaaggagccgctcgcgatctagaactagtc

SEQ ID NO: 26981 - DNA, 1760 bp, Triticum aestivum
  Clone ID: PAT_TA_26981
gtcgcccggtgctcctcccgcgcccccgtggtagcgagagagacagaaagacacacacacacacaccctcaacgccgctcgccagaggcataagagcgagagaaagaaagacacatacacacacccacacaccctcaacgcagctagagagacaaagagaatggcgagccaaggtgttgcctccatgttcgctctggcattgctcctcggagccttcgcctccatcccacaaagcgtcgagtccatcggggtgtgctacggcatgagcgccaacaacctgccggcggcgagcaccgtcgtcagcatgttcaagtccaacggcatcaactccatgcggctgtacgctcccgaccaggcggcgctgcaggccgtcggcggcacgggcgtcaacgtcgtcgtcggggcgcctaacgacgtgctctccaacctcgccgccagcccagctgcggccgcctcgtgggtcaggagcaacatccaggcctaccccaaggtctccttccggtacgtctgcgtcggcaacgaggtcgccggcggcgccacccagaacctcgtcccggccatgaagaacgtgcagggcgcgctcgcctccgctgggctgggccacatcaaggtcaccacgtcggtgtcgcaggccattctcggcgtgtacagcccgccctccgccgggtccttcaccggggaggcggacgcgttcatgggccccgtggtgcagttccttgcccgcaccggcgcgccgctcatggctaacatctacccgtacctggcctgggcctacaacccgagcgccatggacatgagctacgcgctcttcaccgcatccggcaccgtggtccaggacggctcctacgggtaccagaacctgttcgacaccaccgtggcacgccttctacacggccatggccaagcacggcggctccaacgtgaagctcgtggtgtcggggaccgggctggcccctgaggccgccgcacggcggcgactccggccaacgccgggatgtacaacaagtacctcatcaatcacgtcgggcgcggcaccccgcgccacccgggcgccatcgagacctacgtcttctccatgttcaacgagaaccagaaggacagcggcgtggagcagaactggggactcttctaccccaacatgcagcacgtctaccccatcagcttctgatgagctagctgcgtatgcgtagctagtgtccgtatgtccgtacgtacgcgcgcgtacacgcgtataagagcgtgtatgcggtacgtatgtgcacattatgtattgtacagggtttgggttggggtgcgaccgctgaggcagctcagatgcgtacgctatagtagtggtttgctgtagtagtgtatgtgtatgatttacgatggaagggaagcagatgtaaacgctctcccttcgtcgattcatcatacatttgatacgtacacacatgtgtgcgtaagtagaactatattgtagggttcaaaatttcgtcaaaatttgacggaatttgtccaaaataatatgaaatatatcggcgagaccgaagtattcctataataagaaaaaataacgatggaaggggggcagatgtaaacgctctcccttcgtcgattcatcatgcatttgatacgcacacacatgtgtgcgtaagtagaactatattgtagggttcaaaatttcgtcaaaacttgacgaaatttgtccaaaataatatgaaatatatcggcgagaccgaagtattcctataaaaaaaaaaaaaaattctcgagactgc

SEQ ID NO: 26982 - DNA, 606 bp, Triticum aestivum
  unsure (1)..(606): unsure at all n locations
  Clone ID: PAT_TA_26982
ccgccaccgcctcgccgccgccgctagctcctccctttcgcccctccgcttcgtcgccgccgccatgtcctcctcctccgccgcgcccggcggcggccggaagccgaaccgcctcgccgccgagcacagcccgtacctgctgcagcacgcgcacaacccggttgactggtatccttggggagatgaggctttcgagaagcctcgcaaattggacatccccatctttctgtcaattggctatagtacatgccattggtgtcatgtaatggaggtggagtcttttgagaatgaagaagttgctaagattctaaatgattggtttgttagcatcaaggtggatcgtgaagagcggccagatgttgacaaggtttatatgacatatgtgtcagcgctgtacggaggtggtnggttggcctttgaccgtctttttatcacccaacttaaaacctttgatgggcggtacatactttccaccagatgataagtatggaagacctgggttcaagactattttaaggaaggtcaaggaagcctgggatactaaacgtgatgctcttgagaagtcaggaaatgtggtcatcgagcaacttagagatgcattatctg

SEQ ID NO: 26983 - DNA, 744 bp, Triticum aestivum
  Clone ID: PAT_TA_26983
gcggccgcgtcgaccgcggccgcgtcgacagatgctctgcgtttatggctctcgctgcaaaatttcctgcaaagccagaagtctctaaaatatctgcagataggatgtttcacacagcatcagagaacgttggttgttctggattgtttggtgattctgtcaaattgccgggtggtattcttgttgaagaggcaagtaacacaacaggctccttagttacaacagaagaaaaggaaggaagcaacagttctgggttgtttggaaattctcctggagatggagtagactgtacagcaggggtttattataattcttatgggacactgctggttaggctgcatgagggcaagacaccggctgtggggactgaaagcgttgttgaagtcgaagatggggcactggaggacgttgtttcatcacagaactctgctatttcatctcaaagttcccctgactatctgtttcacatgactgatcatatgttcccaagcacattgctaaattttacagcaggtcgccgcggccgcagaaatatggccaatggtacaagcaattcaaccacatacacagaacttctgaagatgcaagagctaaagagcaagcctaatgaaaaggaatatgatggagttccaatacaatgtacaaacagggggtcaatccccagtgaagtacataaccttaacagcaagactcaacctcttcatgcttctggctcttatcaccagaatggccgagctcatctcc

SEQ ID NO: 26984 - DNA, 691 bp, Triticum aestivum
  Clone ID: PAT_TA_26984
gcgactgcggcggcgcccttccctcctccgaacgccgagtacctggccgccgagttctccggccacggcgtcaccttcgaggccgtgggcgacagctgcgccgtgaagatggcggtgcgcaacggcagcgcagcgcacctgctgctgcccagcgggctggtcacgtcctacaagccggccatgtggcacggcgccgccacggaggtgctccacaccaccgtcggcgagggccccggcgggcgccccgtcatccgcggcggcgtgtccatggacttccggtgcgcgcgggacggtccgtcgccgtggtcgccgggcggggcgtggtcgctccgcgccgtgaggggaggccccacggggtccatctccgtggagctggtgtccgtggagccgccggggagcggggacggggcggaggcgaggtgcgtggtgacgctgcagccggaggcgctggcgtcggagtacgcggtgacgaacgccgcgtcgtcgccgtcggccgtggcgctgtcgggcgccgtgtgcaaccacctgcgcgtgagcacgcccgacgccacctacgccgtggggctccagggctcggactaccgcggcagggagcccctgctgtccgagttcagcatcctgccgccggactactacgcgacggcgccgtcgtccccgcagccgcgctgggtcagcaaggggctcgacatgc

SEQ ID NO: 26985 - DNA, 609 bp, Triticum aestivum
  Clone ID: PAT_TA_26985
agtgaaaacgagtacaatttagttaattagctttgaaccgacttatttgtacaataaccctgctaaaaagcttatcagtactataaggttagaggaaaaatcaaatcaagaagaaaagaagtttggatagcaaatggggtcagccttttccttcaagggatgtcgaagtccacatcacttactgatgaaactcttgatttgaccaaattaagatatgtcctgagccccggctcgctgttgccttgaaaacaaaattcagttgataagctcaccagaaagggactcctatccagtctcctctagtctgttgagcaaactaaattcaaccagctaaaaaccaaaaggacaagatatattttattcttttgaccaaacgaaggacaaaatttggctcagcaaactgatcacttgcctgaaatccaccgtgcagatgaggcatatgtccagttccacgacgaatcctggggcgttccggtgtacagcgacgagtacgactctgccacatttcttctctttttttttttgcttgtcgcgtgcaaaagttcatcttgaaaaatcggaaaaaaagaatcattccgtttacaaatatattctattgtaatttgcagc

SEQ ID NO: 26986 - DNA, 554 bp, Triticum aestivum
  Clone ID: PAT_TA_26986
agcaggtaaagagctggttccagttgatggtctcagtgaaacagctaatcaagttcacccgcacaagactgagaagggactcctgaagttaattgaacttgtcgagggagttatccagagatcgtcaaaagattacagtagcaaccttgtgcaatctggtggcaacatgggtgatcaatctacgctgataactggttatttcgctcatgcattcttatggaaaacatcagaactcacatgtgtactgcgacacttcattgttgtatgcaatgagcttctgtatgggaatactgatgtcgaaagatttgttcttgaagtgagcctcacactagattggatactgaaccactgcttttcactgcaagatgtatcagagatgagggaaactatcataaagcatttgcatttagatagcactgatgtgcatgaagctgttgcagccaaacaaataggagtccaagccacaaatggcctagatgaacccggcactccaaacagcgtgcagatgtcactagtttctcaatcaagccccatggatattggacttaaagctg

SEQ ID NO: 26987 - DNA, 686 bp, Triticum aestivum
  Clone ID: PAT_TA_26987
ttcggcacgagcatctattctctccttttttagaacaaaatgtgattaatttggcatgcttatgaggaatgttgaatatttttgtgcattagcttctgctgggattgttttggtcgatttgtacccattggtccattatggtgctgatcctctctccattttttagaaccaaaatgtgattaattcaacatgcttatgaggaatgttgaatatttttgtgcattagcttctactgggatttttttggtcgatttgtacccattggtccattatggtggtgatcctctttactttatttgctgaataagcttgatcttggactgatcatgtatattggaacgtacaagattcatgtggaattagttaagttgatatcaagtacatttgttgcatgctccattagtggtttatacttgaaacctggcttgtcatttttagtaaatattacatcatcaaagttgttttatgcatgatgttggtaactgtatactctcctaacagttttattacttgttgtatgcaggctgattggagcctattttttcctttaaaatactattttttgatatcaggtgctcattaagctgtctaagaacaagcagatcatcatttcaccattttcggttgcccaagttatgccatctctttggcctattccagtcagcactatcttctttgttcctaac

SEQ ID NO: 26988 - DNA, 424 bp, Triticum aestivum
  unsure (1)..(424): unsure at all n locations
  Clone ID: PAT_TA_26988
ctcccgcgtccacccagctagttgcaacccagaaatctccggacggcgcatccccaagcctctcgagaagcgatcgatctcccgctgtgcgcgccatgtcgtcgctcgccgtcggccgcgggccggagagcgagctgtactggctcgggggcctcttcacggccgcggaactggccgccgccgacctgctgctaaagctacgcggtgacgacgaggaggaggtggcggcgtncgccgacacgtcatcatactcgcggcgggtcccgagctcccgccgcgaggacctcgccgtggtggacgaggagtcgaaggaggagcgggccttcgaggacgccgcgacggcgtctgcggccacgccgttctcctcgaggcggtctgcgagctcgtgctgccaggtccccgtggaggccgaggaggagcctcg

SEQ ID NO: 26989 - DNA, 135 bp, Triticum aestivum
  Clone ID: PAT_TA_26989
gggttttgttttgtgatgagatgattatttctatggtcctttttaccttgcgcaattgatgattagttctgtcaacattgttttgccttgctcctctactgaaacggaacttgaacaaaaaaaaaaaaaaaaaaa

SEQ ID NO: 26990 - DNA, 385 bp, Triticum aestivum
  Clone ID: PAT_TA_26990
ctgtatacaggctcatcgccaccggttggctctggggcccttacgcgcacccgcctattctcaaggccgtgccaggatctctggagctcatgacatcttcaatctcagaaatcaacacgttcagttacgctagctcctgagtagtgctagctagctgcaacggacggcgcaagtctcttgaagctctatcctacggctgtaacctttcattttgcatgcgtgctactactccttcaataactccacacttaatgtactatatgtaataattatgtgacattggcataatcacggctcacggcggtataaattaaagcagcattgtactatatgtaaacccaaaatttatggctgatgtttcccttccaaaaaaaaaaaaaaaaaa

SEQ ID NO: 26991 - DNA, 397 bp, Triticum aestivum
  Clone ID: PAT_TA_26991
ttcggcacgaggccggtcaaggccccagccacccctgcgcccgcggccgcgccgatcaccgctccagtcactcccgcccccgtcactgcccccgccgcggctcctcccactcccaagcccaaggccaaagcccccgcggccgcaccacccgccaaggccaccgcccccgctccagcagcgctccctcccaccgtcgaggcacccgcagccgccgcgccaacactcatccccgaggtgccttccgccgcgccagccccattgaccaagcccaccgacgcccccgcgccggcgccgtccaagaagaagcgctcgtccaagaagaagacgaaggcgcccgcgcccgccccgggcgccgcggcccccgtgaaagccaagggcgtggcgcctaccaccgccg

SEQ ID NO: 26992 - DNA, 665 bp, Triticum aestivum
  Clone ID: PAT_TA_26992
agcaactgcccatctccttcgacttccaagttccaataggaatggccatccagcctaaactgccgttcacacaactcttcctcttgattctttatttccttgctgtagtagcggttcggccggaatcatcccatgaaatcaatctacagccagcagactttcccaacgagcgcctctaccgagcctaccttgccatccagcgtttcaagagcaccataactagtgaccccaataacatcacctccacctggtccggcaatgacatctgtggcgacaagacatatgtcggcttctactgcgcaacgccgccagggttaaatgagaagctaacagttaccgaggttattctcaatggctttggcctgcatgcgccgaggttacaacgcttcgtcgatcagcttcctgatctggcgcttttccatgcgtcctccaacaacttcggtggcgatattcctcacctcgacagcctgccatacctgttcgagttcggcgtcgctaagtacgacctccaacctcttcatccttccggccgtgtctacgggagtgcagagggaggcgctacgggacaggttattacgaaagatgaagggaagaagaagaagaaaaaaagggtaaacttcagcagattcagtgcgcatatacttttcttaattttacgtttcaca

SEQ ID NO: 26993 - DNA, 543 bp, Triticum aestivum
  Clone ID: PAT_TA_26993
cggcacgagcgtgcttccggaacatggccaccggcatcagaagcagtgaagtagaaggccatgattctgccaaaccagacacgcggctgctcaccacttctgcccatgagcactctgccatcacccaaggcatgaacaacatgagcagaactaaggagttcatttcttgttatggcgagattatagatggcaaacgtgatacatgggggaaaactgttggctgtggggaagaaatcgtggtcagcgatgacgaagaatatgagagctgggatgcattgatggctcgatacccctttgaaggtgtactcccgttggatgtttttccaaaaagcaggcaccgtgatggttctatatacaaatgcacacatccatggacaagaaaatgtctcattacagaccgcagtgagactgtgttcgaggcaatgatgtttacagagccctcaaattgcttcatcctcaatggaacttgcatgcggcatgcacctagtcacatgttccaaattttatcaataaagctggctaaacttgacgtggatggtggac

SEQ ID NO: 26994 - DNA, 381 bp, Triticum aestivum
  Clone ID: PAT_TA_26994
gggctgcagcattcggcacgaggtcataccaccgtactacagctacacaactgcttgcgagtttgtccggcacagcagtagtaccacagcatagatgaagaagagaagcgctctttggcaccgtggtgacattgctttgatttactggtggttctcttcttgtctatggaccatggctcacctgattggttgatgagacttccttgctttgctggtgtaaaagttgatgatatttatttaagttgatctggttcttgactcgatcttgtatggagtatactgtgactggtatccggtacatatggctccctaattaccggttgtgtttgtaatcacttttgccatcttcatctgaataaataagcccttggctaagtagct

SEQ ID NO: 26995 - DNA, 632 bp, Triticum aestivum
  Clone ID: PAT_TA_26995
tttgttagtgtctcaattagtttccttaactgttacaggttttttaggaaggtagaaaagagtgtgtgtgcttattttattaaattcttagaagcttccttgtgtctcaattagtttttgttgtcataaattttccaaaaagtgggaaagaggggttcctcattacattgttagaattttaggattacagaaaagaaagatatgatgggatatgtcgtaccatcgccaactcacatgttatgtacaagtaaagattctagcaatatatttattattcgaaaatcattctactttgtaccgctgaagtatttttcctttttcagcctcatctagttcttggtttgctatcccaaatcataaaggtgtgttttctacaaccaccatcactgagttagttactaaataatttttaagcaatatagtgttacctagaacattgatgaatgctatctttacaaattgtttcgttggacttctctcagatacaactcttagctgatttgaatctgaagaaaacacctgagttgttggagttggtggctgatgataacagcaaggaagtagaggatcttgtcaacttagcaccagataagatgttgctcaaatggatgaacttccatatcaagaaagca

SEQ ID NO: 26996 - DNA, 447 bp, Triticum aestivum
  Clone ID: PAT_TA_26996
tcggcacgagcagcctctcctcgatgcttcacggcaaccgtggcgccgggcgatcgccgctgagctgggagtcgaggaggcggatcgcgctggcctcggcgcgcggcctggagtacatccacgcgacgggctccaaggtggcgcacggcaacatcaagtcgtccaacatactcctcgggcggtcggtggacgcgcgcgtggcggaccacggcctggcgagcctcgtcggcccggccggcgcgccgtcgatgcgcgtggcggggtaccgcgcccccgaggtggtcgccgacccgcggcggctgtcgcagaaggcggacgtgtacagcttcggggtgctgctgctggagatgctgacggggaaggcgccgacgaacgccgcgctgcacgacgagggcgtggacctcccgcggtgggcgcggtccgtggtgcgcgaggagtggacgtccg

SEQ ID NO: 26997 - DNA, 578 bp, Triticum aestivum
  Clone ID: PAT_TA_26997
cggcacgagggccgtcgtggcccaccccctacatcgacggtgctcaagcggctcttctcactggctcctgcgactccctccttcgccatggatacaaccatcattgcaggtgtggagaaccaaaaagttctaataatggtgaatcagaagttcaagtacagtaatccgagggcgtgggggcaactgctgatagaggccgagtcaaagtgtcgtgactgctgatgcagatcttcagcatggattttgatggagatactcctctgatgagtcctacttccagaagataggagtgagatgcgatgggacctgaccagatgctgatgttggactagaaaatttagtgaaaaactattctgtgctgaaagaacagctatgctttgtcggactagcacaccacgagcgatggacttgaaggatttcagtcaatcaagctagttgtcgaaaaggtagtgttcgccgtcgacggtgctgccatttgagtttatggctctgtccatggaggctgcctggaagtttctctgtttccatgtacggtgtcggtgttccatgacagcggccgtgacacgtgatgttccttg

SEQ ID NO: 26998 - DNA, 672 bp, Triticum aestivum
  Clone ID: PAT_TA_26998
ctattgtcttcatgcagacatgcagtgaacttcaattggataataatgatggttttaatttttgactcaaaatgcggaagagattcaaaatagtttttttccagtgaatacatacattatagcaagcattagggttttgaccatgcacgagcaatgtataagaaagtagatgcagaggaatattttatgagcaattcaatgtgttttgactgtaacactaaaatataccgtatatatctttattcaattttttttttgcatttgacatatatgatcttgtataaagctgaataaagtttttagttgagttgattcttgacaagctcaaatccatcacggggctggggctcgtcagcgacgtgttaagggatctggcacacgtcaatagcccccatggccaggccaccattggccacatccgctactccacctccggtggcgatgcccagctgtgcaatgtggtgccgttccttgccggacaccggttcgggcagctcgccgtggagcacaacgacaacctggtgaactacttgcctttgcgccacaagctggaggcgcatggctccatcttcaacaactcagaggtcatcctccacctcatcaccagatcctccacaatatggatgcatgggttctacctaggtttcatggaagtgtgtgtatgtcgaatgc

SEQ ID NO: 26999 - DNA, 890 bp, Triticum aestivum
  Clone ID: PAT_TA_26999
gcgcgtggcacgcacctgcgcctcggggccccacacaagtggcagaggcaccaacacgcaccgccgattcgatacacatacgattccaccggaccggagtaagtgagggtgaggtagacggaggaggaggcatggtgatgtgggtgttcggctacggctccctggtgtggaaccccgggttcgcctacgacgcccgcctcgtcggcttcgtcagggactaccgccgcgtcttctaccaggggagcacggaccacaggggcacgccggaattccccgggaggaccgtcacgctcgagcaccagcccgggtccacatgctggggagttgcttacaaaatttcaagggagcaagataagcagacagccctggagtatctggaagtaagagagaagcaatatgatgagaaggtttaccttgacttgtatacagattcttcccccaaaataccagaagtccaagatatgatggtatatttagccaccacaaataaggaggccaaccaaaactatctgggtcctgctccgctggaagaaatggccaagcaaatctaccttgctgaaggcccgactggacctaataaagagtatttgttcaagctcgaggacgcgttaaacaaaataggagttgtggatcaacatgttcaggatttggcgaatgctgtgcgcaattatgcagatagtttgtaatctcgttataggatcacatgaaggtggaattgattgttgcggaaacatctttattcatgtaaggtctgaaaagcttgtgagtcgtgaatatattcatgcccctctatagatggcagtataaaaattacataagtgagatggtaatgagagctattggctgtcctgtattttactcaaaaaaaaaaaaaaaaggcccctgggaaa

SEQ ID NO: 27000 - DNA, 775 bp, Triticum aestivum
  Clone ID: PAT_TA_27000
cctggcaaggctgcgcatagcagcgccgtcgtcgcctcctgcaaacacgacccggccgccgtcgcccaggtcgaggttgcctatgatatgctgctaatggtgcctctatcacggcaggcccctggcaaggttgtcgataacagcgtccgctacgtttatgggaaacctgtcgttttcgcagatgcagcgccgcaatccatgcagtcagccatgaagaacgtgcctctgacattggaggccccagcttcgagcagcttgggcatccagtcatccatttatggtgcactgatggttttcacatatgcgagtggaacctctacatctttaccatcagcatacactagccctgatgtgcctggatttatcctagcaacagggttcggcgcttcattgtattttctgtccaagaaaaacatgaacttaggtaaggccgcattgatcaccgtcggggggctggcagtcggtgcgacggtcgggtccggcgtggagagctggctgcaggttgacattgtgcccttcctgggcatccactcccctgcggtcgtcgtcaccgaattcattctcttctcgcaattgttggtgtcgctgttcgttaggtagggtctgtgggcaagctaagctgtcagctggccttgtaactgactgaaaaatggtgcatcttttccccagaagatgcaaaaagcagctgtgtatagcaaaaacagtactacagcggggatctaagtcccttgtacttcaatcatcacttgtatctagcctttttctccattgtccc

SEQ ID NO: 27001 - DNA, 485 bp, Triticum aestivum
  Clone ID: PAT_TA_27001
cggcacgaggtctctctcttctcccttccttcgattgcagtccatgtccgaggaacagtagttagttcacagcacaacaccaccgcgccaattagtttgttaagttaggagcttgtgatcaaggcagcaaggcgagaagctgaagctctagctagctctggcgggcatgtttccggcggaggcgtcgttcgccggcgcggaagcggccatgctgccgcccttcttcgtgggctccatgtggcagtcggcgccaggcggcggcgcggctgccttgtccgaggaggacgaggtagccgccgctgcggctgccgaggcagcgcacgaccgcgcggtggcggcgacgcggaaccaccgcgaggccgagaagcgccgccgcgagcggatcaagtcgcacctcgaccgcctccgcgccgtcctcgcctgcgaccccaagatagacaaggcaacgctgctggccaaggcggtggagagggtgcgggagctga

SEQ ID NO: 27002 - DNA, 657 bp, Triticum aestivum
  Clone ID: PAT_TA_27002
ttttttttttttagatagaattgtatgtgtacacatcagaacataagcaactcttgcttagccactcgggtaaaacattacaaaacaaatcaaattagaacacactagactagtgtctcactgcctcatatagctcatactcgttgcacatcaaaaggcacagaacattctacaactcataccaagtgtcttgtacacatccatagtagaacataaataattctggctgagccaatagaggtacacacggaaatgtctcatacatccgtacttgttgcctcgtcaaaaggcatagagcatacgacaaatcacagtaacacatccatgagggaaacatccaacgagacaaatactagaaatgaaaaccaatgcagatcaaactgaaactaaaggtggcattttctatgaacaacacagcatctccgtttgaatctttgtgaagagttcacttgaaaacgcaacaaccaactgagcacctcgtccatggcttcccattttcaatcagcagaacattcatcaactaggagttgcgagccgtaggctggccagcagtggcacatatgggaaatattgctcatgtgcgcagtaggtacgctcaatgcggagtacagctgtactttcatgatgatccaaatcatatgccagcagttcattatt

SEQ ID NO: 27003 - DNA, 572 bp, Triticum aestivum
  Clone ID: PAT_TA_27003
ccaggttcgcttccattttcaaaggatccggcagagatgggcagcaatggaggcgccgacggagcagggttcaacacggacgcactggagggcgtgcgcgccatcctgttgaaaccgtcagagtccctcgacgagtccaccaggatcgccggccccgacttcaacgacgccggcctcggccttgccgggatgctcgggtcgctcgcctccacgggtttccaggcctcccacctcggcgacgccatcgacgtcgtcaatcagatgctggattggaggctgtcgcacgagaagccaagcgaggactgtgacggagctgaacttgaacccaagtacagggaatctgtgaagtgcaagatattcctcggtttcacttcaaaccttgtgtcttctggcatacgggatgtgatacggtttctggttcaacatcatatggtggatgttattgttacgagtgctgggggtatagaggaagatctcattaaatgccttggaccaacataccgaggtgatttttctttaccaggagcattgttgcggtcgaaaggactaaaccggattggaaatctcttgct

SEQ ID NO: 27004 - DNA, 2163 bp, Triticum aestivum
  Clone ID: PAT_TA_27004
cgccgggtcaccccacgcggccgattcgcaacccctcctcccccgttctcctcattgtcctcgcgccccgccccgctccgctccgacggccaaccgctccacacaccactagcctgcctgcctgcctgcctgcctgccgccaaggcaagatggtgaagatctgctgccttggggctggctatgtaggtggcccaacaatggcggtcattgccctcaagtgccctgacattcaggtggttctcgtagataccaccaaaacccctactcccgcgttctcctcattgtcctcgcgccccgctccgctccgacgaccaaccgctccacacaccactagcctgcctgcctgcctgccgccaaggcaagatggtgaagatctgctgccttggggctggctatgtaggtggcccaacaatggcggtcattgccctcaagtgccctgacattcaggtggttgtggtagatatcaccaagtcccggattgatgcctggaacagtgacacactgccaatctatgagcctggccttgatgaagtcgtgaagcagtgccgtggaaagaacctcttcttcagcaatgacattgagaagcatgttagtgaggctgacatcatctttgtgtcggtaaataccccaaccaagacccgtggtcttggagctggtaaggctgctgatctcacttactgggagagtgcagctcgcatgattgctgatgtggccaaatcggacaagatcgtggtggagaagtccactgttccagtcaagactgctgaggcaattgagaagatcttgacccacaacagcaatggcatcaacttccagatcctctccaacccggagttccttgctgagggtactgctatccaagacctatttaaccctgaccgtgttcttattggaggacgtgagacccctgaaggtcagaaggctgttcagacgctgaaggctgtgtatgcgcattgggttcctgaggatcagattctgacaaccaacttatggtctgcggagctgtcgaagcttgcagccaatgcgttcttggcccagaggatctcctctgtgaatgccatgtcagccctctgcgaggccactggtgcaaatgtttctgaggtgtcctatgctgtgggcaaggactctaggattggcccaaagtttttgaatgccagtgttggatttggaggctcttgcttccagaaggatatcctcaacctggtttacatctgcgagtgcaatggcctcccagaggtcgccaactactggaagcaggtgatcaagatcaatgactaccagaagagccggtttgtgaaccgtgttgtttcctctatgttcaacacggttgcgaacaagaagattgcggtgcttggttttgcattcaagaaggatactggtgacactagggagactccagctattgatgtctgcaagggtctgcttggtgacaaggctaagatcagcatttatgatcctcaggtgactgaagaccaaatccagcgtgaccttgcgatgaacaaatttgactgggaccaccctgttcatctccagcccatgagccccacgactacaaagcaagtctcggttacctgggatgcatatgaggcgaccaaggatgcccatggcatctgcatcatgactgagtgggatgagttcaagactctggactacaaaaagatctacgacagcatgcagaagcccgcctttgtttttgatggtcgcaacgttgttgactctgagaagctcagggagattggcttcattgtctactccattggcaagccactcgacggttggctcaaggacatgcctgctgtggcttaaataaactctgataaagggaggagatccgcctcgggtgaatccatgagcagctatcgatagggattcagcttgttatttctctttatagtcgctgtttatcttgtgccagaaaatcagatgtcattttttttcttgagtgtttcttcggggtttacagtgttagaatggcatggtcactgggatgtgtcattcctttgctccattgccacatctttgtagctaatgtctgttgttgcatctttatcatgttactggtgttcatcctgttggttatacatgtggcttcaattactaagattatcttagcaatctacatattctgcaattcagcatttctttgcgtgtgaatactgaaaa

SEQ ID NO: 27005 - DNA, 668 bp, Triticum aestivum
  Clone ID: PAT_TA_27005
gcctacttttccatcccggcatatatccaacagaacatgatgatgacacatcttatggttacagtgttccagcttcaccgaattcatctacaaacagttctcttgcccagggggtatcccagcaagattcaaagaagaatcccttttcgtggcatcgatatcccttcctatcccggttccgttcaagtggagataagaaggacacctctcaacatgttaactctatggacagtgaatgtgaagggactcctattagctcagcaagcttcatcagcagtgacaagttccatttttcattctataagtgggcagggaaaggagctttgttgatgttgccagctagtgtgcaagaaaaagatggaaatattattggggttagaagcttccctcaagtaattgtgcaaggcatcgacctaattgatgaggaagaaagcatgtcaactgccacgcctgcatcaaaaagtcagactgactatgaagattacaaatctgggaaggatggcttgtttgaaagaaaacacagcataaactcaacaaccaaggaggaatcttcagtgtttgatgagtacctgcagggtgataaatccaaagaagcaggaacaaagaagagtatcaataatgcaaagagcaatgtatcagcagggagccccagaactcaaagttcacgt

SEQ ID NO: 27006 - DNA, 518 bp, Triticum aestivum
  Clone ID: PAT_TA_27006
gagcatgacatgatgccattgtccacgggatgcctgtgcgaccgctattggcgaagcttgacatcacctcgcttccactggagacgcggttcccgccgttccgtctgaggcagtacggcgggttctggctgctgcgagaagttcctccagggcgttccggccgtccactccatcttcgagccagggccgtcggacgtcctcctcgccagcttccccaagtgcggcaccacctggctcaaggccctcgccttcgccacgcgcaaccgggccgagcacccgctgcgtggcctcgaccacccgctccgccgccgcaacccccaccacatcctccagtacttggagctgcagtacgcgcaatccatgggccccgggtgggcggcgctcccttcgccacgcgtgctctcgacacacctgccatactccctcctgccagggcgcatcactgcggaggagtccggctgcaggatcgtctacatctgccgggaccccaaggacgcattcgtctcctcgtgggtctt

SEQ ID NO: 27007 - DNA, 251 bp, Triticum aestivum
  Clone ID: PAT_TA_27007
tgtgtaacgtacataggtatacattgcttacgatctgagttctctgccccaggagttagttgtgtaatatgtctgctcctatacaatgtagaaagagaggggagagagagtatacacacacagcgttgtaaattagattaatctgtctattttactccaaggctccaagcaagtggaaatgtacacctggtattttcttttacattaagcgcaaatgtaaagttgaacaacatgcacggctgccataggag

SEQ ID NO: 27008 - DNA, 590 bp, Triticum aestivum
  Clone ID: PAT_TA_27008
cccccgcgtccggcacatgttcttgaaggccagtgtacctcctgatactccgatagatggtacaactgagtattaccaggacctgttccatgctctgtgggaggcctgtaacagttcctctaacacaggccgtgagaccttccctttgagtggagggaaagggttagctgcgatcagtggaacccggtcggtcaagcttcttgaggtgactccaaaggttttgataggagctcttgagaggtacctggctccctttgttgtcagtgttgctgggcgttcacttatcaccattctaagaggcaatggagtcattgagaatgtcgtgtgggaagaaagtgactcagatgctgctgttggtgctgatgcattggttccatactccatggaaaacaatctccagcttcagcacatcgatgatgacgaaattgggataggcgcgcagaggtttgctcatctaagcaagaagggatatgggtgtcgtgagcattctgatattcctgccgcccaggtatcacctcctcttctcaatggaagtaggttatgcctccacattggtcaggataagaacagatcattggccatgtttggca

SEQ ID NO: 27009 - DNA, 594 bp, Triticum aestivum
  Clone ID: PAT_TA_27009
ttcggcacgagggcatatatacttgattgggtatacgggatctgaatttcggcgcacatgatcttactagcttctaaatccgctgagctgtactgatgatggtatgtttgctactcacacattttatccaaaggatccttatgtcgaaacgatggccacttcgaggttgctagtatgtattttcacaccatatgtatgcttgtgcttacctccatatgtatgcttgtgcttaccccatccgcctcggcacattcagtccaaatttgaccaaatactgaagatggtgcacttgtgggtgctacgtgccatgcatcttgcccaatctcacggaaataatcagtaaaaggcagcagtgtttagtcgtccgccacagagaatcgtcggcgatattaattagtatatctcagcccattgttcttgctaatgaagactgttaccaatattaattatcctttcttgtctctcaaaactatcagcctgaatcatagaatgatatattttctttaggattcatgttttctcttgttattatacattacaatgagttcattgtattcagtttctttacaacttcatgcacctgagctatttgca

SEQ ID NO: 27010 - DNA, 503 bp, Triticum aestivum
  Clone ID: PAT_TA_27010
tcggcacgagctgcctcgcctcccactctacacaatcgcatcgaaaccatagatcggttattacccaccacgtgaatccacgcgcaaaattgcccgcggcaacttttccggcggatttggtttcccttcctcccttggcatccactcctcgctgggtgggtgcccctcagcttctactctagtctagtctagatataatactattctacaaagacgagggacgacgaggagatcgatccaagatgttatatgtggcgccaaggtggcggtgcctgctagccgtagccatggccatcgccgcggtgctgtcggcggcgggcggcgccggggcgcaggagacgtgctccggtgcggtgccgccgccgcccaagcgcggggcctggatgtccattgccagcttcggcggcgccggcgacggccggacgctcaacactgcggccttcgcggccgccgtcgccagcatccagcgccgacgcgcgcggggcggggcgctgctctacgtg

SEQ ID NO: 27011 - DNA, 458 bp, Triticum aestivum
  Clone ID: PAT_TA_27011
cggcacgagcgaccgcactaaccatgcccatttaactccaccggccactgcagctagccttctcgtctccaagaagcagagcacccgcagccagcaccatggcgagtcgggctgccgtgtccgcggccctggcgctgctggtggcgtcggcgtccgcgtggctgcacgaagagttcaccacggagggcaacgtgcgcgcgggctacgacgcgcgggggcagcaggtggcgtcgatcgtcctcgaccggcagtccggcggcgccttccgctcccggcgccgctacctctacggccagttcagcgtccagatcaagctcgtccccggcaactccgccggcaccgtcgcctccttctacctgtcgtcgggcgaggggccggggcacgaccagatcgacatggagttcatgggcaacacgacgggccagccggtggcgctcaacaccaacgtgtgggccaac

SEQ ID NO: 27012 - DNA, 583 bp, Triticum aestivum
  Clone ID: PAT_TA_27012
tagtttctgcgaccaacacaaatcaatcagatatctttttctggattgtcctatggcaaaaatatgtggcggtcggtccatatagcttttaacattactccaccgaattctatcaatacgttatttgggacgtgggttgatgggataaattatgatatagcgagacacattcgtgtaggagtgtgtgctttattatgggcaatctggaattgcagaaatgatttggtttttaacagaacaacaaatatcaactttttgcaggttatcttcagagccactgcattgatccatatatggtcgttactcactccaacggaggccagagagcatttggttactgggtctactcgatgggagacggtagcacgagatattttcaaccgatttggatggcgttcatataataggatagacatgtagtgctcttgtcttcttatgccagccggttgtggctttgcctattttatttcagctcttttggagcctttttctttctttctttgttcaagacttgacgacttatgttggatattttgcttattaataatattggccgtatacatcaaaaaaaaaaaaaaaaaaa

SEQ ID NO: 27013 - DNA, 548 bp, Triticum aestivum
  Clone ID: PAT_TA_27013
ccattttaaggtaacacttacaattgcatagccggtcccaagcccggaaaaagaggagggaccaaccatgtgttcttataggttaaagtgtggtgttgactcccattttatatatagtagaaatgaacaaatgtgatattcgcaaagaaggaaaagacatccaagtggagccaaacaggattgtcgcctgggatgcagctgcaaataaagtggcagtgatgagtgaggtgatgactgatgacacaagttgcagccgccagcaacagaaataaccgaagtccatcttgttccccggcaattctggccaagtgatatcccagggtatttccaaggagggcacatctgtgtgcaggtcctttttgttatttacctcgctcgcagcgaacggcaacacccgggactctgaatccctcgtttttactcagcctcagcaatagcacctacaggcaggctggtgccggcgcagaataggtagcacgacgaagctacttgttcgcgcaagcctagagacgacaatgagaaaaacaaagtctgggctgtagcatact

SEQ ID NO: 27014 - DNA, 547 bp, Triticum aestivum
  Clone ID: PAT_TA_27014
aagagcacgatctctagggaatgagctatttaaatctggaaaattttcagaagcttgcatggcttatggcgaagggctcaaacatcaccctgtaaatccggtccttcactgcaacagggccgcttgcaggttcaagctagggcagtgggagaagtctattgaggactgcaatgaagccctcatgattcaacccaattataccaaggctctgctgaggcgtgcagcttcctatggcaagatggagcgatgggcggaatcgttgaaggattatgaggttctaagaaaggaactcccaggtgacactgaggttgctgaggcctatttccatgctcaggttgccctcaagtcatctcggggtgaggaagtatcaaacctgaagtttggaggagaggttgaagcagttacaggaatggaacaattccagatggctacttccttgccaggtgtttcggtcgtccatttcatgacttcttcgaatcagcagtgcggtaaaatttccccgtttgtgaatgcactgtgtaccaaatacccatctgttaatttcctc

SEQ ID NO: 27015 - DNA, 653 bp, Triticum aestivum
  Clone ID: PAT_TA_27015
ggcacggaagaggcccggggctgcagcgggagagagccggacggcggggaggaaggaggcggacacgtccgccggtgggagttttgtccggcggcggaggggacgaggttagggtttgatctgcgaagatttcggggggactcacatatatatagctagagggagctaggagactcctaatggagtgcggttttctcccacacgatcgtgatcgaacgacctagagcatggaggtgacttagaggggttttgggctgtttggagggggtttttgctacaacacacaaaaggactttgcggttacccggttaaccgttggagtaccaaatgacctccaaatggaacgaaacttgacaggtggtctaccggtggtataccaaggccacttgacaagcctcggtccatcccgagaacgtttaacacccgctcacgaaaagagacaagaggggtgctccggtgcatgagggagtgtcggattgtaaaatggacaacgggaaaaatgctcagatgcatgagacgaacacgtatgcaaatgtggtgcacatgatgacaagatatgagatgcatgacatgaacaaaatgcaaaaccaagaaaaaaacccaaccacggagagaatatcgtaacacatagccgaaaatggcaaaagttggag

SEQ ID NO: 27016 - DNA, 899 bp, Triticum aestivum
  Clone ID: PAT_TA_27016
gtttagtcccattgctggtcagctgcgtgtgcctccctccctccccctctgcctccaacagagctccccaacaaccagactcggagagagcgcacgtacgtactgctcctacgtgcgtgccacccgctgagctcagcgtccatgaggaggcggcgctgggcgcgcgccgccgccctatgcctcgccatcgccgtcctgctgcagctcgccgccgtccactgcgcgggcgcctcgaccaggacgccggccttctccacgcgcgcgcgcggccgcgctgcgcagaggtggccctcgatgcccgtgcaccacgctgtgccaaagcccggtccaagagccggagcccgcgcggtcgcgttcgacgccaccgccaccgccaccgccgcggccgctgggtgcaagagcaagagcaagaccagcgcggcgtggaagcggaagccgaccgccggcggccgcgacgacgccgcgtgcgacgaggacgacaagcggcgcatcccgacgggcccgaacccgctgcacaacaggtgatcgcgctttcctccgtaattaagtagcggccaagcgaagaccggggcagagctgcaaatgcaagaagcaaggaggagcagagcagacactccggcgccggtggtgagctgctgctgaaccggagcgccagtcagaatttcccgctcccgagctggtccttctgcccggtgcccatcagcatcctctgtccatcatgggacagatatctatcagtttgttagccatagttagcaagcacttgatttttggtttgatgtcgatgatcttgtccgcttcctgcctgtttgcgctcttgtccgcgagtacttggtgtatattccgcctagctgatgtccttttgttctaccatcagaaacaagaattgttctcttgct

SEQ ID NO: 27017 - DNA, 539 bp, Triticum aestivum
  Clone ID: PAT_TA_27017
cacgaggctcgccgccctcgatagctacctccgcgccgtcccacccgaggccgtcgctgccgtcgtcgacctcgtgttcgcctcctccccatcctccacctcgccctccaagctcttccgcacactcctcttctccttcccgaaggtgtaggacgacggtcacggccatgccgccggcttctgccatccgctcccccgcctctgctaccccagggacgctatgtgtgcacttctcgtgagggtcttccggtcgctcctccaccgggaggacgcccagcctagccggctccagcaacaggccggaatgtcactggcccagacctgcaccatcttctcaatcgatctgctgcagcgagctatgtagattctgatggatgaagtgcatggtttttgtgtgcagaagagagcacgtgaacgaggggctctccggcgaaattgtgggagatgccggggccggggggcagcgaccgctcgtacgatgcgggctgggatgattcgaccaccgcgatggggcccatcgcccaccttttcgacctcct

SEQ ID NO: 27018 - DNA, 1019 bp, Triticum aestivum
  unsure (1)..(1019): unsure at all n locations
  Clone ID: PAT_TA_27018
gcgcgtttgttttttgctttcagatgggacctttctattggatgattccagataaatgtttgctatttacatgcctagtaataataatgtacaaaggtgggtgaggatccaagccattgaaataacaatattgcctcctgcggcatgggttgcccgtcttcctactgctactgttgtattttatggttgtatgcataggtgcaagttccttctgccattctacatttcaccatctggttgaggtgcaaattctttcaatatgtcttccttgtatggacctgattcatgcaggacattgatgacatgcttaacctgagctgtctcatgtacaagaaaatttcctatagctgtcgcaaaaccaggttctaagaagtagtggcagctgtaagttgtaacagggaggtaaccacgctggatcttgtgctctccctgggcaccagcttccaccttactcaggtttagttctatggccgcttcgattgcctggtaatagcaagcttcaaaatgcaaattggggaaaatgggcatctggtaggcatccccataagcggccatataatgtatcgcctccaataagattaagagctccagcgacaactttatcatcatgttcagcaacaattagcattaccttgtcccccatcttttctcccaaaaggngaaagaactcccgcgtcaagtatgctctgccccagtgattatcagttgtgttacggtagaatttatagaaggngtcccagtggntgctctttatttcatctcctcggaggngcttcatttctaagttctgggcaggaatctttttacgttcttgtctgatattcttccgtttgggctgcttcaaatccatcaaaaaatcatcaaaacatttgttgttccgggttgtccaatggnattgcaagcccaattctttgcaacaatccactaaccttcaacttgctaaattcaacttcagatgggaaagttatatgcaagtgatgacacaatcaacttggnaagncaaaantcctcaaagcttt

SEQ ID NO: 27019 - DNA, 526 bp, Triticum aestivum
  Clone ID: PAT_TA_27019
tcggcacgaggctctccaaaacttttgaagtttcttctctctcccccaaaatcctatttaaaaatatatttgaattaacacacatttcaaaaacagtacaaaaaagtggtttgaaaaattttcaaataaatcttaaaataaactagaccaaatttgaggaaggtgggaaaaagaatcaactcatttggagttatatttaaaaagctatagccagtcaaagatttggtcaaatctgtttttaaaataaaacagaaaagaaaacgtttcagatagaaatacgctttcggagcggggaaaacgtactgggtggattatgtcttcacttaaacacgcgtggcggcggagagggtcactgacagtgggtccacggggcccactagtcaggtttgaccagtcttctccctcctctttctctgtcccgagcggaggcgggactccggcgatcgccaccggcgattggcggctccgttcgagaacccgaagtcatccgcgggttcagggggtcgaggcggtcccgccggtgggt

SEQ ID NO: 27020 - DNA, 611 bp, Triticum aestivum
  Clone ID: PAT_TA_27020
cgttcgatttactggacacattccgaaattccaaccaatccagcagatcactgatgccagagctagcaaagtgtccattcatggtgattcacgaaataagctacgtgatttgtcattctacctaaatggcaattcagaagagccagaattttatgaaggccatttccacattgactccaatagcacgataaaggatacattcatatcattccgtggttggaacaaaggggttgcttttgtgaacaacttcaacattggaaggttctggccggtaatgggaccacagtgtgctctttatgttcctgctccaatcctcagatctggagacaacattgtttcttcgaactgcacggtccaaatcctgagcgtactatcaacttggtagaagatccagatttcacgtgcggtccaaatcgatgaaaaaggttacattgagtgtatgtgtgtgtatatagatagtacagggcaaaattctcacatgaaaatgctctcttgtttcatacaaaggcccaaggttctcatcaactgaaaaacatgtatgtaaacatattcagagcgagtcatgcttgcattgtattttaagaaatgttgttgtatcgcttgccgcacga

SEQ ID NO: 27021 - DNA, 601 bp, Triticum aestivum
  Clone ID: PAT_TA_27021
cggacccgtgggtccccacctcaccgactaccagccattcatccatggctcagctcctccctctctcctccgctgctcccagcttccgtctcgccgcgacgccaggcaatggtgtcccccggttgtccgtgacgtcagcccgctctgctgctcgtgtgagcaggaggagcatgaggctcaagtccctgcgcgtcaggtgcgagcaggggtccaagggcggccccgggctggacgtgtggctcagccgcggcgccatgctcgccttcttcggggcggtcggcgtggagctcactaccggcaaaggggtgcttcagaacgtagggctgatggcgccgctgccggcgttggcgctggggctcaccggagtggtcggggtcgtcaccgcatttatcatcttccagtctggatcgtcggattgatcaatcgctccatgttaatttgcgctgctgtgagaaaggaaaaaaaatatatctcgagttgtctttcttgcttcccaaaggcgtctatgaattactctcgttcagtggcgggcatggcatattttgtactattagcatgtagtagcgtattaagtattactataacttaataatgaccaaaa

SEQ ID NO: 27022 - DNA, 1104 bp, Triticum aestivum
  Clone ID: PAT_TA_27022
cagccatccagccctggctcagctcctcccccctccctccgccgcccatccattccttctcccccccctccctcttccctcccctcctccccccctccctctctctgctccggcatgcaagggcggcccccgggcgtcactgccgtctgccccgcttgttgcacgaggaagtagagtgggaatcccccgtacctccttgagcgtgaggcgtctcgctagctagctgggcccgccccggggttgaggctcaggcgcccccccgtggtcgccgacgtcggcccgctctgcggggcggggcagtacggtaagctagatcctcgataaatcggggtggtaatgttcctttcggctttaggttattctctcaccggaggcgttgggttgtgcagcaatttcactagtccccgccgccgggagctggggctgcgtcaaaattccgcgttctatttacctctgtacttggtagtgagcagaaggaacatgaggcccaagtccctgagcgtgaggtgtgagcaggggtccaagggcggccccgggctggacgtgtggctcagtcgcggcgccatgctcgccttcttcggggcggtcggcgtggagctcaccaccggcaaaggggtgcttcaggttcagcagctcgcgtgcctgctctctttccctgtttgatggtcaaaaacggaagcgtaactagcgttgctttgcttctctgcagaacgtagggctgatggcgccgctgccggcgttggcgctggggctcaccggagtggtcggggtcgtcaccgcatttataatcttccagtcgggatcgtcggattgatcaatcgctccatgttaatttgcgctgatgtgaggaaggaaaaaaaaaatctcgagttgtctttcttgcttcccaaaggcgtctatcaattactctcgttcagtggcaggcatggcacattttgtattagcatctagcgtattaagtgttactataacttaataatcgccattctaaattgttgattttttgtattatgtataagaaaaattataacgcagggaattttaactgggattattagagctcgtatgtaattcaatcatatgatttctttgaaaaaaaaaaaa

SEQ ID NO: 27023 - DNA, 855 bp, Triticum aestivum
  unsure (1)..(855): unsure at all n locations
  Clone ID: PAT_TA_27023
gccggccgggctgcgatcccacgcggccaggagaggaaagcaggaggaggcgacaggtgctcgcccgccccaccgccgggaagactcgctccgccgcccgccgcccgccgcccgccggagatggcgatgaccgtggaagtgctcgctggacttgcgtgtatgttctccacgagcgttcttttgcaaatcctggcatgtgctttgtacaacaactggtggcctatgttagcagcactcatgtgtatcattgtgccaatgccatgcctgttctttggcgacggatccacacggttcttgagtagcggagagggtggagcctggatgaaagccgcaaagttcttgaccggcatgtctgccatgggaagcctcgccatcccggcgatcctgaggcacgctggcctgatcgagacgggggccatgttcatcgagttcacctccttcttcatcctggtgtgcacggttctgtgcttccacagggctaccctggacgaggagtggtaaaggctcgcgcaaggccacaaggagtgcccgagagaagaacgcctgttaggatgtggaaaagaaatcccttggtgggagggagctaacgtggaactgtgtacaaagaagcgtgcttcaagcgcttgactactgtatttatgtatacgcgtacccgagattcggtaatctagttggtaatctgtgctgaaccggtcgtgtgaagcatatatgattcggcgcagttgattgacgcaaagcagtctttctatggtcggtttgacacttgtgcattcagaatctgcacttgcagtatggtacaaactattggatggaatgnaagtgacatattttgtttagatgggtgcacctggagcc

SEQ ID NO: 27024 - DNA, 924 bp, Triticum aestivum
  Clone ID: PAT_TA_27024
ggtgaccggggggaggccacgggtaagtggagtcggtcacgcgaggaaagcaggaggagacgacagtaccgccgggaaagacccgctccgcccgccgcccgccgggagatggcgatgaccgtggaagtgctcgctggacttgcgtgtatgttctccaccagcgttcttttgcaaatcctggcatgtgctttgtacaacaactggtggcctatgttagcagcactcatgtatatcattgtgccaatgccatgcctgttctttggcgacggatccacacggttcttgagtagcggagagggtggagcgtggatgaaagcagccaagttcctgaccggcatgtctgccatgggaagcctcgcaatcccggcgatcctgaggcatgctggcctgatcgagacgggggccatgttcatcgagttcacgtccttcttcatcctcgtgtgcacggtgctgtgcttccacagggctaccctggacgaggagtggtaaaggctcacacaagaccacaaggagtgcccgagagaagaacgcctgttaggatgtggaaaagaaatcccttggcgggagggagctaacgtgaaactgtgtacaaagaagcgcgcttgactactgtatttacgtatacgcgtacccgagatttggtaatctagttggtaatccgtgctgaaccggtcgtgtaaagcatatgatctggcgccgtcgatggacgcgaggcagtctttctatggttggtttgccacttgtgcatccagaatctgcacttggagaatggtatgagctattggatggaatgaagtgacaagattttgtttagatgttggacctgaagctaaagttgctcagttatgtgtgccccaattttttgtttgtgtgtgtgtgatctttagagaacattctttggtgtgaatttggagagttcttttt

SEQ ID NO: 27025 - DNA, 642 bp, Triticum aestivum
  Clone ID: PAT_TA_27025
cgctgattcctcatctcgtcagtcgatctgctagcgtgtacgcgttgcccttgctcggatttccttctaatcgtgacgatgttccctattcatctattcctcgatatattattcctaaaaaagaaatctattccaagatctcgcatgctcatggccgaaccgaacaaaccggagacagccgtcgttccttgtttcccttcctctcgcggcaagccggcgatggggatggatgagggagcgacgttgatgctggatttcaaaggtggtggcccgtgcagttctatctgacgacggccatggtggcagccggagatctgatgttccagatgcaggtcacaatttgcgcgccggcgaactgcgccgctctccggtcgccaggtgatgcaaatcatcaagcgcctcctatctcacgtcagactaaatcgcatcatggccattgcctgatcaggtggtcaacgctgctccgatcaatccgaggtaacatcagactatctacttcctatatctatattgctaattgagtaatttatttatgttcgcatgcatgatacatagattgcagtgttcaagcttttgacgtaatttaatttttcgttttcagcaatgcgtattatcatgtcgactagaatatatgcatccact

SEQ ID NO: 27026 - DNA, 1255 bp, Triticum aestivum
  Clone ID: PAT_TA_27026
tgaagactgttaaccctgaaccatgctcctggtattaagtctaacaacttggcggtgctagacagccggggatatagtcgttctctgattgcatcccgttcaatagagtcgtacctcattcagatactgaagaccggtttcttccatgctgatcctcatcctggaaaccttgccatagacaaggatggctctctaatatattatgattttggaatgatgggtgaaatcaaatcattcactcgagatagattactctccttgttctatgccgtgtatgagaaggatgcgaacaaggttataaaagctttaattgatctggaagctcttcagccaacaggagacctctcgccggtaagaaggtccgtacaatatttcttggacaatctgctgagccagtcaccggatcaacagcagactctagctgcaattggagaggacttgtttgcaattgcgcaagatcaacctttccgttttccttccacatttacgttcgtcataagggcattctcaactcttgaaggcatcgggtacatactggatcctgacttttcctttgtcaaagttgctgcaccatatgcacaggaactgctagacttgaaaacgagacgaagagctggacctgaattagtccaggagataagaaagcaagcaaatgatgcccgtgattctacgatctcaatgccctacagaatccaacggatcgaggattttgtggggcaactcgagtcgggtgatctgaaactcagagtcagagtacttgagtcggaacgagctgctcgtaaagctaacgtacttcagatggcgaccatgtatacagccatgggtggtactctcttgaatattggggtcgtcatgggtagtcaaggaaaccaaatagtcgcaaatgggtctttcatcggcgcaggcattttcttggcattattggttgcatctatgcgaagagtgaagaaactcgagaaattcgagacgatgatgtgatcgccgggcttcattttggacatctgcacaaaaaccaagacaaagggttcacacttttgtaaagaaattaaatgggaactgctttctcattcataggtaaataatatacttagattatgtaggagcaacattcttcctgaaaatattgtatcttgttgaaacctgtaaaaatctgtccaagcagtatacattcttttagcagaaagctcagattattcatccgcaaatggttaaaagagctggagaattaatttatgctttatcttacagttcccac

SEQ ID NO: 27027 - DNA, 540 bp, Triticum aestivum
  unsure (1)..(540): unsure at all n locations
  Clone ID: PAT_TA_27027
acgcgtncgtctgccccatccatcgatggtgtggcgcctttgatccaggaaaggaggtagtggccttcttcagtggtgtgttggatgtgacgtgctggggcccgtagctgcttggcgacggcatgccccgctggtgtcaggccctctctccttcgagctggtgcgattttgttcttgctgcagcattccatgaggacctcgatgttttcggctcctctctctattttagtctacagactacatcaattaaggttcaactgtcttatgtctctacttcgtagattgtatacatgcacaagctaaatataggttgcaagaggttggatgaagatgcaacacattcatgtaaatgttgctcctgcactgtgtttatgcacactttttaggtgattgttcattatttagtcaacttccttatgtttgtaatttgtgtgattgtgcacatttttaggtgattgtttataccttttaatttgtgtaaagttcatgtttgtaatgactaatgaggtggcactcttgaaaagtgagaaattatgcagt

SEQ ID NO: 27028 - DNA, 768 bp, Triticum aestivum
  Clone ID: PAT_TA_27028
tccccccggcgaccgacaagccccagcccagaggcggagaccgccgccgcgactccgcctcctgctccaccgccagcgacccgcccgaagctgtcgggtggactggagccgctggacgcgcgcatcaaggagctgacctcgtcgcagggggagctgctggccaggatccagaagctcaaacaggacgtgcagaaatggcgctccgacgttgaggcgcaggtcaagacctgccacaacgagcttgtggaggtgaaggagggcctcgcttctgaagtgcagcacctgaaatccgacatcaaggaaatcagggctgctctccaggaagagaaggcaagctcaaaaacggagcaagccaggaagacacaagaccaggtactcaaaaccggtgatgaacagacggagcaacaaacagcggtgcaagcatgaaatttgcggcccctgattcaaacagaacttgtgctggtggatgttcaacttactcctgtggaccacccagaaaagtaggtaaatacatagtggtactacattagatcaggaggggtagatatgtatatgaacttgcttgcacatcgcgcttgcttgccacatgccagtataccagcatcagcaaactgaagtgcgtatgtttcaaaaccctgcaagagtgaaacattataaaatggacaagaattgcttattttgtaacagttctatataccatgtattttgaaaaggtacttgaattagagaaatggttccataaaaaaaaaaaaaaaaaaaaaaactcga

SEQ ID NO: 27029 - DNA, 284 bp, Triticum aestivum
  Clone ID: PAT_TA_27029
gggatattgtgtgagcaggttccgaagatcgaaaaggcttactccaggtacttggacaacttatctgtatctgaaatggatggatgggcgtgccttcagggaacaagaagagcatagatttatgcatttcctttttcttcttcttcttacattgtaaaggcagattgaccttattttcccgactggtgaaggatttttgcccctacagtaggagaatgttttggccttaacaatttgaaccattttggtaggattacttcggtattgtcaaactaaaaaaaaaa

SEQ ID NO: 27030 - DNA, 613 bp, Triticum aestivum
  Clone ID: PAT_TA_27030
cgatgcgccgctgggacgaggccgccaccaggcttcgggaggaggtcccttcgcctgccgttgcggccttgtgatgttcgccaccgatcgattcgttcgggatcaccaccgttcccacaaggacatcacggccgccaagcagaggaaggccgccaagaaggaggcggcacgggtcaaggctgaacgcgccgctggtccatcaagccgacgccgccgaaaccgcaagcaacagaggccaaggacatgcccgcgaaccaaaggggcgccaacaaggccaacggggggaagaagggcaagggccggaagaacaagggcaatggcggtaccaacccaggcggcggcggcggctacaacggcggcggcggcggcggcggcggaggcttcaacggcggccgcggcggcggcggcggaggcttcaacggcggccgcggcggcggcggcggaggcttcaacggcggccgcggcggcggcggcggaggcttcaaccacgccggcggccgcggcggcgccaaccatggcccgggtcgcggcggaggacatcagggtgccggtcgcagggcacgtggaggtcgcaattgagcacttgtacatgacggctgggtgaccgggggag

SEQ ID NO: 27031 - DNA, 582 bp, Triticum aestivum
  Clone ID: PAT_TA_27031
catgcagaaaacctgaagcatagtagcgtaactgaatattcatttattgaaaagccataaaacacaacaagttgacacttttattggatactgtatccaattattacaaaattacgagcacattttcacaaggaaatggcacaccatcgaaacccttactggaaatatatggaaaggaaaggaaccccggagctatcacacctcttcgatagatgcaaagaaacaaaaataagattacacggtattggatgggacatgatgtccaattatgcaagacaacaagaacatttcgactatcttggcatgaaatcccggcgcatagaatttcttatgaaatagctgcggcaaattcaacatccttggtacagacacgatcgcatccagttgtgcaattctctatgacatctttctcttgttcaccgacgatgaaagggtttgtggtgttgcagacggaggacatgcaacccaacttgcaatactcaatgacttttgcttcgtctgcttccgggtaaagattgaagcgatcacaaggacgcgcacacttgtcaagaattttgcaaccacacaagcttgcacatgtcc

SEQ ID NO: 27032 - DNA, 550 bp, Triticum aestivum
  Clone ID: PAT_TA_27032
cacccctacctgcattacatcttcggcgaggagaacgagccggagcaggtcggggagcaagagcttcatcggccggtgcaggcaccatggcccatcggcagcgatatcagcgtgacagtccttgggcgcacaatcgacatattgcagaggaggtgtgatgagcagtttgccatccaccatgcaaaagatccagagctgctcggcggcatgatcgacgacccacccgaagagccgccgtcaccagtgctcatcgagagcctgatgccccgcaaggaatgggcagaggacctctgcgattcagtcaagacaaaggcagcctgcggcttcatcattgcctgcggcggccgtgtcaacctcgatcccgatgatgtggtggccaggctcgagcgcatccttggcggagttgacgtccccgacgaagtagaacatcgccaacgtgatatcttgaggatgcaggtgatcgacggaatttgctaccaagcgagagacatggaaatggagcggtcccgcggagttgtcatgcgcgtgattgcacgctatcaagctcttc

SEQ ID NO: 27033 - DNA, 452 bp, Triticum aestivum
  Clone ID: PAT_TA_27033
cggggcagtggtgatgtttggaatcccaggcagttttgatctgttccttcgtactaactttcttgaagaacaagcgtctcatgtaagggatctgtccggtggcccggcagatctgttcgtgcgcgtgactggcgattgtgctgtttgtggttttgctaccggggatgttgattcgggggaacgtggtcctgctcgattggtgctagtagggcgtagcgggattgctagagctcctggccaattgtgcaaaatagaacattttgactggtcgcaaaaagttttgggggtcagttaattagtcaaaataaagtatttgtagtttggtcagtcaaactgtttgttgattgtaccactatgaaaattgaactaattagttattattaaagggtcaattatctttgttgaatcttgaggatgagtaaagaaatctaatctccatcacttgaagcaag

SEQ ID NO: 27034 - DNA, 742 bp, Triticum aestivum
  Clone ID: PAT_TA_27034
gccggccgggccgggacatctcgttgcaaatctcccaatctttcccgcacaaacagaccagcgccccttccctcccccctccctcgaagcagcgatggcgcccaaggcggagaagaagccggcggcgaagaagcccgcggaggaggagcccgcgacggagaaggccgagaagccccccgccgcgaagaagcccaaggccgagaagcggctgcccgcgggcaagaccgcctccaaggagggcggcggcgagaagaggggccggaagaagggcaagaagagcgtcgagacctacaagatctacatcttcaaggtgctcaagcaggtgcaccccgacatcggcatctcctccaaggccatgtccatcatgaactccttcatcaacgacatcttcgagaagctcgccggggaggccgccaagctcgcccgctacaacaagaagcccacgatcacctcccgcgagatccagacctccgtccgcctcgtcctccccggagagctcgccaagcacgccgtctctgagggcaccaaggccgtcaccaagttcacctcctcttagattcagtctctggcagctgtagttgggtgctgtttgcccagaattagtgttgctcaatggaaatcggtggaatatcgtttagtttgtagttgggttggtgatgttaccgtgtcatgtgactgatcgatctgaaatagcaatggtctggtgcatcttttgggaaaaaaaaaaaaaaaaaggccccta

SEQ ID NO: 27035 - DNA, 574 bp, Triticum aestivum
  Clone ID: PAT_TA_27035
gtatccttccgtcactcgcttttacattcgcgcgcctgcgtttgccattcgttactcttgttgaaggtcgccggtcattcagtactacaccgtgtaacaatcgtgtaatacctataaccatcgctcggtaccagaagatctactactcccacgacacaccacgtctcaacaaaatgtctctgaaggttttctccctcgctcttgcggccgtcgcaactgcgtcgccattcgactccatggcgaaagccacgaacgacgatccttacgaggcatgccagccgcaaggagcgacaggcacaactccaccagcagtcggcacagagctcagctcgctttataccgacatcctctcgtcgattcagggcatctctttcgacaagcgatctgtacacggacgtgcggacggtttcgggtgccgtcagagcctagactgtgtcaacgtaaagaacatcaacattcccatgtgctacgacaagttcaccaccaacttccagttcccagacggatcttacggaaacgtcgctgccggaacctacagctccggcggcaccgatgtcaacctcgtcagcggaga

SEQ ID NO: 27036 - DNA, 614 bp, Triticum aestivum
  Clone ID: PAT_TA_27036
gggtcgaggcgaggtgacaatgaagactgatatggttaccggcagataaaagggggctggaagggccgctggcactgcacaactaacattcaggcgtcgtcacaaggctggagaggtcctatgcatcgctgctgctattcatgtcactgaacgtgggaaaactgccaagtttgattgttctcaccgtgggaaggctagcaggacaaatatattgcatcatgtgaagaagcaaacaaagcagcaacaaggttctagaagcccggtgtagaggcagatgatggcgatggtcgtgaagacgatcaggctcagccatccgccatgaacatatgcccaagaacaaacaaacaattaatcaagtgaatgcatcaaaatgtgtagatacaggtgacaagtgcttgaactactagctagcattgggctgtatatatagatagaatatttcttgcgcggttttatttatcttttgtgtctggtcaccccgtaatattatgattctgatgtgaatctgtggttcaaatagataggcggggacaccaaatactcattgcggcactactcgactggctctggttaatgcaatatgcttttattcaataaaaaaaaaaaaaaaaaaa

SEQ ID NO: 27037 - DNA, 427 bp, Triticum aestivum
  Clone ID: PAT_TA_27037
cacgggcggatgaaatctcgcctccgcggctccaagcttggcgctcggcgagggggacgcggtgaggaggacggggatggggtgcctgttcgactgcttccgcgcggccggcggcgagccacgcgccggccgcgcccgcgcccagctcgtctcctcctccgtcgtccccagccccaaggttggcggcgagaggagggcgccgccgtccaggaacgcgctgtccgccgtgttcctgcgcgaagatgagggatcgcaggccacgagctcggggtcggaccgggacgccgggagcaacagggtggatccggagctcatgcacgaggaggaaggcaagttgtcgcacctggagaacttacccatcagagggagcaatgaagactttgttaggatagtaccggatgtgctcctacgtgttgaacaatgttac

SEQ ID NO: 27038 - DNA, 546 bp, Triticum aestivum
  Clone ID: PAT_TA_27038
ttacggccaggttctggctctagggtggaactgcacttgccgcgctctgtcgcactttgacacgcagatgctgcggaagttcggcacccagcgccggcagccggcgctgtggcggcggtgccgtagcctccgccaaatcaagcaggtccacaccctcctggtcctccggggcttcctctcggacccctccgcgctccgcgagctcctcttcgcgtccgccgtcgccgtgcgcggcgccatcgcccacgcctaccacgtgttcgaccaaatcccgcacccggacctcttcatgtacaacaccctcatccgcggcgccgcgcacacctccgcgccccgggacgccgtctccctctacgcgcgcatggcgcggctcagcagctgcggcggcgtgaggcccgacaagatcaccttcccgttcgtgctccgggcgtgcaccgccatgggcgcgggtggcaccggggcgcaggtgcacgcgcatgtcgtgaaggctggactggagtccgacgcgttcgtcaagaacgcgctcatcggcatgcacgcgagctg

SEQ ID NO: 27039 - DNA, 545 bp, Triticum aestivum
  Clone ID: PAT_TA_27039
acattcacaatttcatagacaaataagtatttcaatatgttcggttccaacactttcatatgcatctcgtcgtacattgcaacacatgcatgagcttacaggctagttaggtttttttgcaacgtatatttattgtcttatcacttggaacacatacgctaatggtgcaggatattggtcaacatcctacgtggcaaccctagaaaaaaatgttgcactacatttatagacttgcatacaatgggctagcatgcatttttttatgataggcttcctatccaatttctattacagaaacattgggttcgtacgtggtagcatgcatgattcagaagagcaacatcctggtgtaatcctcaaggatggggagcctatgctcatcatcatagccatacatgacgcggaccatccttgcaaagttgagtgacgtgccgacaaaggcatgagatagtgctgaatttgttccagagaagcattccctattcagatcctcccactcacccgcgattatctccagcatgtgttcctccacgtcatctgagaat

SEQ ID NO: 27040 - DNA, 1048 bp, Triticum aestivum
  Clone ID: PAT_TA_27040
caaacctctctccccgctttcccggagacagatccagccatgggcgccgcggcgaggagggcgcccgagcaggagcaaagctgcaaggccacggaggacttcgacgccgccaagccgccgcccttccgcatcggcgacgtgcgcgccgccgtgcccgcccactgctggcgcaagagcccactccggtccctctcctacgtcgcccgcgacgtcgccgtcgtggccgcgctggccggggccgcatggtggctcaacagctgggccgtgtggccgctctactgggcagcgcagggcaccatgttctgggcgctcttcgtcctcggccacgactgtggtcacatggtcaccaggacctcccttggtaccgcggcgaggaatggagctacctccgtggtggcctgacgaccgtggaccgggactatggatggatcaacaacatccaccatgacattggcacccatgtcatccaccacctcttcccccaaatacctcattaccacctagtagaagcaaccaaggcagcaaggccagtactgggcagatactaccgggagccggagaagtcaggcccgctcccaatgtacctcatcaccgtcctcctcaagagcttgagagtcgatcactttgtcagcgacgtgggagatgtcgtcttctaccaaaccgaccccagcttgagcggcgacaagtggaccggaaccgacaagcagaagtgatgagatactggaaactgaagttactactgttcaaggaagaatgcatgatagagatagagacatcgatagcctgctgagaataagcagagggtgcttccagctgaaatcaaagcatggaagctccgcagccaacaaacaggatgcgttgattggttcatcatgagatgagattcagatcatttattagagctagcattctcccattgcgattgtaactagcagatgttgtttcaactttattacaaattttgaatggaatgtggaacagtgtaacagattgattaattattatccaaatcgatattctggcaaaaaaaaaaaaaaaaaggccccta

SEQ ID NO: 27041 - DNA, 1996 bp, Triticum aestivum
  unsure (1)..(1996): unsure at all n locations
  Clone ID: PAT_TA_27041
ccgacgcgtgcgcccaggcctccggcggaggaggaggagaggtgtatccctgcccggccacccaagccttgcccctcccgaatctctctctcctcccctaccattgccttgccccccgctccccctcccccgcgcacacgcacagatccacccgcccggcgatggccccggcaatgaggccggagcaggaggcgagctgcaaggccaccgaggaccaccgctccgagttccacgccgccaagccgccgcccttccgcatcggcgacgtccgcgccgccgcgccgcgcccactgctggccgcaagagccccctgcggtccctctcctacgtcgcccgcgacgtcgccgtgggggcggcgctggccaccggcgcgtggcgggccgccacgcaggtccctccgccccgtctgctgggcggtccagggtactctattatcggcgcccttcgtgctctgacacgactgtggtcacgggaccttctcggacagcggcccgctcaacagcgtcgacggccacccgatgcagacacttatcctagtcccctacaagcgctggaggtatcagcgaaagaacgcaccccaagaaccttggccacctagagagatacgagccatggcaaccgatccctgatcaggtattcgagaaattggaactacggacaaagaaacagcacttctcgtacccgctcccacagcgggcttgtcatgtaaaagtcaggaaccgtggcccggctaaggaggtctcggactagtaaccgagcaactatgagttaactaccacggagaggcgtggtgtgttcatatccaccacctgctggttaaagctaattgcgctgctcaccgggctggcgtgtatctttggcctggtaccggtgcttaagctgtactgggttccatatattgtgaatgtcatgtggcttgatttggtgacgtatcttcaccaccatggtaactaggtcctcccttggtacggcggctagaaatgtaaagccctctgtggtggcatgacgaccgtggatcgggactatggatggatcaataacatccaccatgacattggcacccatgtcatccaccacctcttcccccaaatacctcactaccacctggtagaagcaaccaaggctgcaacgccagtactggttgattaaccacgtacaccatgaaattggcaccgctttcattcaacctcttttccggcctattccgcagtttgagagtcgctcactgtggaccgaggcagcaaagccagtgcttggaaagtaccacaaagagcttgagaggccgcctcttgctcggaatcgacctacagcaggtactagagcctagtttgtaaggggaccactattttaggaacacgggtgacatagtttactaccaaagagcgtcagaaacgagtactagtgcacagagctctgattgagctgaaacatagcatatactaggtcatacttcaactcctcaggaggttgtgacttaagagttaaacaccctaaccaggctcctgggatctcggattggtgagtccatgaatttatttttacatcatgaaacacgaatgtacgtagtaagttgtgaagtattaccattgtaaaagagcaattgcagcttcattcaaggcttgccttgatctgcttgctggtatagtccccgtgtacatcttatctcaatatttgtctcctctcactcaaaaaagcaacactcgggcgtcccgagcgcgctccccttcaacttccccccggatcgagggtttgccgtgtctgcggcaactcccatggnctgattcgcaagtacgggctgatgtgctgcaagcagtgcttccgcagcaacgccaaggacattggctcatcaagtaccgttaagaatggaaactcaaaggaacaaggacaggaaatttcaacaacgtgggctcatcaggcgatcttacctataactagttatgactgcataagttgatccgggacaaacgtgaanaattangcgcgttgacagtaacgt

SEQ ID NO: 27042 - DNA, 1207 bp, Triticum aestivum
  Clone ID: PAT_TA_27042
cggcccccgcgcgtcaccccgcctgctggggacattcctgctctggttcggctggtacgggttcgacccgccgtcctgagccaccagcctcaggcaacagccaggtctaacgaatcaagccgggcaacgttcgggcatagcccgggcgagccggcggccgccgctagcgggcaggtttaccgagctaagccggagttccgaacaagaaatccagtggaagttcggtcgcctttctgttatatccatctcacatgtgatctgatcatcggacaatgttttcgaggtactgtttgggccaatgctttgccgctcttgtgttcgttggcaagattgtaaaattattacactaggtcgacgttcatgctggttttctcacgtttgacgacccgctggaggcggcgcagctgcacggcggctgcggcgcgtgggggatcatcttcacggcgctgttcgccaagaagcagtacgtggaggagatctacggcgccggcaggccgtacgggctgttcctgggcggcggcgggcggctgctggcggcgcacatcgtgcagatcctcgtcatcgccggcttcgtgagctgcaccatgggcccgctcttcttggcgctcaagaagctgggcctgctccgcatctcggccgaggacgagatggccggcatggacctgacccggcacggtgggttcgcctacgtctaccacgacgacgacgagcacgacaagtcggtcggcggcttcatgctcaggtcggcgcagacccgcgtcgagccggcggcggcggcgaacagccaggtctaaccaatcaagccggactacgtaacaagaaatccagtggaaatcgcctttctgttctcgcgcgtcatatcacatatgtgatccgatcatgggatcaatatttccggtgctgtttgggccaatactttggcgctcttgtgttcgttcacaagattgtaaaattattacactaggacgaggttattttttttaccttttttgtgtacatgcgtgcgtttagaggagatgtgtggtgtgtggatggaatctgcagggctggggttttttctttcttggtgatatcttgtcatttttgtggtggaattttgtgatcatgagggtgtggtcaagataggtggctgctcaaggttgaattgttgagatttgtcctctagtacgggccaccctctctatcaaaactttggcgcgttttctcg

SEQ ID NO: 27043 - DNA, 953 bp, Triticum aestivum
  Clone ID: PAT_TA_27043
ggcaacggcgcccgcttcggctgtcggcagccggtcctcacccattgaggatgagctccttcccaaactgcaaagtccagctcgccgcctctccttcttcctccatccacccaccactagcagctttcctctctagctcgatcgatcgatcgaatccttccgtcgcgttcgcgtttccgtttcgtgtgtttagaccaagtttccaatggctcctcttggtgacgctgttgcccccgcgtccgccgccgccccaggcctcgtcgtctctttcggcgagatgttgatcgacttcgtgcctgacgttgccggggtctccctcgccgagtccggcggcttcgtcaaggcgcctggaggcgcgcccgccaacgttgcttgcgccatctccaagctcggcggctcctctgccttcatcggaaagtttggcgatgacgagttcggccacatgctggtggagatcctgaagcagaacggcgtgaacgccgagggctgcctgttcgaccagcacgcgcgcacggccctggccttcgtcacgctcaagtccaacggcgagcgtgagttcatgttctaccgcaacccgtcggccgacatgctcctgaccgaggccgagctcaacctggacctgatccgccgcgcccgcatctttcactacggctccatctcgctcatcaccgagccctgccgctcggcgcacgtcgccgccatgcgtgccgccaagtcggccggcatcctctgctcgtacgaccccaacgtccgcctgccgctctggccctcggcgcaggccgcccgcgacggcatcatgagcatctggaaggaggccgacttcatcaaggtgagcgacgacgaggtggccttcctcacccagggcgacgccaccgacgagaagaacgtgctctcgctctggtttgagggactcaagctgctcatcgtcaccgacggcgagaaggggtgcaggt

SEQ ID NO: 27044 - DNA, 1330 bp, Triticum aestivum
  Clone ID: PAT_TA_27044
caaccacaggctgtcacaaactgataccatatattcttatgctactgaatagtattatcaatccattacgcacaacataataaccatagtaacaaaccttctgagtcgtccaggaactaaataacaggttcaggaaacaggtaggaaattcactgacaaacgtcttaaacttgaaatgtactgtcacaaccacatgtagcgagcagaaactggaaaatggttccatgtttcagggagacacgcttcttcctctaggtgagcctgagcctcgacgtccatcgtcgtcaccattgccccttggacttgggctgccaccgttgccattgcccttaggactagggctaccgttgttgcccctcgggcttggactggccctgttgtctctggtaggactgggactgccattgttaacagggcttcttgggctgcgcccattggccacagggctacggtagccatcagatgggctcctgcttgtctccctgccccgagggctatcaccattatcctttgctacaggtgagatggatcgcctggggctccgactgcgatcaggtgtggggctgcgatccatttccttgcctcctggggagagtgatcgcctggggctcctgctgtagctaatgctccttgatctcctctcatcacgctctgtgcggcgccctctgggagattcagaataggatctggacctagatcggctgtaactacggcttctgctgtagctccgactgcgagcccgtccacgacgtggagatggggaccgtgaatagcttctctcacgcctgagactcctcgggctattctggcaatttctttcaatatggcccctttctccacagcggtagcatttgttcttccagtcaccagctttgcagtccctggcccaatgaccatcaataccacagttgaaacaacggcctgttcctggaggaggccctcttcccacatattcacgttctcgtgaaccaccagaaccacgtggaacccctttagcaaactcaacaataatgcggctcccatccacatccctgccatctaggttgtatcgggcctcatcagcatcacgaggatcactgtattcaatgaatgcatagtcgcgcttcaattccacttcccgtattcttccatatttgctgaaaagatattctaggtcgcgcgaacgagtacgggaggacaatctaccaacatacaagcgtgcgtttccataacgatcatcataacgaggcatctcctcgggagcaggggggcggcggcggcggcgcagaacccgtcggacgctgcggctgcgggctcgtccggcctggagataaggaggacggcaggagag

SEQ ID NO: 27045 - DNA, 2130 bp, Triticum aestivum
  Clone ID: PAT_TA_27045
gttcatgttctaccgcaacccgtcggccgacatgttgctcaccgaggccgagctgaacctggacctgatccgccgcgcccgcatcttccactacggctccatctcgctcatcaccgagccctgccgctcggcgcacgtcgctgccatgcgtgccgccaagtcgaccggcatcctttgctcgtacgaccctaacgtgcgcctgccgctctggccctctgcgcaggccgcccgcgacggcatcatgagcatctggaaggaggccgacttcatcaaggtaagcgacgatgaggtggccttcctcacccagggcgacgccaccgacgagaagaacgtgctctccctctggttcgagggactcaagctgctcatcgtcaccgacggcgagaaggggtgcaggtacttcaccaaggacttcaagggctccgtgcccggctactctgtcaacaccgtcgacaccaccggcgtcctctctcgcgctagttcgatcgaagcagctttcctctctagctcgatcgatcgatcgaatccttccgtcgcgttcgcgtttccgtttcgtgtgtttagaccaagtttccaatggctcctcttggtgacgctgttgcccccgcgtccgccgccgccccaggcctcgtcgtctctttcggcgagatgttgatcgacttcgtgcctgacgttgccggggtctccctcgccgagtccggcggcttcgtcaaggcgccttggaggcgcgccctgccaacgttgcttccgccatctccaagctcggaggcgcctctgccttcatccggaaacttttggcgatgccgagttcgtgcgacatgtcaggccgggggctcctggtgcagcatcggcggccgtgcgccccgggctgcgtctgccaccatcgcccgcgcaccgggccctggccatggtctgctggcccatcccgcggggaacggtgcgttcatgtcccacgccgagccctgcggttgacattcgccccagggcggcccgctcggccccggccccgctcccgcccgcgcgctccgccgcgacgcctcctgcttcgttcagtgccgcgaggtccgccggcggcccccttctcgtcaaggcccttcgaccgcctggcgtgccggcccggggcgggcgctccgagcggctccctctcgctccggtccctggagccaggctcactgcggctcctgctgtagctactgctgcgtgctcgcccccgacccggaggtggggacacgcactcgcttcccacacgcctgaggatcctcgagctgatccgccgttaccgtcgccttcggctggtgtccccaccgcgctacccgttgccctgccagtgagcgggtctgcactccctgccccgctgaccatcgactccgcaggtggctacttcggcctcgttctcggcagcagcgcctccgcccacgtcttcatcttctccttcaccgccaagcgtgcgtgaaggacgtgcagcatcctctacaatgaggcggcacctagagggatcggtgctgtcaagttctcggcaacgccatgcggcgccatctgcactattcagaacagagccgtcccggctccgctcaccaccgcctccgcccttgcgcgcatcatgcaaggggcaggcgcgagcgactcctggtggcgcaccgtcgagtatgaatgctgggggagccttgctgcactttttccatttgggatgcatcagggacgactccatgttctacaatggggcgaagctgagggaggtgctgcagttctcgaacgcttgcggcgccatctgcaccaccaagaagggagccatcccggcgctgcccaccaccgccaccgccctggagctcatcagcaagggcagcaactagagactcattgtgtcgcgccatcggggttgaatcttaggggatttagctgcacttttattattagggatgaattgagtttagttcgtgtgtcaaatgtgtgtgacctcgtgggcgcttaataaaaagcaagcatgtgtggtgattttggttgcggtctttgtgtaaggaggctactgattgttgtagccttcacccaaactttatcagagtctttaatgaatggacaagtttatcaaaatcttgttctgctaaaaaacgggggggccgggaccggtttctc

SEQ ID NO: 27046 - DNA, 594 bp, Triticum aestivum
  Clone ID: PAT_TA_27046
tcacgaggtcaccgttgagtccgacctccacctcgatcatgacgacgacgacccgcacaaggtcgatccctactttaccacaaatatgttctttcttttgtgaagtaacagttccttgctttgtgtaatgttaagaaactgtttgttgagacaacaattattctctcccggctacaggaactgtttatatgcatttgcttaggcttggagcataactcataaatcagttacctgttttgcgtatcctatgaatttgagccttatctgtttgctatttctccatctcaaatctccatcagtaagctaaaaaaagactagctagctaatcctctgtaattagcttgcttcccccatctcacgctgaaaccctagctcttcccttggtgacggagaggctcacatcatggatcctctcctcgaagacatcaacggccaaggaaggagaagctgctgcatagccatcctgtagccatggacggcactcatagcatgtgcgaagtctgctccttccccgcatggctagttagcacttctcccgcccatggaagcagcaggcaccctccgccgatgacctggaccccatgcccaagctga

SEQ ID NO: 27047 - DNA, 530 bp, Triticum aestivum
  Clone ID: PAT_TA_27047
catgatcctgcggtataacctagcattagagacgttgcatgtgatgagtgtatttgggcattcattgtcccagcattacaataagctcaaacgtggctacaatttcctgatacttgtcgccaagttgtacgccccatatgcgttcttcaaagggtgctttgatgacacgaacatgagaaatttgtgggcaataacctctacagaccagctgaaggatggatccacgtttgattgtgatcctgcatgcatcgattggggctcatatctcatcaacacacacattccggctgctctaacatatgctcgaaataataattagatgaacaaagattacaaaagtgcataggggagaagagattagaatatctatttctaatagtaatcatgtatgtcgtttatgtatgtgatgtaatgtttatatatctcatgtataacagcatgatcatgcttcccacgtatgtacctcaaacatacataggcgaaatataggtgtatatatttcatggccataaacatattttgtttgatat

SEQ ID NO: 27048 - DNA, 580 bp, Triticum aestivum
  Clone ID: PAT_TA_27048
accaaactgccatttgtttccggtgcttgaaagcatcgattgcagaaattgtcccaatctcctttcactgccctttttcccagagtgctatgtctcttgtgcacgaggcatacattgtgccagcctgcatgcactaaagattattgactgtcctaagcttttggtgtcccccatgccacctgctcctgcactaacatccattgaattagttgatactcatcggtctgtgacattgggaaagtgggaaatgaagatgagtggctacagtggtgcactagccttccagaatatggtaaatttacataggttattgtgtgaaggtgggtcaataaccttatggtcatacctccaaaaggtaacctcccccatggagcttactattcctgaaggctcgggcataaagtttgtgtgtttcgccggctgcaagattttaacagtgggtggggtcagttctctcatcacatctgtcagcctaaagaggttgtgggccaatggtggtggggatcctcccaactctgcaaccatgaatctgctctcagaggtggcaagaagaaccaaagaattgcctgccggatccttc

SEQ ID NO: 27049 - DNA, 483 bp, Triticum aestivum
  Clone ID: PAT_TA_27049
cgcaacagccctgtagcatggagtgctagaatgctgcactggaggagagtagggagagagttgtatgtgggcttgggtctgtcctggtggcacatctcatgcagaggagggtgcggtgtggtgcagaggaataaagtcctccactccatccttgtgatggcggcgtgagctccagcaaggccacaaagtcaagaagatcttgcctcattcttgctggttctgctaagaatgcgggggagtatatacatgaatcctttgtgtgcctttatgtggggacagttgtttggattgtggtgaggtggtgagtggctcctcacatgtttcccggcaatcgctggaggtggtacttggccaaggtcagaggaggatggtcgtgtgcgtcaactagaatatatccagctttgctccttgtgatagtgttcctctttgtcacaatggagattaagtatgcatgtcaattcttgagttagttttcattctagg

SEQ ID NO: 27050 - DNA, 729 bp, Triticum aestivum
  unsure (1)..(729): unsure at all n locations
  Clone ID: PAT_TA_27050
aaaaaccactatgtttctttcacataaagaatcagcattcatgatcaccaatgtccaggacatagacgattctttaacgagaacaggatgtttctttaacatgctggaactaggaaggatactatttttgtcactatcagctacagctgctacgataaacagcattatcagagctatccgcacattaaattagaccatcacatgactatactgtacataacggtccatatgagttgcaaaacgcatcctccctacatcatcttgatcttgttggctgggtccgtgacatgnataggatttcaatatctggtatatgttttgtcctttatgtacaatataaccggcaagttccagatttagatgatattatggaaaaattgaacaatgccggttatattgtacagaacggggaagacatataccagatattgacctcatcatggccacggacccaaccagcatgatcagaatgatgtagggaggatgcgttttgcaactatgactgtacggtatgtaccggttaatatgagttgcatctaatttcctccctacatcatcttgatcttgttggctgggtccgtgaacatgatgaggtcaatatctggtatatgttttgtcctttatgtacaatataaccggcactgttcaatttttccataatatcatctaaatctggaacttgcaagcggattttcggacgcgtgggtcgacccggaaattccggaccgg

SEQ ID NO: 27051 - DNA, 518 bp, Triticum aestivum
  Clone ID: PAT_TA_27051
caggggagcggcgatgagcgggtggatgctggcggcgctagtgccgccctgctgcagcgtggccggcggggctttacgggcccaaatcgggcctggtcgggccaggggtggcctggtatgccctgctgctgcgtccggacggcgaccgcgatggtgccggagacttgggcctcccgcacgactgcggtggaggtagttccctcccgcgtggttccggtgctgctgctcctgtcgcctcgtgcgtctctctccttcctcttggcctcgtggtggtgatctcggtgaggcggcgtgggtggcgtcaagaccgcggtggcgcatgctggtgggcggcgaggtggctggttggcttcggcctggttgggcggtggggcttggagtgcgggagaaatcccttgccggctctcttccggctccgatgcggtgagacctacggttgccaccatcccttcttggagggtgtcggatgtatccatcccccacttcctttcgcgtgtcgggggaaacccctagacatg

SEQ ID NO: 27052 - DNA, 868 bp, Triticum aestivum
  Clone ID: PAT_TA_27052
cgtccgcgccgggcgagcctccgaaatccaaggtcgggctagggttcttgcgcagcgcgcgccaattcctgcgatttccagggttctacccccgccgggagttccagcttcgcatctcggtgggagtataactgctcgagcaagcaagcgcgatccggcgacgccaccggaccgtcggaggaaatgcaggctccgcgggctccggtcctcgtgcaaaacgagaacttgcccatcttccgaggcgttgatgggaagaaagccggggtggcgcgcgggcctgcggccagggcggggcggcgagccctgggagacctcggtagagccggcaaagctccgccggccggcgccgccgggaaggccgcaccagcagcagcagcagcagggagcgtgcaggggtcgaagggcgtggcgaaaccgagctctctgagcgatggggactggatgaggtgctgcgagtgggctaagggtggcattgagactgcgagtttcaccgggaatgatatgcagagactgatggccgatgagcaagaagagcgcatacgaaagaaggtggagaaggcaatggccactttgcaagtctccatgaacagtatttatgacatcaatgtaccatcgaagatatccctggacgatccagatgatgaaacaacattggagcttgatcctgagttccttcctccaacggcgtacttaagctcaagactaggtgagcatgatggcaactatctcctttctgatttggaatttgagcatgaccctttttctggttgcaattttgacctgaagctcaaggatgactactgaaatgatagtttgtctagatcaacagtattactctgttgaggtttcatcgttcagtgactcagtg

SEQ ID NO: 27053 - DNA, 692 bp, Triticum aestivum
  unsure (1)..(692): unsure at all n locations
  Clone ID: PAT_TA_27053
gtcggcttcaccgtgcctgtgctcgacggtgaggatctatcactcagggtgctggtggaccactcgatcgtggagaccttcgccatgggtgggaggtccaccgcgacgtcgagggtgtatccgacggaggccatctacgccgccgctggcgtgtaccttttcaacaacgccactggcgccgccgtcaccgtcgagaagctcgtggtgcacgagatggacgactcctacaaccagatcttcacggccgacgatgcctcggccgccttgtagctgaatctaatcaagctcttggcccggtaatgcatattcacctatactacatattatgattcgatcggcggtcacattgatcggtcggcggcttcctccctcatggatggatggagatggagtactagctacgtactctagtcatcttcctgttcgtttgtttgttgttttttcttccttttggattttgggtttttggtgagatgaattagttagacgatttgttggcgggatgattactgccttccaagtgtaactattggcaggatggatatgtatcctgcagcaggactatgatgatgatgatcgtattgatcaatcaattgtaaatgaaattattggggaaagagcggggtacgcgtgtgcgctgccaccaattttttgaaatgnaaaaaaannnannnaaaaaannnnnanaaann

SEQ ID NO: 27054 - DNA, 1128 bp, Triticum aestivum
  Clone ID: PAT_TA_27054
cgcctggtgcccgaccaaggtacgacatcaacggcgtcttgacgggatccgccaccatgctccccaatggcacggtcatcttgctttacacgggcaatagtgacacctttgcccaggttcagtgcatcgccttccctgcagaccctgcagaccccctccttcgtacctggaccaagcaccctgccaaccccgtcatcttcccgccccctggcattggcgacagggacttccgcgaccccatggccgcatggtttgataagtccgacaacacatggcgcaccatcatagggtccaaggatgaccatggtcatgccggtattgccctcatgtacaagacgaaagacttcatcaagtacgagctcatccaggacccggtccaccgtgtcgagggcaccggcatgtgggagtgcatcgacctctatcccattagcggtggcagcgactcatcagaggaggtgatacacgtgatgaaggcgagcgtgaacgatgagtggcatgactactacgcgttggggaggtttgatgcagaggccaacaggtgcacgccgttcgacgcggaggctgacgtgggcatcgggctgaggtacgactggggcaagttctacgcgtccaagaccttctacgacccctccaagaaccgccgcgtgctctgggggtggatcggcgagaccgactccgagcgcgccgacgtcgccaagggatgggcgtccctccagtcgatcccgaggacggtggagcttgacgagaagacccgaaccaacctcatccagtggcccgtggtcgagatcgagacgctccgcatcaactccaccgacctcggcggcaccaccatcgacaccggcagcgtgctccctctcccgctccgtcgcgccacccagctcgacatcgaggccaccttccaccttgacacctccgccatcgctgccgtcaacgaggccgacgtcggctacaactgcagcaccagcggtggtgccgccaaccgtggcgcactcggccccttcggactccttgtcctcgctgacggtgccctcaaggagcagacagcggtgtacttctacgtgtcgaggggcctcgatggcggcctccagacccatttctgccaggacgagtcgcggtcgtcgctggccc

SEQ ID NO: 27055 - DNA, 2157 bp, Triticum aestivum
  Clone ID: PAT_TA_27055
tcgccccgggcggccgccgtcgcggacgggcgcgtagctccacgcgtcgtcccgcctcgatggcggcttccagaccccacttctcgccatgccgactcaccgtcggcgctggctcagcacgtcctggagcggctggtccgccgtcactgcgccagtgctcctcggtggggaccattcccgcagggtcatggcggccgacccgttcgtgtgcgtccctgccccctcgggggacggcccctccctgcgtcgcacgtggacgaagcggtgggcggactcagcccgcgtgggcacgccggttatcatcaacgcctccgggtgcgcctccaccaccggatcgtgcggcgcgtccgagaggaccgaatccaccgcccggcgctgagggggacaccaccgctcgccgccgccgcggccgtaccgatgtacgctctctgcaccgcaacccccgctgacctccacatcttattgatcgtggcccacgcgacggactactcgcccggcgggttcttcccgcctgacgaagcctcaaccgtcttgtagctgctatttataacgctctcggcccggtcctgcccactcacccatacttcgtattatgattccatgacatggcattcatggatcggcgacttcgtcccgcatggatggacggagatagaggactcgctaccctggtcggccatgtgtctgtttgttgttctctcctccttgtgcatgtggggatttttggtgagctgaagtagttagatcgtttcttagccggatggcgactgcgttgcaagcgtatggatttacgtgatgtagatgccccgtgcggttgacctccaccggtgattctgatgaaagttattttagtcgaccccgtgtgacctaaatactttgagaatcaagacaacagacggcggcggagccaccagtgacaggggtaatgatggccatgcccggcattgcccttccacgtacaagaccaaagacttcatctagtaccagctcatcccggccccggctcaccgcgtcgaagcgcaccggcgatgtagggagtggcattgccctctagccgccaaagcgggcggcagcaactcaccaggacgactcggctatactgtgatggccgtcaaggatcaaccggtggatgacatcaacgacaagtgcagtctaggtggggggcccagggcacacggcgggctcggcccctctcggctgctgatccatgccaccgacagcggcagggaagaagtggcagtggtccctttcctttacaaggggcttgatgggggcacctccgggaccccagttctgccattgatggagtcggggtcatcgcgagccaaggaactgctgaagcggtgtggtgggaaggcaccgtgcccgtgctcctatggagaggctttatccgcaagggcgctcgtggatcattcgattgtggagagctttgtgatgggtgggaggatgacggtgacgtcgcgcgtgtaccctatggaggctatccatgcggctggtagggtgtgcgttttcaacaacgccaccgggtctgccgttaccgtcgagaagctcgtggtgcacgagatggcgtcagcaccaatacaaccataccgtgatgcatgagattaatttatgtagttttcatgttcgatgtcaaatatggtcttgttctttcagatggatctagttaatcagttttcggtcatgcgtgattgaaaattcctacaacctgatcttcacggccgacgatgcctcggccgccttgtagctgaatctaatcaagctcttggcccggtaatgcatattcacctatactacatattatgattcgatcggcggtcacattgatcggtcggcggcttcctccctcatggatggatggagatggagtactagctacgtactctagtcatcttcctgttcgtttgtttgttgttttttcttccttttggattttgggtttttggtgagatgaattagttagacgatttgttggcgggatgattactgccttccaagtgtaactattggcaggatggatatgtatcctgcagcaggactatgatgatgatgatcgtattgatcaatcaattgtaaatgaaattattggggaaagagcggggtacgcgtgtgcgctgccaccaattttttgaaatgaaatttaaaaaaaaaaaaaaa

SEQ ID NO: 27056 - DNA, 528 bp, Triticum aestivum
  Clone ID: PAT_TA_27056
gaatgcccttatccttccttcccatgacgacccctctccagtaagaactatggctggtggtagtgttgccaacacagttcggggtctctcagctggttttgggatatcaactggaataattggagctcgtggagatgatgaccagggcattttgtttgtcaacaacatgagctttagtggcgtagatctcacaagactaagggcaaaaaaggggcacactgcacagtgtgcatgcttggttgatgcaagtggcaatcgcaccatgcgcccatgcctatctagtgcagtcaagctccaggccaatgagttcactaaggaggacttccaaggctccaagtggctggttgtgagatatgcacaacaaaacctcgctcagattattgaggctatcagggttgcaaaacaagaaggtctctcggtatcattagatttggctagttttgagatggttcgtgactataagtcacaactaattgccctgttggagacaggcaacattgacctttgtttcgccaatgagtatgaagc

SEQ ID NO: 27057 - DNA, 463 bp, Triticum aestivum
  Clone ID: PAT_TA_27057
agctaggacaagggcaacaaccaggacaatggcaacaatcaggacaagggcaacaagggcactacccaacttctctacaacagccaggacaagggcaacaagggcattacctagcttctcagcagcagccagcacaagggcaacaagggcactacccagcttctcagcagcagccaggacaagggcaacaagggcactacccagcttctcagcagcagccaggacaagggcaacaagggcactacccaccttctcagcaagagccaggacaacggcaacaacggcaaatcccaccttctcagcagcaccctcgacaacggcaacaacggcactacccaccttctctgcagcaaccacgacaacaagggcattacccaacttctctacagcagctacgacaagggcaacaaatacgacagccaggacaaaagcatcaaccacgacaacggctacaaacacgaca

SEQ ID NO: 27058 - DNA, 478 bp, Triticum aestivum
  Clone ID: PAT_TA_27058
gtccgcccgacgtcgtcgaggcatcctaacaggcatcggtctcagttgtggagtgatgctggccgtggaggcatcccaaatcagcagcaactgattattagtcaaaagagaggtggttaaaattgctccaacattcttcttcacgatgactgatggtatcatgtggctggaagataaatcaacttcgccagattccgggacatggtgatgattaggtctcccttcatctccatcttatgcatcacgtagccgtctctctggcacaaccattgccgctggatcaaatggagctgaaattctgcacagtatataggatgactatggtttgatgtgctaatgtgttgaaatggtccagcgagtaagaagagcattctgaatgtagcttgtgagatttggaccgtttgatttttttatggaaaatatgtcttctagtgcatgcacgcagaacttactgttcaagtgttcatttgcatatagg

SEQ ID NO: 27059 - DNA, 462 bp, Triticum aestivum
  Clone ID: PAT_TA_27059
gtaaatgcagtctgaggagggtgaggagtatttttagccggagtgaaaaacggctcgcccgaggaaaatacacaaacgtgcccctgaccttctcatcctagcgacatgtgtcacccacatacagtgtggtggagatcgtgggtgaatagataactcttatcgtgggaagtgtaatggtttgagcggcaaaagccgaaaattcagataagaatattttaaagtttcgttcgcaatttcttcagctgacaaggacacattgaagcttttgaacgagtttcaaatagaacgcacatgaagaatttgtgaacatactgggttgagtttagcagagagggggaaagggtccgatcacattcacttagcaaaaaaaatcaacttgaagaattagcaatgagtgaatgttgtagaggacataaactcgtacatatatatagtcaaatgaagaacaacaaaggaaagagt

SEQ ID NO: 27060 - DNA, 845 bp, Triticum aestivum
  Clone ID: PAT_TA_27060
caggctcattttataacagcggcgaggcagatatagttgcacaacatgtcatcaatcttgtactgtgtggggtctctccaacttccattgctgttcagtcgccttacattgctcaggtacaacttttaagagatagactagaagaatatccagaggctttgggtgttgaggtgtcaaccatagatagctgggcggggaggtgggcagatgcggtggtcatatcaatggttcggtcaaactccttgggagcggtagggttccttggcgacaacaggcgcatgaacgtggccattaccagggcacggaggcatgtcacacttgtgtgcgatagctctacgatttgcaacaatgagttcctggccaggctccttcgccacatccgtcagcatggccaagtaaggcatgttgaacccggttcctacggtggtgattatggccttggcttcagcccacctgccttgccctccatcagttagtgctccgctcatttggcaacaaatcggcaatcctaaagtgttccgtttctccatgcatacatgtcgcgcaattcttgagtggtaaaactgggaggtccatcatgtactacggttctgaggctggtactttggggtatctgagatggctcgatgggctgtcctgaatgaactgtgtggccagaccaagttgtttatcatgcactttttgcgtttagcagcaaaaacaattaactgtcctgggtttatgtaacatacgtattgcttacctgacgatggttgaaaattattgagtgttgccccctggattatttgattattacagagatgtccagcaacttaaatctcatgattaaaggcaatttttttggc

SEQ ID NO: 27061 - DNA, 611 bp, Triticum aestivum
  unsure (1)..(611): unsure at all n locations
  Clone ID: PAT_TA_27061
gcangctcgtaattangcccgtaagccccttcgccgtcaggcacagcactggtcgccggctcgccgccgtcgccccacttccactccacaccagggcaccgcgccacgggcaccagtcggggaaaaaccttgctctgctgcagtgctgcgctgcccccaatccgttgtccagctccggtttcgaggcggaggccgagggggaggaggcggaggcgcggacaagtcgcggaacagcgccgagaattagatggagcagagcttagaaaggtgctggatctggaaggggaaaagctcagaggatatgacatgaattaccatcggtagtagactggccatgtacttgaatcgtcgtgaccaggatgagaagcagcgcaaggatccatgtcagctttgtacttgctgagcaactgaagttgatcaccatggtactctgtcttcggttcttgcaatgttggtaagcaatcatgcaaattaagaagcttggtatctgcaacaaatgacttgtgtacgcagttatatggccgagaaaaccaagtacagtaacacaatttagtagtatgcggattgacttgacttgacttggcctcggcgctcaattaacaatgtggatg

SEQ ID NO: 27062 - DNA, 1094 bp, Triticum aestivum
  unsure (1)..(1094): unsure at all n locations
  Clone ID: PAT_TA_27062
ggcacgagggagttcatagcggacatgcagcagatgttgaagagtgtggttcaacatttcggctacagacatgaggtccgtgtagaagctgagattctccacaatctattcttcaacataatgaagatcgccttcccagactctgacttccaagaggtgaaggactcgctgtcgttttcgaatcccggaggtggtgcaagcagcgcggctgtcccatcagcaaagcacctggcttcaggcctgaagcgccgttccgccaccactgaagcggagcagcatggtcccggcagcggcaagcacagccatcacgcgtcggccggcgaggctcctagccgggccaaacccgagagggactcgaaggcattcaggaccaggcagcagggaccagagcctcngacagcccagggctgccgctgcaccctggcgacctgttcatcgccaagaagaagaggcaagaccgggctcggtccagcatcgggtcgccgtccagctcaggcccccgtggaccgctctccccgaccaacactggccggctgggcccggcgccgtcgcccagaggcgcgaggacgccgttccagagggactctcacccgtcccagcagtccatgcccgggtggggcgcgcactcggaccgcggggggagctcgccgcccggcatcggggacatccactgggccaagcctgccaagcggcagcggaccgacacaggcaagaggcggccgagccacttgtgacgcgacgggcacattctccatgcatcatcatcgccgccatgcgtcgcggacttacggccatgagaagaagggaatgctgtgtgggtagtagggagtatgttgggtatttgtttgtttactgtaaagaggaacacttcctttaatagcctttgttatgtggtaggtggtttagtggtgcaaccagaggatgcatgtgttctcatgtggaagggacagtgataatggaaatgagctggtgtttagttaataatcagttagtaaaaaacatctgtagtatgtttccataagcaaagttgttaccaggacctgataaattaattaacagcgctttgctttcaaaaaaaaaaaaagtgcccagag

SEQ ID NO: 27063 - DNA, 716 bp, Triticum aestivum
  unsure (1)..(716): unsure at all n locations
  Clone ID: PAT_TA_27063
caggactctcataaaaacgtcaggtctcctagcactggagggaagtagatgcttagaagacagagcaagtggtctggtcaggtgccctgtgaacctacagtcttctaaaaaaaacctgagcagtaacccactgcgattttttttattatatcttttttttgttaacatgcttagatgatttttttggttaccttctttatcatgttttcatttctattgacagttttctcagctgaatcagcatttgctgtgcaaacagcccgccagtcggagatgcacatttacaaaaattgaaatttgaaatgacagctgagaacatatacagacattggtaagctggagtgaagcaaataagcacgtatgcaaagggctacgtcatcagacacactgcttgcacaacacattgccctgtgaagtctacggtgcttcgaagaggaaatgttaagttgcccggcatgacagtggttggggatccgctggtggccgccgggggctgctggtccaggaaacgtacggcggtgcaggtgatgttgttggcgcttcccctcttcgtcgccttgacgaggagcttcttggcggcctcctgctaagcccaaggttggcttcaacaatgggccacgggttccttggtaaacaaagggcaagtcatctcaaanatttctgcatcttttgctancttncgnagggcaagttcaanctgggtacaaaggattaag

SEQ ID NO: 27064 - DNA, 999 bp, Triticum aestivum
  Clone ID: PAT_TA_27064
gtcgacccacgcgtccgggcagcactcaagagcctcataaggctggtgaacataaacttgatgataagtctgcgcaaactgatggcctaatcagcgatataagaaatctggtggttggcctgtcgtctagaagaggtcaacgagcaaagaacaaagttctgcaagaagatattctacaagaaattgagaggttagcagctgaagcatatagcatttttaggagccccactattgatgccatagaagaccctgtttacatcgatgacccagaaagtgtgaagccagcttgttctggcactggatctggattcgaaatagtgtgccaaggatttaattgggagtcacataagtcaggaaaatggtatgttgaacttggtacaaaggccaaggagttgtcatccctgggtttcaccattgtttggtcaccaccacctactgattctgtatcacctgaaggatacatgccaagggatttatacaacctaaattccagatatggaaccatggcagagttgaagcagcttgtggatattttccatgaaaatggtgtgaaggttcttggtgatgctgttctaaatcacagatgtgctcagtttcagaatcaaaacgggatctggaatatttttggtgggcgtatgaactgggatgaccgagcagtcgttgctgatgatccacatttccagggaagaggaaacaagagcagtggagataacttccatgctgcaccaaacattgatcactcacaagattttgtgagaactgatattaaagaatggcttcgctggatgagaaaggaagttggatatgatgggtggagacttgattttgctcgtggcttttggggtggatatgtcaaagattacatggaagcaactgaaccatactttgcagtaggagagtactgggactctctcagttatacttatggtgagatggattataaccaggatgctcacaggcagagaattgttgactggataaatgctacaaacggaactg

SEQ ID NO: 27065 - DNA, 836 bp, Triticum aestivum
  Clone ID: PAT_TA_27065
cttttagcttccgacccccccgctccgtcctccaagctatcatcctgctagcacccgtgaactccagccattcacgctgcgtcgatcgtttggtttcgtgcgtgcgttgtttgtgatcgtgtgatctgttcgggagatggaggcttacatgctgttcccgcggagcaatggaaagagctgcgaggaggagcaggaggaggacatcggctgcccgtccgagtccgaggtgtcggcggccggctccatgctgtcgtcggacgaggagctcgacgacgacgccacctccagctccagctcgtccggatccaccgacaacttccagatgtcctccctcatggcgcagctcccgctcaagaggggtctgtccaagttcttcgacggcaagtcgcagtcgttcgcgtcgctcgcggccgtgggcggcctggaggacctggccaagccgccgggcaagcggatcaagacgtcgcggagctgcgaggtcgggctgcaggacgcgcaccgccggcggttcgcgcgccacaatgccgcggccttcaagaaggtgtccaaagggcggctgtccgcgctcggcagggcgccggcgctccggccgctgacggcgagcgcggcgaggcccaagggcttgcccgtgcgggctccgctcttcgtttaggagatttcgcccgcagattagtcgtgtcggttgtggcgtgctcgaagagcagttggtgcggttgttacgtggattttgacatggtaactgaccggaaggtggccggctggtcgatggatgtgtaaatacagaaatgagaaacatgccttgttcagtttccaaaaaaaaaaaagagttgccccta

SEQ ID NO: 27066 - DNA, 928 bp, Triticum aestivum
  unsure (1)..(928): unsure at all n locations
  Clone ID: PAT_TA_27066
ngggggccttcgccagccacaacgggcggcgcagcctttaaacaggaagttcagcgacctttgcgacgaggtgcggttgcgcctaaaggagccacgtcgtctacaccgacatgttcgccatcaagtacggcttcgtcgccaaccacaccaaatacgggatcgagtgccattgatggtgtgctgcggaaacggcggcccgccttacaacttcatgccggggaagttcggctgcggcgatctctgcgggccggaggagaaggtgctgagctgggacggcgtgcacttcaccgatttcggcagcggcctcgccgccaagcatgccatgagtggcgagtactccaagcccagagtaaagctggcgagcttgctcaatggtggctccaagaaaccatcatcggtgtcttgatgctcattgatcaacgattgaaccacgaacttactttgggcgggtcttactttaaaaagaaaggttgcttgacaaaaaggaaaaaaaaacttcggatggatcatggatgagtggataatggtgaagatcaatccatacgatggccacgatggatgatgtgaatgttgtaaaagttgcagctgattgttggctccttgtacacaataggcaatagctccctcggctacaagtaaaaagttttttttcacttttggagtataatgattttgctttgttggtgtgtgtgtatagacaatgtacgtggcggctgcgatttcacagagctcataaaaaatggtgaatcctagatttatttgatctgtaaaagaaggtaatacaaaaacttccaaccataggcactattttatacggaatattgtacttctagcacaaaattttcgttttggattgtttgatttgtaaaatagcaacccatatgaatttttttgtaaaaaaaaaaaaaaaaaaaaaactcgagactag

SEQ ID NO: 27067 - DNA, 262 bp, Triticum aestivum
  Clone ID: PAT_TA_27067
ccgttcctaaatataagtcttttaaagagttaaatacaccaccggtgtcttaacttgtttggtgcggttactttgatgcctaaacttgtaaaatacattaaactggtgccgtaacttgttcgagcgtgcaaatacggtgcctccgtccgtatccggcatatgcactgcccacatggcgtggcaacgtcgcgttggcccacgtgccagtgtctctgtgaggagcgtgctggttgttttacagaaaactccatgtactttaatt

SEQ ID NO: 27068 - DNA, 1116 bp, Triticum aestivum
  Clone ID: PAT_TA_27068
gccggcccccccacgccttcttctcgcctctgtctcaccttatccgcaacccgcaaaaacctcgctcccccctcacgcacgctcgcttcaatggctgccctgccgaccgccgccgccgccgggcgcgtagcggccagcgccttcacgttccccgccaagccctccttatcctccttctcagccgcgtctctcccccgcgccgcagccgcggcggcggcctattcagcgatcgccctcgcaccggcggggagcctccagcgtcggcggaggccgacggcggccggcgcagcgcccgggagcgagcagagggagacgatactgctccccgggtgtgactacaaccactggctgatcgtcatggagttccccaaggaccccgcgcccacacgcgagcagatgatcgacacctacctcaacaccctcgccaccgtcctcggcagcatggaggaagccaagaagaacatgtatgccttcagcacaaccacttacactgggttccagtgcactgtcgatgaagaaacatcagagaagttcaagggtttgcctggtgtcctgtgggtgctccctgattcctacatcgatgtgaaaaacaaagactatggaggtgataaatacataaatggtgagatcattccatgcacatacccaacctatcaaccaaaggagcggaggacctcaaagtacgaaagcagacggtatgagaggcgaagagatggccctcctgccagcaggaaaccgaaacaacaggccactcagcctgagtcggcgtcttcatgagttttgcaggcgattactcgcatactgaaacaacagagagtgctcaattctatcatctgactccgccaccatgtattgggagagcttctaggcacacaatttcatccaaagcccaaaatatgatgtagcacttgagcgagcgacctgcgcagctggatttggggttttggaccacaaggatatcttgagtggactaaatctaagtgtaacaaaagactgaaatcctggtccatcaaaaatgttatcccccagtgcactgtgtgatgccgactggtctagctgtattgctgattgtgtgaaatgtgtggcttttccctcagggcatgtttagtctgaatg

SEQ ID NO: 27069 - DNA, 547 bp, Triticum aestivum
  Clone ID: PAT_TA_27069
cgccgcccggccgctgccgttgcgtccaagaacgtgcaccggctgctcctcgcctgcctcctcatcgcctccaaggtcctcgacgacttccaccacgacaacgccttcttcgcgcgcgtgggcggagtgagcaacgcggagatgaataagctggagctggagctcctcggcgtgctggacttcgaggttatgctcagccgccgcctctacgacctctaccgcgcgcacctccaacaagccggatcaggagccctcaagggtcgacggcggcgaggaggaccacgacgatgaccggatcacgcggctgccggaaggcgtcttgcggtacgactggagccagcaggcgccggcggtgaacggcgggcggcggcactcgtcgtcgcaggcaccgtcgcggtactcctaggtagcttctggcctaggccacgtacaacggtcgatgtgtacattaactaactatacgtactgctcggattcgatgtgtatggacggtgaacggaatgcactaagactggagttaaatccggtaccgtgttttcaaaaaaaa

SEQ ID NO: 27070 - DNA, 419 bp, Triticum aestivum
  Clone ID: PAT_TA_27070
aagttttggtgccggcggcaaaacgtgcatcctcacgagggtctacccgagaaaggccgtcggggacaatgcacacctgttcgtcttcaacaatggcgagtcggacatcaagctcaccaacctgcgtgcatgggagatgaagacccccacgatgaacaagcgtctggggcagtagcaacagcccggcccggtagatcgaggattcagagtagcctagactagccatagctagctagcttgttgatttagttgagattaattaggagaggtccaggtttagtgatgagttgttagaaaggaccggaaatgatccattttgtttcagaaccttttccaaatggcaggaggccttgaaaagccaacattttttgttggcatgcaagatatcatcaacatatcaacaaaattttgaaagacag

SEQ ID NO: 27071 - DNA, 2001 bp, Triticum aestivum
  Clone ID: PAT_TA_27071
ccaacaggcacgagaatccatccacccgtcctcctccgcgacgcaagatcggccgatccaatccagtaacgaagatggcgtcggcggcggcgccattgatcgtgtctctgttgtgctgcacggcgttggcggtccacgcggcgcatgtcgtctacccggagctccagtcgttggaggccacggaggtggacaaggagctgcgcaccgggtaccacttccagccccccaagcattggatcaatgatccaaatgggccgatgtactacaaggggctgtaccatctcttctaccagtacaacccaaagggcgccgtgtgggggaacatcatctgggcgcactcggtgtcgaccgacctcatcgactgggtggcgttggagcccgggatctacccgtccaagccgttcgacatcaacggttgctggtcgggctccgccaccattctgcccaacggcgtcccggtcatcatgtacacaggcatcgaccccaaggaaacgccaggtgcagaacgtcgcgtacccggccaacctctccgaccccttcctccgcaagtgggtcaagcccgactataaccccatcatcaaccccgaccacggcatcaacgccagcgccttccgtgatcccaccaccgcttggtacgggccagacggacactggaggctggtggtgggcagcaaggagaacatgagggggatcgcggtgttgtaccggagccgtgactttaggagatggatcaaggcacaccactcgctgcacgctgggctcacggggatgtgggagtgcccagacttttaccccgtggcggtggccggcggcagacgtcaccaccggagcggtgtggacaccagagagctgcatgacagcacagtcgctgcggaggtaaaatatgtgctcaaggtgagcctcgacgtaacgcgctacgagtactacaccattggctggtacgaccatgccaaggacaggtacaccccggacctcgacttcccagacaatgactacggtctccgatacgactacggcgacttctatgcatcgaagtcgttctatgacccggtcaagaagcgccgcgtgctctggggctgggccaatgaatccgacactgtccccgacgaccgcaacaagggttgggccggcatccaggcgataccgaggaagatcttcctgtcacggagcgggaggcagctaattcagtggccggtagaggagatcaagtcattgcgcgcgaagcacgtcaatgtcagcaacaaggccgtcaagggtggcgagtacttcaagatcgacggcttcaaatccgtgcagtcggacgtggaggcggcgttcgtgatcaagaaccttgagaaggcggagaaattcaacgcgtcgtggcggacagacgcgcaagggctgtgcaagaagctcaactcacatgtcaagggcggcgtcgggccatttgggctctggttgctcgcctccgacgacctcaaggaaagaacagctgttttcttcagggtattcaagaacaatgacactagctacgtcgtgcttatgtgcaacgaccctacaaggtcgtcgtacgagtcgctgatctacaggccgaccttcgccggcttcgtcaacgtcgacataaccaagaccaagaagatcgccctcaggacattgatcgaccactctgtcgtggaaagttttggcgccggcggcaagacgtgcatcctgacgagggtctacccgaggaaggccgtcggggacaacgcacacctatttgtcttcaacaatggcgagtcagacatcaagctcaccaacctgcgtgcatgggagatgaagacccccacgatgaacaagcgtctggggcagtagtagcaacagagcccggcctagtagatcgaagattcagagtagcctagactagccatagctagctagcttgttgatttagttgagattaattaggataggctccaggtttagtgatgagttgttagaaatgcaggaaatggtccgttttgtttaaaaaaaaaaaaaaaaaaa

SEQ ID NO: 27072 - DNA, 624 bp, Triticum aestivum
  unsure (1)..(624): unsure at all n locations
  Clone ID: PAT_TA_27072
gggcgttcgtctataccaaatgctgatgtgccatcagagataagaaatccccaacanatgcggaagggcaggcaagaaaaagtcgatgcaaaatctgcgcaggaatgagaaatctgcaagagacagtaaatctcccgggaagttccagaaaaacaggaggcctaatggatctggcagagatgataaattccaagacagtagatcccagaaganccgaagaccagacgggaaagggaaagggggcggaaaagggaacgccaaagggtttggtaaaggtaaaggaaaaggcaaaggcaaccccaaagggaggggtaccaggtgattatctggccacaagaaagaaatattgttgtagaaccaacaggaaagaagtccgcgtgtctgatatgtctgcgtgcttgttacttaacctagaccgggtccctggttcagttcagttttgtttcacttctattgtgatagccggggaaataaccatgattttgccagatatatgtaaccgcctttgttgtgacgagaagtaaccatgggctcaatttgatttgcatccaccataccacacttggtgtgactgccagtatacacaatagagtaactacnatcacgattttagccttaaggcat

SEQ ID NO: 27073 - DNA, 320 bp, Triticum aestivum
  Clone ID: PAT_TA_27073
agtaacaagagtgttctgcatgattttgccggaaagtttctgtaggaatgtctcagcagcctgctgacaggagccagactgcagcgcttcattgttcacttggtcacggtgattcattacatcgtttatagatagcatcaatcatctgtcgatttggggtttttctccgtccgtttggtatactcatgtgtatcttgttctgggcttgctggacatgtggtgaagttgtaagatgtaacttttggtcgattcagttgtgaaaatgtatagaagcgttcttattcacttgtgaaaaatatatagaagcattcttattcaca

SEQ ID NO: 27074 - DNA, 517 bp, Triticum aestivum
  Clone ID: PAT_TA_27074
tcgcgatctagaactagtcttcttcttctgcaccactccatttgactgtgcgggctctgtcctaatggcgtcaaactctgccgggagccttgccttgccggcaccaggccctgccgggggagtctctgacttgccgtctgccggtcctgccgtcgccactgcctcttcgtcaatctccctctgcgccactagcgcgtcactgaccacttgattcgtcgccgctagatacagcagcaatggctcttgtggtgtaggcgcaactagtattggtgtagaggaaaggtatctcttctggtcttgcaacgccgcctcagcatctggggtacactccattgggctgcctacttcaaaatcttgaaaaagggaagggcgcgctcggcagacttggagatgaatcggctcatggctgcaacgcagccagtgagccgacgcacatccttgatccgcttgggcgcctcaatctgctcgatagccttgatcttgtctgggtttgcctcgatcccgtgctgcaacacaa

SEQ ID NO: 27075 - DNA, 555 bp, Triticum aestivum
  Clone ID: PAT_TA_27075
tgaattaatcggatcggaagaaagaaccgtcgagaaccatggcgagcaaggcccacctctccttcctgctcctcgcgctcctcgcggcctccctcgccggcccgtccgccggcattttccacatcgtcggcgccggcaaggggtggcgcatcgcccccaaccagacctactacgccgactgggcccgcaccagggacatccacgtcggcgacaagctcatgttcctgtaccggagcggggtgtacgacatcgtgcaggtgccgaccaaggagctgttcgacgcgtgcagcatggacaacgtcaccatgcggtaccagctcggccccaccatcatcaagctcgacacgcccggcccgcgctactacttctgcggcgtcggcgagcactgcgaggggggccagaaggtcgccgtcaacgtctccggcgaccccgccgcccccgccaccgccaccgccaccgccgccgccaccgccgccgaggcgcccgccgcagcggcgctgccgccggcggcgccgatagagctgggggaggccgcgctggcgtcgtccatggcgc

SEQ ID NO: 27076 - DNA, 488 bp, Triticum aestivum
  Clone ID: PAT_TA_27076
tagctagcatctcactcgcaggccatcacgattcctcccctccgcttccccgccgccgccaccgccacccgccagcggcagccgccggcgccggccgtggaccccaagttcgagtgggcggacaaggccggcacctacgtgctccgcctcaccctcgacgggcttcaagaagggggacttccgggtgcaggtggacggcgccgggaggctcaccgtgcgcggcgccaggccgggcgcctccccgggttccttgcacaaggtcttccagctgcccgccaccgccagcctcgacgacatcgccggccgcttcgaggccggcgtgctcacgctcaccgtgcccaagcgcgccgcctccgcccccccggccccccccccggctggcgtggtgggcgagccggctgccgccgaggagccgggcgccgtgccggcgcctcccgcacaggtcgacggcgccaagagcatgcccgccaagccgacgccacccacag

SEQ ID NO: 27077 - DNA, 711 bp, Triticum aestivum
  unsure (1)..(711): unsure at all n locations
  Clone ID: PAT_TA_27077
gctgtgcaagtgtacaactttttacttgaatacactagaaaaacatggtatgcttcatttattctcgtataaatccaacaaagtggacttcaaccttattgtaaatgcactgtcttacatatatcagacagagtggggtaaccactgcaaataagcatcaggcaatttgccttcagtagcaatgtttctgcacatagatacaaaatatgttcaattgcgtacatattaaagcgttgctgcagggaaaatgcttccactgccattgcaatcgccttttctcggcaccactagtgaccaggtcagccactccattctgatgccatctcttcctacctgtatgctattagtagattaattatactgagtagcggtgcgacaaagtctaggacgccgcttcccagattttgtaatcatgtccctctgctgcaacaatccagtttatgggaccagttggttcaaaatgtcccgcgccaatcttcatcagtaaattctcattaatctcggcggcatataaattctgttctgccttgagtatcttgatcttgctgcggcactgaatctttaagcggcatctgatagacattaatttggcaatatcttgttgtaagtgtgagaagatgtgatcatagaagactgcangagtgccaggatgtgtcaagatatangcatagccttgcatctncataccatagggaaatctcaatgaccctg

SEQ ID NO: 27078 - DNA, 598 bp, Triticum aestivum
  Clone ID: PAT_TA_27078
tcagctccgacgggcagtacctggccaccggtggcgaggacggcgtggtgcgggtgtggcgcgtggtggagggcgagaggcccgacgagctcgacttcgccgaggacgatccgtcatgcgtcttcttcactgtcaatgagaactctgaactggctcctgtcaactccagcgaagggaccaagagcaaacaggacaagagctcaaaggggcaagcagatccggcctgcgttgtgatccctcaccggacctttgcgctgtctcaggtccctgtgcatgaattctatgggcatgatgatgccatcttggatctctcatggtccaaaaatggggacttgatctctgcatctatggataaaactgctcgactgtggcgggtcgggtgcaatagttgtctcaaggttttctaccacaataactacgtgacatgcgttcagtttcaccctacgagtgacaattattttatcagcggctgcatcgacgggttggttcgcatttgggatgtccgtaaatgcctagtcgtagactgggctaacagcaaagagataatcaccgcagtctgttaccggcctgatggaaagggggtagtggttgggaccat

SEQ ID NO: 27079 - DNA, 1296 bp, Triticum aestivum
  Clone ID: PAT_TA_27079
cggtgtccttttactttctttttactttttcctctcttcagtttctttctagttccttgttacatgctaaatacaacagaatctttccaacgtacttttacatgcatataaatcgacaaatgcaacatacaattagaatccagaatgatttcacacgtaaaaaaaagttacaccatcaattacagcggcttccctaaaaccacttgcgatatttatgctctctacactcagctgcgagctaagaacagcctaataacaaatcataccagtaacaatttgacaaaatgtaaacacaattgtgtacggcggcgttccatgggcaacacattattgtcgaccaaactggagaacggaagggcgcgcgtcgattgcatcctctcaccgggatgaacctaaacacgaaagcagggctctggaagtcaacgaacttgtaagatccttcgagcgagttcagatagattgcttcacggggctcttcgctcacgcccctctgcatggcatactcccgtgccatttcacagtcaacctgttcaacatgctgcgttcgtcttcctcgtcaaaccgtggccgcctcggccgccgctcgtctgctagttctcccagagtcgccttccttgtcctcccctcgcctcttggggggagactcgtctgcaagttctcccagagtctccataattgttcttgccacatcaggaatgtatttgttcaggtgccttttcctgtcctgctgttcacgagcctgaagtttcttcactatctttgacttcagttggacacagcactgcttaagggctgacttgacagcatctgctatctcggttatatcatccccaatatactcttttccagttcctttaaaaggtatctttgtactgacaatgctcacgaagacaccaatcttgtcctgctgctgattaattttgtagatgctccaattgatcctttttagggcagttcttgtgatgacatcagcaccttgttcaaaaagaagtggtatgcggtttgcaaacctaaaaatatttagaccttgtttaacatcttttccaccaatgcttactccggcttcaacaataaacggatgcccttcaaaaacctgagggctgcttgcgtgtgttgcaaccagatcagggtgcagctcttttatgatacctagacgtaaattgtattcacctgcagggctaagacacttcccactgggttcatctctcttcgccggccgctacttctgctgttgtcgtactttctgccgtgatgcagctgatgagtgattaacaaatcaagaaggaaagggatgca

SEQ ID NO: 27080 - DNA, 612 bp, Triticum aestivum
  Clone ID: PAT_TA_27080
cggagagctgcttcacggtcgcgacgtaccgcccgtggtactcgcagccaatacacccgatcccggacaagaccctctggaatgagggccagcccaccgaggacaggctggaggtgatcatcaacccgccaaagtcgcttcggccccccgggcggccgaggaagacgagggtccgtgcggaggacctgggccgggtcaagcgggtcgtgcactgcagccgctgcaaccagacgggccacttcaggaccacctgcgccgctcccatatgagcttccggggtacatctgtgctgctgctgctggtggtggtggcggtgtgaatgaagaagaacaagttagaagttggcgcctattatgcaaacttcctgcttgcagattagtgttcctttttggttatacagtgctaggttacataccgctgttggtttagccgtgacgatgatggtgatttaataataatgccgttaacttatgcttgccctgctagactagaccgagggaatatataagaagagtaaatgtgttgctcaggcaggtgctggttgttccatggaatgattgaattatgtatgtgacccctgaatcaaatggcacttactgggacttggatgaa

SEQ ID NO: 27081 - DNA, 1004 bp, Triticum aestivum
  unsure (1)..(1004): unsure at all n locations
  Clone ID: PAT_TA_27081
aaaaatgaacttcaaaaaggaattcttttgattcaaccatctctttctcaactcagcaacttgaagtattaatcttatatttaggataccaagaaagcacatcagatcataatatatatcaataccctctaatatatatcaatattccccttcttttttctatgcaaaaaaaattctatgcaaaaaaaagatatagtaaagtaagtgattccataaatttacgcagttgcccaagaattcactatatattcttaatcaacgatttcttatatagagagaacggccctcacaaattgaaaatactaatttgttaagaatcaatcgaattgaagtcatagtgtcatcgttggctggaatcgatatattcgcgagatccgggtcacaatttgtatcgactaaagaaatagtaggaatccccaaaatggcacattcccgaagagctatatactctttttgctgatcaaggacgatcacaatgtctggcaatctcgtcatatatttgatcccgccgagataaaaaaaaaaaatagataattttctgcttcacgattgccacatctctttttgggagatggtggaattttcccattttttcttctgctctgcaggcccgggctggtgaaagtctagttttcgtaatcgaccaattcgttaacataccactgaaccactttttattaacataatgacaacgagcccttattgcagctgatgctactaaatctgttgctctttttttggtaccaacaattaagaaactttttccctgacttgctgcatcaaaaactaaatcacaagcttctgataaaaaacgagccgttctagcgagatttataatatgagtacctttacgcttggccgaaatgtaaggggccattttaaggattccatttcttaataccatgaccaaatggaacccctgcacctcccccgcgacctcgcgtcaananttctgcattttcaaatnctttttttaaccaacatccattcngattattctttga

SEQ ID NO: 27082 - DNA, 725 bp, Triticum aestivum
  Clone ID: PAT_TA_27082
gcagccttccgctttcgctgcaactccgaaataacgccggcgggcatcgccccgtcggcatggccgacgccgccgccgccgccgcccctgacgagctcaacaagtggtgggagaccttcaacaatggcggcgccgtggaggatgagccgatggtggactccgactccgatttcgagcaaggggggcaggacgcggaggaggaaggcaatgcgggcgtggtggcgggcgagtgccaccggaaggtggagccggacgcccacgcgcccgccgggagggagggctgcagcggcgccgcccgcgattacgatgagaaggagatttctgaggatggccattttcagcttgaaggtgtgctgccgggaatgaagagagaagcagccgccggacgaaacacaccgcgggctactgcagctgagatccagagcgtagaaggtcaagggttcgtttctgcgcccctcgttgctggtggtacctatagaacacaatatccatgcttgattgattgaattttctgtggtgcataagcggaatgttcaaatgcagagtacgttggtgaggataactatgttggaggtgagttccaaggaaagaagaggaaagcaaccgtgacagccggcaaactggagactgttggatctgcaatcctgaacaaaaatgctcatgttgcggaggagatttctgaggatagccattttcagcgtgaagatgggctgcagggaaggagc

SEQ ID NO: 27083 - DNA, 754 bp, Triticum aestivum
  unsure (1)..(754): unsure at all n locations
  Clone ID: PAT_TA_27083
atctcaagcaagcatgggcaactttgtttgaggattcatgatcgaggaaaatggctatctactaatcaggttcctacatcggaggactacctaagaaatggtgtcatcacttcaggagcaccacttttatttatgcatcttttattcatgcttgggcatgatttaacggaggacaacaacgaccacatccttagggtcatctcttgccctgcaaagatcatgaggctctgggatgacatggggagtgcaaaggatgagttgcaggaagggctcgacggatcatacaaggatttgtaccagagagaaaaccctcatgctgatgcggagaagcacatgttggatatgatagcgggtgaatgggaggatctaaacagggaatgcttctctcagacaaagtccacactaccacctagcttcatcggggcgtctctcaactttgcaaggatggtcagcatcatgtatggctatgacgacgagcagaagctccccgccctggaggattacactaggatgttgctcttttgaataatgcatgctactgttgtgtatgtaagtcttatatatgtagcacaccaattttgtagggttgctaactgctccacaaacgatacttgtgcccgagctgtgcacgacatgcaaatccagcagctagtgcccttctcactcatatgcatgtccagcagtattcaatcttcatctgtgaatcgttcacctgtgcataaaaanaaaaaaaaaaaaaaaaaannaaagggcg

SEQ ID NO: 27084 - DNA, 657 bp, Triticum aestivum
  Clone ID: PAT_TA_27084
tagcgtggtcgcggccgaggtgaaaattcctgcatattcacacccgtgcgcaacgcgttgccggggtagaagcagggcgggtcaccacaatggggaaccattgatcactggtatatttggagtgggagggccggttgagatccatggtgagaggaaaatacctttttttaaattcgagaagacagacaccactggcaatcgtcagtgggacttggtgaagatgcaatgtgttaacagaagcaacctggttggcaataagcgcagggacatcctgccgttgctgaacaagaggaagaagagacatattcagaagcagttgaacaaataccgcaatgaacttcaaggtctggaagctcatcttcaagctaaaatcgatgactttgaccagtttgttcctggtggttatgccatgccccgtcatttccttgagttcccagcgctcgagtagatgggagggagggtcagctgtgagtaccagtaagccgcagttttgagaaaaccattcctcaatttgcattgctgtgttggatacacacatagaacctccctgttttggcagtgcctagtttagtgtcttggatcagtatttgcccactcttcctgttgatgatacggctgttttctgggttggtaaaaaaaaaaaacttgctgttgtct

SEQ ID NO: 27085 - DNA, 573 bp, Triticum aestivum
  unsure (1)..(573): unsure at all n locations
  Clone ID: PAT_TA_27085
ttcggcacgaggtgcagatagaagtttgctgttcgtgcagaacggaaatagcttttgtgaattantcaacaatgtgaatctggtagacattctagtggcggatatatttatgcttttgcgccaatagctttgtcttttagctgtgatacgagatttcgtaattcatagtccatcatctagttccacttcataatttttggtgggtcctttacattgtctgaaattatggcgttcttctgtttgagccatatccatgtgaatacttctttggtttgcacgtgtttgtggaagcaatttaacttgattctacattggcctgctataataacttcagcttggatttgcatggtgattttcctatctacttttttttgcgtctgggtttatttgtacaccaaatatattcaaatagaggtggaataattggttattatttccttcggttgccagcatgtattggttttgtacttttgttattagccttcaaccttctgctccatgtctcttaagcgtataactatggtaatagctaggcatagtatcatcaagatccaattgatctctggaagtctg

SEQ ID NO: 27086 - DNA, 637 bp, Triticum aestivum
  Clone ID: PAT_TA_27086
tcgcggccgcgtcgaccctagctttctcattgctctcgacacagcaacatgtcggaagatgaaaaatacgtccacacacatttggcaattgcaacgacgccaaccagcttttattcaagacatgcttctgtagtatatttagacaaaggaaaaaacaatagacatcacttgcatacattttgtatggggcaatgaaacaaaatgctagtaaaagatgctcctgaatcatatgtatatagaaggggtgagtgcgcatatacgtacatacaaaattattagtactggattaattgtaactttcttacatatggatgtagcttgaaagattggatgtggagctaccaagcaaagaaaggcgttgatgacaaacggacttgctgtaggcagcctccgattttttttttcaatcatagagagtaataaagacagctactaaaaacaattcaaacacacgtatgaatatttttacaaaaatagtaaacgtgaatgctaaagcaagtgtctaagttgtctttctgaaagtcctctccactgggagcagacatgcttctccacatatgcacaatctgaagtcaatacaagaattgtacatagagaaacttaacatataactaacgcagaagtaacatttttctca

SEQ ID NO: 27087 - DNA, 451 bp, Triticum aestivum
  Clone ID: PAT_TA_27087
catcctgtccctcagagccctagtgcgtctacatctcgtatgctctgctactgttgcttaatgtaaggcagctagcacaccaatatttctgtatcttcacaacgcttaatttttcttcacttgtcctggctggaagtatgtaccaagtatagctatcgaaggccattctattttgctttgtaaccggttcaatcgtttatatacatatatatactactcaaaaataattgcataacgatggttgttcgtttgttattattccataatatacaggccgaatcatggctgacacggacagcaagaagatcgatctaccatactatgcgttgaaatatctcctgacgattgtatgtatcgcgctggttgcttccattgtttggtaactgacgagaacatggttactattacaaactagtcgcttgaaaataatgcctatgtgcggaaaccagtt

SEQ ID NO: 27088 - DNA, 653 bp, Triticum aestivum
  Clone ID: PAT_TA_27088
cgccctcgccggccacccctaatctcgaacagcacccaaagcagagccgccggggaggctgcggcgagctgccggagggagggaaggggagatggcgagccggctgtggaggtggtacgcggaccggcagttccacaagtgggagaagacggtgctgtgggacatggtggagccctaccgcccgccgcgctccttcgcgccgctcgtcggcacctacgtcgccgccttctacaccgccatcgtcggcgccgccgtcaccgagcagctctacaaggagaagtactgggaggatcatccgggcgaggcggtgccgatcatgccgcccatgttctactgggggccatggagggtggtgaacggagaggttccccgcttcatccagacgcccgaggaagctaagccggcatagaactgcttggagatcgctggggatgctgtgaaatgtttgctgttcgactgttctagatcggaggcctctcataagtaactcactgtttgctgtgtagctatggcattgctgcatttcttgtaatttacattctggtgattgggcagtgccgtggaatcataatggtctttttatgtatgcttgtttgcacaaataaattgatacttctatcgcggagcagattgtttgcattttaaaaaaaaaa

SEQ ID NO: 27089 - DNA, 1716 bp, Triticum aestivum
  Clone ID: PAT_TA_27089
ccgacccccgcgtccgtcgccgcgcccctgctgcctggccgctccctcccctctgcggtagctcccttggctgtgcacaatcagaaagaaaggcgcgcgcagctgaatacatcggccaagaaacgcttgtccctgccaaataacgtcggcgggggagcagcaaaggggacaaccaacaggaatccgatgaaccgatcgagcagtgctaagtctgacccgaaaccacgggcgaacgcgcccaaccaagcccggaagcaagtcgagttgcaggcctgattgcacatactaccgttcccaatctgacctgggcagatctgttccgttccgttcctggtgtgccgtttctccagctgtgcatcacgtgattcgcatgttactctgtcccgggaacttccttgtgcagcgggtttggctgcctctgtcatcctgtccactgttcgggctttcggggctccgccggcctttcgtgctcttaaaggtatcgttcttctccaggcccttgtgtggggctatttggtgagaaagcagactgcagaaacacttcagtgtatgcatgagctggtaagagctgaagctcgtgtgagagcaaggcaagccggtgttgcattagaaaatcaagtggcacggaaaaaggtccctgggcaagatgattgtgagaaccatgttcgagaaattgaggaaggctggtgtggcggtattggttctgtggcagaaatgcaggctaaagtactgaaaaggcaggaagctgctgcaaaacgtgagagagcgatggcgtatgcattgacccatcagcggcaagctggtttaaggcagcagaaacctacaaatctgcaaggatccgaacttgatgacgaccactggggatcaaactgggtagagagatgggtggctgcacgtccatgggagaacaggttacttgacaataatgcgaaagagagcatgccagtgtgtgatgataatcaggatgaggaaataaaatctcaggtcacaccaaagggcaaagcgccaacttcaagcactcctcctaatggcctgagcaagaagaaaggtgcaagccacaggaagtcatattcggatataaatttcacttcatttgggcgatcgtcaagtgtactgccttccacctctctgggaacatccaaacagaagccgaaactggaagatgaggcttttgaggaagtcagctcccagcccacagatgtagcttccttggctgtgcccaatcagaaagaaaggcgcgggcagctgaatacatccgccaagaagcgcctgtccctgccaaataacgtcggcgggggagcagcgaaggggacaaccaacagaaatccgatgaaccgatccagcagtgccaagtctgacccaaaaccacaggcaaacgcgcccaaccaagcccggaagcaagtcgagctgcaggcctgattgcacatactaccgttttgaatctgacttgggaagatctgttccgtttcgttcctggtgtgtcatttctccagctgtgcaggcttcatctccgttcataattttttccggaacaaggattgtgcatctaggctgacggcgtgtctcgactttcccattgtgcatggttgaggggttgccggttgcgattggtgttgttgtgttgtgcattcttggttttgcttatgttttaccatccttgtatgctgttctacctgctgaaacaagtgattgtgctgttgtgcagtattatttttc

SEQ ID NO: 27090 - DNA, 718 bp, Triticum aestivum
  unsure (1)..(718): unsure at all n locations
  Clone ID: PAT_TA_27090
nggaatgagttttcgtggtactatcattgtctgtaccaactagcaattttatcacttgactcaactcttgatcacggccaaatattgtggtctcaatgggaaaagaactagtctctggcctgactgatttgtcaaaacgtggtgtcgcttcacccaagcccatcttctcgagcagattagaaagattctccagccttttctggatatccttcactttgttgaaactgccctgaatgacacagttaaagaaatcgataaaaggagattggtttgcaatgccctccactgtcactttctgctcataccacctgaactcgccgccgcggccccccgcatcatacaccgcatcactgaattttggaaggagctcggccacacagtgcttgtggctgctccactccgcccgatcaatgatgttgtacattgccggaagagtatcactaagacattgtaggccactctgcaagtgcagtacctcatcctgaagattttgctcttgtttaccactccatcgggagcgcagagatgaaatagaagaccttgcccattgaaacaaattgacacattcgttgatgccactgatgaccccaatagtacctgatatactcatggtgactcgaatctgaagatttcttctctgtcgggtgcggcggatgaccggcgaggcaagcagccagcgacgatgatccagacctcgagcacgctctcccttccccgc

SEQ ID NO: 27091 - DNA, 713 bp, Triticum aestivum
  Clone ID: PAT_TA_27091
gccccggattcgatgctctccttcagccccattcgatgagaggacaaataggtttagttttttacatagtattacaggggttaggggttgtatttagttgtataatctacttatgcaccattggaatgcacctcatctgaagctcggccgagatttttgtggcattgctgttaactaccacaagcttcaggttcttgccgcctgtaggctctcaatttccgcacttcgaatcagtggggtgcttctgctcgtcgaggtccatggcctcaggattgctcggggctctcggaaacaaaaccggattcttttgcgaggactgagagttcctggtcgccgctcaggagcttcccgttgatgacccatgttggaaaaccttccagaccagtggctacacattcgttggccattttcttccccttaccggctccattagggaagcattccacataatccagaatttccatagcttcacgaccaaacaattgtttttggtcattgcagtgagtacaccagaatgctccatacatcttagcacctatagaatgtagatgtcttgccagtgaaatagcaaaaggggttgattctgatgttacctctgttttgtatggttctaatacgaaatcacctgtaccctttaactgagtagtagccgaactatatgagtttgttaaagcaagagcaacaatgacagctacagctaactgaagaccaac

SEQ ID NO: 27092 - DNA, 482 bp, Triticum aestivum
  Clone ID: PAT_TA_27092
tagcgtggtcgcggccgaggtaccgcaccatggccagcactgttccgctagctgttgagggagaatcagcaagcaagtgatctcgccacctccatgccgaaagaagggtggcttggattcctgcaaagattgagatttgataatgctttgattttcttcctagacgctgctcttttttaagattcaaggtcgagtcagtgtgctagtttggtttagtagcgggagtgagtcgggacagaggaaaatgtggtgtgtgtcagtcggttggtgcttgtcgtatttcttgggggattcaccgcaaatactactttggctcattattgccgcgacaatggcctacttcttcacattcaccgtgcaatgcatgcagttattgatagacagaaaaatcatggtatgcatttccgtgtattagctaaagcattgcgcatgtctgggggagatcatatccactccggtacctgcccgggcggccgctcgaa

SEQ ID NO: 27093 - DNA, 556 bp, Triticum aestivum
  Clone ID: PAT_TA_27093
ttcttcagctttgtgctgcctataatgccaacattgtctaggagccaaatggtgtcgttctaaggaatgcttggttaccagagtttttttgtcagaggatgatgagtctcttggtgtcatgtgtccatgaagctggttcctggttcgtccatgtgtaggttgatggtgtgatgggaaagagaaggtcgccaaatcaaatcatatatagaaacatgaactttgtggagaatctgtctattttggtttgaaatttttgtgtgtgtggaagagttctctttttcccggtgagtgtactggtactggtccccgaatgttgtcaatgttgtctgtgtgtgttgttattcccgtgggatctgctgtaattcggcatgggaaatggtatatttgttggatgttattggcagcatccactgttggtgtaaccctttcacgagtctcagttttgaaggttgcaacttgctgcaatgctgtgtgcccctcagttgatgatttgtatagcattgtggtatgacttgcgaggtccaaatgttttttgattttaaaaaaaaaaaaaaaa

SEQ ID NO: 27094 - DNA, 732 bp, Triticum aestivum
  Clone ID: PAT_TA_27094
ggaattcggcacgaggcttggttcctgcctcgcgtggcgtttcccggggctctcctcgcggagaaggagagcaaggtcaggctagcttgagcgatgggggaagccgccggcgaccgcgtactcagccgcctccacagtgtcagggagcgcatcggcgactccctctccgcgcaccccaacgagctcgtcgctgtcttcaccaggctggtcaaccttggaaatggaatgctgcagtcccaccagatcatcgctgagtacaacaccgcgatccccgaagcagagcgagagaagctcaaggatggcgcctttgaggatgtgctcagggcagcgcaggaggcgatcgtcatctcgccgtgggtcgcgcttgccatccgtccaaggcctggtgtctgggagtatgtgagggtcaacgtgagcgagctcgctgtagaggagttgagtgtccctgagtacctgcaattcaaggaacagctcgtggaaggaagcaacaaggactttgtgctcgagctggactttgagccattcaacgcctccttccctcgcccttcgctgtccaagtccatcggcaacggcgtgcagttcctcaacaggcacctgtcatcaaagctcttccatgacaaggagagcatgtacccccttctcaacttcctccgcgcacacaactacaagggcatgactatgatgctgaacgacagaatccgcagcctcagtgctctccaggggagctctgag

SEQ ID NO: 27095 - DNA, 741 bp, Triticum aestivum
  unsure (1)..(741): unsure at all n locations
  Clone ID: PAT_TA_27095
tgacaccccttactcagagttccaccaccggttccaggaacttggtttggagaaaggttggggtgactgtgctcagcgtgcgagcgagactatccaccttctcttggaccttctcgaggcccctgatccatcctccttggagaagntcctcggaacaatcccaatggtggtcaatgatgntatcctctctcctcatggntactttgctcaggccaatgtcttggggtaccctgatactggtggacagattgtctacattttggaccaagtccgtgctatggagaatgagatgctgctgagaatcaagcagcaaggtctcgacattacaccaaagattctaatagtcaccaggttgctccctgatgcacatggcaccacctgtgggcagcgcctttgagagggtccttgcacccgagcacacccacattcttgcgggggccattcaaaacagaaaaatggatttgttcccaaatggatcttcgcgttttgaaggcttggccttaccttgaaagctaaccctggatgatgtggcccaccagaatcgcccgaaacttgcagcccaccccctgcctggcattggaaaactacacggagagcaaccataaaacatagtttgttggcccccaagtttggaagaacctcattggaccacttcgttatggcctctcgagaaaaccaagtacccccactctccccttatactggaaagaatttggcgaaccctaccacttttccgcccct

SEQ ID NO: 27096 - DNA, 459 bp, Triticum aestivum
  Clone ID: PAT_TA_27096
catgaaagagagaagaggagccctccaccccgccgtcgcagcgccaaccaaaccctcgtcgtcgtcccggatcctgccgtcgccgccgcagccatgccgttcaccccgggaccctactccggcaagagcaccctcgccctcgtggccagggtctccgccgtcggcgtcggcgtcgtctacggctccatcaagctcggcatcctcaagatgaccaagcccaaggaggaagcagctgctcatcactgaggacaagtagctccagcgggttgacgccgtagattgacgatgtaccttctatatgtgcattcggttctgtgatttgtgtctgaaacccaagaaaccccagacccatgtgggagctgaaccttagttttttgcttgtggaaaataatatcctcggctgaatcgatttgaaatcaggaagagtgaaacttaaaaaatcctttggtgtggtactgc

SEQ ID NO: 27097 - DNA, 599 bp, Triticum aestivum
  Clone ID: PAT_TA_27097
actggacgaagatctcacagggcgggcttcagcgtattgaggagaaatacacctggaagctttactctgagaggctgatgaccctaaccggcgtgtatgggttctggaagtacgtctccaacctcgagaggcgcgagacccggcgctacctcgagatgctgtacgccctcaagtaccgcaccatggccagcaccgttccactagctgttgagggagactccgcgagcaagtaatctggccacctcctggccgaaagaagggtgacttggatttctgaaagattgagatttgagaatgatttggtttacgtcctaggcgctgcccctttcaagatttaaggttgagtaattggtgtgctagttttgtttagtagttggagtgagtcgagacagaggaaaatgtggtgtgtgacaatcggttggttggtgcttatcgtttttcttggatgttacccttgaataataggaacggacttggcgccgtttttgaaataataatagtagcatccttcctccgtttccaagaaaatcttttgtcactgctgttgagctctgtaacctctgttacctaatacaattactagatggttaattacagtt

SEQ ID NO: 27098 - DNA, 578 bp, Triticum aestivum
  unsure (1)..(578): unsure at all n locations
  Clone ID: PAT_TA_27098
gcgcaccaaacccgggccagttcgcctcgcgtttccccggtgacgtttccttgttcctcgccctcctcctctggagcaaggtttgaggacagcaatgggggagactgctggagagcgcgccctgagccgcatccacagcgtgagggagcgcatcggtgattccctctctgcgcacaccaatgagctcgtcgccgtcttctcaaggcttgttaaccaaggaaaggggatgctgcagccccatcagatcactgctgagtacaatgccgcgatccctgaggccgagcgcgagaagctcaaggacaccgcctttgaggatctcctaaggggcgcacaggaggcaattgtcatccctccatgggttgctctcgccatccggccaaggcccggcgtctgggagtatgtgagggtcaatgtgagcgagcttggtgttgaggagttgagcgtcgctgagtatttgcagttcaaggaacaactgccgaattgaaacatcgataacaactttgtgcttgagctggactttgagccattcaaacgctncttcccgcgcccatcgttggtcaagtccatttgccaacggg

SEQ ID NO: 27099 - DNA, 764 bp, Triticum aestivum
  Clone ID: PAT_TA_27099
cctctctatgcttcccttcgtttctacctcgcgtggcggttcctggggctctcctcgcggagaagaagtgcaagactaggcttgagtgatgggggaagccgccggcgaccgtgtcctcagccgcctccacagcgtcagggagcgcatcggcgactccctctccgcgcaccccaacgagctcgtcgccgtcttcaccaggttggtcaaccttggaaatggaatgctgcagtcccaccagatcatcgctgagtacaacaccgcgatccctgaggcagagcgcgagaagctcaaggatggcgcctttgaggatgtgctcagggcagcgcaggaggcgatcgtcatctcgccgtgggtcgcgcttgccatccgtccaaggcctggtgtctgggagtatgtgagggtcaatgtgagtgagctcgctgtcgaggagttgagcgtccctgagtacctgcagttcaaggaacagcttgttgaaggaagccacaaggactttgtgcttgagcttgactttgagccattcaatgcctccttccctcgcccttccctgtcccaagtccatcggccaccggcgtgcagtttcctcaccaggcaccctgacatcgaaagctcttccatgacaaggagagcatgtaccccttgctcaacttcttccgggcacacaactaccggggcctgactatgaagcttaacgacagaatccgcagccctagcgctttttcggggagctctgaggaaggcctaggggccattggcttggtctcccc

SEQ ID NO: 27100 - DNA, 909 bp, Triticum aestivum
  Clone ID: PAT_TA_27100
agctcgaaattaaccctcactaaagggaacaaaagctggagctccaccgcggtggcggccgctctagaactagtggatcccccgggctgcaggaattcggcacgaggtctcgagttttttttttttttttttagcagcgacttgcaagaatatatataaacaagatgataatatgacatgaggaaaatgccgccaagttaaccgagtattaaagtctgaccacaaaggatattggccagaagccacgggaggaatcaagtcgaaccctagtgttcctcctagtcccgacaaatatttggttaactaacctctacccctccatgatcacaaaaatattcccagacagacacgcacgggagccaactcgaaatagcatccagctgcctgcgacaaccagtgtccatccgcaacaataatttaccaccactaacaagtctcaacagtagaacggaatacatcttcttcttcacttcacagtaggaaggggctcctcgaatacaatggtcacctagcaagcatctgatgggtatatttgcagctgtttcgatcaaaaaggtggggtggctgggtgcaaagatatgggatcaactccttggcgacaacacccatgaattggtaataagctagcaacaaacacttatgtcaacatgaaggcatcgactttgacctcttaagatgctgcggtctgaaatcctccaacttgagattggagctagtcttggcctccttcaagaaggaatcccccttttctgttttgatccactccaagactgcccctaggacatcagctgcgatgccttcctgcacaaggtgtccaggctcctctccgccttcttcaatcaatttacctacgtcttgcaaaaccagtatcttctccaccacaaaccttgcaagaagtcgtcccggacg

SEQ ID NO: 27101 - DNA, 527 bp, Triticum aestivum
  Clone ID: PAT_TA_27101
ggatccatccgtctcttctttatcaccccgagggtcgtcttcttctgccccacgaaacagagagagagcagccgcagcgccagccaaaccctcgccgtcgtctccgatcccgccgtcgccgccgccgccgccgccgcagccatgccgttcaccccgggaccctactccggcaagagcaccctcgccctcgtggccagggtctccgccgtcggcgtcggcctcgtctacggctccgtcaagctcggcatcctcaagatgaccaagcccaaggaagaagcagctgctcatcactgaggacaagtagctcccgcggattgacgccgtagattcacaatgtacccctaccccgcattcggttttatgatttctggcccccctgtctgaaacccaaaatactccggacccatgtgggagttgaaccttagttttttgcttgtggaaataatattctcggctgaatgacttgaaatcaggaagagagattataaatcgtgtgatagatgaattgtctccttaaaaaaaaaaaa

SEQ ID NO: 27102 - DNA, 1481 bp, Triticum aestivum
  Clone ID: PAT_TA_27102
ccacgcgtccgctcaccgcgcaccaaacccgagcctgctcccctgtgacgtttccttgtttctcgccctcctcctccctcctctggagcaagcgggtacggttgggactatacggaggtctgtggggctagcctggtttcagtgattcaagagaggtttgaggacagcaatgggggagactgccggagagcgcgccctgagccgtatccacagcgtgagggagcgcatcggcgattccctctccgcgcacaccaatgagcttgtcgccgtcttctcaaggcttgttaaccaaggaaaggggatgctgcagccccatcagataactgctgagtacaatgccgcgatcccagaggccgagcgtgagaagctcaaggacaccgcctttgaggatctcctaaggggcgcacaggaggcaattgtcatccctccatgggttgctctcgccatccggccaaggcccggcgtctgggagtatgtgagggtcaatgtgagcgagcttggtgttgaggagttaagcatcgctgagtatttgcagttcaaggaacaactggcgaatggaagcatcgataacaactttgtgcttgagctggactttgagccattcaacgcctccttccctcgcccatcgctgtcgaagtccattggcaacggtgtgcagtttctgaacaggcacttgtcgtcgaagctgttccatgacaaggagagcatgtacccgttgctcaacttccttcgcgcgcacaactacaaggggatgaccatgatgttgaacgacagaattcgcagtctcagtaaactccaaggtgcactcaggaaggcagagacacatctgtcaggccttccagctgacaccccttactcagagttccaccaccggttccaggaacttggtttggagaaaggttggggtgactgtgctcagcgtgcgagcgagactatccaccttctcttggaccttctcgaggcccctgatccatcctccttggagaagttcctcggaacaatcccaatggtgttcaatgttgttatcctctctcctcatggttactttgctcaaggccaatgtcttgggggtaccctgatactggtggacagattgtctacattttgggaccaagtccgtgctatggagaatgagatgctgctgagaatcaagcagcaaggtctcgacattacaccaaagattctaatagtcaccaggttgctccctgatgcacatggcaccacctgtggccagcgccttgagaaggttcttggcaccgagcacacctacattctgcgtgtgccaattcaaaacagaagatggtattgttcgcaaatggatctcgcgttattgaagtttggctttacctggaaagcttacactgatgatgtggcacaccaggatcgccggaaagctgtcaggccaccccttgacctgataatttggaaactaaccgcgatggccacccttaaaagcatgtttgtttggcgcacaaattgcg

SEQ ID NO: 27103 - DNA, 1012 bp, Triticum aestivum
  Clone ID: PAT_TA_27103
ttactttgctcaggccaatgtcttggggtaccctgatactggtggacaggttgtttacattttggaccaagtccgtgctatggagaatgagatgctgttgagaatcaagcagcaaggtctcgacattacaccaaagattctaattgtcacccaggttgctccctgatgcacatggcaccacctgtggccagcgcctcgagaaggtccttggcaccgagcacacccacatcctgcgtgtgccattcaaaacagaagatggtattgttcgcaaatggatctcgcgttttgaagtctggccttacctggaagcttacactgatgatgtggcacacgagatcgccggagagctgcaggccactcctgacctgatcattggaaactacagtgatggcaacctagtcgcatgtttgttagctcacaagttgggagttacccattgtaccattgctcatgcacttgagaaaaccaagtatcccaactccgacctttactggaagaaattcgaggatcactaccacttctcctgccagtttacagccgacctgattgcaatgaaccatgccgacttcatcatcaccagtactttccaagagattgccggaaacaaggacaccgtagggcagtacgagtcgcacatggcattcacaatgcctggcctctatcgtgttgtccatggtattgatgtcttcgaccccaagttcaacatcgtctcccctggtgctgacatgtccatctacttcccatacactgaacagcagaagaggcttacctccctccatactgagattgaggagctactcttcagtgatattgagaatgctgagcacaaatttgtgctgaaggacaagaggaagccgatcatcttctcgatggctaaggtggaccgtgtcaagaatatgactggcctggtagaaatgtatgggcgggaatctcgcctacaggagctggtaaacctaatggttgtctggggtggaccatggaagggtgcccagggccaagggggagccggccc

SEQ ID NO: 27104 - DNA, 1294 bp, Triticum aestivum
  Clone ID: PAT_TA_27104
gcctcgtgccgaattcggcacgaggctggtgcggacatgtccatctacttcccgtactccgagtcacaaaggaggctcacatccctccacccagagattgaggagctgctctacagtaatgtcgacaacaatgagcacaagtatgtgctcaaggacaggaacaagccaatcatcttctcgatggcccgtttggaccgtgtcaagaacttgacaggtctggttgagctgtatggcaagaaccctcgcttgcaggaacttgttaaccttgtggttgtctgtggtgaccatggcaatccatcaaaggacaaggaggagcaggctgagttcaagaagatgtttgaccttattgagcagtacaacctgaatggccatgtccgctggatctccgctcagatgaaccgtgtccgtaatgctgagctctaccgttacatctgcgacacaaagggtgcctttgtgcagcctgctttctatgaggcatttgggcttactgtcatcgaggccatgacctgcggtcttcctacctttgcaactgcatacggtggtcctgctgagatcatcgtgaatggtgtgtcaggctaccacattgatccctaccagggtgacaaggcctctgctctgctcgttgagttctttgagaagtgccaggttgaccccagccactggaccaagatctcacagggtgggcttcagcgtattgaggagaaatacacctggaagctttactctgagaggctgatgaccctcaccggtgtgtatgggttctggaagtacgtctccaaccttgagaggcgcgagacccgccgctacctcgagatgttgtatgccctcaagtaccgcaccatggccagcacagttccattggctgtcgagggagactcccgcgagcaagtaatttggccccctcctgaccaaaagaagagtggcttggattcctgcaaagattgagatttgagaatgctttggttttcttcctagacgctgctctttttaagattcaaggtcgagtcagtgtgctagtttggtttagtagttggagtgagtcgagactcgggacagaggaaaatgtggtgtgtgtcagtcggttggtgcttgtcgtatttcttggatgttactgttgaataatagaagcggccttggtgccgtttctgaaataataatagtagcatccttcctcgttttcaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaac

SEQ ID NO: 27105 - DNA, 1270 bp, Triticum aestivum
  unsure (1)..(1270): unsure at all n locations
  Clone ID: PAT_TA_27105
atctgtcaggccttccagctgacaccccttactcagagttccaccaccggttccaggaacttggtttggagaaaggttggggtgactgtgctcagcgtgcgagcgagactatccaccttctcttggaccttctcgaggcccctgatccatcctccttggagaagttcctcggaacaatcccaatggtgttcaatgttgttatcctctctcctcatggttactttgctcaggccaatgtcttggggtaccctgatactggtggacagattgtctacattttggaccaagtccgtgctatggagaatgagatgctgctgagaatcaagcagcaaggtctcgacattacaccaaagattctaatagtcaccaggttgctccctgatgcacatggcaccacctgtggccagcgccttgagaaggtccttggcaccgagcacacccacatcctgcgtgtgccattcaaaacagaagatggtattgttcgcaaatggatctcgcgttttgaagtctggccttacctggaagcttacactgatgatgtggcacacgagatcgccggagagctgcaggccacccctgacctgatcattggaaactacagcgatggcaacctagtagcatgtttgttggcgcacaagttgggagtaactcattgtaccattgctcatgcactcgagaaaaccaagtaccccaactccgacctttactggaagaaatttgaggatcactaccacttctcctgccagtttacagccgacctgattgcaatgaaccatgctgacttcatcatcaccagtaccttccaagagattgccggaaacaaggacaccgtagggcagtacgagtcgcacatggcattcacaatgccaggcctctatcgtgttgtccatggtattgatgtcttcgaccccaagttcaacatcgtctcccctggtgctgacatgtccatctacttcccatacactgaacagcagaagaggcttacctccctccatactgagattgaggagctactcttcagtgatgttgagaatgctgagcacaaatttgtgctgaaggacaagaagaagccgatcatcttctcgatggctaggctggaccgtgtcaagaatatgactggcctggtagaaatgtatgggcggaatcctcgcctacaggaagctgtaaacctnatggttgtttgtggtgaccattggaaggtgtccaaggacaaggaggagcaagcanagttcaagaagaagtttgaacttattgaacagtacaacccgat

SEQ ID NO: 27106 - DNA, 1122 bp, Triticum aestivum
  Clone ID: PAT_TA_27106
tacccacgcgtccgcgcgcaccaaacccgggccgcctgctcccctgtgacgtttccttgtttctcgccctccctcctccctcctctggagcaaggtttgaggatagcaatgggggagactgccggagagcgcgccctgagccgtatccacagcgtgagggagcgcatcggcgattccctctctgtgcacaccaatgagctcgtcgccgtcttctcaaggcttgttaaccaaggaaaggggatgctgcagccccatcagatcactgctgagtacaatgccgcgatccctgaggccgagcgcgagaagctgaaggacaccgcctttgaggatctcctaaggggtgcacaggaggcaattgtcatccctccatgggttgctctcgccatccggccaaggcctggtgtctgggagtatgtgagggtcaatgtgagcgagcttggtgttgaggagttaagcgtcgctgagtatttgcagttcaaggaacaactggcgaatggaagcatcgataacaactttgtgccttgagctggactttgagccattcaacgcctccttcccgcgcccatcgctgtcgaagtccattggcaacggtgtgcagtttctgaacaggcacttgtcgtcgaagctgttccatgacaaggagagcatgtacccgttgctcaacttccttcgcgcgcacaactacaaggggatgaccatgatgttgaacgacagaattcgcagtctcagtaaacttccaggtgcactcaggaaggcagagacacatctgtcaggccttccagctgacaccccttactcagagttccaccaccggttccaggaacttggtttggagaaagggttgggtgactgtgctcagcgtgcgagcgagactatccaccttctcttggaccttctcgaggcccctgatccatcctccttgggagaagttcctcggaacaatccccaatggtgttcaatggttgtatcctctctcctcatggttactttgctcaggccaatgtctttgggtaccctgatacttgtggacagaatgtctacattttggaaccaaatccgtgctatggagaatgagatgcttgtgaaaaataaacacgcagggtctcgactttacacccaaaa

SEQ ID NO: 27107 - DNA, 2297 bp, Triticum aestivum
  Clone ID: PAT_TA_27107
tctttgtaatttgacacccacgatattcattcacattcatgcatgtactctagctgattattattctatcaccaacagaaaagagctaactggtatgcaattctaagacgcctgcctgtactagaacggcttacctagcaacaaacacttatgtcaacatgaaggcatccaactttgacctcttaagatgctgcggtctgaaatcctccaacttgagattggagctagtcttggcctccttcaagaaggaatcccccttttctgttttgatccactccaagactgcccctaggacatcagctgcgatgccttcctgcacaaggtgtccaggctcctctccgccttcttcaatcaatttacctacgtcttgcaaaaccagtatcttctccaccacaaaccttgcaagaagtcgtccaagatactctgccgctcttggagaatcacttagagcatcttccaatgaagcaagaacagatgaaagccccacaatgagctgtggcttgctcaataaattatatccaccgttgtaaagcccgacaaagagctttgccaacaactctctttccatatctttcctctcaaaggaatcatttacccaaagtgatacaagagaaggatagaagctcggagcattcaactcttcaatacacaatgcaacttccttttcatctttcgcactataatattcccggatggttgcaatagatttctctctcaattcctcctcggagtatgatttatttcctgaacgaccctcctggctggcaggtctgtgtgaagaactagcagattgtgcagcaggtgctattctcccagaaaatcgatctggaattctagagctagtgtcttctcttgttgttgaaggcacagaattgtacccattaggaccagataaaatcctgcgctggtcaacaacactaggaagttcagaatttgataccggtggctgccctcttaaagacatacccctagctaggccaccttgtggtccaagagtgatagcttcgtccttcacagaacgctggggaaggggaacagttctatcaaactgatgcctttcctgctcataccgaatatcttgattaccaaatccacgccctcgttgctgaggacctggagataccaatggtgctgctgagccacgggagccgtaatccatagagggtgcccctcttcttggaagagaactaacgactggaccacgagacctactcgattgagattgagcatgtctttcctgagctgcatccctgtgaacctcatcgatcttcttggggccatccactttacgcctttgctgccatttgttcttcctgagatcgattgaatctctgagcaggaatctaacacgggaagatatcagttgactggttgacaggttgcgcattctatcaaaatatgcatccatatgttccttagcctttggatgatctatcatctctccaattgtactcatcaatttgcatagtgcttcaatgttctcctcatctggattctgataatttccccccaattttttgatgcattcatgcatgatgcgctctgtcagcatcctctttttgtacaattctccaatcaacctaatattacccagcatgcgccttcgagctttaactctcttttcttccctttcctctttcgtttgcttaatctcaccttcctcctccgttttatctgcttcagcttcctctctttcacccctctcaaactcctcttggcacttgttcaatagcagtctcttgaatgtaatcttttcattgtcctcactaaagtctggcagtgcaccagccaaatgggaacagaagttggcgtacatttcacagaaagttggttccatcaatgctttgtcaaatatctgtgaaatcaccccagtaagagttgacacattgtcaatgttcacctctttcacttgttcaaaaagcttgtcaaagttttgtggggtcagtttattcagaatggctttcagctgcctctgctttgcctgctcctcatcagaaactttgccgacaacatactttttctcggctttgtgcattacttgcatgggtgtaacaggagatgggatcagacccttttgctgccatctatctgcatcagagccactgcggggtacttgaggagcattggattgtggtcccacaagaagtgcagcacgtggattcctcaaaacaccatgagtgcctcctgggccgccacggtaattcgttgctgggccgtttgtcaagtccatgtgggcatcacggttaggactgtaaggaacacctgattttaaccacttatcatcatccatacggacg

SEQ ID NO: 27108 - DNA, 1613 bp, Triticum aestivum
  Clone ID: PAT_TA_27108
agaatttaacctttactcacttaaccctcactaaagggaacaaaagctggagctccaccgcggtggcggccgctctagaactagtggatcccccgggctgcaggaattcggcacgagcaccaaacccgagcctgctcccctgtgacgtttccttgtttctcgccctcctcctccctcctctggagcaaggtttgaggacagcaatgggggagactgccggagagcgcgccctgagccgtatccacagcgtgagggagcgcatcggcgattccctctccgcgcacaccaatgaggcttgtcgccgtcttctcaaggcttgttaaccaaggaaaggggatgctgcagccccatcagataactgctgagtacaatgccgcgatcccagaggccgagcgtgagaagctcaaggacaccgcctttgaggatctcctaaggggcgcacaggaggcaattgtcatccctccatgggttgctctcgccatccggccaaggcccggcgtctgggagtatgtgagggtcaatgtgagcgagcttggtgttgaggagttaagcatcgctgagtatttgcagttcaaggaacaactggcgaatggaagcatcgataacaactttgtgcttgagctggactttgagccattcaacgcctccttccctcgcccatcgctgtcgaagtccattggcaacggtgtgcagtttctgaacaggcacttgtcatcgaagctgttccatgacaaggagagcatgtacccattgctcaacttccttcgcgcgcacaactacaaggggatgaccatgatgttgaaccgacagaattcggagtctcagtaccctccaaggtgcactcaggaaggcagagacacatctgtcaggccttccagctgacaccccttactcggagttccaccaccggttccaggaacttggtctggagaaaggttggggcgactgtgctcagcgtgcgagtgagactatccaccttctcttggaccttctcgaggcccctgatccatcctccttggagaagttcctcggaacaatcccaatggtgttcaatgttgttatcctctctcctcatggttactttgctcaggccaatgtcttggggtaccctgatactggtggacagattgtctacattttggaccaagtccgtgctatggagaatgagatgctgttgagaatcaagcagcaaggtcttgacattacaccaaagattctaatagtcaccaggttgctccctgatgcacatggcaccacctgtggccagcgccttgagaaggtccttggcaccgagcacacccacatcctgcgtgtgccattcaaaacagaagatggtattgttcgcaaatggatctcccgctttgaagtctggccttacctggaagcttacactgatgatgtggcacacgagatcgccggagagctgcaggccactcctgacctgatcattggaaactacagtgatggcaacctagtcgcgtgtttgttggctcacaagttgggagttactcattgtaccattgcgcatgcactcgagaaaaacaagtattccaactccgacctttactggaagaaattttgggatcactaccacttcttcctgccagttcact

SEQ ID NO: 27109 - DNA, 2844 bp, Triticum aestivum
  Clone ID: PAT_TA_27109
aactgaactgaagaacacaccactgataaccctgtcctgttctgcagcagactaggcttgagcgatgggggaagccgccggcgaccgcgtgctgagccgcctccacagcgtcagggagccgcatcggcgactccctctccgcgcaccccaacgagctcgtcgccgtcttcaccaggttggtcaaccttggaaatgggatgctgcagtctcaccagatcattgctgaatacaacaccgcaatccctgaggcagagcgcgagaagctcaaggacggcgcctttgaggatgtgctcagggcagcgcaggaggcaattgttatctcgccgtgggtcgcgcttgccatccgtccaaggcctggtgtctgggagtatgtgagggtcaacgtgagcgagctcgctgtcgaggagttgagcgtccctgagtacctgcagttcaaggaacagcttgttgaaggaagcaacaaggactttgtgcttgagctggacttcgagccattcaatgcctccttccctcgcccttcgctgtccaagtccatcggtaacggcgtgcagttcctcaacaggcacctgtcatcgaagctcttccatgacaaggagagcatgtaccccctgctcaacttcctccgcgcacacaactacaagggcatgactatgatgttgaacgacagaatccgcagcctaagtgccctccagggagctctgaggaaggccgaggagcatctgtctggtctcccggcagacaccccgtactcggacttccaccacaggttccaagaacttggcctggagaagggttggggtgactgcgccaagcgtgcgcaggagacccttcacctgctcctcgaccttctcgaggctcccgacccgtccacgctcgagaagttccttggcacaatcccaatggtgttcaatgttgtcatcctgtcgccgcacggttactttgcccaagccaatgtcttggggtaccctgacaccggaggccaggttgtctacattctggatcaagtccgtgctatggagaacgagatgctgctgaggatcaagcagcaaggcctcgacatcacaccacggatccttattgtcaccaggcttctccctgatgcaaccggcacgacctgcggtcagcgtcttgagaaggtcctcggtacagagcacacccacatcctccgtgtgccattcagaactgaaagtggaattgttcgcaagtggatctctcgttttgaagtctggccgtacctggagactttcactgaagatgtggctcacgagatttccggagagctccaggccaatcctgacctgatcatcggaaactacagcgacggaaaccttgttgcgtgcctgcttgcacacaagatgggagttactcattgtaccattgcacacgcgcttgagaaaaccaagtaccccaactctgacctctactggaagaagtttgaggaccactaccacttctcatgccagttcactaccgatctgattgcgatgaaccatgctgacttcatcatcacaagcaccttccaagagattgctggaaacaaggacaccgttggtcagtacgagtctcacatggcattcacaatgcctgggatgtaccgtgttgtccatggtatcgatgtttttgaccccaagtttaacatagtctcacctggtgcggacatgtccatctacttcccatactccgagtcacagaggaggctcacctccctccacccagagatcgaggagctgctctacagcgatgttgacaacaatgaacacaagtatgtgctcaaggacaggaacaagccaatcatcttctcgatggctcgtttggaccgtgtcaagaacttgactggtctggttgagctgtatggcaagaaccctcgcctgcaggaacttgttaaccttgtggttgtctgtggtgaccatggcaatccatcaaaggacaaggaggagcaggctgagttcaagaagatgtttgaccttattgagcagtacaacctgaatggccatgtccgctggatctcagcccagatgaaccgtgtccgtaatgctgagctctaccgttacatctgtgacaccaagggtgcctttgtgcagcctgctttctatgaggcttttgggcttactgtcatcgaggccatgacctgcggtcttcctacctttgcaactgcatatggtggtcctgctgagatcatcgtgaatggtgtgtccggctaccacattgatccctaccagggtgacaaggcctccactctgcttgttgagttctttgagaagtgccaggttgaccccagccactggaccaagatttcacagggcgggcttcagcgtattgaggagaaatacacctggaagctttactctgagaggctcatgaccctcactggggtgtatgggttctggaagtacgtctccaaccttgagaggcgcgagacccgccgctaccttgagatgctgtacgccctcaagtaccgcaccatggccagcactgttccgctagctgttgagggagaatcagcaagcaagtgatctcgccacctccatgccgaaagaagggtggcttggattcctgcaaagattgagatttgataatgctttgattttcttcctagacgctgctcttttttaagattcaaggtcgagtcagtgtgctagtttggtttagtagcgggagtgagtcgggacagaggaaaatgtggtgtgtgtcagtcggttggtgcttgtcgtatttcttggatgttaccgttaaataataggaacggccttggtgccgtttctgaaataataatagtagcatccatcctcgtttccaagaaaatctttgtcactgctgctagctctgttacctaatacaattact

SEQ ID NO: 27110 - DNA, 732 bp, Triticum aestivum
  Clone ID: PAT_TA_27110
attcggcacgaggcttcttctccccacgaaagagagagagaaaaaaaaaggagccctccaccccgccgtcgcagcgccaaccaaaccctcgtcgtcgtcccggatcccgccgtagccgccgccgccgcagccatgccgttcaccccgggaccctactccggcaagagcaccctcgccctcgtaagccctcgaaatcgccccctccccccgattcctccgctgcatcgcggatcagatctggatgacagaccgtgggggtgttgctttgcaggtggccagggtctccgccgtcggcgtcggcctcgtctacggctccgtcaagctcggcatcctcaagatgaccaagcccaaggaggaagcagctgctgctcatcactgaggacaagtagctccagcgagttgacgccgtagattcgcaatgtaccttctatacctgcattcggttctgtgatttgtgtctgaaacccaaaaaaacccagacccatgtgggagctgaacctttagcttttttgcttgtggaaaataatatcctcggctgaatcgacttgaaatcaggaagagtgaaacttaaaattctttggtgtggttctgcgatccagaccaagtttttgctgtgtcatctagtttttgccgtgcaacctgattggctggtctagcgagcatcttggcgattgaatttatgtgtattcttttttgtaatatgttgcaagtttatatagacgtatgtagttc

SEQ ID NO: 27111 - DNA, 3178 bp, Triticum aestivum
  unsure (1)..(3178): unsure at all n locations
  Clone ID: PAT_TA_27111
tgattacgccaagctcgaaattaaccctcactaaagggaacaaaagctggagctccaccgcggtggcggccgctctagaactagtggatcccccgggctgcaggaattcggcaccagccgcgcaccaaacccgggccagttcgcctcgcgtttccccggtgacgtttccttgttcctcgccctcctcctctggagcaaggtttgaggacagcaatgggggagactgctggagagcgcgccctgagccgcatccacagcgtgagggagcgcatcggtgattccctctctgcgcacaccaatgagctcgtcgccgtcttctcaaggcttgttaaccaaggaaaggggatgctgcagccccatcagatcactgctgagtacaatgccgcgatccctgaggccgagcgcgagaagctcaaggacaccgcctttgaggatctcctaaggggcgcacaggaggcaattgtcatccctccatgggttgctctcgccatccggccaaggcccggcgtctgggagtatgtgagggtcaatgtgagcgaacttggtgttgaagaattgaacgtcctgaattatttgcagttcaaggaacaactggcgaatggaagcatcgataacaactttgtgcttgagctggactttgagccattcaacgcctccttcccgcgcccatcgctgtcgaagtccattggcaacggtgtgcagttcctgaacaggcacttgtcatcgaagctgttccatgacaaggagagcatgtacccattgctcaacttccttcgcgcgcacaactacaaggggatgaccatgatgttgaacgacaggattcgcagtctcggtaccctccaaggtgcactcaggaaggcagagacacatctgtcaggccttccagctgacaccccttactcagagttccaccaccggttccaggaacttggtttggagaaaggttggggcgactgtgctcagcgtgcgagcgagactatccaccttctcttggaccttctcgaggcccctgatccatcctccttggagaagttcctcgggacaatcccaatggtgttcaatgtcgttatcctctctcctcatggttactttgctcaggccaatgtcttggggtaccctgatactggtggacaggttgtttacattttggaccaagtccgtgctatggagaatgagatgctgttgagaatcaagcagcaaggtcttgacattacaccaaagattctaatagtcaccaggttgctccctgatgcacatggcaccacctgtggccagcgccttgagaaggtccttggcaccgagcacacccacatcctgcgtgtgccattcaaaacagaagatggtattgttcgcaaatggatctcccgctttgaagtctggccttacctggaagcttacactgatgatgtggcacacgagatcgccggagagctgcaggccactcctgacctgatcattggaaactacagtgatggcaacctagtcgcgtgtttgttggctcacaagttgggagttactcattgtaccattgcgcatgcactcgagaaaaccaagtatcccaactccgacctttactggaagaaatttgaggatcactaccacttctcctgccagttcacagctgacctgattgcaatgaatcatgctgacttcatcatcaccagtactttccaagagattgccggaaacaaggacaccgtagggcagtacgagtcgcacatggcattcacaatgccaggcctctatcgtgttgtccatggtattgatgtcttcgaccccaagttcaacatcgtctcccctggtgctgacatgtccatctacttcccatacactgaacagcagaagaggcttacctccctccatactgagattgaggagctactcttcagtgatgttgagaatgctgagcacaaatttgtgctgaaggacaagaagaagccgatcatcttctcgatggctaggctggaccgtgtcaagaatatgactggcctggtagaaatgtatgggcggaatcctcgcctacaggagctggtaaacctggtggttgtttgtggtgaccatggaaaggtgtccaaggacaaggaggagcaggcagagttcaaaaagatgtttgatcttatcgaacagtacaacctgattggtcacatccgctggatctctgctcagatgaaccgtgtccgcaatggtgagctctaccgctacatctgcgacatgaagggagcctttgtgcagcctgctttctatgaggctttcggtcttaccgtgatagaggccatgacatgtggccttccaacattcgccactgcatatggtggtccagctgagatcattgtgcacggtgtgtccggctaccacatcgatccttaccagaatgacaaggcctccgcactgcttgtggacttctttgggaagtgccaggaagacccgagccactggaacaagatctcgcagggaggactccagcgcatcgaggagaagtacacctggaagctgtactctgagaggctgatgaccctttctggtgtctatcgtttctggaagtatgtctccaacctcgacaggcgcgagactcgtcgctaccttgaaatgctctacgccctcaagtaccgcaaaatggctgcaactgtcccattggctgttgagggcgagacctcgggcaaatgatttgtccttaccagagaaataaatggcgggcgagcgctccgctttaccgttcttgattcagtgatgaagcacagatcggagagtgttatgcctttgattgtcctttgttaccgttcttgattcagtatgaactttagttcctgttgaggccccggccgtgttgtcgcggtaggggaactggatggatgctgtgttgttggtactttctcatggatacagtatttgaatgaatgaataagatagtctttgttttaaaaaaaaaaaaaaaaaaaaaaaaanctcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcacctgaatggcgaatggcaaattgtaagcgttaatattttgt

SEQ ID NO: 27112 - DNA, 1535 bp, Triticum aestivum
  Clone ID: PAT_TA_27112
ttttttttttaccgaaaaaggctttcgccccgctttatatataaagcaccgaccatacaaacacaccgatacaaacacacgcgaccaccgcacatgacacacacccaaggcaaatacaaaggtgccaagcaccgccacgccaccccaacgactaccaaacaacatgaatcgcttggagccaacggagacctccgcaatcttccgaggagaggcgaggcggataacgacggagcagggactccaggacggtgcctccagaagggcacgactatgggtagccgccaccgtccgatcacgaagatcaagttttcacctggagcatcacgaaggagtgggaacaccgcgacggagccttgatgaaggatacggcgtccacggacgtcgccaccgtcggcccatgagcaagtggtgtacccggcgctcacacccctccaacgcaccctacctccgccaaccacccgcaaccaaaccacccgcgtggatatggctgcacaccagcacctgagacgcgagctccgcccatacatttctacccggccataatattctcgatggctaggttggaccgtgtcaagaatatgactggcctggtagaaatgtatgggcggaatcctcgcctacaggagctggtaaacctagtggttgtctgtggtgaccatggaaaggtgtccaaggacaaggaggagcaggcagagttcaagaagatgtttgatcttattgaacagtacaacctgattggacacatccgctggatctctgctcagatgaaccgtgtccgcaatggtgagctctaccgctacatctgcgacatgaagggagcctttgtgcagcctgctttctatgaggctttcggtcttactgtgatagaggccatgacatgtggccttccaacattcgccactgcatatggtggtccagctgagatcattgtgaatggtgtgtccggctaccacatcgatccttaccagaatgacaaggcctccgcactgcttgtggacttctttgggaagtgcaaggaagacccgagccactggaacaagatctcgcagggaggactccagcgcatcgaggagaagtacacctggaagctgtactctgagaggttgatgaccctttctggtgtctatggtttctggaagtacgtctccaacctcgacaggcgcgagactcgtcgctaccttgaaatgctctacgccctcaagtaccgcaaaatggctgaaactgtcccattggctgttgagggcgagacctcgggcaaatgatttgtccttaccagagaaataaatggcgggcgagcgctccgctttaccgttcttgattcagtgatggagcacagatcggagggtgttatgcctttgcttgtcctttgttaccgttcttgattcagtgatgaactttttcctgttgagtccccgtgttgtcgcggtaggggaactggatggatgctgtgttgttggtactttctcatggatacagtatttgaatgaatgaataagatagtctttgttttactcccaagtttcccaaaaaaaaaa

SEQ ID NO: 27113 - DNA, 1998 bp, Triticum aestivum
  Clone ID: PAT_TA_27113
aattaaccctactaaagggaacaaaagctggagctccaccgcggtggcggccgctctagaactagtggatcccccgggctgcaggaattcggcacgaggatggcaacctagtagcatgtttgttggcgcacaagttgggagtaactcattgtaccattgctcatgcactcgagaaaaccaagtaccccaactccgacctttactggaagaaatttgaggatcactaccacttctcctgccagtttacagccgacctgattgcaatgaaccatgctgacttcatcatcaccagtaccttccaagagattgccggaaacaaggacaccgtagggcagtacgagtcgcacatggcattcacaatgccaggcctctatcgtgttgtccatggtattgatgtcttcgaccccaagttcaacatcgtctcccctggtgctgacatgtccatctacttcccatacactgaacagcagaagaggcttacctccctccatactgagattgaggagctactcttcagtgatgttgagaatgctgagcacaaatttgtgctgaaggacaagaagaagccgatcatcttctcgatggctaggctggaccgtgtcaagaatatgactggcctggtagaaatgtatgggcggaatcctcgcctacaggagctggtaaacctagtggttgtttgtggtgaccatggaaaggtgtccaaggacaaggaggagcaggcagagttcaagaagatgtttgatcttattgaacagtacaacctgattggtcacatccgctggatctctgctcagatgaaccgtgttcgcaatggtgagctctaccgctacatctgcgacatgaagggagcctttgtgcagcctgctttctatgaggctttcggtcttaccgtgatagaggccatgacatgtggccttccaacattcgccactgcatatggtggtccagctgagatcattgtcaacggcgtgtccggctaccacatcgatccttaccagaatgacaaggcctccgcactgctcgtggacttctttgggaagtgcaaggaagacccgagccactgcaacaagatctcgcagggaggactccagcgcatcgaggagaagtacacctggaagctgtactctgagaggttgatgaccctttctggtgtctatggtttctggaagtacgtctccaacctcgacaggcgcgagactcgtcggtaccttgaaatgctctacgccctcaagtaccgcaaaatggctgaaactgtcccattggctgttgagggcgagacctcgggcaaatgatttgtccttaccagagaaataaatggcgggcgagcgctccgctttaccgttcttgattcagtgatggagcacagatcggagcgtcttatgcctttgcttgtcctttgttaccgttcttgattcagtgatgaactttagttcctgttgagtccccgtgttgtcgcggtaggggaactggatggatgctgtgttgttggcactttctcatggatacagtatttgaatgaatgaataagatagtctttgctcgtgccgaattcggcacgagatcactgaggacaagtagctccagcgggttgacgccgtagattcgcaatgtaccttctatatgcccatccggttctgtgatttgtgtcttgaaacccaaaaaaccccaggcccatgtgggagctgaaccttagttttttgcttggtggaaaataatatcctcggctgaatcgacttgaaatcaggaagagtgaaactttaaatcatttccttttgcgtggtgctgcgatccagacccagtgtttgttgtctcatctagattttgccgtgtaacctgattggctggtctagtatagcgagcatctttgcgactgaatttatgtgtgttgtacatagttcaaccaaacgctcttaatgaggcaaatttaacaattttgacctcgaaacgaaataaattcacaaaatgaactgggtgtgaaattatttcacacccctgacc

SEQ ID NO: 27114 - DNA, 581 bp, Triticum aestivum
  unsure (1)..(581): unsure at all n locations
  Clone ID: PAT_TA_27114
gtggaaggctgtaattgatggatactcacaggttggaaaggcatttcttgctgggactgttttggtgtttggaggagcaacagctgtgctgctgtacactgccaatacgctacagttgcattcagttgacgtcgtcaaagccaaaggaaaagacgcagtgcaaccacatgcccatgtgatcaaagtacagatacctccactgaggctatgggccgaggccgcggccccgtcccggcattgccatgccgacggcgactgcggggcggggagaagtctgtccttgttagagagctttcaagggcacttggttctaagacgcgtcctccgaattgatcaatactactggcgagtggctgttgtcgttgttgttgtaacctgtaagtccaccattatgaagctttcgcttgttttacgtgtctgccttgtctatatgtgtaaggctacaaggaacgaaatcaatgtacatatgttacccctatgttaaataaagcagggtttgccactctaaaaaaaagaataaaaaaatgaagaaatacctgcacagtatactagnnnnnnnnnnnnnnnnnnnnnnnnnnnnn

SEQ ID NO: 27115 - DNA, 418 bp, Triticum aestivum
  Clone ID: PAT_TA_27115
gtcctggcggagggaaggagcgaaggaggaagacgacagcccgtgcgatttcaaatcggtgggtgggggaggggcagtttggtaatttcactcattttcacttggtcggaaaacctcctccaacgacaattatttcggaacggagggagtatgttattgatgtgtactttactagtgttcgtagtaacccttaggtatttgatactggttctgttgctaagattagtaactcgaaacaggagttgcagaataaaacaaagactagttaacggcaaggtgatgatgtgtgttggaaatgattccaagattgatatgatcaccatctacacactccgctctaccttcggtattagtgttgagcctaaatagaatactatttggtgtttgcgttgatcatgaacatgattagatcgtccgc

SEQ ID NO: 27116 - DNA, 1593 bp, Triticum aestivum
  unsure (1)..(1593): unsure at all n locations
  Clone ID: PAT_TA_27116
agtctgaacctgaatgccattcatccggtaagcagtttaacaagcatacaagataagagaacaaaacatcccgacttctcacagttaagctatagtttttaaccaaaaagtaaacatccaacgacacaactggcagtacaaccgacccaaggcaccgcatgtgaaatgctgagaaaattaatcgatatgctggcgctccagcgaaggaatagagtgaggaaaccggggcacctggtccgttggcccttgctgtagggacaggtctctgactggcttcagcataagcagggttggaggtctgataagaatgtgggagatctacggcacgagcatttagctggtcagaacggtagagccccccataagaaccacgagcatctatccctccttgacggtagggatcctccatacgaacatcgcgagcagcaacctctcctggacggtagagatcctccatacgagcaccacgagaaggagcctctgcagagcggtagagatcctggtagagatccgccacacgatcaccgcgagaagcaatctctcctgggcggtagagttcctccacacgagcaccacgggcagcaagctctcctgggcggtaaggatcctccaggcgagcatcatgaacagtggttcggtagagatccgacatgtggtcagcacgagcagccaactccccaagctgtgctgcgtaatcccttggaggtgttctggcagcaatgcgctcatgcactggatccactcgagaacggtagtaagaatcatcagatgaaggagccaaatggtggtaatacactagtgggacatgccgaggctctggtacagaaggcgcatagtgaggccctgtggcaataggaacttggcgagcctcgggggcaagaggaatgtgttgagactcgggtgcaggaggtgcttgttgataatatctgtgatcatcctggacattaaccaaaaattggccaggtcgggactcggtaggaaatggagcatagtgtgttgccctatatgagtcctcaggagcaggaacatgtacaaccacctgcgggcgcctgtcttcaacatgcaatggatgtggcctatcttcatgttgatgccttctttcttcatggtggtaccttccatctagatgaccccttggagctgattgctgtacagtgataggcttgaatagagccatcagcctacgaacttgtgtagaggtgatctcagggtcgaatttgcggcttgcactgtagttctctttgatggcatgcttgaaagtactctcaggaagaggaaggcaatctttatcagttgtaaatttcacctgagcaggaaacttcccgttaaaggcatttctgataaggtttatcccgccctttgatgtcgccttgtacactccatatagcagcctcaagtcaaaatcatacaggaatacctttgtccctggtcggaccttctccaccatctccttcttccccatgggcatgccaaacacgcggttctggaagcactccggcttagtctgtgcattgcacatgaagataagccctcctcccctgccatcaccacccccttctttncttggacccctcctccttcccctcgtgccga

SEQ ID NO: 27117 - DNA, 647 bp, Triticum aestivum
  Clone ID: PAT_TA_27117
tcgcggccgcgtcgactttttttttttttttttttttttttcattggatcttcatgctttgaagttggatccttctcttaaacttcctacctagcacagtacgcgtcaatcttactttgtaattcattaaggccatccatcaccaagtcatgcaatgcatcaaactctgcaccattctctgccagttcgggggaacgcttgcacaaattatcataacgctgcacaacttgggtatcaatcatatcatcataggagcatctaataaatgggggtttgcgcttaatatcctttctccatcgctgcaatatatacctaaaagggacatctgtgatctccatgagagcaagcacggaaatgatgtggctacacaagatgcctcgaaattcaaagagcctacacatacactgcacatcacattccccttggttgaacaagacaatgaactctaaaataacccctttctcttttcctttgccatcctccccttcacaaaaaatcttgctgtcctctctgactccaaatgtaaaaattgatccttctttgttcagctgagttggatagcaatagattttacctcttaattgatcttgaaactctttaaactttgcagtagtatatgctgcttgaaattgtctctcaaagtcata

SEQ ID NO: 27118 - DNA, 966 bp, Triticum aestivum
  Clone ID: PAT_TA_27118
cgcgatctcttctccctcctcccctcgccctgctctcctctccttcctcccctctggcggcgccactcctcgatcgatcctccccgcccgcgaccaatatgagcaccgcctacagctacagtccatccccgccaccaagaggctacaggggaagggcccgtagcgccaagtccccgtgatcgttatgatggtcggggtagagatctcccaaccagccttttggtcaggaaccttcgtcgtgactgcaggccaagatgaccttcgccgaccatttgcacagtttaggtcgtcttaaagacgtatatattccaagggattactatactcaggagccacggggatttgggtttgtgcagtactttgatcccaacgatgcggcagacgcaaaatactacatggatggacaggtcattcttggtagagaagttgcagttgtttttgcacaggagaacagaaagaagcctgctgagatgagaactagagaaagtagcagaggtcggtcttacgatcggcggcactctccttccccaagggggcggccatcttaccgcggccgaagctactcaaggtctccatcacctcggcccgcaaggcggaggttcagagacgagtctccctcgcgctcccgctcgcccagcggatcgaggagtgcgagtccattggatgggaagtacggcaggtcctcacgaagagagaggtcgatttcggttagcggttgaagcatcagtagctctgctcgggtctctagaactgtagtggacttgctcgtgggaatctaagtttgctatcgcttttgtgaaccgcgctaaccgtggatttatagagagaagattgccgtcgtgtatcagcaagagtatgtcaaactgtgtctgcggctctgtacctttgcactagattatttagcgcataaataaaatgactctgcattgcatattcgtcaaaaaaaaaaagtcgacgcggccgcga

SEQ ID NO: 27119 - DNA, 546 bp, Triticum aestivum
  Clone ID: PAT_TA_27119
gagccaacaattcatcagcctccaactgtgcacttacgttaggatcaatcgaggttctattactgcggccactcagactagcgcccgcgtcggcggaaggtatgtcatcaatatctattacagaaatattatgacgacgagtggtacgatttctgccagctgttgtgtctgaaggtgcaagacatgaactaccaagttcattaacagaactagagctttcaccaggatgataggaacttgtggcgtgtttcctctttcctttactgatccttattgtcctattcctcaaacttgcagaccgcgcagcggctgctgcacctaatgagttattgctgtcttctgctgcggtttcatcgcccccattagatggtccagaagatccagattccattccagaagtactggtcgtcttacacaacaatgacacgggtaacttaatagtatgattatgtgttgttctccaaccttgctgagaaatgccagtactgtcgtcatttacaaaagaagaacctactggggcccttggacaaaccctcatcgtatcag

SEQ ID NO: 27120 - DNA, 520 bp, Triticum aestivum
  Clone ID: PAT_TA_27120
tcgcggccgcgtcgacagcgctttcacatcacactccatcctccctcagattgcacacctttgcggatgaggctgtttgggctgctgcctctcgccggcgccgccctgctcctgctcggcatggccggcggcgtgtagccgatcgtcacgcgggaggcgttcgactccatgctgagcgcccgcaacgtgagcgggtgcgagggaggcgccttctacacctacgacgcgttcctggcggcggcgaacgcgagcgtgttccccggctttggcaccaccggcgatgacaagacccgccggcgggagctcgccgccttcttcgggcagacctccttcgtaaccactggttactgctacgtgaaggcggtgaaccgggccagcgcgccctactacggccgaggccccatacaactgactaccgaggacaactaccggctggcacggagggcgctggggctggacctgctgcgcaacccggacctggtgtccacggaccccgtcgtcgccttcagacggccatctg

SEQ ID NO: 27121 - DNA, 959 bp, Triticum aestivum
  Clone ID: PAT_TA_27121
attcggcacgaggcaaagatccagatcgcaccaaacggaggcagtccagatcgagctcccgagctcccgggaagaagcgagatccagatcgagctgagctgctctgcttgggccgccggagctgagctgagctgctctgaccgccggagcggaagagcaagaagatgaagcggaagacgcggaacaagatcgtggtgacggtgctgctgctgggggcggcggcggtgctgatcggcggcacgctggcgctgatcctgacggcgggcacctggaaggtgaagctcaaggagtcgcaggagaaggtgtgcaacaaggggtgggagtgctccggcaccaagtactgctgcaccacccggagctgctggagcagaacgcgacgctggcgttcgcggcggccatgtggcggtggatgacgcccatcaagaagaagcagccgtcggcgcacgaggccttcacgggggtgtggaagcccaccaagaacgacacgctcagcaagcgcctcccgggcttcggcgccaccatgaacctcctctacggcgagtccatctgcggcaggggcttcatcgacgagatgaacgtcatcatctcccactaccagtactacctcgacctcatgggcttcggccgggagcggtccggcctcaacctcgactgcgccgagcaggcccccttcaaccccgcccccaagaaggacgacgagcagcagcccaccggaggccagaagccgtcgggctagcacgcaccatgttgttgttgtatacatgttcagatattcttgccacgcaccattgcctgctctgctccccgagctatgctgagttgctgatacatacttcagtgtgtgagctttggtgccattttgggtagggctctgtatgtgaattggggaagctgtagcctgtgtgtgtaccacggtgtccattttcagttgttttgtttgcattttttgtgtcacacaa

SEQ ID NO: 27122 - DNA, 558 bp, Triticum aestivum
  unsure (1)..(558): unsure at all n locations
  Clone ID: PAT_TA_27122
caaacctcccatctccgtctagcgtcggcggcagttccactccctcgccatgggcaagattaagatcggaatcaacggtttcggaaggatcgggaggctcgtcgccagggtcgccctccagagcgacgatgtcgagctcgtcgccgtcaacgaccccttcatcaccaccgagtacatgacctacatgttcaagtacgacaccgttcacggccactggaagcacagcgacatcaagctcaaggacgacaagactctgctctttggcgagaagccagttaccgtctttggcgtcaggaaccctgaggagatcccgtggggtgaggctggtgccgattacgttgtggagtccaccggggtctttactgacaaagacaaggccgctggttacttgaaaggtggtgcccanaaaggtggatatnttgccccaagcaaagatgccctatagttgggttgtgtccatgagaccagtcacctcacacgctacactggtatatgcgtatggccctcaatggcctggtccctagctagacataatgcacttcgatatgaggttgagac

SEQ ID NO: 27123 - DNA, 807 bp, Triticum aestivum
  unsure (1)..(807): unsure at all n locations
  Clone ID: PAT_TA_27123
ctcccgtcccgtccccagccaacctcccatccccgtctcgcgtcgcagcggcagttccactccctcgccatgggcaagattaagatcggaatcaacggtttcggaaggatcgggaggctcgtcgccagggtcgccctccagagcgacgatgtcgagctcgtcgccgtcaacgacccctttatcaccaccgagtacatgacctacatgttcaagtacgacaccgttcacggccactggaagcacagtgacatcaagctcaaggacgacaagacgctgctctttggcgagaagccagntaccgtcttcggcgtcaggaaccctgaggagatcccgtggggtgaggctggtgccgattacgttgtggagtccaccggtgtcttcactgacaaggacaaggccgctgctcacttgaagggtggtgccaagaaggtggtcatctctgccccaagcaaagatgcccctatgtttgtggttggtgtcaatgaggacaagtacacctcanacgtttacattgtttcaaaggctagctggaccactaactgccttggtcccctagcaaggatattaatgaccactttcggattaatgagggtttggtgaccactggtattgccattacgggcccccaaaaaactggttgatggggcctttcaaccaagaactgtgaaggggggaaggcccccccacttttaaaataatttcccaccgaactggtgtttttccaagctgtttgccaagttttttcttgggcgtagggccgaggttttcccgcctggtttttctcgcgccccccccggggtgggggcg

SEQ ID NO: 27124 - DNA, 841 bp, Triticum aestivum
  Clone ID: PAT_TA_27124
cccaatcctcgatctgttctcaacctcccctccgtccgtcgcagctccagatttccttccccatggctccgatcaagatcggcatcaatggtttcggccggatcggcaggcttgtggccagggttgcgctccagagccccgatgtcgagctcgtcgccgtcaacgaccccttcatcaccaccgactacatgacctacatgttcaagtatgacactgtccatggacagtggaagcaccatgaagttaaggtgaaggactccaagacccttctcttcggccagaaagaggtagctgtgtttggctgcaggaaccctgaggagatcccatgggctgctgctggtgctgagtacgttgttgagtccaccggtgttttcactgacaaggacaaggctgcagcttacattaagggtggtgccaagaaggtcatcatttctgctcccagcaaagatgctcccatgtttgtctgtggtgtcaatgagaaggaatacaagtctgacatcggcattgtctccaacgctaggtggaccactaactgccttgctcctttttgctaaggtatcaatgacaaggtttgccattgttgagggtttgatgaccacaattcatgccatgacttgcacccaaaaaaatgttggtgggtctttccacaaggaccggagaggggaaaggctggcaactttaaaatatattccaggcaacactggtgccccaaaaggttgtttgcaaggtggttcccaaagctttaacggaaagttgcactgaaaagggccttccggggtcccacacggggaagggttctggttggtgaaccgaactggtaaacatttggaaaaccccgact

SEQ ID NO: 27125 - DNA, 846 bp, Triticum aestivum
  Clone ID: PAT_TA_27125
cctcgatctgttctcaacctcccctccgtccgtcgcagctccagatttccttccccatggctccgatcaagatcggcatcaatggtttcggccggatcggcaggcttgtggccagggttgcgctccagagccccgatgtcgagctcgtcgccgtcaacgaccccttcatcaccaccgactacatgacctacatgttcaagtatgacactgtccatggacagtggaagcaccatgaagttaaggtgaaggactccaagacccttctcttcggccagaaggaggtagctgtgtttggctgcaggaaccctgaggagatcccatgggctgctgctggtgctgagtacgttgttgagtccaccggtgttttcactgacaaggacaaggctgcagctcacattaagggtggtgccaagaaggtcatcatttctgctcccagcaaagatgctcccatgtttgtctgtggtgtcaatgagaaggaatacaagtctgacatcgacattgtctccaacgctagttgcaccactaactgcctttgctctcttgctaaggtatcaatgacaggtttggcattgttgagggtttgaagaccacagttcatgccatgactggcacccaacaagactggtgaaggtcccttcccaccaagactgggaaagtgggagggctgcccacttcaacattaattccaggcaccattggtgccgcaaaaggctggttggcagggtgcttcccaaaagttaaacggaaagttgactgggatggcccttccggggtcctaacgggtggggggttctggtggtggaccggaccggttaaacttgccaaacccgcgaaccttttataacg

SEQ ID NO: 27126 - DNA, 376 bp, Triticum aestivum
  Clone ID: PAT_TA_27126
tatgtttgtggttggtgtcaatgaggacaagtacacctcagacgttaacattgtctcaaatgctagctgcaccactaactgccttgctcccctagctaagatcattaatgacaacttcggtattattgagggtttgatgaccactgttcatgccatcactgccacacagaagaccgttgatggtccctcgagcaaggactggagaggtggcagggccgcaagctttaacatcattcccagcagcactgggtgctgccaaggctgttgggcaaggttcttcctgaagctgaatgggcaagcttaaccggtatgtctttccgggttctaacagtgagatcaacaactgacacatccctcgtgccgaattcggcacgag

SEQ ID NO: 27127 - DNA, 650 bp, Triticum aestivum
  unsure (1)..(650): unsure at all n locations
  Clone ID: PAT_TA_27127
ctcgatctgttctcaacctcccctccgtccgtcgcagctccagatttccttccccatggctccgatcaagatcggcatcaatggtttcggccggatcggcaggcttgtggccagggttgcgctccagagccccgatgtcgagctcgtcgccgtcaacgaccccttcatcaccaccgactacatgacctacattttcaaagtatgacactgtccaatggacaagtgggaagcaccatgaaatttaggtgaaaggactccaaagaccttctcttcggccaagaaggagtagctgtgtttgggctgcaagaacctgaggaagattccatggggctgctgctgggtgctgatacgttgttgatccaccgggnttttaactgacaaggacaagntgcagtcaaattaaggggggtgccaagaagncacattntgctcccaacaaagatctccaagtttgtcngggntcaatganaaggataaatctgantcacatntctcaacctagtngacaataatgcctgcnctctgcnaggtanaatgaaggttggaatgtnagggttgtacaaatcangcaagatgaaccaaaaagttangcctcacaggnggaagggaggngcaattaanatcaaaancgtnccaagggtganggncat

SEQ ID NO: 27128 - DNA, 784 bp, Triticum aestivum
  Clone ID: PAT_TA_27128
tttttttttttttttttgaactaagcattgctttattgcgaaaattattataagcttataacatccaagatagctacaaggaaaaatggagtaaactatagtacaaaggtcgccccggaaactggcccaaaattgcaaacacaaattactgggtacccaaattacttgtcagacgcctatcggaacaattttacatgttgacacagtagcacctgaaatagggccactgccaacctttatcttgtatatgctcaatgaacccaaccaggcactatcttatcttttggttgttacaggatttggttgcacttttacgcgagctcgagaacaagtgcggatgctccgcctccgccgttgcagacaccggcgaccccgattttgccacccttctccctgaggacaccaataagggtgaccaagatgcgagcaccgctgcatccaagagggtgtcctaaagacacagctcccccatgtacattaatcttttctgaaggaattccaagaatcttctgatttgcgagtgcaacagccgcaaaggcttcattaatttcataaaaatcaacagatgaagattctaagccagcatttgagagagccttcggtatggcaagtgccggggtggtggtaaatagttcgggagcttgagctgcatcggcaaatcctttgatccttgcaagaacttccagtccaagttcttgagccttctgcccactcaccaatactaatgcggcagcaccatcacttatactagaggcgttcccagcagtaacagtgccagcgttct

SEQ ID NO: 27129 - DNA, 896 bp, Triticum aestivum
  unsure (1)..(896): unsure at all n locations
  Clone ID: PAT_TA_27129
gctcgcgtcgcggcggcagttccctccctcgccatgggcaagattaagatcggaatcaacggtttcggaaggatcgggaggctcgtcgccagggtagccctccagagcgacgatgtcgagctcgtcgccgtcaacgaccccttcatcaccaccgagtacatgacctacatgttcaagtacgacaccgttcacggccactgttcatgccatcactgccacacagaagaccgttgatggtccctcgagcaaggactggagaggtggcagggccgcaagctttaacatcattcccagcagcactggtgctgctaaggctgttggtaaggttcttcctgagctgaatggcaagcttaccggtatgtctttccgggttcccactgtggatgtgtcagttgttgatctcactgttagaaccgagaaggctgcatcatatgatgacatcaagaaggctatcaaggctgcatctgaggggaagctcaaggggatcatgggttacgttgaggaggatttggtctccaccgactttgttggtgacagcaggtcgagcatctttgatgccaaggctggaattgctctgaacgaccatttcgtcaagcttgtctcgtggtatgacaacgaatggggttacagcaaccgcgttgtcgacctggatccgccacatggccaagactcaagtagagtgctctgctttcctttggtggcgcctggncaagaggtgccctgctttggtctatgcgaaagaataatgtgaatggcgtcgccaagacgacgcctgggtcatgttagttgggacatgantacttcctgtttcccgcacaaactagtacctggtaatgggagttgctaacaaaganccttttttgggtggtggttgtggaagaatatataaccgtcaa

SEQ ID NO: 27130 - DNA, 842 bp, Triticum aestivum
  unsure (1)..(842): unsure at all n locations
  Clone ID: PAT_TA_27130
gccgtcccaatcctcgatctgttctcagaccctcctccgtccgtcgcagctccagatttccttccccatggctccgatcaagatcggtatcaacggtttcggccggatcggcaggcttgtggccagggttgcgctccagagccccgatgtcgagctcgtcgccgtcaacgaccccttcatcaccaccgactacatgacctacatgttcaagtatgacactgtccacggacagtggaagcaccatgaagttaaggtgaaggactccaagacccttctcttcggtgagaaggaggttgctgtgtttggctgcaggaaccctgcaggagatcccatgggctgctgctggtgctgagtacgttgttgagtccaccggtgttttcaccgacaaggacaaggctgcagctcacattaagggtggtgccaagaaggtcatcatttctgctcccagcaaggatgctcccatgtttgtctgtggtgtcaatgagaaggaatacaagtctgacatcgacattgtctccaacgctagctgcaccactaactgccttgctcctcttgctaaggtaataatgacaggtttggcattgttgagggtttgatgacccacgttcatgccatgactgcaacccanaagactgttgatggtcccttccaccaggaacttggaaagggggaagggctgccagctttcaattattcccaggagcactggtcccgcaaaggctgttgccaaggggcttccaaaagctaacggaaaagtgaatgggaaggggctttccggtccccacggtggaggttttctgtggtgaaccgaacgggtaaactggcgaagccggaaacctatt

SEQ ID NO: 27131 - DNA, 1200 bp, Triticum aestivum
  unsure (1)..(1200): unsure at all n locations
  Clone ID: PAT_TA_27131
gtctctgtctcgtcgtcctcgcatctccactcgccatgggcaagattaagatcggaatcaacggtttcggaaggatcgggaggctcgtggccagggtggccctccagagcgaggatgtcgagctcgtcgccgtcaacgaccccttcatcaccaccgactacatgacctacatgttcaagtacgataccgtgcacggccaatggaagcacagcgacatcaagatcaaggactccaagactctgctcttgggcgagaagccggtcaccgttttcggcatcaggaaccctgacgagattccgtgggctgaggctggtgctgagtatgtcgtggagtccaccggtgtcttcactgacaaggagaaggctgctgctcacttgaagggtggtgccaagaaggttgtcatctcagccccgagcaaagatgctccgatgtttgtctgcggtgtcaacgaggacaagtacacttcagatattgatattgtctcaaatgctagctgcaccacaaactgccttgctcctcttgccaaggtcattcatgacaactttggtattatcgagggtctgatgacaactgttcatgccatcactgccacccaaaagaccgttgatggaccgtccagcaaggactggaggggtggcagggcggccagttttaacatcattcccagcagcactggtgctgctaaggctgttggtaaggttcttcctgagctgaatggcaagcttaccggtatgtctttccgggttcccactgtggatgtgtcagttgttgatctcactgttagaaccgagaaggctgcatcatatgatgacatcaagaaggctatcaaggctgcatctgaggggaagctcaaggggatcatgggttacgttgaggaggatttggtctccaccgactttgttggtgacagcaggtcgagcatctttgatgccaaggctggaattgctctgaacgaccatttcgtcaagcttgtctccgtggtatgacaacgaatggggttacagcaaccgcgttgtcgacctgatccgccacatgggccaaagaccaagtaagagtgctctgctttcccttgtgggcgcctggtccagaggtgtccctgcttttgtctatgcgaaagatattgnntttggcgntccccnagacgacgcctgggttcaagttaagttgggacatgattacttccngttttcccggcacaac

SEQ ID NO: 27132 - DNA, 726 bp, Triticum aestivum
  Clone ID: PAT_TA_27132
ttttttttttttggacaaaacattgctttattgcgaaaattattataagcttgctatagcatccagatagctacagtggaaaatgggagtacaaaggacatcccgaaaactggcccaaaattgcaaacaaaaattcatgggtaccccaaattcatgcctactgtcacgaaacaattttacatgttgacacaataacacctgaaaaaaggccaccgccaacctttctcttgtacacaaccaggcactatcttatcttttggttcttacaggatttgggctgcacttctacgcaagctcgagaacaagtgcggatgctccgcctccaccgttgcagacgccagcgaccccgattttgccacccttctccctgaggacaccaataagggtgaccaagatgcgagcaccgctgcatccaagagggtgtcctaaagacacagctcctccatgtacattaatcttttctgaaggaattccaagaatcttctgatttgcgagtgcaacagccgcaaaggcttcgttaatttcgtaaaaatcaacagatgaagattctaagccagcatttgagagagccttcggtatggcaagtgccggggtggtggtaaatagttcaggagcttgagctgcatcggcaaaccctttgatccttgcaagaacttccagcccaagttcctgagccttctgcccactcaccaatactaatgcggcagcaccatcacttatactaga

SEQ ID NO: 27133 - DNA, 818 bp, Triticum aestivum
  Clone ID: PAT_TA_27133
attcggacgaggcctcctcctcccctcctcctccacccgtgcgcctcgctggggcctagggtttgctcccgccctccaccgccgggacgaccacgggcgcgcaggaccccaccgcctcggatgctatgctgctaggctgcaggtccctctcctcctgggtgcgccgcctcgtcgcctgcatgggagcagaagttgccttggatgctgtggctgtgctaagcctgctccgataacagcggtcgatgagccttcaaaaggtttgaggatccaaggccgctccataaggaagacaaacttgtccgagggcttctggagcacgagtgcacacgggattggaaacagcgcgctacaatcgcagaggagcatgtcttcaatctgtacagcgccgcaatccagcgaccagcatggagctggaagtagcagcaacccaaacgagtttgtaaatcaaggtcttgtgcagtggaaccagactagacaacagtgggttggaaacaaaaaacgcaaatctcgacttgaaaagacccaagaaccaaagataagttggaacacaacgtacgagagcctgctaggaagcaataaactattctaccaaccaattcctcttgcggaaatggtagacttgcttgtggacgtgtgggagcaagaaggactatacggttagacagggaaaagaacatttgtttcaagtcacgttatgagattatatagattgtcaagagctcagtgagctctaagttggcaaaagtgtatatttggtgagccaattatgtccgggaccttgaacatacagtattattatcttaaatcaattctaattt

SEQ ID NO: 27134 - DNA, 878 bp, Triticum aestivum
  unsure (1)..(878): unsure at all n locations
  Clone ID: PAT_TA_27134
agacaaccacgaaatgagccccgaccagggctactgcgacgactcctacacgcagtggccctgcgtcaagggcgccgagtactacggccgcggcgccatcccggtctactggaacttcaactacggcgncggcgggggacgggctgaaggtggacctgctgcaccacccggagctgctggagcagaacgcgacgctggcgttcgcggcggccatgtggcggtgggatgacgcccatcaagaagaagcagccgtcggcgcacgaggccttcacgggggtgtgggaagcccaccaagaacgacacgctcagcaagcgcctcccgggcttcggcgccaccatgaacctcctctacggcgagtccatctgcggccggggcttcatcgacgagatgaacgtcatcatctcccactaccagtactacctcgacctcatgggcttcggccgggagcgctccggcctcaacctcgactgcgccgagcaggcccccttcaaccccgcccccaagaaggacgacgagcagcagcccaccggcggccagaagccgtcgggctagcacgcaccatgtttgtatgcatgttcagatattcttgccacgccattgcctgctccccgagctatgctgagctgctgatacatacttcagtgtgtgagctttggtgccattttgggtagggctctgtatgtgaattggggaaactgtggcctgggtgtgtaccacggtgtccattttcagttgttttgtttcatttttttgtgtcacacatatgtctaaagaggagaattcgaactgaacataggcgacatatcctaccatgactctgctcaactttctgtatatgttccacctgagtaaggtattgcttgatttatccatgtat

SEQ ID NO: 27135 - DNA, 685 bp, Triticum aestivum
  Clone ID: PAT_TA_27135
ttgccacttcgctttcatccccactcccatttttatctcctcaccagatccccgccaccagctaccgcattccccaaagatccagatcacaccaaacgggggcagcccagatcgagcacccgagctcccgagaagaagcgagatccagatcgagctgagctgcccgggccgccggagctgagctgagctgctctgaccgccggaggcgaagaagaagaagaagaagagcaagaagatgaagcggaagacgcggaacaagatcgtggtgacggtgctgctgctgggggcggcggcggtgctgatcggcggcacgctggcgctgatcctgacggcgggcacctggaaggtgaagctcaaggagtcgcaggagaaggtgtgcaacaaggggtgggagtgctccggcaccaagtactgctgcaaccagaccatcaccgacttcttcaaggtgtaccagttcgagaacctcttcgccaagcgcaacttccccgtcgccaaggccgtcggcttctgggactaccaggccttcatcaccgccgcctcgctcttcgagaaccagggcttctgcaccaccggcggcatcgacatgcagatgatggagctctgcgccttcctcggccacgtcggcgcaaagacctcatgtggatacggcgtggcgaccggcggtccgaccggcgtgggggctgtg

SEQ ID NO: 27136 - DNA, 844 bp, Triticum aestivum
  Clone ID: PAT_TA_27136
ggcgggcaagacggcgtccaaggaggccggcggcgaggccaagacgaggggccggaagaagggcagcaaggccaagaagagcgtcgagacgtccgtcccgtcccgtccccagccaacctcccatctccgtctcgcgtcgcggcggcagttccactccctcgccatgggcaagattaagatcggaatcaacggtttcggaaggatcgggaggctcgtcgccagggtagccctccagagcgacgatgtcgagctcgtcgccgtcaacgaccccttcatcaccaccgagtacatgacctacatgttcaagtacgacaccgttcacggccactgggaagcacagtgacatcaagctcaaggacgacaagactctgctctttggcgagaagccagttaccgtcttcggcgtcaggaaccctgaggagatcccgtggggtgaggctggtgcccgattacgttgtggagtccaccggtgtcttcactgacaaggacaaggccgctgctcacttgaagggtggtgccaagaaggtgggcatctctgccccaagcaaagatgccccctatgtttgtggttggtgtcaacgagggacaaggacacctcagacgttaacattgtcttaaatgctagctgcaccactaactgccttgctcccctagcctaagatcattaatgacaacttcggtattattgagggtttgatgaccactggtcatgccctcactgccccccagaagaccggtggttggtcccttcaacccaggactggagaggtggccagggcccccaggctttaacattatttcccagcaaccacttggtggctgtttaaggctgttgggtacaggc

SEQ ID NO: 27137 - DNA, 837 bp, Triticum aestivum
  Clone ID: PAT_TA_27137
cagagcatgattgtcagcacagagctcagcacacactcccatggcacaatcgccatatacatcccaaaggccatccttaagcataccgtcaacaaggctgtcatgtccgaagcgagaaccttttctagcttcagcgatgtatttcggagcattcgacatgctttccataccacctgccactacaatatcattgctgcccagttgaatcgactgtgcagcaaacatcgttgctttcatgccagaagcgcaaactttgttgactgtcgtgcaaacaaccgtgttcggtatccctgcacctaaagcagcctgtctcgcgggagcttgccccaagttagcactcaagacattgccgaagaagacctcctgcacaagggatggatccacattcgcccctttttcagagcagcttcgatagccacggagccgagtttggtagcaggcaaggaagacaggggcgccgaggaaaccacccataggggtgcgcgcgaccccgacgatgcagacatctctggggccgatgttctgtgaacccatggcagctccccgattccgacctgcaaaattagtcaggcgaacaaaaacaaactccggttcagtgtcgccgcgggatcaggcaagcagccgtcgcgtcacgcgcggtccagaggggggacgacagacgtcgctgccacgccggcggcgccaaggagcggtccgcgattattgacgaccatctgcatcaggccaagaaaatgcagagaaagagagagagggagggagggggcgtgcctggggtcgtcggatctggcggcggcggaggcggagtgcacgaggcgcgggagcgggggtcaagcagcc

SEQ ID NO: 27138 - DNA, 928 bp, Triticum aestivum
  Clone ID: PAT_TA_27138
agggagaagaaagccgccacctaataatgtcctaatcccccgacctcctcccctcgatcgaaattccaattccaaggagagagaaaaaaatagcagcgcctgagagcaacggtgcgtgcgtgcgtgcgtgcgagcgagggaacccaggcgaggtagcggatcccccggacgggcgggtggttctagggttagggtttgcggcggcggcggcggggctggggaccgtgcgtgcgcctccttcgacggcgagccggatgctatgctgctaggctgcgggtcgctctcctcgtgggtgcgccgcctcgtcgcctgcgtgggaaattgttttggatgtgcgaagtctactcctataacagctgttgatgagccttctaaaggtttaaggattcaagggcgctcgataaaacatcgtagtttgtctgaagatttttggagtacaagtccacgtgaaatggagaacagtgccttgcagtcgcagcgtagcatgtcttccatcagcacagcagcacaatctagtgagcagcatggagctgggaagtagcagcaacccaaatgagtttgtaaatcaaggccttctactctggaatcagactagacagcagtgggttggaaacagaaggtttaattctcagcgtcaaaagacccgggagccaaaaataggttggaatgctacatatgagagcctgctaggaagcaccaagacatttgcacagccgatccctccttggtgaaatggtagatttcctcgtggacgggctgggagcaggagggcctatatgattagctgcttaattaaagggtggtggtatttgtcgggggtctcgttgttaatcgcgtggaatgtactcaactttggtttaattcaaagcgtgtgggtgatgaatgtgtattatcctcgtgacagaagggcatcattttttttttaaaa

SEQ ID NO: 27139 - DNA, 655 bp, Triticum aestivum
  unsure (1)..(655): unsure at all n locations
  Clone ID: PAT_TA_27139
caagctttaacatcattcccagcagcactggtgctgccaaggctgttggcaaggttcttcctgagctgaatggcaagcttaccggtatgtctttccgggttcccactgtggatgtgtcagttgttgatctcactgttagaaccgagaaggctgcatcatacgatgacatcaagaaggctatcaaggctgcatctgagggaaaactcaaggggatcatgggttatgtcgaggaagatttgggtctccactgactttgtcggtgacagcaggtcgagcatctttgatgccaaggctggaattgctctgaacgaccatttcgtcaagctcgtctcgtggtacgacaacgagtggggttacagcaaccgcgttgtcgatctgatccgccacatggccaagactcagtagagcgttctgatttcctttggtcaaaggtgtccctgctttgtctatgcnaaagaataaatgtggatggtgtccccaaacgacgcctggttcatgttagttggacatgagttaccttctgttttccgcatcaactagtacttctgtaatggagttgctaatcaagtactcttttttggttgtggtttgtgaagattatataaatcgttcagcccagcacttgtgttcgcctgaataatcttatttctctccc

SEQ ID NO: 27140 - DNA, 1091 bp, Triticum aestivum
  Clone ID: PAT_TA_27140
cgtgaccccccatttcaaactgcacttgtgttactatacgtatatatgaggtatatgtattaagtgttttaccccagccatcggtggatgactcccattcaatccaattaaattgtgtagtccatatatactccataattccatctgtacaaagctatagctagctagcacaagcagcttgattaattgttcgtacaaacttaggtagctagtacaagcagcttgatccataaatgtacgagtagcttcctgcttgttacttgttgcatcttctgccatcactaagatttaccatctacttgctactgcatatgcatggaatacgacgagtcggcaaccaacaattgatgagcctgactgccagagaatggaaggagcaagatgtgcttgattaccatgtttcgtccggatcggcaggcttgtggccagggttgctctccagagccccgatgtcgggctggtcgccgtcaacgaccccttcatgagcactgactacatgacctacattttcaagtatgacactgtcaacggacagtggaagcaccattgagttaaggtgaaggactccaagccccttctcatcggtgagaaggaggttgctatgttgttttcactgacaaggacaaggctgcagctgacatgtagggtggtgccaataaggtcatcatttctgctcccagcaaggatgctcccatgtttgtctgtggtgtcaatgagaaggaatacaaatctgacatcgacattgtctccaacgctagctgcaccactaactaccttgctcctcttggttatcaatgacaggtttggcatcgttgagggtttgatgacaacagttcatgccatgactgcaacccagaagactgttgaatgtccttccagcaaggactggatagggggaagggctgccagcttcaacatcattccgagcagcacttggtgtcacaaagaatagatagatccagaaattttcatacctagaggacgatgccttcttggtgctccttgcttacagcaggcctgggagatgatcagatggatataatgtatgcaacatgaatgcaagagagatggcgaacttgaaggcatgaata

SEQ ID NO: 27141 - DNA, 707 bp, Triticum aestivum
  Clone ID: PAT_TA_27141
tcgcggccgcgtcgacgttgggatggtggtctgggatttctggaagtttgtctgatccatatggtcttataatccgtataagcgctgaacatggtcgatacgtggcaaaaagttatgatatcaggcagctggcttcagatggccatggttaccctatattcgaaatttattttgcagaggcaaatggaggatacaacctgcaggcagtgcatctgaaaccagatgtcagtgattcggaccagttgcgaaacatgttgagtggaaaactcaaggggatcatgggttacgtcgaggaggatttggtctccactgattttgtcggtgacagcaggtcgagcatctttgatgccaaggctggaattgctctgaacgaccacttcgtcaagcttgtctcgtggtatgacaacgagtggggttacagcaaccgcgttgtcgacctgatccgccacatggccaagactcagtagagcgttctgctttcgtttgtggcgcctggtcagaggtgtccctgctttgtctatgcgaagaataaatgtggatggtgtcgccagacgacgcctggttcatgttagttggacatgagttaccttctgttttccgcatcaacctctagtatctgtaatggagttgctaatcaagtactcttttttggttgtggtttgtgaagaatatataaatcgttcagtccagtactcaaaaaaaaaaaa

SEQ ID NO: 27142 - DNA, 1063 bp, Triticum aestivum
  Clone ID: PAT_TA_27142
ttcggcacgaggccgctgctcacttgaagggtggtgccaagaaggtggtcatctctgccccaagcaaagatgcccctatgtttgtggttggtgtcaatgaggacaagtacacctcagacgttaacattgtctcaaatgctagctgcaccactaactgccttgctcccctagcaaaggtgtgttttgtttcttcacgtcgtcttaccttgactacttttggaattgtggatcagtttgtaataatgtttatcatcattcaccagatcattaatgacaacttcggtattattgagggtttgatgaccactgttcatgccatcactgccacacagaagaccgttgatggtccctcgagcaaggactggagaggtggcagggccgcaagctttaacatcattcccagcagcactggtgctgccaaggctgttggcaaggttcttcctgagctgaatggcaagcttaccggtatgtctttccgggttcccactgtggatgtgtcagttgttgatctcactgttagaaccgagaaggctgcatcatacgatgacatcaaagaaggctatcaaggctgcatctgagggaaaactcaaaggggatcatgggttatgtcgaggaagatttggtctccactgactttgtccggtgacagcaagtccgaagcatctttgatgccaagggctggaattgctctgaacgaccatttcgtcaagcttgtctcgtggtatgacaacgaatggggttacagcaaccgcgttgtcgacctgatccgccacatggccaagactcagtagagtgctctgctttcctttgtggcgcatagacaaagcagggacacctctgaccaggcgaagaataaatgtggatggcgtcgccagacgacgcctggttcatgttagttggacatgagttaccttctgttttccgcatcaactagtatctgtaatggagttgctaatcaagtactcttttttggttgtggtttgtgaagaatatataaatcgttcagtccagtacttgtgtttgccttaatagagagataactctattaactctaaaaaaaaaa

SEQ ID NO: 27143 - DNA, 1048 bp, Triticum aestivum
  Clone ID: PAT_TA_27143
agggagaagaaagacgccacctaataatgtcctaatcccccgacctcctcccctcgatcgaaattccaattccaaggagagagaaaaaaatagcgactgagagcaacggtgcgtgcgtgcgagcgagggaacccaggcgaggtagcggatcccccggacggacgggtggttctagggttagggtttgcggcggcgttggggctggggaccgtgcgtgcgcctccttcgacggcgagccggatgctatgctgctaggctgcgggtcgctctcctcgtgggtgcgccgcctcgtcgcctgcgtgggagcagaaattgttttggatgtgcgaagtctactcctataacagctgttgatgagccttctaaaggtttaaggattcaagggcgctcgattaaacatcgtagtttgtctgaagatttttggagtacaagtccacgtgaaatggagaacagtgccttgcagtcacagcgtagtatgtcttccatcaggcacagccagcacaatctagtgagcagcatggagctggaagtagcagcaacccaaatgagtttgtaaatcaaggtcttctactctggaaccagactagacagcagtgggttggaaacagaaggcttaattctcagcgtcaaaagacccgggagccaaaaataggttggaatgctacatatgagagcctgctaggaagcaccaagacatttgcacagccgatccctcttgggtgaaatggtagaatttcctcgtggacggctgggagcaggaggggctatatgattagctgcttaattaaagcgtgttggtattgtctggggtctcgttgttaatcgctggaatgtactcaactttggtttatcaaagcgtgtgggtgatgaatgtggattatcctcgtgacaggatggcatccctttttcttttaaagtaaatgtaacatatttttatcctactatttttttttacatttagcaaaaaaaaaaaaaaaaaaaaaagaaaaaaaagaaaaaaaaaaaaaaaaaaaaaaaaaaagaaaaaaaaaaaaaaaaaaggccccta

SEQ ID NO: 27144 - DNA, 2306 bp, Triticum aestivum
  Clone ID: PAT_TA_27144
ggggaagtggagctgggagaggtggaagcagcacttcgccctcattcaggagagcgagcgccttgttgatgaactgcagctacaactccgcactgctgtgtgtagagaagactataggagtgcccacaaactgaagttagctattgctgctacatcaagaaatgatactgtcggcagagcaatatctgagttacatagggccatagaagaggaccgctatgtggatgcagcttatattagagaccacgctggtgcaggactgttgggatggtggtctgggatttctggaagtttgtctgatccatatggtcttataatccgtataagcgctgaacatggtcgatacgtggcaaaaagttatgatatcaggcagctggcttcagatggccatggttaccctatattcgaaatttattttgcagaggcaaatggaggatacaacctgcaggcagtgcatctgaaaccagatgtcagtgattcggaccagttgcaaaacatgttgagtggaaaactagatgtcaacaatataaacatatctagcagttccttaggtgctaaacacgaggaacacgatgaaggcataagcatggacgatcaaaatagcgatgatagtgatgttgctgctggtccagctggtttgaaaaacttgtcaaatgattcaactccaattcccaggatcaaaatattgaaggtagcgcctatggaaaacatcaaccaggactatataattaaaatatttgaccagatttcagaggaagatgatgacaacgatgaagctgagatcgaaaatgaatcttcacaagatattggcgatgaagataagaatgaagaagcaggaacaatttctgcagaagagaataatgatgagtctggtgaggaaagtgatattgaagcattgttatcgattggaattgaagttgataatgataaggattttgcttcacagtcctcacctaaaacatttgaacgcatgccagctaaattagacaagagagaccgcttttcatttaccttctatactgaacaatccagtaaaaagccagctgcagaaaaggctcagcagattccgaggaagcgggttggcttccgtaccactgagcaggatggtgatctcaagtttgatcgtttaaagttgtctgggggcaataggaaactaccggtactacaacttggtattaagcaacttaataacaaggttcagccaaaactatatggagttacccacttcagccgtattcagatgcccatctcttcagatcctcttagtggtctatacgagactgcatctgggtttgactcagaagttcttagtttacaacggaaattcggtcaatggcaggaggaggattcatctgaggagcacttggatcttaagttttatgagtatgtcgaagctgcaaaattgactggggacaatcttgtgccagcgggtcaggttgtcttccgtgcgaaagttggcaaacactatcagcttcctcataagggggtcatccctagagaacttggagtggttgctaggtataaggggcaaaggagaattgcagatgctggcttcaaaaatcctcgatgggttgacggcgagcttttgatactagatggaaagttcatcagagatggtcctgtgatagctttcttctactggacatcaaatctccatctttttgaattctttaggcggttgagtcttcctgactagtttcattttaagagacgcagttcaaggacattctgcaatcacacatgctgatgtacagttaacggaggtaatgtacatagtttacctttggagcaaattgggctttcgccgagcatcacattttccatatacggggatcgtggcggagatggccccacagtatggtggatgagagggtgaagaaatttatgaccagagaaatagctcaaatagccccactgcccaacttgaatggtgagcatttctcattccacttctctcagctgacccacccaatttacgagttgaggcccaaagacttgctgctttggaaggagccacctttattttgacccagtcgaattgaaatatgttaaaaggaaagtgatgagtgggttttcatttttgtcctccttcttggcattcttcatacagggaacccttttgtgaaatataagcaacaattgtgtgcagattgtcatgtggtgtaactaaggtcactattattggttccagaaaagtggagcggagcattaaactggtgtatgtgtataaagtttggtgcccacgtattcaagtatgttaactacgtgcaaaaaaaaaaaaaaaaaaaaaaaaaaaaaaactcgag

SEQ ID NO: 27145 - DNA, 822 bp, Triticum aestivum
  Clone ID: PAT_TA_27145
tttttttttttttttttttggtagcacaaccatgctttattgcaacaattattattattgttattaaaccaagaatgcttaaaacagctacaacagaaaataaaaacaatctaaagtaagagcagaaaccggcacacaagttctaagttaatcaattacttaatctgacacagcactatgaaatacagtacatagcattttacatgcaggctccatctttggtgccagagctccttacgcgagctccataacgagcgcagatgcaccgccaccgccgttgcagacaccagcaactccgatcttgccactcttctccctaagaacaccaagaagggtgaccaaaatgcgagcaccactgcacccaagtgggtgtcctaaagatacagctcctccatgtacatttatcttttctgaaggaattccgagaagcttttgatttgcaagtgcaacagccgaaaaggcttcgttgatttcataaaaatcaacacgggaggactctaggccagcattcgtgagagcctttggtatggcaagtgctggggtagtggtaaatagttcaggagcttgggctgcatcggcaaatcccttgatccttgcaaggacatgcaatccaagttcttgagccttcttcccactcaccaatactaatgctgcagcaccatcacttatactagaagcatttccagcagtaacagtaccagcattatccttgaatgctggtcgtagcttcttcagcttggctgcgtcaaacttgtctaggctctcatctttgtcaacaagcactgcaggtttccctctaccaacaggaacttcaatcggaac

SEQ ID NO: 27146 - DNA, 1251 bp, Triticum aestivum
  unsure (1)..(1251): unsure at all n locations
  Clone ID: PAT_TA_27146
cctcgtgccgctctgccgccagagtgacggccaaggagggggatgagtactgctgctatcaactacgacggaggagaaggaggcggccatggaccaagagttgaaagaacaggctgtggaagacgtgcgtgtacgccattaccttcggcatgctcgtggcgctgctgctgggcctgaacatgtcctggagcgccattaccgccgccctggcgctcatcgtcctcgacttcaaggacgcccgcccctgcctcgagaaggtctcctacccactgctgctcttcttctgtgggatgttcatcccggtggatggcttcaaccagaccggcattccgagcacgttctgggagttcatggagccctacgcgcggatcgacacgcccgccggggtggtcatcctcgccctggtcatccttctcctgtccaatgtcgcctccaacgtaccaacagtgctgctgatggggaacgaggtggcgaccgcggcggcggcgatctccccggcggcggagactcggtcgtggctgctgctggcgtgggtgagcacggtggcgggcaacctttcgctgctggggtcggcggcgaacctgatcgtgtgcgagcaggcgcgccgggcgccgcgcaacgcctacgagctcaccttctggaaccacctcatcttcggcgtgccctccaccctcatcgtcaccgccgtcggcatccccctcatcggaaagatgtagccaccctatccatctaccaacatcgccctcgccaccgccgaccgacgatccaactatatgcaatatacactttccttatatataccagcagcctgtacatatgtacgtgcatacacaagcgcatatacgggcactttgtacgtacgtacgtataggtcatagcctccgttttcgtatgtgtgttaattgctgtgtgcgttgttgattaattagtatatgtatgtatgtaatggtgagaagagaaggagagggagatgattatcacgcacggtgtgctaattatttaagcagtgcaactgtggaactgtactggtgattaatctgcatggatgaatgaatttggttcatcaagatcaagagaacacatatgtatatatgcaagtgcaacacatgtggttgcatgcattatgcatatatatatatgccaagatgtaagggaatttaaagtaatgtatcttggcaccttggtgtgtgtatgttgcaagtggtacttnaaagaaaaaagaaaagaatcccttgttgggttccaaaaaaa

SEQ ID NO: 27147 - DNA, 1712 bp, Triticum aestivum
  Clone ID: PAT_TA_27147
cccacgcgtccggcacgcgcggttgccacttcgctttcatccccactcccatttttatctcctcaccagatccccgccaccagctaccgcattccccaaagatccagatcacaccagacgggggcagcccagatcgatctcccgagctcccgagaagaagcgagatccagatcgagctgagctgagctgagctgctcggaccgccggagctgagctgagctgagctgctctgaccgccggaggggggagagcaagaagagcaagaagatgaagcggaagacgcggaacaagatcgtggtgacggtgctgctgctgggggcggcggcggtgctgatcggcggcacgctggcgctgatcctgacggcggggacgtggaaggtgaagctcaaggagtcgcaggagaaggtgtgcaacaaggggtgggagtgctccggcaccaagtactgctgcaaccagaccatcaccgacttcttcaaggtgtaccagttcgagaacctcttcgcaaagcgcaacttccccgtcgccaaggccgtcggcttctgggactaccaggccttcatcaccgccgcctcgctcttcgagaaccagggcttctgcaccaccggcggcatcgacatgcagatgatggagctctgcgccttcctcggccacgtcggcgcaaagacctcatgtggatacggcgtggccaccggcggtccgacggcgtgggggctgtgctacaaccacgagatgagccccgaccagggctactgcgacgactcctacacgcagtggccctgcgtcaagggcgccgagtactacggccgcggcgccatcccggtctactggaacttcaactacggcgcggccggggacgggctgaaggtggacctgctgcaccacccggagctgctggagcagaacgcgacgctggcgttcgcggcggccatgtggcggtggatgacgcccatcaagaagaagcagccgtcggcgcacgaggctttcacgggggtgtggaagcccagcaagaacgacacgctgagcaagcgcctcccgggcttcggcgccaccatgaacctcctctacggcgagtccatctgcggccggggcttcatcgacgagatgaacgtcatcatctcccactaccagtactacctcgacctcatgggcttcggccgggagcgctccggcctcaacctcgactgcgccgagcaggcccccttcaaccccgcccccaagaaggacgacgagcagcagcccaccggcggccagaagccctcaggctagcaccatgttgctgtataaatattcttaccacgccattgcctgctccccagagctacgccgagctgccgattcttcagcgtgtgagctgctttggtgccattttgggtagctgatccgagagctgtgtatgtgaattgggaaaactttagcctgggtgtgtaccacggtgtccattttcatttgtttttgtttcattttttgtgtcacacatatgtctaaagaagagaattcgaactgaacataggcaacatatcctaccatgactctgctcaactttctgtatatgttccacctgagtaaggtattgcttgatttatccatgtataaataccagtttggcctgactaaggtgttgcctgattgagccatttgtgaggggccatctttggcaaacgtgatccaaggaaggaaagggccaatctatgaacagccgttgttttgaacct

SEQ ID NO: 27148 - DNA, 1047 bp, Triticum aestivum
  unsure (1)..(1047): unsure at all n locations
  Clone ID: PAT_TA_27148
tgcgttcgcgtgggcacggtgagcgggttcaacaagacggggctgccgggcgccatctggaacttcatggcgccctactccaaggtggacagcgccggcggcatctccgtgctctgcgtcatcatcctcctcctctccaacctcgcctccaacgtaccaacagtgctgctgatggggaacgaggtggcgaccgcagcggccctgatctcgccggcagcggtgacgcggtcgtggctgctgctggcgtgggtgagcacggtggcagggaatctctcgctgctggggtcggcggcgaacctgatcgtgtgtgagcaggcgcgtcgggcgccgcgtaacgcctatgagctcaccttctggaaccacctcatctttggcgtgccctccaccctcatcgtcaccgccgtcggcatccccctcatcggaaagatgtagccaccctacccatctaccaacatcgccctcgccaccgccgacgatccaactatatgcaatatacactttccttatacataccagcagcctgtacatacgtatgtgcatacacaagcgtatatacgggcactttgtacgtacgtacgtataggtcatagcctccgctttcggtatgtgtgttaattgctgtgtgccgttgttgattaattagtatatgtatgtatggtgagaagagagggagggagatgattatcacgcgcggtgcgctaattaattaagcagtgcactgtggactgtatcggtgatctgcatggattaatgaatttgcttcatcaaaaaaaaccgcctcgtcgcctgcatgggagcagaagttgccttggatgctgtggtgtgctaagcctgctccgataacagcggtcgtgagccttcaaaggttaggatccaaggccgctccataaggaagacaacttgtccggggttctggagacgagtcacacgggattgaacagcgcgctacatcgagagacatgntcaatctgncacgcgaatcagcgacacatgactgaatacncaccaacgantttaanaagctttcatgacagctgcacanggtga

SEQ ID NO: 27149 - DNA, 907 bp, Triticum aestivum
  Clone ID: PAT_TA_27149
agacacttctcccgtcccgtccccagccaacctcccatccccgtctcgcgtcgcagcggcagttccactccctcgccatgggcaagattaagatcggaatcaacggtttcggaaggatcgggaggctcgtcgccagggtcgccctccagagcgacgatgtcgagctcgtcgccgtcaacgacccctttatcaccaccgagtacatgacctacatgttcaagtacgacaccgttcacggccactggaagcacagtgacatcaagctcaaggacgacaagacgctgctctttgggcgagaagccagttaccgtcttcgggcgtcaggaacccctgagggagatcccgtgggggtgagggctgggtgcccgattacgttgtggagtccaccgggtgtcttcactggacaaggacaagggccgcctgctcactttgaagggtggtgccaaagaaaggtggtcatctctgccccaaagcaaaagaatgcccctatgtttgtggttggtgtcaatgaggacaagtacacctcagacgttaacattgtctcaaatgctagctgcaccactaactgccttgctcccctagcaaagatcattaatgacaacctcggtattattgagggtttgatgaccactgttcatgccatcactgccacacagaaagaccgttgatgggtcctcgagcaaagactggagaggtggcaagggccgcaagctttaacaacatttcccagccaacactggggcttgcccaagcttgttggcaagggtctttcttgaacttgattggcaacccttccccgtttggcttttccgggttcccacttggggaaggtgtcagttgttgaatctaactgttgaaacccgaaagggtgctttttcccattaacttcaaaaaggcttttaggggt

SEQ ID NO: 27150 - DNA, 937 bp, Triticum aestivum
  Clone ID: PAT_TA_27150
gccgggtcggggaacgctagccaagagcgagaagctagagcacttcaaactcgaggttagctagccaggctccatggcccgcattgcgcctctcgtgctggcggcgctgctctccgtgctggtcgcgccctcgtcggcgtgccccagctgcccgaccccgacgacgcctcccccgccgccgccgccgaaggtgaagcccccgcccccgccgtcgtccgtgccgtgccccccgccgccgtactcccccgcgccgacgcccccgacgccggcgacgccgacccctccggcgccgtcgtcgccgacgggcaagtgccccgtggacgtgctgaagctggtggcgtgcgtggacgcgctcaacgggctggtgcacgcggtggtgggcgccaaggccagcgagacctgctgcccgctgctgtccggcgtggccgacctcgacgccgcgctctgcctctgcaccaccatcaaggccaaggtgctgaacgtcaaactcgtgctccccgtcgccatctcggtgctcgtcaaccagtgcggcaagcacgtgccgtcctcgttccagtgcccttcataatccactccatcgatcgattagcacctactacatacatactgtaccaccacctgcatcctcatgcatgcccgcgtgcatggagctagcaccttctcaaggtaagtacgcatagtacatgcatgccacatgtcatgtgtaatctgtataacgcatacatgcatgggcagctagctctggctatcttttggtgtggagcagcgaacatgcgttgtgtaaatgtgtatcaactatcaagtactagcagtatatactgtaatcgtgcataattgcttatatacatgtgactgtgtgagttgtgatgttgggtgtgtagcattctttttgacagttattatgaataatataaagtgattgtaatgtgtaaaaaaa

SEQ ID NO: 27151 - DNA, 906 bp, Triticum aestivum
  Clone ID: PAT_TA_27151
agaccagtgcagcgaacgctagccaagagcaagaagctagagcatttcaagctcgaagctagctagccaggcaccatggcccgcattgcgccgctcgtgctggtggcgctgctctcggtgctggtcgcgccctcgtcggcatgccccagctgcccgaccccgacgacgcctcccccgccgccgccgccgaaggtgaagcccccgccccctccgtcgtccgtgccgtgccctccgccgccgtactcccccgcgccgacgcccccgacgccggtgacgccggcccctccgacgccgtcgtcgccgacgggaaagtgccccgtggacgtgctgaagctggtggcgtgcgtggacgcgctcaacgggctggtgcacgcggtggtgggcgccaacgccagcgagacctgctgcccgctgctgtccggcgtggccgacctcgacgccgcgctctgcctctgcaccaccatcaaggccaaggcgctgaacgtcaaactcgtgctccccgtcgccatctcggtgctcgtcaaccagtgcggcaagcacgtgccgtcctcgttccagtgcccttcatgatcaccggcctccgtcgattagcacctacctacatactgtaccaccacctgcatcctcatgcatgcccgcatgcatggagctagcacctttgcaaggtaagtacgtatacggagtgtttgcatgtttggtcatacatacatgcatgacacatgtcatgtgtaatctctataacacatgcatgcatgggcagctagctctggccatcttttggtgtggagcagcgaacatgcgctgtgcaaatgtgtatcaagtactctagtatatactgtatcgtgcataattgcatatatacatgcgagttgtgtcccccgcaaaaaaaaaaaaaaaaaaactcga

SEQ ID NO: 27152 - DNA, 1599 bp, Triticum aestivum
  Clone ID: PAT_TA_27152
gggcgcgcgcggttgccacttcgctttcatccccactcccatttttatctcctcaccagatccccgccaccagctaccgcattccccaaagatccagatcgcaccaaacggaggcagtccagatcgagctcccgagctcccgggaagaagcgagatccagatcgagctgagctgctctgcttgggccgccggagctgagctgagctgctctgaccgccggagcggaagagcaagaagatgaagcggaagacgcggaacaagatcgtggtgacggtgctgctgctgggggcggcggcggtgctgatcggcggcacgctggcgctgatcctgacggcgggcacctggaaggtgaagctcaaggagtcgcaggagaaggtgtgcaacaaggggtgggagtgctccggcaccaagtactgctgcaaccagaccatcaccgacttcttcaaggtgtaccagttcgagaacctcttcgccaagcgcaacttccccgtcgccaaggccgtcggcttctgggactaccaggccttcatcaccgccgcctcgctcttcgagaaccagggcttctgcaccaccggcggcatcgacatgcagatgatggagctctgcgccttcctcggacacgtcggcgccaagacctcatgtggatacggcgtggccaccggcggtccgacggcgtgggggctgtgctacaaccacgagatgagccccgaccagggctactgcgacgactcctacacgcagtggccctgcgtcaagggcgccgagtactacgggccgcggcgccatccccgtctactggaacttcaactacggcgcggcgggggacgggctgaaggtggacctgctgcaccacccggagctgctggagcagaacgcgacgctggcgttcgcggcggccatgtggcggtggatgacgcccatcaagaagaagcagccgtcggcgcacgaggccttcacgggggtgtggaagcccaccaagaacgacacgctcagcaagcgcctcccgggcttcggcgccaccatgaacctcctctacggcgagtccatctgcggcaggggcttcatcgacgagatgaacgtcatcatctcccactaccagtactacctcgacctcatgggcttcggccgggagcggtccggcctcaacctcgactgcgccgagcaggcccccttcaaccccgcccccaagaaggacgacgagcagcagcccaccggaggccagaagccgtcgggctagcacgcaccatgttgttgttgtatacatgttcagatattcttgccacgcaccattgcctgctctgctccccgagctatgctgagttgctgatacatacttcagtgtgtgagctttggtgccattttgggtagggctctgtatgtgaattggggaagctgtagcctgtgtgtgtaccacggtgtccattttcagttgttttgtttcatttttttgtgtcacacaatgtctaaagaggagaattcgaactgaacataggcaacatatcctgccatgactctgctcaactttctgtatatgttccacctgagtaaggtattgcttgatttatccatgtataaataccagtctgacctgactaaaaa

SEQ ID NO: 27153 - DNA, 1723 bp, Triticum aestivum
  unsure (1)..(1723): unsure at all n locations
  Clone ID: PAT_TA_27153
ttaccctccttaagggaacaaaagctggagctccacccgcggtggcggccgctctagaactagtggatcccccgggctgcaggaattcggcacgaggcccgtctccagcaaacctcccatctccgtctagcgtcggcggcagttccactccctcgccatgggcaagattaagatcggaatcaacggtttcggaaggatcgggaggctcgtcgccagggtcgccctccagagcgacgatgtcgagctcgtcgccgtcaacgaccccttcatcaccaccgagtacatgacctacatgttcaagtacgacaccgttcacggccactggaagcacagcgacatcaagctcaaggacgacaagactctgctctttggcgagaagccagttaccgtctttggcgtcaggaaccctgaggagatcccgtggggtgaggctggtgcccgattacgttgtggagtccaccggtgtcttcactgacaaggacaaggccgctgctcacttgaagggtgggtgccaagaaggtggtcatctctgccccaaagcaaagatgcccctatgtttgtgggtggtggccaatgaggacaaagtacacctcagacgttaacatttgtctcaaaatgctaactgcaccactaactgcccttgctcccctagctaagatcattaatgacaacttcggtattattgagggtttgatgaccactgttcatgccatcactgccacacagaagaccgttgatggtccctcgagcaaggactggagaggtggcagggccgcaagctttaacatcattcccagcagcactggtgctgccaaggctgttggtaaggttcttcctgagctgaatggcaagcttacgggtatgtctttccgggttcccactgtggatgtgtcagttgttgatctcactgttagaaccgagaaggctgcatcatatgatgacatcaagaaggctatcaaggctgcatccgagggaaaactcaaggggatcatgggttacgtcgaggaggatttggtctccactgattttgtcggtgacagcaggtcgagcatctttgatgccaaggctggaattgctctgaacgaccacttcgtcaagcttgtctcgtggtatgacaacgagtggggttacagcaaccgcgttgtcgacctgatccgccacatggccaagactcagtagagcgttctgctttcgtttgtggcgcctggtcagaggtgtccctgctttgtctatgcgaagaataaatgtggatggtgtcgccagacgacgcctggttcatgttagttggacatgagttaccttctgttttccgcatcaacctctagtatctgtaatggagttgctaatcaagtactcttttttggttgtggtttgtgaagaatatataaatcgttcagtccagtactcaaaaaaactgctgttggcgtgggtgagcacggtggcgggcaacctgtcgtgctggggtcggcggcgaacctgatcgtgtgcgagcaggcgcgccgggcgcgcgcaacnctacgantcaccttctggaacactcatttcggcgtgccctccaccctcatcgtacgccgtggatccccctcatcggaaagatgtagcaacctatcattacaaatgcctgcaacgcgacggtcaactaatgaaanactttctataatacagagcttaatcgattgatcnaaggttancggattgagacgagatagnaactcnttcgagg

SEQ ID NO: 27154 - DNA, 1640 bp, Triticum aestivum
  Clone ID: PAT_TA_27154
tcggcacgagggacacttctcccgtcccgtcccgtccccagccaacctcccatctccgtctcgcgtcgcggcggcagttccactccctcgccatgggcaagattaagatcggaatcaacggtttcggaaggatcgggaggctcgtcgccagggtagccctccagagcgacgatgtcgagctcgtcgccgtcaacgaccccttcatcaccaccgagtacatgacctacatgttcaagtacgacaccgttcacggccactggaagcacagtgacatcaagctcaaggacgacaagactctgctctttggcgagaagccagttaccgtcttcggcgtcaggaaccctgaggagatcccgtggggtgaggctggtgccgattacgttgtggagtccaccggtgtcttcactgacaaggacaaggccgctgctcacttgaagggtggtgccaagaaggtggtcatctctgccccaagcaaagatgcccctatgtttgtggttggtgtcaacgaggacaagtacacctcagacgttaacattgtctcaaatgctagctgcaccactaactgccttgcttccctagctaagatcattaatgacaacttcggtattattgagggtttgatgaccactgttcatgccatcactggcccacagaagaccgttgatggtccctcgagcaaggactggagaggtggcagggccgcaagctttaacatcattcccagcagcactggtgctgctaaggctgttggtaaggttcttcctgagctgaatggcaagcttaccggtatgtctttccgggttcccactgtggatgtgtcagttgttgatctcactgttagaaccgagaaggctgcatcatatgatgacatcaagaaggctatcaaggctgcatctgaggggaagctcaaggggatcatgggttacgttgaggaggatttggtctccaccgactttgttggtgacagcaggtcgagcatctttgatgccaaggctggaattgctctgaacgaccatttcgtcaagcttgtctcgtggtatgacaacgaatggggttacagcaaccgcgttgtcgacctgatccgccacatggccaagactcagtagagtgctctgctttcctttgtggcgcctggtcagaggtgtccctgctttgtctatgcgaagaataaatgtggatggcgtcgccagacgacgcctggttcatgttagttggacatgagttaccttctgttttccgcatcaactagtatctgtaatggagttgctaatcaaagtactggactgaacgatttatatattcttcacaaaccacaaccaaaaaagagtacttgattagcaactccattacagatactagttgatgcggaaaacagaaggtaactcatgtccaactaacatgaaccaggcgtcgtctggcgacgccatccacatttattcttcgcatagacaaagcagggacacctctgaccaggcgccacaaaggaaagcagagcactctactgagtcttggccatgtggcggatcaggtcgacaacgcggttgctgtaaccccattcgttgtcataccacgagacaagcttgacgaaatggtcgttcagagcaattccagccttggcatcaaaggcaagcccggccggc

SEQ ID NO: 27155 - DNA, 2437 bp, Triticum aestivum
  Clone ID: PAT_TA_27155
tttttttttttttttttggtagcacaaccatgctttattgcaacaattattattattgttattaaaccaagaatgcttaaaacagctacaacagaaaagaaaattgaaacaatctagagtaagatcagaaaccggcacacaagttctaagttaatcaattacttaatctgacacagcactatgaaatacagtacatagaattttacatgcaggctccatctttggtgtcagagctccttacgccagctccataacgagcgcagatgcaccgccaccgccgttgcagacaccagcaactccgatcttgccactcttctccctaagaacaccgagaagggtgaccaaaatgcgagcaccactgcacccaagtgggtgtcctaaagatacagctcctccatgtacatttatcttttctgaaggaattccgagaagcttttgatttgcaagtgcaacagccgaaaaggcttcattgatttcataaaaatcaatacgagaggactctaggccagcatttgtgagagccttcggtatggcaagtgctggggtagtggtaaatagttcaggagcttgggctgcatcggcaaatcccttaatccttgcaaggacttgcaatccaagttcttgagccttcttcccactcaccaatactaatgctgcagcaccatcacttatactagaagcatttccagcagtaacagtaccagcattctccttgaatgctggtcgtaacttcttcagcttggctgcgtcaaacttgtctaggctctcatctttgtcaacaagtactgcagggtttccctctaccaacaggaacttcaatcggaacaatctcccatgcaaaagcaccactgtcacgagcagcaattccacgctcattactttgaatagcatatgcatcctggtcttccctcgtcagggcatgattgtcagcacaaagctcagcacagactcccatggcacaatcgccgtatacatcccaaaggccatccttaagcatgccatcaacgaggctgtcgtgtccgaagcgagatccttttctagcttcagcgatgtatttcggagcattagacatgctttccatcccacctgccacaacaatgtcattgattcccagttgaattgattgtgcagcaaacatggtcgctttcatgccagaagcgcaaactttgttgactgtggtgcaaacaaccgtatttggtattcctgcacctaaagcagcttgtcttgcaggggcttgccccaagttagcactcaagacattgccaaagaagacctcctgcacaagggatggatcgacatttgcccttttcagagcagcttcaattgctatagagccaagtttcgtagcaggcaaggaagacaagccaccaaggaaactacccataggggtgcgtgcaaccccaacaacacatacatctctgaggtctgaacccatggctgctccaaagcccagctccgacctcgatctggcggcggcggagtgcacgaggacgacccctagaggagtcgagatcggggagagggaacaagacactgaaacaggttggtgtcaatgaggacaaagtacacctcaagacgtttaacattgtctcaaaatgcctagctggcacaactaactgccttgctcccctagcaaaagatcattaatgacaacttcgggtattattgagggtttgatgaccactgttcatgccatcactggccacacagaaagaccgttgatggtccctcgagcaaggactggagaggtggcagggccgcaagctttaacatcattcccagcagcactggtgctgccaaggctgttggcaaggttcttcctgagctgaatggcaagcttaccggtatgtctttccgggttcccactgtggatgtgtcagttgttgatctcactgttagaaccgagaaggctgcatcatacgatgacatcaagaaggctatcaaggctgcatctgagggaaaactcaaggggatcatgggttatgtcgaggaagatttggtctccactgactttgtcggtgacagcaggtcgagcatctttgatgccaaggctggaattgctctgaacgaccatttcgtcaagctcgtctcgtggtacgacaacgagtggggttacagcaaccgcgttgtcgatctgatccgccacatggccaagactcagtagagcgttctgatttcctttggtcagaggtgtccctgctttgtctatgcgaagaataaatgtggatggtgtcgccagacgacgcctggttcatgttagttggacatgagttaccttctgttttccgcatcaactagtacttctgtaatggagttgctaatcaagtactcttttttggttgtggtttgtgaagattatataaatcgttcagtccagtacttgtgtttgcctgaataatcttatttctcttcctttcaaaaaaaaaaaaaaaaaaaa

SEQ ID NO: 27156 - DNA, 1482 bp, Triticum aestivum
  unsure (1)..(1482): unsure at all n locations
  Clone ID: PAT_TA_27156
ctactaaagggaacaaaagctggagctccaccgcggtggcggccgctctagaactagtggatcccccgggctgcaggaattcggcaccagnaatcctcgatctgttctcagaccctcctccgtccgtcgcagctccagatttccttccccatggctccgatcaagatcggtatcaacggtttcggccggatcggcaggcttgtggccagggttgcgctccagagccccgatgtcgagctcgtcgccgtcaacgaccccttcatcaccaccgactacatgacctacatgttcaagtatgacactgtccacggacagtggaagcaccatgaagttaaggtgaaggactccaagacccttctcttcggtgagaaggaggttgctgtgtttggctgcaggaaccctgaggagatcccatgggctgctgctggtgctgagtacgttgttgagtccacccggtgttttcaccgacaaggacaaggctgcagctcacattaagggtggtgccaagaaggtcatcatttctgctcccagcaaggatgctcccatgtttgtctgtggtgtcaatgagaaggaatacaagtctgacatcgacattgtctccaacgctagctgcaccactaactgccttgctcctcttgctaaggttatcaatgacaggtttggcattgttgagggtttgatgaccacagttcatgccatgactgcaacccagaagactgttgatggtccttccagcaaggactggagaggtggaagggctgccagcttcaacatcattccaagcagcactggtgccgcaaaggctgttggcaaggtgctcccagagcttaacggaaagttgactggaatggccttccgtgttcccactgttgatgtttctgttgttgatctgactgttagacttgcgaagccagcaacctatgatcagattaaggctgctatcaaggaggagtctgagggaaacctcaagggcattttgggttacgttgatgaggaccttgtttccactgactttcaagggtgacaacagctccagcatcttcgatgccaagggccgggattgctctgaacgacaacttttgtcaagcttgtctcctggtacgacaacgagtggggatacagcacccgcgtggtcgacctcatccgtcacatgcacagcaccaagtaaatgagaggcatgaagatacaggggagagtggtttgccccagaggagtgttcaaagcctcttcttctgagaataaatttttgtatggaattatgtcagctaaaaaccttttattggatgtatcctgatggttggtcacattttggtggtattatgtacttgcttgaactaaatcatgagtcattttcactcatcttctttggttttccaaaaaaaaaaaaaaaaaaaaaaaaaaaaaaaaaaaaaaaaaaaaaaaaaaaaactcgagactagttctctcacctcggccgcgaccacgctaatcactagtgaattc

SEQ ID NO: 27157 - DNA, 1215 bp, Triticum aestivum
  Clone ID: PAT_TA_27157
aaaataagcgcaccagtcaccaaaccaacgcatcagatactcattcagacgactcgagcgaccactgcctcttacttgtcccgtccctgccacgtactacgtactcctacatcgcaatggccgcagctgcagcaccggccaggtccacgaaagaagtgctcccgcctgcactgggcgccgtctccgagccccctcccctcttcgatggcaccaccagactgtacatttgctacatctgcccgtttgctcagcgcgcctgggttacccggaactgcaagggcctgcaggaggagatcaagctggtcgccatcaatctggaggacaagccagcatggtacaaggagaaggtttacccacagggcacggtgccttccctggagcacgacggcaaggtcaccggagagagcttggatttgatcaagtacatcgacagcaacttccacggcccggcactgcttcctcaagatcccgcaaagaggcagttcgccgatgagctgattgcttacgctgacgcctttaccaaagcactctactcgcccttgatctcccaagtggccatgtcagacgaagctgttgctgctctagacaagatcgaagctgccttgtccaagttcagcgacggcccgttcttccttggccaatttagcttggtggatattgcctacgtgacgatcttggagagggttcagatatactactctcacttgaggaactacgagatcgccaaaggcaggcccaaccttgagagatacaccgaggagatgaacatgatcgaagcgtataagcaaaccaaaaatgtcccgctggccttgcttgatgctgccaagaggcatctcaagattgcctgaagaagcggtgattcgccaagaattacggcggctgccagggaacggcggcatttgagtaggccaagactgaactctcgtcaccgggggttggggcttcttttactaccattattatcacaatgagttgtagtagtatatgttctcttcccaataaatgacaccatgttgtaacctgtaagggctatgctttttatgaaacaataatgtactccaaaaaaaaaaaaaaaaaaaatggaaaaaaaaaaaaaaaaaaaggcccataggtctgcgcagccggcgccctatgggaaccacgacccgatgaagatattatggggcagaggggcggtgaagcagaaatcgggactcctaaggggagtccccaatg

SEQ ID NO: 27158 - DNA, 841 bp, Triticum aestivum
  unsure (1)..(841): unsure at all n locations
  Clone ID: PAT_TA_27158
cggncgcgtgggcggacgcgtgggcggacgcgtgggcggtgttcctccccttcctcatcctgcaggtcggcaaggacgccgcgctccgcgccaggctccgcgacgaggtgcgcgccgcgctggagcggcacgccggcgaggtcgggttcgcgtcggtgcgcgggatgccgctggtgcggtccacggtgtacgaggtgctccggatgaacccgcccgtgccgctgcagttcgggcgcgcgcggcgggacttcgtgctgcgctcccacggcggggagggcttctccgtcgccgccggggagatgctgtgcgggtaccagccgctggcgatgcgggacccggcggtgttcgaccggccggacgagttcgtggcggacaggttcgtcggggcggagggggaggcgctgctgcggtacgtgtactggtccaacgggccggagacgggggagccggcggcggggaacaagcagtgcgccgccaaggaggtggtcgtggccaccgcctgcatgctcgtcgccgagctcttccgccgctacgacgacttcgagtgcgacggcaccgccttcaccaggctccacaagcggccgccccccccctccccagcctccctcggccgctgcccgcctctaggtccccgcgttcgttcgggggtaccccttggtttttcttcactcgccctccctctgtcctcccccgctccgctcccgttgctcatcggtctcatgtgccggttcagctggttaatacaagttctctggctgtggtttaaattctgtaagaattaaatgttggtaaataaaatcgcagaggatatcttgaactgtaaaaaactcgaaaagaatcc

SEQ ID NO: 27159 - DNA, 477 bp, Triticum aestivum
  Clone ID: PAT_TA_27159
tcgcggccgcgtcgacgtcgacgcggccgcggccgcgtcgacctttccctccgcccgctcgcgctcacggccgccgcgatgccgccaccgccgccgccgccggtccacctccgcctccgggtctccatcaccccgccccacccgctccctctcccctactcccgccgcttctcctccgccacgtctggcctagccaccgcccgccacctctccctccgccgcggcagccggcgccgcgcccccgtgtgcgccgcgcggagcgaggccgcgggggcggaggggttcgacgaggagctcggaaggctcctggagctgctccccggggagctgcggcagcgggtggaggaccacccggagctccccgcgctggtggaggtggtcatggacctcggccggcccccgctcgcgcgcttcccctccggcgacttcctcctctcccaccgccccatatccttcgacgacctccgccaggccact

SEQ ID NO: 27160 - DNA, 777 bp, Triticum aestivum
  Clone ID: PAT_TA_27160
tcggcacgaggggagtgtggaagaaagtcgagtttgcgaggcccggtgcttgcgctcaagtcggggccaaacaaagcctgcctgcaaacccctggatccagcatttcagatcgcgtgattgcagcagcagcagcagcagtgcaagaggtgatggggcacaaactttagtaggtgatcacgaatcgggtattcggactacccctggggggactcccttgtcccatggaagggaattgggagcttgcaagggagaaaaccttctcgaccaaaattcagaggtctctgatcagaactttgctgacgacgacgaggcggaagtcggcgcagaatcaagcagaacatgcaagaaaagacgattgagcagttcttccacttactgcgcccaaacgatccagtgactttacaggatcggttagcatagtctgttgcaagccttgacaaaagcaacacgcccaattactcaaagagcccggacgcgtgggcaaaacctgttggaacttggaagcaaggatgctctgaagtaaagaatggaagagtatttatcgggtaaatgcgccaccggcaagcactggaggatttatttgacagattagatcctggctatgtatctctattttgcagttaaagtcgattgtgtggtagtgccccattatgaggaacaacaggctcactcgctgcttagtagtagtgtcctggtagatagtaatattgttttgttttacggatgtaatgaaatgttgttgcttgcaatgtgaatgaaacgttcatgtttaccac

SEQ ID NO: 27161 - DNA, 1128 bp, Triticum aestivum
  unsure (1)..(1128): unsure at all n locations
  Clone ID: PAT_TA_27161
ctctattgtcttcgaaggacgagctaggnctgagtttctaagcattctgacagggtggggaaagcatagcaagattgcgggcgcaagcactcttcgccatgtcatcgaagcacttctcaactcaatcggagcaccgtttcaggttgagcgattcaacattggaaggtttgtatcgcccagcgtcgtggtggctgcctggttgagagaatccggcaccatcaacacgatactcgtcagcgacgagcgtgcgcagcgtgcaagcccatccaatctggtgccgaggctggaggcgctgcagttgtagcccgtaaagcaccgcataccctgtagcagccttgtctgtaagctctcccccgcctctccttagtttgtcttctgcctttcagaagactgtgtagtgtattataggctcgccgaataggagcttgttttgttgttgaatcctgttgttaattggcagtgtgcctttcaagttccaactcctctcatcaagggtggaaaaagaagtttaatcagaatccaccagattggatcccctgtccccgattgattgtcgctttcgtcgacagcaaggactggggaatcactgctcccaagagggtcatctgcagcgggttaagatgccttgagttcttgttttggtactcgtccggtgaaggcagatacctggagctcttgtttcggccaagtgccatggatggatgacgctgacacccccactggctggtttccccctttggatcgtgatgctgctttacaagatgccatcagctttgctgaagatgcaaatggcatctcccgatccatgaatgatgagcaagcagcctgtggctgtgtgggcagctcaagtggttggctgacgaggcgccatggaaagggcaagcaaaaaggcgtggaggagatgagcgcaatgtgtaggctgttagattcattcattcagttgccatggctcctttctgaacaattgggcctggagatggggcattgtcaaccgttcgaaatggtcaaaaaattgtctggaaactgtatatcgccgacccgtggcccattttttttactttggttttcattttacatttaattgttggttcgcttctcgctctcatcggtatttgacttcttcctcgc

SEQ ID NO: 27162 - DNA, 962 bp, Triticum aestivum
  Clone ID: PAT_TA_27162
atggaggaggtgggtatggagtttcttctcgacgccgtcgacagcgacccgaagactcaaatgctgggtctgcatgcggtcagcggctcggggaagagggacctgagaaagcacgagacagagtctgccggcgtcggaaatcatcaccgactaggtcggcgcagtccacatacagagtcaacccccaggccccaggatggacgaaaaggttggactgaacctgctgatggttgggagacggagctatctagcctgcttggttgcgctggtgcacatggtgccggacgacttgctgctgagcacgggctatctgctgagtgctcatcctcctcagatatgagcgatgaaagttgaagaagcgacacagccgagcctgcggaaaaatgcagacctatagactgaaactcaatatcacgcttgaagcctgcaagatgcaagaactatggtgttgagggtcaccgccgcaacagctgcaccatgcctcacctctgggtgttattgcatcttgactagaattgcattttcagtatggttcagtttgagaattttctagtgcgcgttgcccacttgttcatctcggttgtacgatggctttgtgttcatcagttgctgcgttcattagttatgtttgtgaacagttaactgtgtttttgcatgtagtcgactagtcgaggactgcctagcatgtgatgtctgtcaagtctgtgtgttcctgattgtaaaaactcctcctagtttgtgtcctgggtcactcgatgatgagagtttttgctgtatgtgtcatcagatgtctgtctgtccaaactgaatctgtattctcttcccctgttcggtgtatggtgaacaaataaagtcatggcaaaatgaaggcacgagcctgctgtgaggagttctaaattctcagccattcgtgcatgtgcttagttcctgcaggaaggttgcccccctgtcaataaaaaaat

SEQ ID NO: 27163 - DNA, 709 bp, Triticum aestivum
  Clone ID: PAT_TA_27163
gcggccgcgtcgacctcggaactgctccctttgggaggaaccctaagttgagctctttccaactgggcggcggcggcggcaccacctattagaacacaaaaagagaagcgacggcgggtggcggccgggggaaagtgaggcgagggcgcctcttgaggtggagacggggacggggacggaaggggaatccggcaagtccaccgagcagcagcctgaagctctttcttgcggcaccgagatccagaactttcaggggcggatcataaaactggagcgggaggatatgcctaaccagtcggacacattggatggtggtggcgatggcgcagaggatgcgatggacgggcaaatctgttgtcttggaggaggatcagtctgaagatgtctcttgcagccctgagatccagagtaaggttccagtccctcctcctcctcacggcgtgaagaagggggatcacaagggtccggtcatccctcctgagaagctcaaacaattggcggggctgcgatcagaactgcttaaggaggagaaaacgctgttggccgattttcgaagacggaaggagagagcactggaggagcatgagagggaccgaaggtgactcgttgccgtggacgccgagcgtggaatatgtatcagttgtgagtggtattttggatgacctcgaccgaaacagagagaaacagaaggaggtcaatcctgtttttt

SEQ ID NO: 27164 - DNA, 647 bp, Triticum aestivum
  Clone ID: PAT_TA_27164
gggggaagtcatcatttatgatcgcataacatacactaagatacatgtagtagcacgcaccatatacactgaaaaagttatgttcggtgtaaaagcacggctgaaacattttggtgagccgtcgccgtctctcatatggtattaatactataacgaggagctaaatatataagttcctagactttctctatacagaattaatcgatacttcctcgtcatagttttgaaattccaatggccccgtcttcatctccttcctccagcatggcagcaatacctcacctcctatatattgtttctgctccggctttaaggcagcttaagactagctattccggtcttaatagcgagcttcaactgatttctaactgctcagtacgtatttatgatcctgccagccctcttcttcttgttcttcccgctccacgggagcggccgttctcccccggctgtgaacgcaagttactactaactattgcagacataatagcttcagttaattgctgactggttagtattcatgatcgtgagcgccttcccatgggggcccaggacgcactcccccgcaggccgcccgagcccccgcccctccagctgccgcggcgtcgccgcggggcggcggaccagcacatcccgtagcttcttgt

SEQ ID NO: 27165 - DNA, 381 bp, Triticum aestivum
  Clone ID: PAT_TA_27165
cagtgatggtaaccttgtggccactctacttgcccataaattgggagttacccagtgcaccattgcccatgccttggagaaaaccaagtaccccaactcagacatctacttggacaaattcgacagccagtatcacttttcatgccagttcacagctgacctgattgccatgaaccacactgatttcatcattaccagcacattccaggaaattgctggaagcaaggatagcgtgggccaatatgagtctcacattgctttcacccttcctgatctgtaccgggttgtccatgggattgacgtgtttgatcctaagttcaacatcgtctcccctggagcagacatgactgtctacttcccgtacactgagactgacaagag

SEQ ID NO: 27166 - DNA, 1502 bp, Triticum aestivum
  Clone ID: PAT_TA_27166
cccacgcgtccgccgcgcctctggtgtcagccacttctttccttcgttccgtgagctcagttttgtgtcctgagccatggctgccaagctgactcgcctccacagcctcagggagcgccttggtgccaccttctcctcccaccccaatgagctcattgcactcttttccaggtatgttcaccagggcaaaggcatgctccagcgccaccagctgctcgctgagtttgacgaactgttcgaatccgacaaggagaagtatgcaccctttgaagacatcctccgtgctgcacaggaagcaattgtgctacccccatgggttgcacttgccatcaggcccaggcctggtgtctgggactacattcgggtgaatgttagtgaactcgctgttgaagagctgactgtttctgagtacttggcattcaaggaacagcttgttgatgagcatgccagcagcaagtttgtgcttgagcttgattttgagcctttcaacgcctccttcccgcgcccttccatgtccaagtccatcggaaacggggtgcagttccttaaccgtcacctgtcttccaagttgttccaggacaaggagagcctctacccactgctcaacttcctgaaagcccataactacaagggcacgacaatgatgttgaacgacagaattcagagccttcgtggtctccagtcagcccttaggaaggcagaagaatatctagttagcattcctgaagacacccccagctctgaattcaaccacaggttccaagagcttggcttggagaagggttggggtgacaccgcaaagcgggtacacgacaccatccatttgcttctggaccttcttgaggcccctgatcctgccagcttggagaagttccttggaactattccgatgatgttcaatgttgtcatcctgtcaccgcatggatactttgctcaatccaatgtgttgggataccctgataccggtggccaggttgtgtacatcttggatcaagtccgggctttggagaatgagatgcttctgaggattaagcagcaaggccttgatataactcccaagatcctcattgttaccaggttgttgcctgatgctgttggaactacatgtggccagcggctggagaaggtcattggaactgagcacactgacattctccgtgttccattcagaactgagaatgggatcctccgtaagtggatctcgcgttttgatgtctggccgtacctggagacatacaccgaggatgtttccagtgaactcatgagagaaatgcaggccaagcctgaccttatcattggcaactacagcgatggcaacctagtcgccactctgctcgcgcacaagttgggagtcactcagtgtaccatcgctcatgccttggagaaaaccaaataccccaactcggacatatacttggacaaattcgacagccagtaccacttctcttgccagttcacagctgaccttattgccatgaaccacaccgatttcatcatcacca

SEQ ID NO: 27167 - DNA, 1016 bp, Triticum aestivum
  Clone ID: PAT_TA_27167
ctccgctgtacagcgatgttgagaacgatgaacacaaatttgtgttgaaggacaggaacaagccaatcatcttttcaatggcccgtcttgaccgtgtgaagaacatgactggcttggttgagatgtacggcaagaatgctcatctgaaggatttggcaaaccttgtgattgttgctggtgaccatggcaaggagtccaaggatagggaggagcaggctgagttcaagaggatgtacagtctcattgaggagtacaagctgaagggccatatccgttggatctctgctcagatgaaccgtgttcgcaatggtgagctgtaccgctacatctgtgacaccaagggagcatttgtgcagcctgcattctatgaagcatttggtctgactgtcattgaggccatgacatgtggtttgccgacaattgcgacatgccacggtggccctgctgaaatcattgtgaacggggtgtctggcctgcacattgatccttaccacagcgacaaggccgcagatatcctggtcaacttctttgagaagtgcagcagatccgagctactgggacaagatctcacagggcggcctgcagagaatctatgagaagtacacctggaagctctactccgagaggctgatgaccctgaccggcgtgtacgggttctggaagtacgtgagcaacctggagaggcgcgagacccgccgctacatcgagatgttttacgccctgaagtaccgtagcctggcaagccaggttccgctgtccttcgattagtacggggaaagaagaagaagaagaagcccaggccggagaaccatcgcctgcatttcgatctgtttcaccgcaattcgcattgttagtcgtgtattggagttatgtgtacttggtttccaagaactttggttccttctcgttttttttccttgtttgagcgtttttgggcagcgctggcctggttcctagtatggtgggaattggctgcacctttgcttcgaataaaaatgcctgctcgttcacctgtc

SEQ ID NO: 27168 - DNA, 612 bp, Triticum aestivum
  Clone ID: PAT_TA_27168
gcccgcacccctcctctccttttcaaatccctccctttcttttcttttctttttttcaaaggaacaggaaccatccatccactcatccatggccgccgcctcgcccgagttcttcaagccgcccgccgccttctcgccgcgcctccacctcctcgccgccgacggcgccgacgacgactaccaccgctgctgccggacgcccacgggcgccggggtcggctgcctgggccaggccgccacctgcccgccggcgccgcggaagccgcgcccgcgccccgacgccgcctgccggaagcgcctcttcgacgtccaggtcatcagcctccgcttcgacgacctcgacgccatcttccgcccctcgccgccgccgccctgccacgaccacaacaacaacaacatacattagcggtagcaccggagccgccgctcgcttaaattaagtgcttgtcattagcaatcagcaccagtagttgagttgagttgagttgacacctgtatcagccatcttcagtagcggtagccacgacccatacttcgcctcacgcacgcacccatcctctgtaatcatccatcatatcataataatattattactacgtattattattttct

SEQ ID NO: 27169 - DNA, 4252 bp, Triticum aestivum
  unsure (1)..(4252): unsure at all n locations
  Clone ID: PAT_TA_27169
cattccaggaaattgccggagcaggntagcgtgggccaatacgagtctcacattgctttcaccctccctgatctgtaccgggttgtccatgggattgacgtgtttgatcctaagttcaacatcgtctctcctggagcagacatgactgtctacttcccatacactgagactgacaagaggctcaccgccttccactctgaaattgaggagctcctgtacagcgatgttgagaacgatgaacacaaatttgtgttgaaggacaggaacaagccaatcatcttttcaatggctcgtcttgaccgtgtgaagaacatgactggcttggttgagatgtacggcaagaatgcacatctgaaggatttggcgaaccttgtgattgttgctggcgaccatggcaaggagtccaaggatagggaggagcaggctgagttcaagaggatgtacagtctcattgaggagtacaagctgaagggccatatccgttggatctctgctctgatgaaccgtgttcgcaatggtgagctgcacccctacatccgtgacacccacacgagcatttgtgctaccagcacattccaggatatcgctggaagcatggatagcgtgggccaatatgagtctcacattgctttcacccttcctgatctgtaccgggttgtccatgggattgacgtgtttgatcctaagttcaacatcgtctcccctggagcagacatgactgtctacttcccgtacactgagactgacaagaggctcaccgccttccactctgaaattgaggagctcctgtacagcgatgttgagaacgatgaacacaagtttgtgttgaaggacaggaacaagccaatcatcttttcaatggctcgtcttgaccgtgtgaagaacatgactggcttggttgagatgtacggcaagaatgcacatctgaaggatttggcaaaccttgtgattgttgctggtgaccatggcaaggagtccaaggatagggaggagcaggccgagttcaagaggatgtacagtctcattgaggagtacaagctgaagggccatatccgttggatctccgctcagatgaaccgtgttcgcaatggagagctgtaccgctacatctgtgacaccccgtgctccgccacgccagcctcgctcctgtcgccccctcgccctgctctctcctccactcctcccctattgttttgtgtcgtgagccatggctgccaagctgactcgcctccacagcctcagggcagcgccttggtgccaccttctcctcccaccccaatgagctcattgcactcttttccaggtatgtccaccagggcaaaggcatgctccagcgccaccagctgcccgctgagtttgacgacctgtccgattccgacaaggagaagtatgcaccctttgaagacatcctccgtgctgcacaggaagcaattgttctacccccatgggttgcacttgccatccggcccaggcctggtgtctggggactacattcgggtgaatgttagtgaactcgctgttgaagagctgactgtttctgagtacttggcattcaaggaacagcttgttgatgagcatgccagcgcgcaagtttgtgtttgagcttgattttgagcctttcaacgcctcccttccgcgcccttccatgtcccagtcaatcggaaagggggctgcagttccttaaccgtcacctgtcttccaagtagttccaggacaagtagagcctctacccactgctcaacttcctgaaagaccataactacaaaggcacgacaaatgaatgttgaacgagagaattcagagccttcgtggcctccagtcagccctctaggaagggcagaagagtatctagtgagcattcctgaagaaaattccaaccctggattcaaaccacaggttcgaagaagtgtggcggagagaggggttggggtgaccgcgagatgcgcattgcacacctgatccttcttctgattcatcttcttgccgcccctcagacggccacttggacaaattccatggccaccattcctttgaacttcactgctcatgtccactgttctcaatggatcacattgctctaatcttaatcaggtcggtccgttgagttaccccgagaaccggatcgtggtgtgcaacttcgagtatcgacctgggttttggagaaagggaatgcttctgaggattaagcaacaaggccttgacataactcccaagatcctcattgttacccaggtggtggccgactggagtgggaacttctggtggcacgggcttggggacggtatttggaactcagaaccctgaatttctccgtgtctccatggaactcgtgataatgggatcctccataagtggatctcgcgttttgatgtctggcccgcacctggaagacatacaccgaggatgttgcaaacgaactcatgagggaaatgcagaccaagcctgatctcatcattggtaactacagtgatggtaacctttctggccactctgcttgcacatagattgcgaggtacccacgtgcaccattgcctatgccttacggagaaaaccaacttaccccaactaagtcatatattatgcacaaagttgacagccactactaattttcatgccaaagttgacatgctgacctgattgccacacaaccacactgatttcacagcaacctgcacactatgaggttttggccttgtatcattgagggcatggacatgtgtgtctgctgacatttccgacatccctcggtggccctgctgaatcattgtgaagggggtggctggtgtgtacattgatccttaccacatgtgacctggccgcagatatcttggttaactttcttgatacgtgcagcgagacaagaagctactggggacacaatgtctgaatggaggcctgaatgtgaattgatgagaagaacgccgagaagctgtactcatgagaggctgatgagccgtgacccatgtgtatggattcttggaattacgtgagcaacctcagagaggcgtgggactacgccgtcaccttgagatgttctacgcaaggaagtaccgcagctctggctgctgcagttccattggcggttgacggccacgaactccgacaactaggccggtgcactaggggatgaagagtcgcattcagcgggatgtgcggagggaccgctgccttaagatctatcttccgtggatctctgttcgtatggtagtggtgtgccttaatatgctgtgacaccaaagggtgcatttgtgcggcattcattccatgaagcgtttggcctgactgtcttttacggccatgacatgtgggttgccgacgatttgcgacatgccacggtggggcctgctgaaatcattgtgaacggggtgtctggtctgcacattgatccttaccacagcgacaaggccgcagatatcttggtcaacttctttgagaagtgcagcgaggatccaagctactgggacaaaatgtctgaaggaggcctgaagagaatttatgagaagtacacctggaagctgtactccgagaggctgatgaccctgaccggcgtgtatgggttctggaagtatgtgagcaacttggagaggcgtgagactcgccgttaccttgagatgttctacgccctgaagtaccgcagcctggctgctgcagttccattggcagttgacggcgagagctccgacaactagcgcggtgcaatggggcatgaagaggcgcattcagcgggagggtgaagtgtcggctgcgttatgatttgtctgtctaccgtagttttcatttggtctggtcgtggagtgtgtgcaatttgatgtctccggcacatttgtgaggtcctgggcagtgcttgctggttcttgccagcggcatttgttgttgcctctgaataaacgcctgcccatattgttcatctttcatcagagttcaatgcaatgtttcgtcttggaaaaaaaaaaaacacccactaccccggcccccgccttaacggcaaaanaccgcccgggacatcaacgctactctgctctcaacggccgttnaaacatggaacgcattcacttacacgctctcaacccggtaccaccaaaancattgatatggcataaggctttgatgccggcaacaccccattatggcttggccaacacatttactcacttaaaaccaagcgcatcgtaacncccataancggcatgactactctgccgaatgcaaaagggcattcggcaaacccaccgggtttacttaatcccgaaag

SEQ ID NO: 27170 - DNA, 489 bp, Triticum aestivum
  unsure (1)..(489): unsure at all n locations
  Clone ID: PAT_TA_27170
cttgattccgaagttagaagaggcaatgggctctaccgtgactagcgacgaggaggcatgcatgtacgcgctgcagctagcaacgtcgtctatcctgccgatgacgctaaagaacgccatcgaactgggcatgctcgagacccttgtgagtgccggcgggaaggccctatccccgtccgaggtggccgcgcagctgccatgcaaggccaacccagacgcgccggccatggtggaccgtatgctgcggctgctggccacgcacaaggtcgtgtcgtgcgagatggagaagggcgaggacggcctcctcgtccgccggtatagtccggctccggtgtgcaaatggctcaccgccaacgaggatggcgtctccatggcacccatgctcctcatggtccangacaaggtccttatggactgctggtatcatttgaaggatgtcatggttgacggcggtctcccatttaacaaggcacatgggacgagtctgtt

SEQ ID NO: 27171 - DNA, 157 bp, Triticum aestivum
  Clone ID: PAT_TA_27171
cggacgcgtgggctggatttggcccgtctcgatctgggtcaccatgattgagaatgtagatagacgtagtactgtttgacaacgaagatgcaaaaattgcagcaaaataagtggcagctatgtcgtggcattttcattagcactttagctatatgtc

SEQ ID NO: 27172 - DNA, 874 bp, Triticum aestivum
  Clone ID: PAT_TA_27172
aaacccctaactgccgatcctgaattgtgctgaggtatgtgaaggccatctccaccaccggccaccgcagagctgtgcctgcggcaaccctgctgtcatcctcgccaccgtgctgcttcttccccaacatctccttgccactagagacacaaaggtgcagccgtgggctacacaggggctgcatcgagatatcgccaagtacctgtatgtgaaggccatctccaccaccggccaccacagagctgtgcctgcggcaaccctgctgtcatcctcgccaccgtgctgcttcttccccaacatctcctcgccactggagacacaaaggtgcagccgtgggctacacaggggctgcatcgagatatcgccaagtacctgatcatgcacacggacacattacagaaagagtgaggccatcaagcaagattcttgatatgcatgcatgtggccatctatctactctagatccactgacgcgatctcgatcgatgagatgacttggagacgcagcaatggatggagttaccatcttgttcatggatcttgttctctgcctgcccacactggactcgttgcttgggcagaccacatcacatggacgccatgtgcaggtgcaggtgcagcacagcagagtgtatggggcacacgcacatccctaatctatcattaccaggagcactggaccaggctacagtttagtgctactaactgagcagttatccctgccactgcagtgttgagccatgagatagagattaggctgtcccacgtttgaccggtctgatctcaacttgctgacagattacatctgttggactggtcattatcatcttgttcttgtcgctaatgataaggatctggctgcctcctagtacat

SEQ ID NO: 27173 - DNA, 975 bp, Triticum aestivum
  Clone ID: PAT_TA_27173
tgggatctcataccaactactggcgggatcatgatactgctctcttcattatcaaacatttgtaccgtgatatacctgaagaacctccaactgatggaactggaagtgcacccattagactgttctatgtgagggatccaattgctgaagacactcccctgacattttcagaccactcctcagttaaggaattctccaggaaggtgaaaacttattcgaggaaagggggaggatgatgcaaactgtgaagcctcttgatggtgaccactgtatgttgcgacgtgatatcgtcttacgattttcacctagcagaagtgttccgccaagaagaaaaacccctagcagaagcgtgatgtacataaaagcacctggcatagagggacgcattgcacagttttggggaaaaaagggggatacattgctggtgtgcatcccttgtcactttggcaccacagatcagagtcagagcacacttgcgggtgaatggatgttgcacatagaattatggcccggcacatgctgtgtataacttgtttacccgtatctctagcagtaattttgtacgtacatatacagatataaaagggagagagagtgtaaaaaagagcgattagatttgagcggttgaacaccaggtggaaaaacagaggtgcattcagtggagcacgtccgatggcgattgcgccggcacgagcgagcagatgtgcattctcacctcatgtgtatagagtaaagagcttttgcccaatgtcaagttctccaaccggctgtaatacaaacatcaaaggaccggacgcgtgggcaccaacgccatctgtcgaagtctcaaggaaatacccaacccaatgtacacttgacttttgtcccctggcatcagttgaatgataatctctctcgcgtgtcatggaatactcggtcaagaaacagctgggcttgatttgtgataataataaacgttggttgatatggaacgaa

SEQ ID NO: 27174 - DNA, 318 bp, Triticum aestivum
  Clone ID: PAT_TA_27174
gagcttttatctgtgaagctcgtgtgccggaattgaacagaaagctttgcaagcacacgtcggacacaaacattccgtcatgtggtgcagatactaggttgtatagctgttgcagatacacttgacctgtaagaaatcacaaccatctgctgcacaaagcgttctactaagacttttttttggatccctggcatcctagaaaaagttatgctgcctgacaaaagtattggacggtgtggtgttgaaggtgtgtatatatataatcagtgacgtgtacgtgggtgtgggcaacctggcaatgtcatcatccaatccaac

SEQ ID NO: 27175 - DNA, 1036 bp, Triticum aestivum
  Clone ID: PAT_TA_27175
cggccgcgtgggatgctggagtggctgggccggccggccaaggcgtgccgcagcagccgacgccgccgctcagggtgtccatctccaagaagctgagggcggtggtggaggacaagtacaaccgcgcgggcgtggagaagggcaagtacgtcgtcatccacggcatagaatcggacgccgtcgccaacttccagacgacgactgcctcctccccctcgaactgtgggcagagatcgccaaggagatcagctctggaggcaatgggctgaggcctctgtttgtgatgccacatgagaagcacagggaagagatcgaggagattgtcggcgaggagacggcctacctgttcatcactactcctggacagcctcacctgcctcatcaatgattctgcgggcgttgtggcgaccaacaccgccgccgtccagctcgccaacgcccgtgacaagccatgcgtggcgctgttctcctccaaggcaaaggcgaggctgttcctgccgtacgcggaggagaggaagagctgcaccgttgtcgcgtcggcgacaggcaagctggccggcattgacatcgaggcggtgaagaaggccgtcaaggacttggagcccgctcctagcttcgcattggcacaaacataatcaattgcatcgtcttctttgggttgtacatagatatgaaaagccagctcatttgatccactacggggacgaggggtacggctgcatttctcgtttgattggtcacaggcagggtggaccgcaccgcctgcgtggccgtgaggccggccggccaggacttggggcccgctcctagcttacgcgttggcccaaacataatccaaagcatcgtcttcggtgtgttgtacatagatatgaaaatcgagctcatctgaccaacaaatgtgaccaagagttcggttttcttgtagttacttcagttcagcagacaatatatattggcgcaccgaggcgtattccgcgattgtaaatttgacttctctaaataagtggtcaatctaaatgtacgggacagttcacgc

SEQ ID NO: 27176 - DNA, 1822 bp, Triticum aestivum
  unsure (1)..(1822): unsure at all n locations
  Clone ID: PAT_TA_27176
gcacgaggggcgcttctccgtcgacgagggcggcggaggcggggaggacggggagaagcggggcgaggaggaggcggcagcgcccgtggaagccaaggtgggggccgcggaggagcggagccgctcgggcagcttctcctcctcgtcatctccgtcctctgcgactcctggtgtatcaagcgagcctcctcttttgagcttcagtgtggataatatcgatacagttaagttattggaactcctaggcccagaaaaggttgatcaagctgatgtcaaggctatcaaggaaaagttttttggctacacaacattctggttgacaagagaagaaccttttggtgatcttggggaaggagtcctttttgttgggaatctccgaggggacagagaggaaatctttggaaaacttcagcggcagctacgtgaacttacaggtgacaaatataatcttttcatggtggaggagcccaattcagaagaggatgacccacgcgggggaccacgtgttagttttggtttgctcagaagagaagtttctgagcctggacctactaccctgtggcaatacgttatttcgctgttacttttccttctcactgtgttctcctgtattgagctaggaattgcgtcaaagataagcagtcttccaccagacattgtttcatatttcactgatccaaatgctactggacccccacctgacatgcaacttttacttccatttgtggagtcagctctaccagtggcttatggcgtcttggctatccaactatttnatgaagttggacactttttggcagcatacccaaagaatgtnaaactgggcattcctttcttcattccgaactttactcttggaacttttggttcaattactcagttcaaatccattctaccagatcgaaagacaatgtttgacgtatcaatggctggtcctttggctggagctgcactttctttttcaatgttctctgtaggcttgtggctctcctcaaatcctgctggggcaactgatttggttcaagtacccagcaatctgttccagggttctttgttgcttggacttattagcagagcaatacttggttacagtgctttgcatgctgctacggtttctatccaccctctcgtgatcgctggctggtgtggtttgacaactactgccttcaatatgcttcctgttggatgtcttgacggtggaagaggtttacagggtgctttcggcaaggatgctttatttggatttggcttgacgacttattcgttgcttggacttggagtgcttggggggccgctatctcttccctggggtctatacgtgctactatgtcagagaacacctgagaagccatgcttggacgacgtgagcgacgtcggcacctggaggaggggcgccctgatagcttcggtgttcctcgtcgtgctgatcctcatccccctgtgggacgagctcgcggaggacctaggtgtaggacttgtcagctcgttctgagacacaaaaagtgttttaccggtagaaagctaggccatgatgcaggtcaattttgcgcccgaatttagcaaagcgatagcgaaattgttgtaagttcattcaccgcgggaggtgaaaaatacgagtttttactcctggggcgtgtgtatgcagagatttgcacagggacggggtcagtcagcagccattgaatttccccgtacggccggggcagaggcgctgccccgtccaggctgtagccattgtttgaaatcattgcccggtactccggttgcccagtccagtaatgtgctgtgagttggcccagggagcgttgtttgttgttgcgca

SEQ ID NO: 27177 - DNA, 923 bp, Triticum aestivum
  Clone ID: PAT_TA_27177
ccctcgccaccccaaccacccgcccccgcccccccgcccctcctccccggaaccctacccggaatggagccccactccaccacccctccgccgccgggccgcgtcctgggcgcccctgtcggccccgcgcggcgcgccgtccacccggctcgccccgcccccccgctacccgcacgcgccggccctctacgccccgcagccgccccccgccgccgtcgccgccgcgtcgcagcagaccgccccccagcagccccagcacctgcaggtcttctaggcggagcagtaccgcgacatggaggccaccaacgaccacgaggtccacgccctgccccgcgccatcttcaagaaggtcatgaaggccgacgactacgtccgcatgatcgccaccgaggcgcccgtcgtcttcgcccgggcctgcgagatgttcatcctcgagctcacccaccgcggctgggcgcacgccgaggagaacaagcgccgcacgctgcagaagtccgacatcgccgcggccatcgcgcgcaccgaggtcttcgacttcctggtggacatcgtgccgcgggacgaggccaaggacgccgaggcggccgtcgccgccgggatgccccaccccgccgccggcatgcccgccgccgacatggggtactactacgtcccgcagcagtaacgcctacagtatgttacagcggatttaagttgcatcttaagtttgtgctgttgatttagtgctctccaatgtttgtttgttcaccgctgaataatttaagatgttgtcatcatttgaggggcctcctctatgttataagtgattcgatctgagaagaatccggctaggttcttctgatcgaggcaggccgtatgatgctcatgcatgtctaactgataagataatttatctcgtggcatttctctgattacttttgttc

SEQ ID NO: 27178 - DNA, 690 bp, Triticum aestivum
  Clone ID: PAT_TA_27178
gcgggggagaacgtcaacgtcaatccatcaaccatttcagtagtccagatccagtaacacccgagcattgcgcattcgctatcgccctcaatcgtagccttaaataagtccttttatttcggcgtgcgacctttattaccattcatccagccttgacaacctgacaacctcaaccgctttcgcctccagcctcctttcaccatgtcgaaccctctcgataccgacgctggctctgagcttttcagctcttacgaagccgagtacaaactcatccaagccgatctgaaccagaaactcgatcaaatccccgaactggccggcgagcctcgaaaggctgccatcagccaagccgagcgggcgcttgaggaactcgatgaacagctcagcgcaatgcgcctggagaagcagaacatcccgaccagctcccgcaccaaagtcaaccaacgcttccgaaactacgaatcagacacagacgccgctcgtcgcaagttgaccaccctgtccttcgaccggtcagcgctttttggatcgcgatacacagacgaccccgctgggtcatcagatgtcaacatggagcagcgactacagttgctttccggctcggaccgtcttgatcgaagcacacagtgattgaagaccggccggccctggccctgggtcccgggctccgggccggcccctgccctgaat

SEQ ID NO: 27179 - DNA, 496 bp, Triticum aestivum
  Clone ID: PAT_TA_27179
ggtcgacccaggtgtccgcccccgcgtccgaccgaggccgagttcctcggcagcatcaccccaaagaccgagacgttcggcctcatggcgctcaccatgaacccgccggtgaagcccggagagccgctcatgggggagcggccagacacggagcagtggacgagcgagcagcgggcggccaaggcgctgctcgagttcaactcgaagctggacgcgatcgcggaggccgtcaagaagaggaacgctgacggcgcgctgcggaaccggaacgggcccgtggaggtgccctacacgctgctcgcgccgagggccgaccctacggtaccccacgtcggcgggattcccaacagcatcgccgtgtgagtccgtcggcgtcgtgtatgcagtatgatggatgtcaaaagtgtggacttgatcaataataataaataaataaaagagcgcccggatgatgattgggaagtcctttgataaataaaaagaacaagaatctgtg

SEQ ID NO: 27180 - DNA, 799 bp, Triticum aestivum
  Clone ID: PAT_TA_27180
cgccgacccctccaccaacacctccggggacgccccggccgacggcacggcggccgacgccgagggcgacggcgccgtcgcgggcgacaccgagctccagacgtggtgcagcgtggtgcgcaccgtggaccccggcgagctgcgcgacgcgccgcggtggccggcgatgcacagcgcgggcgacctggtggagacctgcgccaccatcatctggctcggctccgtctacccgtccgcggtcgccttcgggcagtgcgcctacaacggcttcgtccccaaccgccccagcgtcacctacggggagatgccggccggcgccggggcggccgtgaccgaggcggagttcctcggccacatcacccccaagaacgaggcgttcggcctcatggcggtcaccatgagcccgccggtgaagccgggggagccgctcatgggagagcggccggacaaggcaaggtagacgagcgagcagcgggcagccaaggcgctgctcgagttcaacgcgaagctggacgccgtcgcggaggccgtcaagaagcggaacgccgacggcgcgctgcggaaccggaacgggcccgtggaggtgccctacacgctcctcgcgccgagggccgaccctgcggtgccacacgtcggcggaattcccaacagcatcgccgtttgagcaccacgctgcgtccgtcggcgccatggatgcagtatgatggatgtcaaaagtgtggacttggtcaacaataaataaataaataaaagggcacggatgattgggaaaaaaaacaaaaaaaaaaaaataaaatct

SEQ ID NO: 27181 - DNA, 2039 bp, Triticum aestivum
  Clone ID: PAT_TA_27181
cagacgcgatcaccacgccagtagtgaacacctccgcctactggttcagtagctcgcaagagctgatcgatttcaaggaggggaggcatgctagcttcgaatacgggaggtatgggaacccgaccactgaggctttggagaagaagatgagtgcactggagaaagccgagtccactgtctttgtggcgtcaccccggcccgatccaccaaccccgacccctcaattccgtcgagcgccccgcgccgccacccaaaccctagctccccatggccaccgtctccttctcatccccggcgtccttcgccggcgacaacagcggtgcccttacctccgccaccatcctccgtttcccgcccaacttcgtccgccagctcagcaccaaggcccgccgcaactgtagcaacataggcatcgcggagagcctcgccgccgcttggtccgatcgccgggatgtatgcaagcgtcgctatgctcagcacacttgtcccagcaggtgggcacattgttacaaccacagatttgtaccgcaagacaagaatttacatggagactgagctccccaagaggggaattacgatgactgttattagacctgctgacatggatgctcttcaagatgcacttgataataataatgtatctttattcttcactgagactcctactaatccatttctcagatgcattgatattgagcttgtctccaatatgtgccataacaagggagcattgctatgcattgatagcacctttgcctccccggcctgccagcttgcactgactttaggtgctgacatagttgttcattctgcaacgaagtatattgctgggcacaatgatgttattggagcctctgtctgtggcgcggccgggctgtatgcaagtgtcgctatgctcagcacacttgttccagcaggtgggcacatcgttacaacctcagatatcctccgcagcatgaaaacactacttctccgtgttcagtgccagaatagtactgctctgcggatggcccggtttttagaggaacatccaaagattgcacgtgtatactatcctggcttgccaagtcaccctgaacatcacattgccaagagccaaatgactggctttggttggtgttgtcagctttgaggttgatggggacttcgaccctaccagaaaattgattgctcctgtgaagataccctaccatgccccttcatttgggggttgtgagagcataattgatcagcctgccatcatgtcctactgggattcgaaggagcagagagacatttatggaatcaaggacaacctgatcaggttcagcatcggagtcgaggattttgaggacttgaagaatgacattgttcaggccctcaacaagatctaagcgtcatatgcatcaccattacgggaatatatctgggcatatttgcctcaccattacgggaatctatctgggcatatttgcctcaccattacgggaatctatctgggcatatttcatgtggtgaactcttgatatttgatatgcttactgcgaataaattgttttatttgtttcctctttattggaggggaatgtattttctcttttttctgtcattgattatgtcaagataccctaccacgccccttcatttgggggttgtgagagcataattgatcagcctgccatcatgtcctactgggattcgaaggagcagagagacatctatggaatcaaggacaacctgatcaggttcagcatcggagtcgaggattttgaggacctgaagaatgacattgttcaggccctcaacaagatctaagcatcatatgcatcaccattacgggaatctatctgggcatatttgccttgagatcacgtggtgaactcttgatatttgatctgcttattactgcaaataaattgttttatttgttccctctttttttgaggggaatgtatttctgcttttttcttgcgatttcaataaagattgataaccatggctatcataggataaaaatgaagttaagtaattttattatatatataataacaggcaacaca

SEQ ID NO: 27182 - DNA, 1015 bp, Triticum aestivum
  Clone ID: PAT_TA_27182
cccatgttcgagtgggagcagcattgtgtgggccacctgcattatctttgggcgcaacctggttacaaagcccttgacatacatcagtgtctccccgagttcccgatcatgaccgtggatgacccggatgttctgtgctgcctgttaagggaagaggattatggcaagggctggatgatcatggttgacaaccatgcgcatctgcggtcatgtactcctgagtccgagtctctgggcgtggaagctcatgataaccggtttcctgatatccccctacttccaactgtcttctgcaaataccttgaaagcccaacaggggtggcttggattgagcataaaaagcgtaagcgtaagctgaagtctgcaaaggtaaaggcctggaatctggtgactggtgttgaacactttggcgacgctcaaatcaaagatgcgatgaagatggtgtactgatgaacatctattagagtaattgatacatgttctggatcatgtaatatgttttaagagtttaagtctgaggtaaaggcctggaatctggtgactggtgttgaacactttggcgacgctcaaatgaaagatgtgatgaagatggtgtattgatgaacatctattagagtaattgatacctgcatcatgtaatatgttttaagagtttaagtctgaggtaaaggcctggaatctggtgactggtgttggaacactttggtgatgctcaaatcaaagatgtgatgaagatggtgtactgatgagcatctattagagtaatcgatacatgttctggatcatgtaatatgtttaggagtttaagtttgagattgaacatcttttctttgggcgcagacatatatggaaatgaaattgagggcaacgcaaggaaagaagtagtgctaggcgttaattatgtatgacagacatatatggaaatgaaattgagggcaactcaaggaaaaaaaaaaaaaaaaaaatcaaaaaaaaaaacctgcccgggcggccgctcgaaatcactagtgaattc

SEQ ID NO: 27183 - DNA, 1098 bp, Triticum aestivum
  Clone ID: PAT_TA_27183
gcggtcttccgattgcagccaatggcgccaccggcgcggccatccaatgccacgcttcttgcgcggctcggggagggcacggccaggttcgagctcctcgaggaccccgcgcctgctcccgcgccgccggtttggccccgcctccactgcttcgccaggattggctcctcgctgaggggcgggtggtcggcggcgttgaacaaggtggagcactacggggtccagagagtcaccggcgatggccggtgcatgtttcgagccttggctaagggaatggcaaagaccaggggaattccattgaccccaagggaggaggtacaagatgcagacgacctacggctggcagtgaaagaggttatatgtgataaccaaaccgagcgtcaaaagtatgaagaggcgattatagctattacagtggatgaatctttgaaacgctactgccaaaggataaggcgacctgatttctggggtggagagtcagaactcttggttttgtctagactgtgtcggcaaccaatcattatttacattccggagcgtgagtaccgtggacggggcaacgggttcatcccaattgctgagtacggattggagtttaccaaagactcgaaagaggggaagaaacgggtgccggtgagactattatacagtgggaagaaccattatgatctgctgatataaaatgggcacatgagatgtgtcccgatgaagcatcagaataccggcagccaccgcccatctgtggcgcatacacaaattcccgtttactttccatggttacattcttcgatcctgctatgctcctgcttgtcagttacgatgctgtaacagctgtttcgtcgatgacagtcatgggcatttggggatttgtggatttggagctagaagaattagcactgacctgatgatagcgccacacgagctaactatgtgctgctgcatggtgcaatgctgttttggcagtggcagtgatttggttggcgtggtgccgtggagttgttgattgcgtttccggttggtgccgggcagaataatggtgcgttggtcgcactcgcactcggtggttgacgattggacttgcttcaaatccaatcatta

SEQ ID NO: 27184 - DNA, 979 bp, Triticum aestivum
  Clone ID: PAT_TA_27184
ggaaaagctaaggtacaaggaggcttcttcaatctttcatccatggactccctctccctgtacgagatctcctgcttcgccgccgggttcgccggcaacctcttcgccttcgctctcttcctctccccagtgccgaccttcaagaggatcctcaaggccaagtccacggagcagttcgacgggctcccctacctgctctccctgctcaactgcttcatctgcctctgggtatggcctcccctgggtctccgacggccggctgctcgtcgccaccgtcaacggcaccggcgccgcgttccagctcgcctacatttctctcttcttcatctacgccgacagcagaaagaccaggctgaggatggtagggctcctggttctcctggtctgcgcgttcgccctcgtcgcgcacgcgagcatcgctttctttgaccagccgactcggcagcagttcgtcggcgccgtgagcatggcgtcgctcatctccatgtttgcttccccactagccgtcatgggcgtggtgatcaggacggagtgcgtggagttcatgcccttctacctctcgctctctacgctgctcatgagcgcctctttcgcggtatacggactgctgctgcgtgatctcttcatctacctgcccaacgggcttggagttgtcctgggagcaacgcagttggcactctacgcttactacagcaggaaatggagatgcaaggattcatctgcgccgttgcttgcctgatcaaacctcaagtgatcaattctcagttttagcttggctagaaagggcgggtgtggggttctgtaggagagaattgtatgccccggccctgttttccccagttgatgctgaatcagtttgtacagatttgctggcctacgcctctgtttatatgttactcaagtatcattcttttcctgaagaatgcagagggggatattttgtttgattccccctttcttatgaaatgtttctccacac

SEQ ID NO: 27185 - DNA, 1425 bp, Triticum aestivum
  Clone ID: PAT_TA_27185
gccggcctaaccatatgggcgtcgtcttagagagacaaaaaggatcatggcagctcagaccgagaagatggccgtccccaccgacgctgagctgctcaaggcgcaggccgacctatggcgccacaccctgtgctacctcacgcccatggcgctccggtgcgcggtcgagctaggcatgcccacggtcaagcaggggctcggcgggatgctggtgacatcttccatgtcgtcccgcctgctcaagctgtgttgctcaaggtctgttctgcacttgtggagcgacgaggattgcatcaagatcttggcacaatgcaagaaggccattcctccccgagacgcaggaggaaaagtcattgtgatagatattatgcttagctcggcttcagggctgatgctggcaaacccatcacctggtggatatgttgaagctggtgatgaccagaggtcggcagcgggatgaaaaggactggagcgacatcttcatgaaagcaggattcagcgaatataagattttcaagaaagttggagctcgagctgtcattgaggtctacccgtaaggttgtgctcccaaatgctctaatatatgttgtgaactgttgtgtgctccaacggatatataaataatttggtgcattacaatctttggctgcgaggtctcgcggttcagaaaagaggaagactgttatggtcagttacaatatggtactcgtgcaactttcttttggacaagccatattcatcgactaagctccgactgaaggtgtggttaagtatgttgctggtgacatcttccacgtcgtcccacctgctcaagctgtgttgctcaagtctgtcctgcacttgtggagcgacgaggattgcatcaagatcttggcacaatgcaagaaggccattcctccccgaggcgcaggaggaaaagtcattgtgatagatattgtccttagctcggcttcggggctgatgctggaaacccatcacctggtggatatgttgaagctggtgatgacgagaggccggcagcgggatgaaaaggactggagcgacatcttcatgaaagcaggttttagcgaatataagatttccaagaaagttggagctcgagctgtcattgaggtctacccgtaaggttgtgctcccaaatgctctaatatatgttgtggattgttgtgtgctccaaggatatataaataattgagtgccttataattttccgaagggaggtctcgcgggtcataaaatagcaagactattatgttttgttaccttatgatactcgtgcaactttcttttggaaaagtattatatatgcactcatagtgcttttcatacgatacaatgtacaattgcctaccataagattatgttggaaatatgccctagaggcaataatattgtattatttatttttacttttaaaaaaaaaaa

SEQ ID NO: 27186 - DNA, 1006 bp, Triticum aestivum
  Clone ID: PAT_TA_27186
cggctcggcgcggaggatcgtcattttcttgcaccaccgaatttcatgggcacacatgactctttgaagagcccatatgcattagctttggtgcctctataagtagcaatagggtgcagggttgatgaaagaacatgcttgagtaccattcgggcaatatcagattttgaagtgcagagtgggcaaagcaaggcagagtgtaactggaccttaggactggtctgggaagtaaggggggatgacatcgtcagcaagacgacttaccttgtctcatttgatgacgatgatgcaaaatatttgcctctgcctaccaagctagtattgcagaagaaaaaagctaaagagggtagatctggggatgaaatcgagcatttcccagtgccttctagaattactgtgagcaggacatcacatggtgatgagatggagcacggagaatcatccagcatgcatggtaatttaaagcggcgaagatcttctgttgatgatgatcttgaggagcatcggaggcattctcgcgtagaagatacagagcagtacagtgaagacgattatgaatgatcaatagatatggaaggatcatcattttcttgcaccgccaaattcatcagcacacatgaatctttgaagatctcgtatgcatttgctctggcgcctccgtaagtagtaatagggtgcagggttgatgaaagaaccaacctgcttgagtgaagtcggccaatagcagattttgaagtgcaaggcacggtgtaactggacctaagactggtctcggaattgattgtagaaggtctcatcagcattgtaagaaaaggctatgtagtctctgggagtgattctccgttgctgttttgatgatataggccaatttatttatgtcaggattgtagacagttgtgttatggtaattattattttttcttgtggaaatgatgatcaacatatcgaaggtcgtgtatttgtgctacgaggaatgttaatgtgcgagttctgaagaaaaaaaaaa

SEQ ID NO: 27187 - DNA, 818 bp, Triticum aestivum
  unsure (1)..(818): unsure at all n locations
  Clone ID: PAT_TA_27187
nnagnnnnnannnnnnncactatttaaaatcttgtttgctctatcttgctgcttttccggaggatttcaacatatctgtgagggatcttattagtttgtggatagcagagggattcattccacatactccaaagcatacactagaagaaacggcgggcaattatgcaactgagttggctcaaagaagcttggtgcaagttgttcaaacaagcagcatacatggatggattgagaaaataaagattcatgatatcctacgtgactggtgtatagaagaagcagcacaagatggtttccttgatgttattgatgaaactactgcaggacaggttggagcatcatcgtctcatagcctgatatcctataggtgttcttttcaagactcaaatgagcagatcttacaggcatcacctaatctcagagcattttttggctttggactttcatcgtcagtaacttttcctgagctaaggttcttaagagttcttcatgttgagaactcgaggatagagaatttctcaaaggtaattggtgggtgcattcacctacgacacctgaggttgagaagatgtgcagacatggaggttccttcctcaatcaggaaactcatttatctgcaaactatagatctatcatatacagatgtatcaacaagctccctctgggatatacctactctaagatatgtacatcttcatagaatttctctgccaaggactgtgcaaattccacaaaccctacgagagcttcgtatgagggctaattattttgaaaaagaaaaagaccgatgccgatcctggagatgcttccttgtcttg

SEQ ID NO: 27188 - DNA, 546 bp, Triticum aestivum
  Clone ID: PAT_TA_27188
gcgggcccgggcgcgcgccgccgagctgcagcgccgcctgggaggagaactacggcaagcggcgccggctcaagcgggtggtggccgccacccgctcccggatccacgacacccgcgcgctcctccaggaccaccaggacccacacccgccgccgcagcagcagcagctccccgccgaatccgatcccacctcctaggtaggcctgaatcgagcctgctgatcaagccgattgatcgaagcgtaaacagtatctaacatcgtcctcttgattcgtctgcagggagtcgcggccgggtgatgtgacgtcctgctccgaagaccgatcggatcggcaggctgcgagcctacacagctactgatttcattcccctttcttcttgttttttcgcatcggaggaagctagctagtagcctggtagctagcctctgcaacatacgagcgagcgggacgaatgttccatggaacatcaatcaatcagaaaaaggcttgtcatgtcattcgcgtcgcatacagtgactggaatgaatcgcaagttattagcccc

SEQ ID NO: 27189 - DNA, 811 bp, Triticum aestivum
  Clone ID: PAT_TA_27189
cccacgcgtccgcccacgcgtccgcccacgcgtccgaaccaaagcccacttctttgcccccacttggccttcttctccttccccgcgaggcgaccgacgcggagggtaggaggatgtgcgaggggcggcgccccgggcacgcgagccggccgccgtgggcgctggcggcggagctgcggcggagggaggccgcggcggacgcgcggctggcggcggcgcgggcgcggctggccgaggcgctggcggagctggagcgggcccgggcgcgcgccgccgagctgcagcgccgcctggaggagaactacggcaagcggcgccggctcaagcgggtggtggccgccacccgctcccggatccacgacacccgcgcgctcctccaggaccaccaggacccacacccgccgccgcagcagcagcagctccccgccgaatccgatcccacctcctagggagtcgcggccgggtgatgtgacgtcctgctccgaagaccgatcggaatcggcaggctgcgagcctacacagctactgatttcattcccctttcttcttgttttttcgcatcggaggaagctagctagtagcctggtagctagcctctgcaacatacgagcgagcgggacgaatgttccatggaacatcaatcaatcagaaaaaggcttgtcatgtcattcgcgtcgcatacagtgactggaatgaatcgcaagttattagcacctggcagggactcactctgtaatacagtagtagtaataatgccttcagtgactgcacgcatacacgtcccaggctcttcagcccccgccgtcccaat

SEQ ID NO: 27190 - DNA, 651 bp, Triticum aestivum
  unsure (1)..(651): unsure at all n locations
  Clone ID: PAT_TA_27190
cccgtgagcgcttgantgagctgcantttgttgcaggctcagtntgtggtctgtcatgtngtntataatgtgactagcatgtcgcnggtantacgctatgctcggatttgttcagggatactcgttgnttgccatggtatgnttggattaggagctgttgcagcagagcagaggacccttcagacgcgccagaggaagtttcatctgatcaccgcagtgaatgaggccacgggattgacattcctttcctcctacctgcagctgaaagattggtgttcgtcacactgtaaatttgagcaattctctagcacttctgttttgactcctgtgttgtgctggatcacaagttatgaatctgtagatgcatgatgtccaacttggaaccacaagaggacccttcagacgcaccagaggaagttccatctgatcaccgcagtgaatgaggccgcgggatcgacactcctttcctcctacctgcagctgaaagattggtgttcgtcagattgtaaatttgagcaattctttagcacttctgttttgactccaatgttgtgctggatcacaagttgtgagtctgtagatgcatgatgtccaacttggaaccacaagaatttgtttccttttggatgattacagaatgcaaactgttag

SEQ ID NO: 27191 - DNA, 1181 bp, Triticum aestivum
  unsure (1)..(1181): unsure at all n locations
  Clone ID: PAT_TA_27191
cgccgcccggccgcgcctcgcgcgcgtacgcaccaccttgatcaagctgccctgggcgcatcatctccctgcggaagtgggggggtagcgaccgacaggccaggggacgcacgcacgtataccttgttacttacacacagcaagaagtgagcgaagatgtgcggcggtgcaatcctcgccgagctcataccgagcgcgccgcccagggagcgtcacggcggtccacctcttgcccaacgcggcccgagggtcgacgacttcgaggctgctttcaagcgcttcggacgaggactctgcggaggaggaggtgctccagcgcgcgggcttcgagtttggcgcccacgggcagccggcagcgaggcgcggtggcagtagtccggcacagtacaggggcgtccggcgccggccgtggggcaaatgggcggcagagatccgcgaccccgtcaagggcgtccgggtctggctcggcaccttcccctccgccgaggccgccgcgcacgcctacgacgacgccgcccgcgacttccgcggcgccagcgccaggctcaacttcccctcctcgtccacgagcgcacccaagtgccgcgtagccgagaaaccgacaccgttcgttgttattgacctcgacgacgacgaagagggtgatgccggagcagcggatgccggcgggataagctccgaatccagcggcgccctgccggacttctcgtggcagggcatgtccgcgtccgacgaggtcacggcgcaatctgtccatgctgaagtggagtccggccagtccgtcgtcgacctgggcagcgccaagaagcggcccggatcgaagccgccgaggttcggccggcagcgtccgacgactccgccaaccaactgttagatcctttcttgttcgatgacgaactcggtttcttgggacagcagctccgtacgagtggctggatggctgttcggcgccgatgctgagaagttcgacggcatcacctggggtctggcgctttggcgacatgactgtctcgccgaggaaacgcgtgcttccctatagcgtccattattgtntaacatcaaagacaacagntagntaggcactcgcaagtgttgacgcctccaaaccttgttttctttnggatacccacacttgttatatanncttacaagaataaaaacacctgttatgatgtaaaaaa

SEQ ID NO: 27192 - DNA, 585 bp, Triticum aestivum
  Clone ID: PAT_TA_27192
atcatttttgttttgttagaacaatttttgagtttgctggagccggtgttattttttgctacaaggggctaattgttttgctccaacagattactggagtatttgttttgcttttgttgctgattttatttttgctacaatcggcatggggaaagcttcaacctcgaaaaaaaaagcttcaaccagagaggatggggaaaagcttggactggcatggaaaaaagcttcagtccgacgcgcgcgagtgcgtgatgccagcgagctgcggtcggcggggcaggttgatgttgcgacaagcatgctatgaaggaggcgattagttgctgcaacggcagaggcatccgatgtgctatgagacagccctctttctgcatgatggcggctggttgcagcgacgacgcccgttggatccggcgaggccgagtgctgcgaggacggcgagccggcgtggcttcaaagtcagcggcaggggcggccatggcaggctgcgtgagtgaggcgggatgtgctggagattttcgtttttcttttttttccgcatgatgtatcagaggaggatgaagaaagggggccagatctgacggt

SEQ ID NO: 27193 - DNA, 1406 bp, Triticum aestivum
  unsure (1)..(1406): unsure at all n locations
  Clone ID: PAT_TA_27193
gttttttttttttttggtcgaacaaggcttccctacttttcattacttatcataatggaaatacaacagttttgcaaaacatacatagggtgcgggacgggaaagggaaaaagcaacttccagtattaccagaaaacccactgcgcgcacccgcaatcggctcgtgcactacggggcgaaaacctggtaaagtgtttcgtatatgcatacacgtactagtgattcatagaaataaactagtaggagtagttgttcatattgatctcaggattcacggtctttgctagctccacatataatggcgatcgttccatgaatcctctacgacgaactgatggcatatgcatgcctgatcatgcatacgtagatgcagaggtcgatcatgatctactgggcaaaaggaactggaaaaaataatgcaagaaaatcaggagaaaacaagctaggaaaatagccttgcacaaccttaaggcacggggagctggcatgctacccctttttacatgctccaattttcgatgaatctcactttcccaggccatattatagagtttagacaggcacatatttgatgttcccttacaagttggtcctaacttacagtggtttttgtacaccttgctgcgtgctgaagatcgaggcattagaatcaagcagggcaattagttgctgatcttagtggcggcgtggctttagctaggcgttagtacaagcattcaccttacctgatatttattcttgtcgaaacatagattgacctcataagctctccagaaagtttatccctatgttttgtagacagatctatgaaatacaatggagagcttggatactgtcctctaacaggtacaccctgagtaatacatccttgttctacagggtgtttaccaccgcactgctgttactgtaaaaaaaaaatgtcgatcgatcgatgaatcctctacgaggaactgatggcatacgcaaggcctgatcatggatacatatatagatggataggtcgatcaggaggatgccctgccgacatactcgacgtcgaagaggagcgtggagttgggcgggatgacgcaggaggtgggctcccaccccctgcacccggcccccttctccccgtaggccagctccggcggcagcctcaggctccgcttcccaccgactctcatcggcgggatcccctcgccgccggcgatgcacaggtcccaccccttgatcacctcccccacgcccaccatgatggtcagcggcctcccgcggccgtagctgctgtcgaacaccgtgccgtcctccagcatcccccggtagtgcgccttgatgagctggcctttgacggcctcggcgccggtgccgacgacgcggtcgcagaaggcgaggccggagggggtcgcctcgagagcgcactctnctgc

SEQ ID NO: 27194 - DNA, 1509 bp, Triticum aestivum
  Clone ID: PAT_TA_27194
gctcgacgacaacaggcaatcgacacctcggataaagtcaatcatcagctcagcctcagcctcatcccgttgcgcgtgcgtgcgtgcgtgttgcctcgctcctgtgattgggttttgagagtttcttggctgtgcttgagaatggacggcgctccggtggccgagttccggccgacgatgacgcacggcggccgcttcctcctctacaacatattcggcaaccagttcgagatcacggccaagtaccagccgccgatcatgcccatcggccgcggcgcctacgggatcgtctgctcggtgatgaacttcgagacgagggagatggtggcaatcaagaagatcgccaacgccttcgacaacaacatggacgccaagcgcacgctccgggagatcaagctcctcaggcacctcgaccacgagaacatagtaggcctccgagatgtgatcccgccggcgatcccgcagtccttcaacgacgtctacatcgccactgagctcatggacacggacctccaccacatcatccgctccaaccaagaactctcggaagaacactgccagtacttcctgtaccagctgctgcgcggcctcaagtacatccactcggcgaacgtgatccaccgcgacctcaagccgagcaacctgctgctgaacgccaactgtgacctcaagatctgcgacttcggcctggcgcggccgtcatcggagagcgacatgatgacggagtacgtggtcacgcggtggtaccgggccccggagctgctgctcaactccaccgactactccgcggccatcgacgtctggtccgtcggctgcatcttcatggagctcatcaaccgcgcgccgctcttcccggggagggaccacatgcaccagatgcggctcatcacggaggtgatcggcacccccaccgacgacgacctgggattcatccggaacgaggacgccaggaggtacatgaggcacctgccgcagttccctcgccggtccttcccgggccagttccccaaggtgcagcccgccgcgctggacctcatcgagaggatgctcacctttaacccgctgcagaggatcacagttgaagaggcgctggagcacccttacctagagcggcttcacgacgtcgccgacgagcccatctgcacggaccccttctcctttgacttcgagcagcaccctctgacggaagaccagatgaagcaactcatattcaacgaagccctggagttgaaccccaacttccgatactagatgattcattcctagttacccaacccccaacagtatgatttcggtataaaactgtctgtaaataggagtaagatcaaagaacatggtagattgcgcactgcatttgtttgtttattctgtgtaagttgttgctgcttcttcaaacctttgtccctcagctgtgcgaataaaaagtttggagcatgatttgagggcaaatcattctctagtttatgaagaaatggtttttattaaaaaaaaaaaaaaaaaaggccccta

SEQ ID NO: 27195 - DNA, 1323 bp, Triticum aestivum
  Clone ID: PAT_TA_27195
acttgggtgacgaaacctctatacaatataaaatatctactattcacacagaaatctgtatccaaattcagcccatgagtcgctaaacaaaaaggacaaacataccggtttccaccgaatatcggtatccgtatgatattctcccatttttaagcctgagcgcatagcttggataaggcacatagtactatgctcgattgtttgcgagtcgtttccaaatcccgcgacaatgacaactctgcacctatgtatgtactggaccgctactgcccttgtatggaattccactacagtgtatataaattaaaatgcactgcactctgtgcttcagcgtgccactagttcgattcagcagctgcaaatagttgcttccatttctcctggtagctcccttccccttcgcccttcaccgtacttgcaacgtctctttttccttgggttgtttcagtatccaaagcttctatacatgcttctgccaccaccaatctgctcgcttatcccacatgcttgtcaccttgacagcattctgtccttcatgagtgccattccttttgcccggcattggcacaacagtcaatgcttcacccttagaaagaacaaccctagtaggaccttgggaggccgaatatgaccccaggagttatgttgtgctggggcagaaaggcctttccatccaagtcttgttgtgcagatgaactctttccgagataatgtttgaaggtgttgtccaaactcgcaatgtgccaattcaatctatgcaccggccgcggctcggcacccactcactttcggtccccaccccatgcgccacgttccgggctctcttccccatcccagcgttttgatggaaatgctgtagtcccagtagtacataccacatgtgtaactccctcaaacatttctggattcaaactgtcaacatttctcgtgtccgcttcacaaacctgcaaaacactctcatcctgcttgccaaataagaacgctgccttttcagggtttcttaggagcagccttgtcttaattttcctgctcagcaaagatgctaccagcaattgacctacgccgccggttccgccgacgacgaggaccagcctcgaggaggcatcggccttttcctgctgcgcggtcctgggctccactgccgccgcgagccgccacccacctcgacccgacgcggcaagtctcgaggacaagggaagcgagcaagaccgcagcaccgctgtgccgcctggctgcgcgaagatgggcggctggccgtgtttggaggttaggtggcgcgacgatgagaccgcgagcgccgggctgaggtgagccgtcgccatt

SEQ ID NO: 27196 - DNA, 1265 bp, Triticum aestivum
  Clone ID: PAT_TA_27196
ccatggcgctccgcacgttggccgcgaagaaaaccctaggcctggcgctcggcggcgccaggggcgtggcgacgttcacgctccccgacctcccctacgactacggtgcgctggagccggccgtctccggcgagatcatgcgcctgcaccaccagaagcaccacgccacctacgtcgcccactacaacaaggcgctcgagcagctcgacgccgccgtcagcaagggggacgcgtccgccgtcgtccacctccagagcgccatcaagttcaacggcggcggtcatgttaaccattccatcttctggaagaacctcaagcctattagcgagggtggtggtgaggcacctcatggcaaacttggctgggccattgatgaggattttggttctattgagaaacttataaagaagatgaatgcagagggtgctgctttacaaggatctggatgggtgtggctagctttggataaagaggccaaaaggctttcagttgaaactactcctaatcaggaccctcttgtgaccaaagggtcaaacctgcatcctttgttgggaattgatgtctgggagcatgcgtactacctgcagtacaagaacgtgaggccggactacctgaccaacatctggaaggtggtgaactggaaatacgctggagaagagtatgaaaaagtgcttgcgtgatttgtctgatgagtagacagacagtacttctcgccctcttgagttccgctgttggatctgtacatgcagtaataaaagtgggcactattccactgtcgggattcgtctgtacattgcatagaggtggactactgtctaatgcgcacaacagtgcccgtccgttttggtacttgttactgtgcctgcgtggcctataaactcattcgctagtgctgttgctgcgtgatttgtctgatgagtagacaggctcgctcttgagtttcccgctgttggatctttgtatatgcagtaataaaagtgggcactattccactgtcgggaccttctgtacattgcatagaggtgacactactgtctaaagcgcactagtgcatgtccattttggtacttgttactgtgcctgcgttgctaataaactcattcgctagtgctgtttcagtccttgtgtgcacgtattagtatgtgtgggtgataatctgccgagattttgatgttatgttaacgtttgcgtgcatggactaagcacaccaagcatgcttttactggtttgggtgtgtagtaaaaaaaaaaaaaaaaaaactcgag

SEQ ID NO: 27197 - DNA, 802 bp, Triticum aestivum
  Clone ID: PAT_TA_27197
ccctaaaatagctctggacctttgggtcaagttgtgacacagtgtacaaataaagaaaaatagattggtgcttctttcagaaaagagtactccctagaaaactgccaatataagctactagtatttggttagatgatttgctgccgagaaagatccgtccacagagagcgccacacatcccactggtggtggtggatgccaatgcatgcatgcagcatggttggtatcggtaatttttacttggcacacctcgcactctgcatatatgtcggttccatacgtacatttgtgcagttccaccaaaatgcagctgaataacccgtgcgtcgcaaggatggaggccgggggtgcttagactgggatgttgaagctggtgctttcagtcaccaacatggatgattcaattcatgggaccttttggtgcagttcacctaaaatgaagcaatgtcccgtgagctagcagcttcttcttcaattttttaagaaaagggctccagccccggttccatttccatcagaaaacgaaacccacagagcttcttcttcattagttgcaataaaattgagcaacatcaaggttggttgtgaagctcctggaatgctcaactataatttggatatcatttgtgcagtacaactaagatcgagcgtgaaatgtatatctctttgagatgaaaaatgtgccattgattcatattactggaggcattacattgaaaacaacattggtttaacgtgtccttacttttaacagtgcgactgctacatttttacagtggcattacataagagtggctcgggg

SEQ ID NO: 27198 - DNA, 783 bp, Triticum aestivum
  unsure (1)..(783): unsure at all n locations
  Clone ID: PAT_TA_27198
gcagtatattatgaaatactctcttctttttaaaataagtgccgctgacctagtacaactttagtataaaatagtactaagtacacttatcttaaaactgtatgagtacgtggagtaatttacaaattgtatatagggaaattagctttaatctcagtatatgaacacgtaatgtaagtataaaattatagggaaattaattatattgtgaagcatttttcacaacaaatataatgtacaatttctacctagcaagtagtagtagtatatgctgccttgcagcagtatcaattagtcaccacaccctcctctttccgacgagctgctgcacctcctcccacagcccgcccccgatgccggtgagcccgtgctccccggggctcccggagaacacacgccacgaaccagcgcgcacgcagtcgcgcgaccccgcgcttaaccagctccagcgcgcatcgagacgctctcccgcgtgcagtagtgcacgcccggcatcacctccctcgaacagccccgtccggcccatcacgttgccgccgtccccgcccgggacctccgcctggacaagcaccgtgaggccatccccccgcccccggcgaattgccacgggcggccggaccgcgcgccggggcgtccgccatcccccctacgggggaccggccgctccgacttaacncttgagaaatcccttcncactgggtatacaaaagcccaccgntgccttcaaaantgcacnaagnnatgaccccntacgggataacccgggttgngtnaccnactacg

SEQ ID NO: 27199 - DNA, 507 bp, Triticum aestivum
  Clone ID: PAT_TA_27199
ggggatcaacaagtaccaggatcccataaacaaccttaatacacttcttaagatatgtagtagcttgtggtcaatcacccgcgttccctttttactctacaaaaatgaaagaaaaaactatgtacaccaaaagtgacaagttttcaccattttggcgccaaagaagaaacagctcgatcccgtatgaagaagaaacaccgcttagttagcagccacatcctatgatcttatcccactttacagccagccaccaaattctcatattgtcagccgagggagctgatcctggccatctcatcaaggccccaacacgatgttacattgggtgacaatgtcgtcgaaggtacaaggagaccgatttttctctgcggtaaatcagactccatacaggggtagagctactcggacgaaggagtaacaaagcgcccctgtgaagacatagctgtcgacccggtcaagaataccaccatggccaggaatgagcgacccagagtcccctcgtgccga

SEQ ID NO: 27200 - DNA, 558 bp, Triticum aestivum
  Clone ID: PAT_TA_27200
cccatcgtctccatgttgcagacatcacctttgacctttcttttctttcctctagctagctcgccggatcgcccctgccccccgtttgtcacctctgcttgcaccttcgcccctggggttcggggcctgctcggtgctaccgccagatcaagaacaagccgtaccccaagtcgcggtactgccgcggggtgccggaccccaagatccgcatcttcgacgtggggcagaagaagcggggcgtggacgagttcccgctgtgcgtgcacctggtgagctgggagaaggagaacgtgacgagcgaggccctggaggcggcccggatcgcctgcaacaagtacatggccaagcacgccggcaaggacgccttccacctccacgtgcgcgcgcacccctaccacgtcctccgcatcaacaagatgctctcctgcgccggcgccgaccggctgcagaccggcatgcgcggcgccttcggcaagcccaccgggatgtgcgcgcgggtgcacatcggccaggtgctgctctcggtgcgctgccgcgacgcgcacgcggcccacgcgc

SEQ ID NO: 27201 - DNA, 2899 bp, Triticum aestivum
  unsure (1)..(2899): unsure at all n locations
  Clone ID: PAT_TA_27201
aacggacagaggtttcttgagaagcagctcagatgtaggtgcgagaccctctggtgactcccttgtggaaaggacaaaaaccggtgaacatatttcaaactaaacacttttaaataagtcgctgtctttcccggatacaacaaatcctggaacaactgtgatccagcctggcgcacaaagttattatggtacgcagaatcctcaggcagcttttgcaagccaacaatctctcattgaaagttggaatgcatcctcaagagattttggtgctgcagtaaatcctatggcacttcctcagccaaccataggaggaggcttttcagggcaggatactgcggttgcaggaaatgtaggtcagctgactcctgtaccagctcctgcaacagtgggcacagaaatagttaattcgcagtcttcagatcgtggagtagctcagcccggagctgcgccatcaaacactcagccaggtgaagatgaaaggtcccaatcaaccgacagctactacacgaatcggctgttgacacatgcacatgtcgcatattcatgtgcgcgcgctcggtaggctgcatatacgagagcttagatccacacttcagagtaatgcaaacatggcctggggaatgatgggacagactaatatgaacatgccctgggcggcaccagcacaaggtgccgccagctacaacatggtgtatgaccatgccaacacagcaaaatgcagtccaaaacatgggctgggtcacaccaaatccaggaaacaccaacatgaatatggtgtgggctacaaatcaaggccaagggactccaaatgcagctgctatgatgggagctcagatgcaaggagttgcgatggcaccttggggcggtgccattgcgcaaggaaatgcaaattcttatcctggttgggtgccccaagttggaaacgcaagtcaaaatgccggcggctggagtgctcctcaccagggaaattcaggtcctaaccctgtaaatggtacagacaaggggaataataacgtgaactggaattcaccaagtgggaacccgacatggaacaaccagcaggattttaatggtggtatgtcgcgtgggagatatggcagtacatggaccccggtaataaaatccaaggccccctgccatctcttccagaagactggtcgctgcaacaaagacaattgcttctattcccatacgccaggagacgagggatattcacagagaaacgatcgccactttgataggcggccttcgagcaacgagagacctcagcatgacaggcggccttcgagcaacgagagacctcagcatgacaggcggccttcgagcaacgagagacctcagcatgacaggcaaaacgataaacattttgatcgtcaagcgtccaggcagcgagaggcagcaaggatcagcccaacagcaggcagagcggctggggatggctgggaataacggatggaaggctgatcagtctggcgcacaagagtattatggtacgcaggaatcctcaggcatcctgttgcatgcccaacaatttctctctttgcaaaagttggcctgcgtcatccctcaacttcagttctgatgccttgaagcaattaccatcctgcccactctgcccagtcctaaaacatttgtagcttaaagcatcatctgcatcctacccttgtcttttcttgctggccttggaaccaatctaacacctcctgcaacagatgggcactgaaattgttcaattcgcagtcttctgggtgaagatcgtggactaggtcagcccggcacctgcgccatcaaacacgtcagcaatttggagatgcaaggaaccaatcaaccgatgcctccaactcgacacagctgatgacacatgcacaagtggcaaacacatctggccaagctcagggggctggaaatacgaactggggatccgcacttcagagtaatgcaaacatggcctggggagtgatgggacaggctaatatgaacatgccctgggcagcaccagcacaaggtgccgccagctacaacatgggtatgactatgccaacacagcaaaatgcagtccaaaacatgggctgggtcacaccaaatccaggaaacaccaacatgaatatggtgtgggctacaaatcaaggccaagggactccaaatgcagctgctatgatgggagctcagatgcaaggagttgcgatggccccttggggcggtgccattgcgcaaggaaatgcaaattcttatcctggttgggtgccccaagttggaaacgcaagtcaaaatgccggcggctggagtgctcctccgcagggaaattcaggtcctaaccctgtaaatggcacaggccaggggaataataacgtgaactggaattcaccaagtgggaacccgacatggaacaaccagcgggattttaatggtggtggctcgcgtgggaggtcatggaggcctcagtctgggggtcgggggtcacggccgccgtgccatgtcttccagaggtctggtcgctgcaacaaagagcattgctcctattcccatacgccaggagacgagggatattcacagagaaacgatcgccactttgataggcggccttcgagcaacgaagagacctcagcatgacaggcggccttcgagcaacgagagacctcagcatgacangcaaaacgataaacattttgatcgtcaagtgtcaagcancgagaagcancaagataggccaacagcaagcaaancggctgggatggctgggataacgtgggaaggctgatagtcaaaatcaaaagangggaatnnaacatgggggctctcttccngtccttctcnttttgttgttcaatactacctggtgttctaactactactatcctttncattacacctgcaaattattnataaaatntctaacaca

SEQ ID NO: 27202 - DNA, 879 bp, Triticum aestivum
  Clone ID: PAT_TA_27202
aaagcgcaataaatagatcctcttttttttccgagttgcaaaataaatagatatatgtgatgtgtagcatcaacgaaccttgagccaagaatatcattgccggtacaatccggcccagtttctgtgactttccctcctggtgatcccccaagtgataattcatcaacaagaaagaaaatctgaagttacagcagaacggagagcctagctcaaaaatcggtaaataaaaaacagcacactggtagcagagaatggctttggagaggcgtaattcagctagctccgttcttggcgcgcaccctggcgattcaggtgatcatccctctacttggatgaggccaaggccttgcggaccctggagctcaccctgatcttcccctttgtctgctgcgccttgtccccagccttcgcgtccgctgccggccttccagccatgactgccggcggtggcaccggtaccgggatcccccctgccgccttctcggcaaccttgctcctggttgcagcgacggtaggagtgctcccgaggacctgcccaggcttgccacctcccttggcagcagccggtttctggggcgccgctggcacgatcgccggtgtcgccgtaggtgcgggagctttgcctgctggagacggcgccggtgcacgtgccggcaatacaaccggtggcggtgcaccaccgtgcgtcgtggcaggcgctcccccgggtacgccggtagcggcagctccgccgtcgtggggttggcccgtgaggcggcgaagaggcccgaagaccggccgggcgtggaaggctctctgaagcctgctacagatggtagtcggcgacttgccgtcggcggccggctccttgttgttcatctgcatcactgctgtacgaag

SEQ ID NO: 27203 - DNA, 569 bp, Triticum aestivum
  unsure (1)..(569): unsure at all n locations
  Clone ID: PAT_TA_27203
ttccccntntcctcagngnatcggccgttgcgagagtncggcggtagcaatnccgcaagccttccacaggggtgccttgaccnctgatggagnacgaccagcgcacntgcccgntctgccgcgccccgctcatccccgacgagatgnccggcgcgctctgggccaccgccgccggcgtgcccgacgcctccgacttcgacttcttctacctgggcgcctcgggcgccccggccaccccgacgctgcttgcggccgcacgagctgctgctcaccggcctcggcggctaccagtgagcccccgattcggtccaggcaactggccgccgccgtccagaatgcgcaattttacaggactgaattggtctccgcgtccggacgccggcgagctgcctggcccaggccgtgtacatagggcgaaatgagtaaagtaaccgccccgaaaagggctaggagattagattcttgttatgtatagctagattccatcttccaagtttgcggagctgtggatctttctgctggcaaaaaaaaaacccacgcgtccgcccacgcgtccgcccacgcgtccg

SEQ ID NO: 27204 - DNA, 1194 bp, Triticum aestivum
  unsure (1)..(1194): unsure at all n locations
  Clone ID: PAT_TA_27204
nnttttnnnnnnnnnntgtggaacaatcattaataagttcctcctcattacacacatttattgtatcagattctttcctataaacaagtaaagaaaagaatcaaagaaaaacaagactgctactgcattctacacaaaggcatcaatataatggtacaatgcaatttccctttccttcccaatgttttgcacgacaatgcgccgtgatgttgatcatcatcacggcaagacaccgatgaaaatcaggccgagctccactggctggccttctcgaagccgttgcggccgtagtaatagtcctccatggcctgctggatctgggcacgcgagttcatgacgaatggaccctgctgcaccactggctcgttcagcggctgccccgccgccagcgcgaaccgcagcggtgcgccagaccgattccacacgctgagcccgtcccccgcgccaagcacgaggcagtggtgcgcgctcgccggcgctgcaccctccttaccgaacacgccctccccctcgatgatgtacacgaaggcgttccagccctcagggattggctggtggagctgcgaccctggttgcattgtgaagtccatgtacatggtcggcgtccgcgtgtagaccggtgaccgcaccccgaaggcctccccagcgatgattcgcaccgccacgccgtccttctcggcctggctgatgtccttgctctcgagctcctggtaccggggctcgatcatcttgtccttggaggcgaggttgatccagagctgcaggcccttctgcactccgtcggccgcaggcatctccgagtgcacgatgccgcgccccgccgtcatccactgcacatctccggtcctgatggtgccagtgtgtccggagaagtcctggtgggtgaacaccccgtcgagcatgtaggtgacggtctcgaagccccggtgcgggtggtcggggaagccggcgggcttggagacggagaactcgtcgagcaggaggaacgggtcccaggttccggacctcgtgcccgccgatgctccggcggacggtggccccctgcccctcggactggacaaggacagcaccttcttgccccccttcctcgggctatggcacggcacggacgcacccgtcccccccgaggaggaagaggaagacatgatcgttctagcagagctggagctcgtgttctggaggcgaggagcaccc

SEQ ID NO: 27205 - DNA, 713 bp, Triticum aestivum
  Clone ID: PAT_TA_27205
ttttgattgttctactttgatacacggatttctctcgagctaaaccgtttatcacttcgttttcctatcacacgcggttggtgtgctgattcagacgaatgcgaagtggagatacaaagttcactacggtaaccagacaacttccaagcaagatagcgtgtttgattgccaaagttgtcgctcacgcggttggcctgctgctgctggcgcttccgcggggggctctctccggtcactgcggcgacctccggctcgcccggctgcggtcgctcgctccctttgccagccgccgcctgcgcttctgcgtcttgctcgctcctggcaccgcgtccaacctcggcccttcccgcttccgggcccctcgccctgctgccgcctcctgctgtgcctctgcgccgttctgcccgcttgctcgtgtcccaagccccagattgtgcagcctcagccgcctgagtggccccgggcctggaggtgatgcggtctgctgatttccccctttgttcgagtctgaaggcgccttgcacccgtgcctcatttgcaccaggagccccctgcgctgctggctttgcgctcttcccaggcacccttggcccccaggcactgtcgggttctgggttttccaggggaggtgcaaagtccacctcacagtctgtctcaataatgctaactgcagaagcaggttttgcttcaacaatatcaatataatactgttt

SEQ ID NO: 27206 - DNA, 865 bp, Triticum aestivum
  Clone ID: PAT_TA_27206
gatcgcgtcttggcctacaaccacaatccctgtcttgtctccaaaaaaaaaaccacaatccctgtcctctcctccgccatcgccaccgccacctcctcccgttcttctccggccgccgcctcagacttggtgcccgcgtgctgccacccgcaggagccgcagatggcgtcttcgacgtccaccctagagatcgaggctcgcgacgtggtgaagataatgctgcagttctgcaaggaaaactcgcttcatcagacgttccagaccctgcagaacgagtgccaggtctcgctcaacacggtggacagcatggacaccttcatcgccgacattaatgctgggcgctgggatgccgtgctgccgcaggttgcccagctgaagctgccgcgcaagaagcttgaggacctctacgagcagattgtgctggagatggcagagctccgtgagcttgacacggcccgtgcaatccttcgccagacacaggtgatgggggtcatgaaacaggaggaacccgaacgatacctccgactagagcacctccttgtccggacatactttgacccgaatgaggcttaccaagaatctaccaaggaaaagcgacgtgcgcagattgcccaagcaatcgcttctgaagtttcagtagtcccaccagctcggctaatggcactgattacccaggctttgaaatggcaacagcaccaaggtttgttaccccctggcacacagtttgatttgttcagaggaaccgtgcaatgaagcaagacgaagaagagggatatctactactttgtccctcaataaggttatcttgtgggctgtatcagcgagcttacatggttttcatgttcccgccggatttgggaactgg

SEQ ID NO: 27207 - DNA, 588 bp, Triticum aestivum
  Clone ID: PAT_TA_27207
tcgacccacgcgtccggacctcctctcctcccccccgtccggccccctccgccatggccgccgggacggccgccgccgagatcgccgcgctgccggagccacgcggcccgctgcgccgcctctgcggcgacctctcccgccgcgtccgcctcctccccccgctcctcgacgacccctccgcctccgcctcgcccccgctcgccgacgccctccgcgccgcccgcgacctcctccactccgtccaccacggcagcaagatctaccaggccatgcgaggccgggacagcctcctccgcgaattcgccgccgtcaacgagcagatccaggccgcgctcgaccagctgccctaccacgacttcgacatgccagaggaggtgcaggagcaggtggcgctggtgcactcgcagttcaagcgggcggcgacgagggcggagccggccgacgcgcagctcgccagggacctcgcctgggcgctcagcgacgacaagcccaccgtgccggccctcctcatgagggtctcggagaagctgcagcccgagaccatggccgatggaacatgaaaccgccgagaccccggggggggcctgc

SEQ ID NO: 27208 - DNA, 644 bp, Triticum aestivum
  Clone ID: PAT_TA_27208
ctagctagaatgcggacgagggagagatcggccacaactcatccgttccatccatagatcgtagccggtgcacattcccggccggaagctagcacgcactctttcctgcccaacgacgtacctcgtgacgccgcgcaagcggtcatgggcaactgctgtgttgcccggccatctttcaagcggcgtggcggtggctctcccaggcaacgcggcggacgcctaggaggcgccaacctccggtgcctctccacggtgtcctcagtcactgacaccccgcgtgccacggcccagccgcctgtaaccgtgcttggcaagggcctggccgcggccgacaacaccgaggagctcctccggcggtaccagcttggcgaggagctggggcgcggcgagtttggggtgacgcgacggtgcatggacgcggcaacgggagagaagctcgcgtgcaagtcgatcagcaagcggaagctccggagcagcgtcgacatcgaggacgtgcggcgcgaggtagccatcatgcggtcgctgccctcgcatgtaaacgtcgtgcggctccgtgaggcgttcgaggacggcgactccgtgcacctggtcatggaggtgtgcgaggggggcgagctcttcgaccgcatcgtcgtgcgcggtca

SEQ ID NO: 27209 - DNA, 779 bp, Triticum aestivum
  unsure (1)..(779): unsure at all n locations
  Clone ID: PAT_TA_27209
aatattgtactaaatacttgcaaaacaggtgtacaaagttcaaactcttgttagacaatcctgcttgaacacctctttcacacaccaagctttaaactccgcatataatccagttgcacatgatatatgcaatgatcgaaatttgatacaattcgaatggagtttgtgcggcacatctttgatcactcttattcagacacattttgcatgatcaatttttgtgaaatcacctcggccaaataacaagaaacttcttttcaaatcgttacttgtttattcagtctctggctcttcccttccatgattcagcagcttcccagtctgaagcgatttgaagccacgttattcttattctgcatcaaccttagcaaagaacgaatgatggtagaatgaggaaaagaaactacagcttgcccttggcctggttgttcatcgtcttcgtcgccgatgcgctcagaggaagaccttcagccgccctctccaacaggtggctgcaaggtttgaagaactggccatactccatctcccactccgacagcatcgtgcaaatgcgccttgcgccgatggaatccgcccagtgcatgatgccacccctgtatggcgggaaacccattccgaagatggaggcgatgtcgaggtcagaggccttgaaggcaatgccctcgcccaggacacggcaggcttcgttgataaccgggaagaacaccatctctgctatcgcgctgttgtcaatcttgagcaactcaggatcaggtgtggctcctgaaattctnctcgac

SEQ ID NO: 27210 - DNA, 237 bp, Triticum aestivum
  Clone ID: PAT_TA_27210
aacaacaaacgaaagtgaatttatatgcagtgctagcagtacacataaactagttcatacagtagatctgacgctcccatgattctaagatggcgagttacacacatagatagatactcctggcagatagcaatagtgcatgagcaaactaaccactgctaattatcgtactagagtactcacttgattactctcgaatactttttgaaacctaaaccatctcgccggacgcgtggg

SEQ ID NO: 27211 - DNA, 1481 bp, Triticum aestivum
  Clone ID: PAT_TA_27211
ggttcatgtgctgcagagcggcggcgacgcgtcgcgagaattccttcggagcgatcgtcacgacgcccgataactcgtcggcgtccttcggggacgacgacaacaacggtgtgagctcgccgcgggctggcaacgacaacgacgatgatgagccggattccaagaggaggaaagacggtggtgacggcgagggaatcaacatggccggcaaccggacggtgcgggagccgagggtggtcgtccagaccatgagcgacatcgacatcctcgacgacgggtaccggtggaggaagtacgggcagaaggtggtgaagggcaacccgaacccgcgcagctactacaagtgcaccaccgtggggtgccccgtgcggaagcacgtggagcgcgcgtcccacgacctgcgcgccgtgatcaccacgtacgagggcaagcacaaccacgacgtgccggccgccagggggagcgccgcgctctaccgccccgcgccccgggcggcggacagcaccgcgagcaccggccactaccttaacccgcagccgtccgccatggcgtaccaagccagcgccgcccccaacgtggccgggacacagcagtacgcgccgaggcccgacgggttcggcggccagaacccgggctcgttcggcttcaacggcaacttcggcttctccggggccggttttgacaacccgacggcgtcgtacatgagccagcaccaggagcagcagaggcagaacgacgcgatgcacgcatcgagcgccaaggaggagccgagggaggaggacatgttcttccagaactcccagtactgaccaaccagtgtcagaaatggcaaaggacacgacgagatggagctttattatcatgtaatacgtaattgtactaggataggcgtagacacattcgtttatttgttgggaggcccgtagttgcagacggctgcacaaaagggttcccttcttttaacacgacggagtaaagaaaatatttaggactgtagcatacacagaagatagggggttgaagcagttttgctttgccgttgtttccacttccacacagaagtatgttgttgaattcaatttttagtaatagcaggcaatgcacgcgtcgagcgccaaggaggagccgagggaggaggacatgttcttccagaactcccagtactgagcgacgagtgtcagaaatggcaaacgacacgacgagacggagctttatcctgtaatacgtaatcgtactaggataggcgtagacacattcgtttatttgttggggggcccatggatgcagagggctgcacagaagggtcccccttccttaacacatcggagtaaagaaaatatttagggctgtagcatacacacaagatagggggttgaagcagttttgctttgccattgtttcacacttgcacacagaagtatgttgttgaattcaaattttagtaatagcagatatttgtcactaaaaaaaaaaaaaaaaaa

SEQ ID NO: 27212 - DNA, 1881 bp, Triticum aestivum
  Clone ID: PAT_TA_27212
gtatgagaaactctgataaaatggtacgaattttgacacgtatacacggttgcaccgtaaaacatatactcctactgcaattactacttcaaaatacatgacatatacatgttcacaagacgaggcgagatgtccatgtagctatcataaactttctatagctagctagcctctgctgtgggctgggagcggtatgtctgccaggtcctcacggtagggcacgggctcgtcgtcgtcctccccgctgccgcccgccgccttctcggcgtcggccttgcacgagtcggcgacgaaggtgacgacggtgtccttcctgaaggtgaggtagacgacggcgacgaggtagacgagcatcagcgggcagacgacaattccgacgagcaccttggcgtaggtgggcagcgaactgttgatgagccaccccatgaagctggtgctgaggaaatagacgttgatgccgatgagcatcagcccaagcgtccacgagaacacaatgacgtagatggagttcttgtgcgggcccatcttgctgctgctgctgctgaacttgagaagcgggatgagtgcaaacggcagctcaaacgacagtatcatcgacgcgatgatgatgagacggccggcgccattcgacccgccgatgatggagaccactaggctgggcgcaatggcgatgcagcgtgtcatcaggttcctcagccacgtcttcatcttgatgtccaagaacccctgcatgatgtactggccggcatatgtgccggtaatggtcgagctttgccctgaggctaacagcgccaccccgtacacgatcgagctggatctgcccagcacgttcttgagcagaaatgaggagttgtccagactgaggtcactgcatttgtcgatgtcctccgccgagaggttctccccgaagcagacggtcccggagacagaaatgacggctatgttgatgagcagcgccacgaacagcgcgaagccgctctcgtacaggaagaacctgcaagcatccttgattcctcttactgatgacggcgtcttcctggacagcaccaacgccgaatgcaagaacaagttgtgaggcatgactagtgctccaaggagggcgatggcgtcgccggtggcaccgttccccttgagcttgggaatgaacagccccttgaggacctccttcgccggaggcttcactatgctcagctctccgaagaagcacgccgccatgacgaaaaccagcatggagatcagaaactcgagcttgcgcactccgtatctttgccgcccgccgaggtgccgcctgcccgagccggtgatgagaaccccgatccacacaggtatgcggaacaagaggtagaaagcgaatgctgtcccgatcacttccgggatatcggcggcgatcaccgccacctccgcaagaagccacaggcagatcatcaccggcttcggatactcgctcttgcatatctccgcgagatgctttcctgtaaccacgccaaggttcgctgccagtgactgtatgatcagcgcgaagatgaggccaatcagaatcacccagaggagctcatatctgtggttggcgccggcttgcaggtccgtctccaagttgccaggatctagataggccagggacaccatgaacccgggcccaacatgggagaggaatcgcttccatgccggctccttgacgagcgtctcatcaccgtcttcgaacttcttgccatcctgcacatcttgctcggcgttggctcgccagctcctccccctctcgccgcccggcgcctcccgctcgatctccattgccgccgccgaactagctaggccggcagggtcccgggcgcacgggcgcgcggctggctggcaaggggggagaagatgggcggacgcggggtc

SEQ ID NO: 27213 - DNA, 824 bp, Triticum aestivum
  unsure (1)..(824): unsure at all n locations
  Clone ID: PAT_TA_27213
cggcgagttccgggcggtacgccagggcgtacggcaggcacccgagcgtccctgtgttgtgcacccagaagtacctcccaccgaggttgtacaccgtctggatcgccgacgcgagcctctccattagatcggggacgtaggcctcgacttgctccgtggtcatgttgtctaggtagcccatggcgaggtcgttggcgccgatgtcgaaggtgtaaagcgacttggagaccaggtgctcgggtttcggcaggatctcccggtagattccacctaggttggtgtagacgaagtggctcctattgatgaactgctggaattgccagatctgtacgtccagcgaaatggggctgtacccagaggtccacaggctcccgttcacccgtctgatggttccggcggcgctcgcgaaattggctccctgcgtgaagttgctcccgagtgaatccagatacgcattcaggtaacgcagccccaggctttgagccatgaagtcgatggtgaggcggccgtcgctttgccgcccggccggcatgccgaagaaggtccggccgtagggtggctgcaccgccgggaagagggccgggaaggctccggtgtccgagtaggagtcgccgaagttgaagatcgccgggaagtcgcacggggaattgtcggagcgcaccctctctagtaccaccagcaagaggacgaacatgatgagtttgttggtcgccatggtggtgcgacggcgagctgaagccatttcccacctctcgaccggtggtcggttttttttttttttttttttttttttttttttttttttnnnnnttnnngaaatcccg

SEQ ID NO: 27214 - DNA, 1395 bp, Triticum aestivum
  Clone ID: PAT_TA_27214
tcccgcggcgggtctccccacgttgccgtaaaaaagatatatgtattattcatagataatttttgtatcttttacaagtagatactcactgtagattttatttggaagtacatataagcattccagattttatacagattttatttgtagtgcggacgtttgaaaaaaatccgacattggcagcctaattaatgaacagcatgctcattgccctttcgcttggcaagcccgccgtagaggcacgggcgggtcggagagcgcgccgtccacgatctggtcgaagatgaacttgtaagccgcctcggtcaaatgcacgccatcccagctcacgctcttggatgggtccccgcacgacttcccctccaggaccgtgccattcacctccaccttaacgccgcagcggatgtccttgtcgaagttgtactggccgccgccgtacccgcaacacacatgtagatggtccgcaaacccatcgctcatcagcctatacatggccgtgtacacgtcgacgtaggtgaaggcggcctcggggagagccaccctgagcctggccacggtctccttgagccgcgcgttgaagaaccgggggccggcgttgagcgcgatggagcagccggcgccgtccttctccgcggcgaggtccgggcggtacgccagggcgtacggcaagcacccgagcgtccccgtgttgtgcacccagaagtacctcccaccgaggtcgtacaccgtctggatcgccgacgagatcctctccattagatcggggacgtaggccgcgacttgctcggtggtcatgttgtcgaagtagcccacggtgaggtcgttctggccgatgtcgaaggtgtaaagcgccttggagaccaggtgctctgggttcggcaggatctcccggtagattccacctatgttgttgtagatgaactggctcctgttgatgaactgctgcaattgccagatctggacgtccaaggaaatggggctgtacccggaggtccacaagctcccgttcacccgtctgatggttccggcggcactggcgaaattggctccctgcgtgaagttgctcccgagtgaatccagatacgcactcaggtaacgtagccccaggctttcagccatgaagtcgatggtgaggcgtccgtcgctttgccgcccggccggcatgccgaagaaggtccggccgtagggcggctgcaccgccgggaagagggctgggaaggctcccgtgtccgagttggagtcaccgaggttgaagatcgccgggaaggcacacggcgaatcatcggagcgcgcccccgcccccgcggagagttctagcatcaccagcaacacggcgggcatgagtttggtcgccatggtagtgcaacggcgagctgaagccatttcccgccccgc

SEQ ID NO: 27215 - DNA, 759 bp, Triticum aestivum
  Clone ID: PAT_TA_27215
ttctatattgaattcttgatcatcatttgttactacgtaggaaaagaacggcatgcatgcacgccccaaatcacatgctgctttcacattttactcatcacgtagtaataattaaacaagtggacatagagggatgccgatcatcacacgcgacggtatagtagtagcagtatctatacaattatcaaagccccaactgcctaaccactacgcacaccaaggcaagccgataagcacgtcgtggtacgatcaagtcaaccgccgcagccgccaccgcatccgccgccgcagccaccgccgcctccgcacccggagctgagcgccgagccgacgatgacgccggtggccaggccggcgcctgcgccgagggcgagccccgcgccggcccccatgcgccctccctgcttcctcccggcgtcgacgggcggcggcgggtacgcgtagccggggggcggctgctgcgccgggtagccgtacgcgcccgcggggggcggcggcgggtacccctggccgtagtagtagacgttgttgttgtcctgccggcgcggcttcttggcccccttcgcgcagccgaaggccgccacggccgccaccgccaccgtcgcgacgaccgcgaaggccacgagcgccgcggggctccccagccccaggtcgcgggcgaacgctcccgagtgctgcgcggcgagaggccccagcctcaccattgctgtttcggctggaggaggaggaaggagagggcggagctggctaggaggaaag

SEQ ID NO: 27216 - DNA, 210 bp, Triticum aestivum
  Clone ID: PAT_TA_27216
gaatcccattaatcacactctggggaaaaaaaggcatgccaaactacagggcaacacaaacaccagcagtaccatcagatatccagatcagtagcctcaccagtcactactccgaaaacggcacagaaaaattacccgaaacaagaaagaatcagggatcaacagaaaccgcactccactaatcaaccaagcaagcggctatcaactttc

SEQ ID NO: 27217 - DNA, 1144 bp, Triticum aestivum
  unsure (1)..(1144): unsure at all n locations
  Clone ID: PAT_TA_27217
aatttntcttttttttttttntnttttttttttttttttttttttttttttttttttttttttttttttttttttttctaacttatatgacaaatgaatacggtacactggaattgccagcatcacaagtaaaattttgatatacagctttacacaatactaaatttacacccctagtgccacactaaccaaaacttccgtatagcgaagttcaaacaagtctcatacaccatatatttctcaacaaagaaaaagaataatgacctataaatcaaatatactaattacacgttgaaagcttgtgctcccttggcaaccttgatgaagacatcctccaaggtggtgtcagcgaggccccaagcgtgtatgctaaaacggccctttgcactctcaacttcattgaaaacgtctgctatcttcacctcctgctttggcagctcaaatttctgtgttccagatatgtgatatatcctgtttgcatttggcgacaaacggcgaaccagctgttcaacctcctgctcatgttctgaagatgttgtcattgtgaacacgtaggtgcccccgtatcttgctttgagctctttcggatttccaatgcactggaaaccaccatcaacaaaaatacccagtctatcacatagtacctctgcctcttccattgaatgcgttgtaagaataatggcacggtttttctttgcttctttcacaacactccacaggttatttcttgacgctggatctagtccagtgcttggctcgtccatgaaaacaactttggggtctccaattaaggagattgcgacactaagccgccgtttcatgcctccactgtacttccccacttgcttatccccgacaccgccacggaataggttaacactcttcagagagtcatcagttgccttcagtaattcagcgcctttaagattttttaatcttccataaaacaatagatgctctcttcccgtcaatgtttcccaaagcaagtcgtgttgtgggcagacacccatatttgtgtatatttcattcatatcagtccgtatgtccattccatggacataagcagtgccagatgtaggtggaatgagcccaatcatcatactgatgaaggatgttttccctgctccattcgggagggcaagag

SEQ ID NO: 27218 - DNA, 1353 bp, Triticum aestivum
  Clone ID: PAT_TA_27218
cgacccgcccgcgcgagcacggagagctagcaccagcagcaacttgcgggggaaatggcaagcatcctcgctccagcggccgggaaaccacggagggctagaagcaacttgccagcgaaaaagcaagcaggctgatcgtgacacttccacccgccggcggggaatcgttcgatggcgtcgcggcagtcgctgctcccgagcttcctctacgcggcgtccagcggcgccgccatgccggacgggaggggcgcgcccgtcgtcgccagggcgccgagcgagccgccgttcgggaagatcgacatgttctcgccggcgtactacgcggcctgcggcttcggcggcgccgccgcgtgcgggctcacgcacgccgccgtgacgccgctcgatgtcatcaagtgcaacatccagatcgacccggccaagtacaagagcatctcctcgtcgttcagcatcgtgctcaaggagcagggcgtccgaggcttcttccggggctgggcgcccacgttcctggggtacagcgcgcagggcgcgttcaagtacggcctgtacgaggtgttcaagaaggagtacaccgacatggccggcccggagtacgccgccaagtacaagaccctcatctacctcgccggctcggccaccgccgaggtcgtcgccgacgtcgcgctctgccccatggaggccgtcaaggtgcgggtgcagacgcagcccggctacgccaggggcctgcgcgacggcttccccaagatcgtcagggctgaaggctatgcagggctgttcagaggaatggttcctctttgggggcgacagattccttacaccatgatgaagttcgcaacctacgagaacatcgtggagatggcgtacaagcacctcatccccacccccaaggaccagtgcagcaagcctctgcagctcggggtgagcttcgggagcggctacatcgctggagtcttctgcgccgccatctcgcaccccgccgacaacctggtctccttcctcaacaatgccaagggcgccaccgtcggagacgctgtcaagaacctgggcctatggggactcttcacgcggggccttccgctccgcatcatcatgatcggcacactgaccggcacccagtgggtgatctatgattccttcaaagtcatggctggactgccaacaaccggtggggctcctgctgctgccccaagggaagaagcgtaagcagtgaaagcctttccgaaattccaagagaaaaaaaatatgtttttattgtcgacatcgcataatctgtaatagattgatgattgtaacagttttcctcagcactgtgccaccatttaccgattgatgaaatttgtcattaggttggtt

SEQ ID NO: 27219 - DNA, 552 bp, Triticum aestivum
  Clone ID: PAT_TA_27219
cgcaactcacccgggatcctcaatattgggacaatcctgaagattttaatccggagaggtttgtgaagaagaatattgactataatgggacatattttgaattcaccccattcggaggtgggcgaaggaaatgccctggagtaggcttcgcttcgtcaattttggagatccgcaaactttctgtatcactttaattggacgcttcccggcggagccagctcagtgtcccttgatatgtctgagaaatttggggtaactgtacgtaaaaggtctgacctatggctcaaggctattccacatgtatgctccaaagctacacatatatagatccaccttaacagagtggatgcccatatttgttgcatattgtacctttatgtttacattagaataagaggagctcttgggaaaacatgtaaaaatcgggtgtgattatgggcaaaatgaaatttcaaagctgtgaatgcatgatatcaggttagcagctactatgtatgacctcttgtgtccaattatggggatactataattagtgattatatgttaagtgtt

SEQ ID NO: 27220 - DNA, 1243 bp, Triticum aestivum
  Clone ID: PAT_TA_27220
gtgcggcgctcgaggcggccggtcgggactaagctgacacgcacgagctgatcgctcgcaaataagctgcctgccatggagtggtggctcaccttatgtttgatagccctatccacgctacttgccctttggttttctggttgcaggagcaagtccatgaagcacctgcctcctcctgggccatggactctcccggtcatcggtagcctccaccacatcctaagcgccttcccacaccgtgcccttactgatctgggtcgccggcatgggccagtgatgctcctcaagctaggcgaggtccccctcgtggtgatctccagcgccgaggcggtggcccaggtgttcaaggcgaatgatgtcgccctgtcgaaccatagtagctccaggttgcaggacatcgtgggcttcggcggtaagggcatcttgttcgccccctatggtgagcactggcgtcagatgcgcaaggtatgtatcacggagctcctcagcaccaagcaggtgaagcgcatggaggggatcagggccgaggaggtgggaaacctcatccgctccatcaatacagcaacagctgccggcgcaaccgtcaacgtcagtgagatggtgtcggtgctcagcaacgacattgtgacacgggcggtgtttggtggcaagttcgcacggcaggaggagtgtccgcacgagataggcaaactcatggatctgataggaggcttatgcctcgtggacctcttcccgtcgtcttggctggtgcagtggttcagcactgccgagcgccgtacaaagaggagctgtgatctcatccagagcatcatcgccgacatctttgagaagcgcaaggcggcgcgagcttcccgtcatggcgcctacagcgacgatgaagaaatgctgaacgtgttgctcaggctgctggaggaggattcgctggccttccctctaaccacagagattatagtcaccgtcatgtttgacatgtttggaggtgccacagagactacagcaaccactttggtgtgggctatgtcagaactcataagacaccctaatattatggctaaggcgcacttagaggttcgagaggtactaggtgagggtcgagctatcattggcaatagcgatcttgcagaactccactacttgcggatggtcatcaaggaggttcttagattgcatgcaccttggtcgcttttaatgccccccgccgggactaagagaagaaacctgcaattattatgggggtttatgg

SEQ ID NO: 27221 - DNA, 949 bp, Triticum aestivum
  Clone ID: PAT_TA_27221
cccacgcgtccgcccacgcgtccggctcggacactacaggaaccgctttggagtgggccatgtcagaactcagaagtcatcctgaagttatggctaaggcacaattagaggttcgagaggtactaggtcaaggccgagctatcattggccatagccatcttgcagaactccactacatgcagatgatcatcaaggaggttcttagattacatccacccgccgctttactccctcgcaagaccagagaagactgcaaaattatgggttaggacatccttaaagataccaatatattcatcaatgtctttgcaatttcccgggaccctcggtattggagcaatccagaagaatttaatccagagagatttgagaacaacaatgtggattataatgggacaagttttgaattcactcctttcggaggtgggcgacgacaatgccctggaatagcattcgcatcatcagttttggagattaccttggtaaactttctctatcactttgactggatgcttcctgacgatgccaactcagtgtcactcgatttgtctgagaaattcgggttcactgtccgtagaaggactgacctactgctcaaggctattccacatgtatgctccagggctacacatatatagatccaagaagtagatgttcatatgtgttgcattgtaccttagttcgtaaaatagaataggagctcatggaataacttgttgtttcagattacatgccaaaaaagtggaagtaactattggcagaaattaaatttcaactttctaccggggaagcatgccaacagagaagagcaagcccccgcgagcgccaagtctgggccccttctccgccgtgcgagtcttgctgaacgtgttgcgcttgctgctggtggaagattccctggactctcctcccacctcggccgcgaccacgctaatcacttagtgaattc

SEQ ID NO: 27222 - DNA, 739 bp, Triticum aestivum
  unsure (1)..(739): unsure at all n locations
  Clone ID: PAT_TA_27222
atgtggagcacctgtcaatgtacttggacgtcgctgactcggccaatctcccatatggttggagccgttctgcccagtttagcttatctgttgtaaaccagattgatcagaagtatacgacacgaaaagatactcaacatcaatttagtgcacgtgagagtgattggggtttcacttcttttatgcctttgagtgagctatatgatccaagtagaggttaccttgtgaatgatactattgttgtggaggcagaggttgctgtccgcaaaatggttgactattggacatatgactcaaaaaaggaaacaggttatgttggtttgaaaaaccaaggagcgacctgctatatgaactctcttctacaaacattgtaccacataccatacttcagaaaggctgtgtatcatatgnccaaccaccgaaaacgacatgccatctggaagtattcccttggcgctgcaaagccttttttataagctccagtacagtgacaacagtgtagctacaaaagagttgacgaaatcttttggatgggacacatatgattccttcatgcagcatgatgtacaagagctcaacagagttctctgtgagaaacttgaagataagatgaagggaactgttgtagaaggaacaatcgagcaattatttgaaggtcaccacattaattatattgagtgtataaacgtggactataaatctaacaggaaggagtccttttatgaccttcaacttgatg

SEQ ID NO: 27223 - DNA, 747 bp, Triticum aestivum
  unsure (1)..(747): unsure at all n locations
  Clone ID: PAT_TA_27223
agtgccccaagggataaagcagaaacaatcgtgccgttctgtgagtttgtagatgaaattcagtttcaatttagtgacactacaagttttgctgatagaaagaccctggatgatataatagctaataaaacagcatgtgaaggagtgcatgatgaagctgatggtgatgcggatgaagagggaggggatgacactgatctcaaaaatgcatccaaaaaacattctgatttgtcaaggcctgagattatccttattcctattcctggaagtgagttgcatctatgtgatagtaatctggaggccaaatctgcaccaaatctctgtcctcacataaatgatcttgaaagatctgatggttttcaagtaagtcgctcactgtacaatggtgagaatagtggggttgatcaagtcgagagtaagaaccctggcttttcagagcaggaactagaaggcactagtgagtcaaaagaaaatagtggcctgtgtgagctcatcaacagtccagtgcctgataacaagcactctgatgacctgaaagacaattcgttcaaccctgttgtggaattatccctatgcaggcacttgttatctgaaggcatgggagcagatgctgcgcgcaaaacctttgatgctgagaagataacctanagaagttccgtgcctgggagcagtcattgataagaaacgacaagctagttgcttagatttcctggccgttactttcccttgggatgtagctgcacctgt

SEQ ID NO: 27224 - DNA, 660 bp, Triticum aestivum
  Clone ID: PAT_TA_27224
gttggtgcaggaaagcatatatctgagcctagctggaaagttggcagcagaatactatccgagaatccggttttactgtgtcgacgtcaacgctgttccacagaagctcgtgaatcgtgcaggagtaacgaagatgccttccatacagatgtggagcgactcccggaagcaggccgaggtgatcggcgggcacgagtcgtggatggtgatcgaggacgtccggaggatggtcgagcaggaggaatgaatgatccaacgcggcgatggttcccgtgacaataccggcctttcaccgtgggaaaatggagaaaacaagataagaggcggaatggagaaaacaagatcgagattgagctatgtatgtccagttttgtataatcattcatcgcgcacggacgcctagggttcttggagaaagggggcttctcttgctggggtcctctctaggatttagaggattggaggggcatgcccttgatgtatctatctattttgagtttctgggatcagaaggctttccgttagtcatcatgtagcaataaaatatccagtcaatgaccttgcagggaattagaatacatgctgggtgctttggtgccaattattccgtggtgtccactttgaactagttgcacagatggataaacagaatataattgc

SEQ ID NO: 27225 - DNA, 760 bp, Triticum aestivum
  Clone ID: PAT_TA_27225
gccggccgggtcgggactttgccccctcgcacgcggcctcttccttccgttccgtccttccttgcgcttgcggcggcggcgcgaagcctccggagaactttccggggggagccagctagggtttgggccgcggcggcgcgcgacgatgtcggcgtacgacgaggtggagatcgaggacatggagtggagcgaggagctgggggcgtacacgtacccgtgcccctgcggcgacctcttccagatcacgctcgccgacctccgcctcggggaggagatcgcgcgctgcccctcctgctcgctcttcctcaccgtcgtctacaacgaggaggacttcgccgacgccaaggagcccccgcagaagccgccggccgccccgcagcccgtcgccgtcgcctgaagcgcaatcccccgcaccccccgtgggtggctcgtcggcatggacggacgacaggatcagcatcgtagctgggagaggaatgagagagattgcttggcatacgcgggagcatctgtacttgtacttgtaaaatgagaaaaatcgcagcatcgtatcaacttttggttgtttaactgaatttatctgtgtgtactcactcagttgttacaaaggcactgtccatgactggtgcttcaaaatttcgttatcccagtttttgtacctgatgactctgatctcattgctgcgccttgtgggtaacctgtgaatctgtggtgtggcttggatgagaagtggcttaaacatgccttttttacaggagtc

SEQ ID NO: 27226 - DNA, 825 bp, Triticum aestivum
  Clone ID: PAT_TA_27226
gaaaaaaacattgcaccagcagtcatcacaggtgcaggacatacaagtgccattgattggtgggctcttggaattctattgtatgagatgctgtatgggcgtacaccttttcgaggaaagaacaggaagaagacattttataacatcctgcacaaagatcttacgtttcctagtagcatcccggttagcctggaggcgaagcaactaatccatggactgcttcagagagatccctcttctcgcataggttcaaatactggtgcaaatgatatcaaggaacatccattttttgaagacatctattggccacttatacgttgcatgagtcccccggagcttgatgttccgttgaagctgattggcaaggagtctcaaccaaaagtgaagcccgaggaaggtgttattgatacattttaaggtggaaatgacgcaaggactgtttgcacgacgtccatgtggtaggaatggttgttcttaaccaaataagaggcttgcaagtcctgtgaagtgatagaaggaagtgtggccttcagtgttttcactttgagatgcctcgagatcctgtacatgagctattcttttggttagattaggagcttaagtaaataggatattattcctgtaaagtttcactcttcctggagatggtatggtaagatgtacgcggcacggataatgtactttgaaaagatctgatatttgcttctttacaataaagcttgtatttacaaaccattgtggccgcatgcatctttccgatgcagaggccggggatgtcctccttttcaaaataataaataaattagaaaccattaagattactgt

SEQ ID NO: 27227 - DNA, 700 bp, Triticum aestivum
  unsure (1)..(700): unsure at all n locations
  Clone ID: PAT_TA_27227
tttcgntaacgaanttttcgttcngttgtncaaggnttataagggaaaacnttttttccgaaatttantcnncaattccgcaaaagttggaancctcgaaatgtgccccaaaangattgaacccctccgaaatttgccggngagatttttctgntgtccgantcggcacggnttctnggcnagtngttcccagttcccgagtgtcaatgggtgatgcatgcaggccggaatntgaacctccngaaatcgttggtgcccccgttcnaattgaccggatgtgaacccaagtcgttggcacccgttntaggccnccagaaccgggatccgcggacagtccttgtacccatcagctnggcgtcnaacgaccacnaagtgttggcaccccgttccaggccaccagatttggacgccgccgccggaatcttcgtccccatcacgcttgcgtcaaacggaccgctgcggaccctcctcggctccttcctcccacgctcccgggcaagaaccgggacagcgccgtgcccttccccgtctccaacactacagtgctcgcgtcgtcggtgctgtcgtatttcattatcattcgaatatgtgtggatttgaaccgttcgttgccttcccatcatgttgtgttcattcttttctgaatctgattctcatacctggtgcgaatcttctataaatcgttgtcaggatttgttcc

SEQ ID NO: 27228 - DNA, 585 bp, Triticum aestivum
  Clone ID: PAT_TA_27228
ccgaccgggtttaaaatttattgcgggaagacttctctctaaatgggaagacccctatgttatcgaaaaagtctatcgttccggtgccataaaaatccagccatttaagtgcacaactccgaaggtggtaaacggtcaaagaatcaaacattatatctcaggtaaccctataaatgttgaaactaatattattgaaaccgtaaccccgaggaatacataagggacactttccagaatgtttcagactccgaaaaggaataggtatgtggtacggtaagtaaaccgactccaaaacaatttttaaggcaatatttctccgttttggaatatttagaaaaatagaaaaataagtagcagtccgggaaggacacgaggcctccacaagggtggagggcgcgctctaccccacttaagcgcgcccccctacctcgtgagcacctcgtgtgccctccggactccgtttccttgcacgatacgtattttggtcggtaaaaaatcattatatatactcccgaaggttttgaccctcgtatcacgcaaatctcccttgttcttgtttcgagctgttgctgctgcacctcgtgc

SEQ ID NO: 27229 - DNA, 684 bp, Triticum aestivum
  Clone ID: PAT_TA_27229
aaaagtctccgctatcctcttcccctctgctctcgatcctcccctccctccctgcctccctcctcggcgctccgccggcttcgtgctccctgcgttcgccgcgcgcgcgagcgcgaccgatggcgtccggcgacagcaagccgaggagcgaggaggagtggcgtgccgtcctctcccccgagcagttccgcatcctccgcctcaagggcaccgagttaccgggaacaggcgagtacaacaagttctacggtgacggggcgtacaactgcgttggctgcggaacgcccctgtacaagtccaccaccaaattcgactccggcctgtgcggctggccggccttcttcgaggggcttcctggagccatacacacggacgcctgaccctgatggtaggagggttgagatcacatgcgcagcttgcggtgggcatttgggacatgtgttcaagggagaaggcttcaagacgcctaccgatgagcgccactgcgtcaacagcgtttccatcaagtttactcctgcctcctcctgaatccggttctcgagtcatttggatgaacttgtgaaaacaaatgcataataatgattaggttccagaatccgttttctcggagttgtgtggatgaattcccctgatccgaaactgcggaaagcgggtaaataaaacattgtcttgcaagtttctact

SEQ ID NO: 27230 - DNA, 868 bp, Triticum aestivum
  Clone ID: PAT_TA_27230
gccggtcgcccccgaacaaaaagactccgctatcctcttcccctcctctggctctgtctcgatcctcccctccctgtctccctcctcggcgctccgccggcttcttgctcccccgcgttcgccgcgcgcgcgagcgcgaccgatggcgtccggcgacagcaagccgaggagcgaggaggagtggcgcgccgtcctcaaccccgagcagttccgcatcctccgcctcaagggcaccgagttgccgggaacaggcgagtacaacaacgttctacggtgatggggcgtacaagcgcgctggctgtcggaacgcccctgttacaaatccaccaccaaatttgactcctggcctgttgggctgggccggccttctttgcgaagagacttcctgggagccatacacatggacgcctgaccctgatggtaggaggggtagagatcacatgtgcatcttgcggcgggacatttgggaccatgtcttcaacgggagaaggcttcaagacgcctaccgatgagcgccactgcgtcaacagcgtttccatcaagtttactcctgcctcctcctgaatccagttcttgagtcatttggatgaacttctcaagtcgtaaaaccgtgaaaacaataatgattaggtcccagagcccgttttctcgaagttatgtggatgaatttccccgatccgaagttgcggaaagtcggtaaataaaacatggataggatcttgcaagtttctgctgttaaccaggctgtaatcctgtactcctaatctgttcggtctgaaagttttctgcgtcatgttttggaactatatatacgtattatatacaccatcctatttttggaaaaaaaaaaaaaaaaaaaaaaaaaaaa

SEQ ID NO: 27231 - DNA, 1567 bp, Triticum aestivum
  Clone ID: PAT_TA_27231
gaattcggcacgagctccgcactccctatccactcctcctagcagcgccagcgccagcgcgccggcgagccagcagctgcctcccgggcggcgcggagcgggagcttgccgcgctggttacggggccggagcgagccggagctaggatgatgggcgccagggccaacgccagcgccaacgcggccgactgcggggagtacgcggagctcgaccccaccggccggtacggaaggtacaacgacgtcctcggcaagggcgcgtccaagaccgtgtaccgggcgttcgacgagtaccaggggatggaggtggcgtggaaccaggtgaagctgtacgacttcctgcagtgccccgacgacctggagcgcctctactgcgagatccacctcctcaagacgctcaagcacaagaacatcatgaagttctacacctcctgggtcgacgtctctgcccgccacatcaacttcatcaccgagatgttcacctccggcacgctccgccagtacaggcagaagcacaggaaggggaactgatgggcggtcaaggacgggtgccggcagatcctcagcggcctgctgtacctacacagccacaatccacccatcatccaccgggacctcaagtgcgacaacatcttcgtcaatggtaaccagggtgaggtcaagatcggcgtcctcggcctcgccgccatcctccgcaagtcccacgcggttctctgcgtaggtacgcctgagttcatggcgccggaggtgtacgccgaggagtacaacgagctggtggacatatactccttcgggatgtgcgtgcttgagatggtcacctttgagtacccttatagcgaatgctcgtacccggtgcagatctacaagagagtgatctctgtaagaagtgcctcttggatctctttagccatttgcagctcttgtgattgtgatgtgtggctagttggaaattgttttactgatgtcatctagtggtttgggttggtagggtactaagcctgaagctttgtacaaggtgaaagatccaatggtgaggcaatttgttgagaaatgtctgaccactgcttccgagaggctcacggcaagagagctgctcaatgaccctttcctgcgcattgatggcatggctctatgttctggggatggggattacaccctgttgaacaattaccttcggcagccctacctaaggcatgcttacagtaatgggtccgtgatgagcaatgggttctcagaaagcattgacgaaggtgcaccgacggagtttgaagatgacgacactaaagctgatggcattgatctgttcaacggccacgaagatgagcctcttggcactgtggacatcgcaatcaaagggagaaaaagtgaggatggaggaatcttcctcagactacgaattacagatgatgatggccgggtacgcaacatctattttccgttcgatgttgaggctgatactgcattaagtgtggcaactgagatgataggcgagctggacataactgaccatgaggttactcgtatcgctgagatgatcgatggcgagccttaattgcatttggtgccca

SEQ ID NO: 27232 - DNA, 1032 bp, Triticum aestivum
  Clone ID: PAT_TA_27232
gcagccaccgcctctgccccgctccccccgacgcccgcccatggctccggctccggctccggctccggcgtccagcggccgcatccggccgtggctggtggttggcgacctggtcctggcggtgctgtgggtgtgcgcgggcgcgctggtgaagctggccgtgtacaacgtgctcggacttgggggccgcccggagggggaagccgccaaggtctcgctctctgtcgtctacatgttcctcttcgcctggcttgaatccgccaccggcggcgcctcctacaacccgctcactgccatctccggcgccctggcctcccgcggtggcatcgccctctacctcttcaccgtcttcgtacgggtccctgcgcaggtgattggggcggttattggagtgatgctcatgcgatttgcattccctaaagtaggtaaaggagctgcgttaagcgtcggtgttcatcatggggctttaactgaaggactggcaaccttaatggttgttatggtgtcattgacacttaaaaagaaagaacaggggttctttgtgaagacatggattgccagcatttggaaaatgacgattcatatccttagctcagatatgactggaggaattatgaaccctgcatctgcctttgcttgggcctatgctcgtggagatcacacatcatttgaccacctactggtatattggctcgcacccctccaagcaacccttgtaggagtatgggtggttaccttcttaactaaacccaagaagaccaaggagcaagaagcagataaaaacaagaacaaaaaggaatagacttcaggaagcgagccatcgcctggttggggagtggatgtacatacagtaccagcgcctgggttgaagtcctcatggacttgaatttaggttctatttggctttccttcaagtattccttcaaagaaagaagaaggaacattgttattgtgggagtggtgtcccccttttttctggagcaagaactccagatcatattatcattaattattctaaaatgttcatctgtc

SEQ ID NO: 27233 - DNA, 703 bp, Triticum aestivum
  Clone ID: PAT_TA_27233
aaccaaattaaattattcagtttgaaagttggaatgatcatcattcaacattggtttcattcgccccctgttagaacatgttatgtacaaagcgggaaacctgtaaaatttcctatcagcaactatagtatataaacatgtaaaatgggtgaagtttcaccaggtagacctcatccattgtgtgaggtggtaaacatttgttattcggtatcatgctaaaattgtgcccatatcttgttgcaacctacacctcaaaggagaacttcgattccgcatcaacacaaactagttctacaggccaagcacatcgaactcatggggcatgtaatcttcgctcggacggtaatacttgttgggagaatacaacccaaagtctgtaacttggctgcagtataggcacgcaaatctctcgacctggtgagcaaaccgagaattttggtacccagtcttcataagctgtccccacaccttgtgaaacttctgatgatgttgcatctgagcatctcggagaaggcagcggatacccttcagcttttgcagtagatttgctgcctctgagcacctcggccccggctccggctccccttcagcttctgctctagattaccctgcgcggttggccactttcccttcgccttctctgtaagatctccaagctgaactgtcctttccacgcgacgcaccgtgtcttcaactgaatcac

SEQ ID NO: 27234 - DNA, 1347 bp, Triticum aestivum
  Clone ID: PAT_TA_27234
gccgcgcgcgctcggcccctggctccggcaccgccctgcaccgcccggccccaccgttccgcccctgctgccccttccccccgcttgttccccgcccccccccccccgcccattgtctcctcgctgggggccggcggcacgagatcccaagccctatgcgctagtaggttgcgcatcagaaccgccgcaggaggaagagcgcagagctagcttgctgatcggtagagctttgcttgcttgcttgcttggaaggaggaggaggaggaggagatcatggggaggggaagggtcgagctgaagcgcatcgagaacaagatcaaccggcaggtcaccttctccaagcgccgcaacggcctgctcaagaaggcctacgagctctccgtgctctgcgacgccgaggtggcgctcatcatcttctccagccgcggcaagctctacgagttcggcagcgccggcacaacaaaaacattggaaagataccaacactgctgctataatgctcaagattccaatggcgcactatctgaaactcagagctggtaccaggaaatgtcaaagctaaaggcaaaattcgaagctttgcagcgaactcagagacacttgcttggggaggaccttggaccgctcagcgtgaaagaactgcagcagctggagaaacagctagaatgttctctgtcactggccagacagcgaaagacacaacttatgatggagcaggtggaggaacttcgcaggaaggagcgtcagctgggagacatcaacaggcaactcaagcacaagctcgacgctgaaggcagcaacagcaacaactacagggccatgcagcaaatcacctgggctgccggcaccgtcgtggatgaaggcgccgccgcatatcacatgcagcagcagcagcagcagcaccctaatcattccgctgctatggactgtgaacccactctgcaaattgggtaccctcatcagttcgcggctcctgatcaggcagccaataatattccacggagcagcggccccggaggggagaacaacttcatgctcgggtgggttctttgagctagcgagctgctggttagcttgtctacccatcagccaagaaaccaaataaaatgcgtgtgctgctcctgcatgctctacacgagaagtagcctgcgtggcgcgtgcctctttctttatttttactcgttatttgtgtgtgtaagaagtaagaaccaagaactactcctatattttgagtatttgaactactacattggtcttgtaaaacacttgcaagttccaagccgtccatgcatgcatgccaagttatctagtaaaactataatttgtggccaaaaaaaaaaaaaaaaa

SEQ ID NO: 27235 - DNA, 653 bp, Triticum aestivum
  unsure (1)..(653): unsure at all n locations
  Clone ID: PAT_TA_27235
nctcatcctctcccacaaccagcgttatttccccttcatcttcttctcctctgtatggctccactcaggaaacaaatcaccatcttcatctccgcatcagccgttgcacaactacgggaagatcctcaccttcagaagtgcccggggtgctgatggcgtcgtaccgctgccggacaagccttcgttggtcgtcgccggcagagccgcacgctgctgccgattcagtccacgtaatcaccgcccttaaattgattcttgctgcagatgaatcgagccccgcaagctacgctggaccaagccccgcgccccgatgtccaccaaagctcccgatgagtcacatgcgccaccatcggcgtcctcctccaacatcacctgcaccaaaggaagcctttttcagaagaacatccctgctccgtctccaggcaccttctctatggccgcaagttccgcaagtttctctcacctacgattcctctctaactgaagcacgatccgcaataatgtgtcaacatccgatggatcatgatgatctctctgatccggttggttttgatcggaaacgatagatggtgcgcaactcctctttgttcgttttctttanttttctgaaggaatanaacatganntttacaatttaacacgtgcanctacan

SEQ ID NO: 27236 - DNA, 1085 bp, Triticum aestivum
  Clone ID: PAT_TA_27236
gaaacttggttgatcaaataaccaaatgttgcaacaacttgaggtttatttagtatattattaatcatgaatacatacatagacgacaaaaagaaatcaaataaactgggcattattttcgctcgtgcgacgtgaccacaaagatacgcctatgatccacacgctggaatagtttcttcttgctcataaaagctaagcctacactacacttctcagtccgaactccgaagccgagtgccgcaaaaaatttcgaagcagcatcgtgcacgtaggaaacatgaactgcaggtgttctattccctataagcgatgaactttgcaatgtcgtggatcccagcctctctgtagcagtcggcgatccgatccacgacttcgtcccagttgccgtcgaccgtggccagatccatcagaaacgccgcctcgtcaaggaccacctgctctggagcttttcctttcttcagatcatcttgtttgccctcttcggataccttttctcttatgaactcgatctgctcatcctcccacccagctagttcagctgcctcttcgtatctacagcctagtgtccaccatggtgacttcaaagccactcgagctgattctttggcttcagatgtacgcccaattcttttttgaacttctgagttgaacacaaagggtcttccaaatccaggaaattgatctctagtatagaattctgaagtaataagagcagagacattatctcctttttccaggtggcgtgatgctttcctttctagaatgtctggaaagagtccaaccttcttcaacaaatagacatcaagatctgccatctgcgattctttgaaatcacctcttctgtaaatgtttggaccagcttcccctacagcagaccacaaatcttctcgaacagcagaccataaatcatcaccactctcagcactgctatcagcctcaacaagtattctatgaatatattgattgacgtttttagccaaaagccatagtccatggctacgcacttccactacaggcatttccatcccacttggagctagtcggccatctcagcagggatgtcaagttacctgtggacttccgac

SEQ ID NO: 27237 - DNA, 475 bp, Triticum aestivum
  Clone ID: PAT_TA_27237
gccgagtgtcactggttctccagttgccaaatcgagtccccatcttggatctacagagaataagaatgccgttgataagcaaaggctagaagaagaaaagaaaaggtggggagtatctgctttgctatttagaatctagattatgccatgtacaaaccaaattgttcactctctctttgccatacctctttcatgatgttgacaagctagtcattaatgaacattttcatagtgctattgtactgtattcatctagctgctgttttcaccacgacacgaggtcaggttctattggctaactgtgttctaaattatacgctcttctgaatacatgtactgcaatttgctctagctttttttttctgaatatacgctgtgcaattcaatcatgtttttattgaacagtaatgaacgaaatactttcaaatatgaatgttaatttgataattgtttcttatctgggttgctttgctta

SEQ ID NO: 27238 - DNA, 465 bp, Triticum aestivum
  Clone ID: PAT_TA_27238
gaggatcaggacgacagggatactggccatactgaacaaggaaactctgatgatgtgggtaacctattcccaattgacttagcatagtgatacggatttcgtaatcgattccgtgcgctatattcgaccaccctccctctctccctacctgcctggctcaatttgatcaatgggacacaccaagaggggggcgataccagggacgatgttccacgccacaacctggattggggatgtctttctgatgtattgttctcttttcatgtctcgcccactcatgttgacctcattgcccttcatctatacccaatcacacgagacacggcatcaactttctggcaatgtactaatattgtttccaggtgtcgacaaattcagcaagccagcccatccccatcctgcccccgcctccagcgcccctgagtctgggtccgtcccgggcacggcgacaattggcagcacgtc

SEQ ID NO: 27239 - DNA, 1567 bp, Triticum aestivum
  Clone ID: PAT_TA_27239
tccgcctcctcgcccgcccccccctccccccccccccccgccgcttcggcctccggcccctcaggctgcagtgctctaggcatggactgcggcgctgtggaaccagcttcaacggcagcaagctgctctgctccgtcagtggggccgcggcgctgtgccaccggcttccacctgggccgctccgggcctcgccgccggtggagccgcgccgcagttccatcgggtagcggctactctcctgcgcggctctcgcccggggcatctgcgcccctggcggacctgggctccactgcgctcctccgcagggctctcctctgccctgcggggcccgtgcccaccagggccccctcccgttgctcgtgatggttctcttcttcccggtgctgcgggtctcttggcgtgtcgacgggttcttggtggcctcagggctacttctcggttgcatttgacgcagtaccttcatcatggcccggcacaagtatgtaaaagttgcataccatggatttagggagatgtcgaaggaagaaaaagttgctgcttatgggagtacattgataagggattccttcgatgaacctgattatgcccttatagatacacttttctcactgggtgaagcctatctgttttgctcagcttgttgatttcattagcgtggtcgcggccgaggtaccttcaggcactgactatgcgcatatgtatagagatgtgaggtctgcggttgatctgtgtcatcgtgatggaactttaaaacgaatggttgcaaaggaacctagcaggtatattaatgaagacttggcaattgtgccgatgcttcaaatgcttagaaaatctggacgctccacattcttggtgacaaacagtttatgggactacactgatgttgtcatgaactacctatgtgggccatatatgtcagatgtaagctcaagtcacaaccacaagtggcttgagtattttgatgttgttataacaggcagttcaaagccaagcttttttcatgatgataatcgaacaggattgtttgaagttgagcctgattctgggaaacttctaaatgctgatcttcagattggaagcccaagatcaagtcaacatcagccaaaaccaattcacaaagtgtacctgcccgggcggccgcgtcatcttcacagactactttctgttgcttctagttcgcagatcctctatgttggtgatcacatatatggggacatactccgcagcaagaaagttctagataaaaatacacatggcaattagcgtgcatgcttgatcaattcaagtaactacacaggaccatccaatgagtcctaagtgccttattatttttctctgcactcatcatcgatgctgctgatggtgtcaaattcagtttgaatagcaatgcttagttaaaaagtcggcctgtgttacggatgtcctctgagttgtggttggtggtcgattccgcatttcactttccatttctccagtgattatgtgctgtgtttatttaaaaggttggcggactatgctggtaatacctgagctggagcaagaggtcgaagcttcacatcagaatcaa

SEQ ID NO: 27240 - DNA, 1081 bp, Triticum aestivum
  Clone ID: PAT_TA_27240
tcaccaagctccaacgagtcgcaggtcaaagcctagaattctagacctctcatctactagaaatcagcatcaaattcaaattcagatagtctggtatttttatattcacattctgcttttttggatgcccggtcttgggccggtgctcttgttagttccatagatgacaaggaagaacaaattttatttcccactcacacacctgtgccctgtgagaatggaagaactgacgtttctgcaggagttgtcggctgccacataatatacacataagaacagttggtttaacatttttctgttgtaaatgtctggacaaacaaacagctatatatacaatgcttagcatgatatcagcgaagtgatgaatgtaaacagaagggctactttctgggatcacttcgctccgcagatagtttccttgtcttcccaaactctagtactgtcggtggtgtaagattgctaccatttaatgagtgttcatgctcggcggcagaatcgagtgctactgaattattatcatcttccctctgaacaaactcgtctttagaccctgcctgggcatcttcgggtgaacctgaatgcatgatatgtggatgtacggggcttatattctcagctgtggctaccgaccttcgacgacgcatcttaagccttgagcagtaggaaaatgtttgatgtcttggatcaactcccttgcccacaagctccattttccaggcatcagccttcagactaacattaacagcctggcattcttcagatatccaaaactcaaagtggaataggtcatgcgttgagttcaagtgacaccccaggccctggtatcaccagaatcacaacagagatgtgcctcgagaaagtgcgcacaacattgttcccataaaaaataagaaaggtcgagcagaaaaagaacaccatctaagtttcctcacaaagaacaagaaggcatcaacggtgcagcgtgaactaaaacgatttcattttaccctaaatgtagcaggtgacatgattcaccggcccttagcagcaataagcaacatttcgaatggaaatttgccggacgcgtgggcggacgcgtggg

SEQ ID NO: 27241 - DNA, 2415 bp, Triticum aestivum
  unsure (1)..(2415): unsure at all n locations
  Clone ID: PAT_TA_27241
ttctttttgactttattctttttgcttgcatccaccactatttggatcgagagctgaatgttcaacaaatgacatttctatagtagggggggattttattaaagggaaagtaaaggaagtcggtcgtcgcagcatcagcgtcttggttaaagaaaattagcccgcaaccttggtcccctttttttgggattcatatcatgcgtaatcaacgtttccttcctggaattatgaagtcttcttcgtgggttgctatccctcaagaatggtgttgcatgtgttcatggcgcgcgcatccagcaggctgtggttccacagcttaatcatcaccaaacgccagcaccagagcagaggagggttttgtacaagctgcggtccatgaagccgggagaagccctcacaggcccaaggtatatgcccatcagctagcaccctttgtttccgaataaatgaattccacatatgcataataagcttctcatctttcgtgacatcaagaaaatcagcaagcatccgtctatcttccaagtcggcaatgtcatcgtcaacttcatcctcgctgtcatgatctgacaaaacttgttccactgccattggctgtgccctgtgagaatggaagaactgacgtttctgcagaagttgtcggtttctgggatcacttcgctccgcagatagtttccttgtcttcccaaactctagtactgtcggtggtgtaagattgctaccatttaatgagtgatcatgctcggcagaatcgggtgctactgaattattatcatcttccctctgaacaaactcgtctttagacccagaccctgcctgggcatcttcaggtgaacctgaatccatgatatgtggatgtacagggcttatattctcagctgtggctaccaaccattccctaaccttctacgcttcttaaaccttgagcagtaggaaaatgtttgatgtcttggatcaactcccttgcccacaagctcagttttccaggcatcagtcttcagactaacattaacagcctggcattcttcagatatccaaaactcaaagtggaataggtcatgtgatgagttcaagtgacaccccaaacccttgtagcttccacattttaccaagcagaaggggcaagcaaaatcttcagtgacttcagtcttttgcatagtattgttgtagtacttgaagttgaaaagcacattaccagctctcaaccttatgatatgtggtaatgaagaaggtgggacatctatttcccactcacacatattgtgcgatttgggaatggaagaactgcacgtttctggagcagatatgcgtactcgcataatatacacacccgaagcatcaaccttatgagagcaaaatgtcaagcaactgtcctgctccataaatttcggctctaagaaacttgggctcatactaactgcagaagccaactcccactgtatgtcccaaatttaaagttacacagttctccaaagacgaaccaagttctagaactgtcattttacccagattgctaccatttaatgagtgatcatgctcggcagaatcgggtgctactgaattattatcatcttccctctgaacaaactcgtctttagacgccgccaatgccggggcttcggctggtgttacggttgccagctcgggtggatggacagggccttgatgcccagctgtggctaacggccgccgtcgacccacctttagccccgagctctaggaaagcggttggcgtcctggatcaactcccttgcccacaagctccattttccaggcatcagccttcactcgtacgtgtaccccccggcactcttcggggatcgatattctgttctggcaactcactatttgtaagttcagatagcgatccagtcacctgtagcctcctttttcggcttgcatgtatcctctaatgaaggcatctttgcagaaaagcgggatttctaatggctcgccgctgaatgatattgtatagctcaactggcttgcagtacaacgcgaaactgtcttcagcggcaagcggcccacattgaatcagtcccgcttccagctgtttgctgggcggcatcctggtcctgcagacttgagggtaacttgaattcacaccccagcgtccgctgcgtccccggggcaggtaaaggtaggccaggcatcctcctcgctgccgcncgagcgcctcagggtcgcggacgggcggatttaacaaggggcatcaaccggcggggactggtctagatggtgcgccggcacaccagaaatctcaaagaccgatgtcgaagctcgcggacggggtggagagagcaggtacggcgatggcggcggcgtcgaggcgcgtcagtggcggcgaagttccggtcgtgaggcgtcggcgacggcgcggcggcggagagagattagagccgcacctcagcccgg

SEQ ID NO: 27242 - DNA, 702 bp, Triticum aestivum
  Clone ID: PAT_TA_27242
tgttttttttttttttcttagaagataatatcatcttatctttcttctcagagagtttaacacattattgttgggagaaaatacatatagaaaaagagtagagcccagagccaatgtacgtagcatttaaatggcgtgtcgcagcacccatggtcaagctagttttaggagaattataaccctcacggcaaatgtcgcagcacgcgtgatcaagctagtcttaggagaattttagccctcacaaccataacctcccacatatacactatattcttcactgccttgattttgaggtgacctgccttgatgctaatccaccacccagcttctgcagacacttctggtcaacctcttgaggtgacatgatccgaatggacttgatgctgatcacaaactcctcccatgggccatcaccgagaagtaggaagtcaccctcatcatcctggtagagacacgtccaacctttagtctgtcgttcttcgagttgcccttcgatgccaaacatgtgggccaaagcttgattcaattctccgtatccagagaacctaccgatgtcaatggagcggcctataaccccacgctttgtgcaccttaatgagtggcatcctctggcgaaggggcaaggcaccaagaatttctgaccacgggcgggcggagattcggctgccgagcagaacagagcagaaggcggaggagcccccc

SEQ ID NO: 27243 - DNA, 698 bp, Triticum aestivum
  Clone ID: PAT_TA_27243
ttcatcatcacacacacagccatataaacagtcatatacatcctttcaaaaagaaaaagaaaaaaacaatcgtatacatattcatacagtctgcacgcaagacggatgttagcaccaatgtcaatactgtatgtttcggcgatcggtggaaacgcttcttacaagttccttcccggaaggaatggtgagatcatgctaatacttcttggcgttggcattaatggcgaggacgttgcttgagagctccgcgagcaccttctcgtaaccgcccaggactggcttcagctgcgggcggtcgaggaaaccttcgtcgcaggtgtcaacagcggtgcgcgccgcgtcgagcgcgctgcccgccgtccccttgtctcctcgcttgagcgcggtcagcgccgagtcgaactcgtagttcatgtcgtcgtaattactgatgcagtctttgatggcgcccttggagagcttgtccacgtgcgggtccttggacacgtccgtggccgcgttcttcgcctccacgatcttggcgcgcacggcatctatggccagtgtcagcacgcccaagaggttcttctgccgccctggcaccgccgccgtctccggcagcctggcgatcgatgcctcacactcgtacgggtagctcgtcctggcgcacatggacttcaccaacgggctcagcatccggagcaccggcgggggcaccg

SEQ ID NO: 27244 - DNA, 826 bp, Triticum aestivum
  Clone ID: PAT_TA_27244
aaacaagtcactaataaacatcgaaagaaagaagggcctggcagatattgacattccgttctggtgagggaagtacttgtaatactcgtaactgacagtcgatgccatggcgacatggaacataatttttttacagcaagtcgagacttgcaccaaataaaatgccagatttttgtttgcaggctcaatcagcagggactcgccatcttctcaccgccctctcaagtacctcagcacgttcatgcacgcgcgctgcttcctgctccacccaggaccttagcatagtaagagcttccttctcagcttcaagatatgatttagcttcagtgacagcttggtgcttgctgctcatatcagaggacaacttttccagattttcttcatcagccatgacctctagactctcagtggccagcctatcatacatgccatcaacttctgaccttaaacatacgagttcctgattctgacgctctaaagctgatttttcttttagcaagtctgcaatttccttttcttgatccgtcctctcatttgcaagctcgtgcagaacatcttgaagatgcttctcaacttcaaacccacggtcttgctccttttttatcttgacttcccaatattgttttatatcccctctattaattaactcttccatcatttcacccatagcagaaagccgggactgattttctgcttcaagtctatttagttcatcacgtactacttcttccattctaccactggtcagtgcagcagccgcttgtgcttttgttacaggcttatgatgttgaagccgcctggtgtttccaaaaaccccacgcgtccg

SEQ ID NO: 27245 - DNA, 696 bp, Triticum aestivum
  Clone ID: PAT_TA_27245
accgggccacaaacaccattcgacaggattcaagaacttatcaatttcagggccattcacccgccgtaagtcagcgtggttactctcacgctccagattgttatggcatgagcttcgccccacagccaagctcataccaaaacaattactcacatgggtggcctgaaaaccagaatatgtcatataggagcaacaaccctgagatctcatcgtttgcctctagttatccaatgcagggatttaggtacaatgaggagagccacaactatgcaccacaacaattttattcacctcctactcatatgcctcagcaccaggagatgttgccaatggagttaaatggtcctccatttggtcaaccaacaattccagcacctatcgtgcaatctcatgtgcaagtgcccacacaagatgagttcgatgacatagacaagctcacacttttgtgcgtcgagttcacttgggcgagccgtgtgctccacacaattgggcctcagcgatacctcacaggaattttaaccacgatccacggacgttgcacagcaacggtagttggaaccgtaaactatgaccggaattccatgtgcccaaccaacaaatgctccacctcatgggccggctcacccatctcatgtgcaagtgcccacacaagttgagttcgatgacatagacaagctcacactcttgagtcttgag

SEQ ID NO: 27246 - DNA, 1641 bp, Triticum aestivum
  unsure (1)..(1641): unsure at all n locations
  Clone ID: PAT_TA_27246
acaccatggggacggcgtgcaaggaggggacgcacgtcgggatcattccgcgagccatggcggcattgttcgacaagatcgagaagctgaaaaatcaagtggacttccagctacgtgtttccttcatcgagatcctgaaagaagaggtgcgggatttgcttgaccctgctactgttgctgctggcaaagttgagaatggcaatgggcacgccgggaagttgtcggtgccggggaaacctccggtgcagattcgggaggggtcaaacggggtcattacnctgtcggggtcgaccgaagtgcatgtcacaactcagaaggaaatgaccacatgccttgaacaaggttcgctgagtcgcgccactgggagcaccaacatgaacaaccaatcaagtcgttcccatgccatcttcacaatcacattggagcagatgcgcaaagcagaccccattatggcatcagatggaatgcctattgaagagatgaatgacgattatctatgtgccaagctccacttggtagatcttgcggggtcggaacgggccaagagaactggttcagatggccttcggttcaaggaaggtgttcacatcaacagaggacttctggcccttggcaacgtcataagtgctcttggagatgagaaaaagaggaaagaaggtgcgcatgtaccttaccgggacagcaaactcactcgccttctgcaggactcactcggtggaaacagcaagactgtcatgatagcctgtattagtccagcagatattaatgctgaagaaacactgaacacattgaaatacgccaaccgggcacgtaatattcagaacaagccaattgtcaacaggaatcctattgctgatgagatgaaaaggatgcgccagcaactcgagtacttgcaagcagagctagttttagctcgcggaggaggagtaggatcagatgatgttcagggtctcagggaaaggatctcatggcttgaacacacaaatgaagacctttgccgggagctttatggccttcgcaaccatgttcacagtgatccatgcgaacctggactacataaaactgtaagtggctacaccaaagtgaagggctcaaacgaagcttgcaaagtacggagccatttgatgtccttatgactgattctgtacgagaaggcaaccctaaagatattgacgatgaagtagccaaagaatgggaacacacaatgctgcaggatagcttaggcaaagagttgaatgaattaaacaaacaactggagaaaaaggagtctgagatgaaagggtatggacatgatactgttgcacttaagcaacactttggaaagaaacttatggaacttgaagaagagaaaagagctgtacagaaagagagggacaggttgttggctgaagttgaaagcctaaatgcagatgggcagacacataaggtgcgagatgcccaactgcaaaaacttaaaacctttgaagcacagattctagaactcaagaaaaagcaggagagccaagttcaacttctgaaagaaaagcagaagagtgatgaagctgctaagaaactgcaagaggaaatccattttataaagtcacagnaaggttcaactacaacacaagatcaaacaagaagcagnaacagttccgggcaatg

SEQ ID NO: 27247 - DNA, 435 bp, Triticum aestivum
  Clone ID: PAT_TA_27247
ctccgtctcaacatccattctctgttctacaggagaaattacatcagccagtactattgcacccccttcatcatgtcgtccgccgctctcacctggaactacaggagctggtaattgcgtaggcggggtggtggtctccgcacatgcttgttgatgtgtggtagttattggtgtgctctcggccggctccagacgaataagattcttcatccatagcagcacccaacccttgcagcttccaatccgcggcggggtctcgtcgtcctctcccacatgctgtactggaggaggcaaatcctcgtgccccgatttcacactggacaagctaaccctgaagtacccagcggggatcggctggttgtggaacgtgcgttgcgaggggtccattatcatcccctttcctacgtccaccttctggcccttgatcaagtagag

SEQ ID NO: 27248 - DNA, 794 bp, Triticum aestivum
  Clone ID: PAT_TA_27248
ccacgcgtccgctaaaagcaggacggtgatgatgacgacaatgatgatgagaaaaaagagaagaaattgaaaaacaaggatgacgacgatgatgatgagaagaaagaaaagaaattgaaaaacaaggatgatgacgataatgagaaaaagaaagagaagaaatccaaagagaaaagcgactcgtctgaggaggatgacgccgagaagaaatctaaaagcaagagcgagtcctacgaggacgacgatgacaataagaattccaaaagcaaaagcaaggcatcagacgaggattttgatgctgtccccatggaggccaaggccgacgaatctatgccaggtgtcgacacgcccgatgaataccaagcgtcgacgactaaagccaagccacggttgcccgcggctgacacccccggtggctacaccgcgcggaccgcggcccaaccaaagatgtctgcagcagacactcccgacggctatgccaccctgacaacgcagatgtcagctactaacacaccagacggctatgtcacgccgagcaaggcccagccagcgacagactcacccaacggcaaccgtccctgtgaccgactcaccgacggcaacgtcccggcgacagactcacccgacggcaacgtccccacgaccgactcgcccgacggcaacgtcccggcgatggactcgcccgacggcaatgttcaggtgaccgactcgcccgatggcaatgtcccagcgaccgactcgcccgacggctacgcggccccgacgaagcccgatgtggacgtgcagtcctactc

SEQ ID NO: 27249 - DNA, 934 bp, Triticum aestivum
  Clone ID: PAT_TA_27249
ggtactgataagagctcccagcatccaaagagcgtttttgatcgtaacatgcaaaaccactacacaagtacgttctacctttttacaggtacatatacacagaacgaacattcgagaaaagactactgtggaagcagaagcactcctgaagaactaatccagtgcgtagagactcggctcagactgttccttcctcattgcctcaaccgcctccctatgcgcctcctgcatctccttgctgttaggcgccagtttcattccagccgagaacgcatcagaggcctctttgtactccagaagagacataagggcggctcctttacggtagtaacctttatgccacttagggtccagacttatgcaagcattggcatccatcaaagcatcatgtgcttcaccacacttcagatggcaaaggctcctgttcgaatacaacaccgcgtcagcgggatccagcttgattgcctctgtatagaattttgatgcggtggcatagtccttgccctcaactgcttttgcaccttgtgatttcagccgagccttcctatctttgtcacttgacttgccctcagaacacaattttgatgcggcaacatagttcttccccctaacagcttttgcaccgcttgatttcagtggagctttgctatcactgtcacttttcttaacctggttagctggaacattgatattggcgccaacctccaacaagtatttaaagcatgtggttaagccattgttagttgctattgccaatggagtttcaggaattgtacaattgacatccgcgccagccttgacaagaagtttcacgcactctaagcaggtggactcattcattctgtcaggagtagcatagagtgctgtggtcaggggtgtaccaaagtcccatgagactttgttcggatctgcatggtgctcccggacgcgtggg

SEQ ID NO: 27250 - DNA, 1139 bp, Triticum aestivum
  Clone ID: PAT_TA_27250
gatccagagcacccacgcgtccgcacacgcgtgggcggacacgtggcgatctccttccccttcccccatactcttttttctccacacatcgttgcgacgcgtcgctgcgtcagccgacctggctagccagttcgcccgctcggggtggcgcgcggcggggtcggaggaggtggatcggccggcggagatggggcgggggaagattgagataaagcggatcgagaacgccaccaacaggcaggtgacctactccaagcgccggtcggggatcatgaagaaggcgcgggagctcaccgtgctctgcgacgcccaggtccgccatcatcatgttctcctccaccggcaagtaccacgagttctgcagcaccggcaccgacatcaaggggatctttgaccgctaccagcaggccatcgggaccagcctgtggatcgagcagtatgagaatatgcagcgcacgctgagccatctcaaggacatcaatcggaacctgcgcaccgagatcaggcaaaggatgggtgaagatctggacgcgctggagttcgaggagctgcgcgaccttgaacaaaatgtcgatgccgctctcaaggaggtccgccagaggaagtatcatgtgatcaccacgcagactgaaacctacaagaagaaggtgaagcactcccaggaggcatacaagaatctgcagcaggagctgggcatgcgcgaggacccggcgtacggattcgtggacaacccggtcgcgggcgggtgggacggcgtggcggcggtggcgatgggcggcggctcggcggcggacatgtacgccttccgcgtggtgcccagccagcccaacctgcacggcatggcctacggcggctcccacgacctgcgcctcggctaatcgatcacggctattgctcctactagcttatatatcgagtgatcaagttaccacaataagaaaaaaaaatctgtgtgtttgtatttgtgaaatgctgtgatcgatgatgccttatgtcggtctcgtgcacatgagtcagttcaatgtgtaattaacgccgtagtgctcgactgtgtattgtattgcatgatgtgctatgactttggttgtgagctacttggtgctactatcatagtatatattttggtacttgtgatgatc

SEQ ID NO: 27251 - DNA, 814 bp, Triticum aestivum
  Clone ID: PAT_TA_27251
gaagtgtcacaactgaaacaatttttgatacaaaagcaaaacaatgtcgcacgactcaccacaagtagactcaaggtacaatacccgactcagcatcaaactttagtacagtgaaattgttcgcagtatgctctgaatatctttgcttgtcagaaaccccgaccatcgttcaactatgaatcgtcagtaaaaatgcatacagattactgctgagatgatggttcccagccgatgatggacgcacaccaagaggatgctactccacacttgaatttcattgtcttgtttgtgaaaaacatcaacaaacaattcaggtgtgcccgcgacctccgcacgtggagcacataatgcttccagttcctccacagcctaggcatctgacttttacgatgattccttggctctccattatagagtcgacgtacaagcctgaaccagcgcaggttgcgcacagcacagcacctttagtttcgcagcgcacgcatggggggttcttcccaacctccttcttttccaaatctagaccagctggtttcccaatattctcctctggaacagctttgtcgtagcagaacagtgcttccaagctactcctgcttctttgcaggtcattaattgcacttgccctgatcttggcggagaccgcgcgggacgcgggccgggccgaagggagcagccgtcgcaggggccctccgccgcggtggagaggcgctgtcgtcgagggcggcgggcggagcctgccgatggaggtctcagccaggctccgctgtcgtcgagggcggcgggcggagcggacgcgtgggcggacgcgggg

SEQ ID NO: 27252 - DNA, 803 bp, Triticum aestivum
  Clone ID: PAT_TA_27252
caacatggtcctttagtacagtgaaattgtccgcagcatgctctgaacatcgtccaactatgaatcgtcagtaaaatgtatacagattactgcaaagatgatagttcccggccgatgatggacgtacaccaagaggatgctactcacttgaatttcattgccttgtttgtgagaaacatcaacaaacaattcaggtgtgcccacggcctccgcatgtggagcacatgatgcttccagttcctccgcagcctaggcatctgacttttacgatgattccttggctttccattatcgagtcgacgtacaagcctgaaccagcgcaggttgcgcacagcacagcacctttagtttcgcagcgcacgcatggaggattcttcccaacctccttcttttccaaatctaggccagctggtttcccgatattctcctctggaacagctttgtcgtagcagaacagtgcttccaggctactcttgcttctttgcaggtcattaattgcacttgccctgatcttggcggagaccgcgcgggaggcgggccgagacgaagggagcagccgtcgcaggggccctccgccgcggcggggcggcgccgtcgacgagggcggcgggcggagcctggctgagacctccatcagcaagcacgcgctccggttggtgggaaattttcaccctcgcctctcctccgtcgccgtcgccagtggggggtgggggagaagaagaggggcggagctcctcggattgctcgtcgccttccccagatttccaaagccgagcttcggtttcgtcgcccggacacgaaat

SEQ ID NO: 27253 - DNA, 764 bp, Triticum aestivum
  Clone ID: PAT_TA_27253
gccgccctccaccctctccatccatggcggccgccaccacacaaagacaaaggctggcagccaccgcaacctcgccatccatggcatcttcccctccgcatcctgaagcccggacgcgtggggccgccgcaacctcttcatccacgaacatctacctctctaccgccgcatcgaccatctgccgtcacgacgttagcctcgtctagtaggcggggacgcccctaaaggcggacctagtgcatgcgtcgctggttcccatcttgctgcaaggagcgaccaggtccctcgtgggcgtgcagaagctggatgggccggacgcgatgactacgggcgtgctcaaggtcccgcttcagcctccacctgatggagtttcgccgcatcggaccggcgggatcctcggcaggctgtgagctgcaagtcccaacaggcactacaggttcgatggtgttttcatcggttgagacagagtgccgttcagcagcatggtttgaggcgagatggtagcgaaaatggtgtctccctctgatgacctcggcgggtacggccgggtctgtggccataaaggcacggggattaacgaaagttgaaatatggcgagcgccgccggcgcttgaagagctggagagtagcttagtgtgtctccaggagaatatttgtaattttaagtttttactgatttttttgctcctgtacatgtgtatttcctggtctgtttatgtaacatccattttagtgaatgaaatgagcatatatatttttcggat

SEQ ID NO: 27254 - DNA, 991 bp, Triticum aestivum
  unsure (1)..(991): unsure at all n locations
  Clone ID: PAT_TA_27254
accntgaagacaccttggttgtcttctgcccccgagtggccgcccgccctttgctacccttcccttccccataatgtttgcttcctgtggggtcgccttcctcctgccaccaggtattgagcctgatcttttccctccatgctcctaagcatcctggcgatctgcgacctttattctgattaagcgcatttcccaaccagaagggttttgatccctttaccccctgatttccctaggaaccaaatctaggagctctttctccagaaaattgttgtttctttctgggcctaccttcgttcaaggtcattatctgggtatccaatatccggtggtactattatccttctaactccaccgggacgcatgcctgtcatagcctcctcaaaggctggtattacctgtcctgatccaaccttgaacttgaagaattctttatcaccaccctcgaacgaaccacctttggtcttgtttcgagcttcaaaaatgcgaccgtagtatccaattgtgtacccatcccaatcaatcactactgtctctcccttctttggggatgggccctctccaactcgcaagtccttgtattggaggcctgattctgtttcagtgtaatctggataactcattttcgtctttccataatccttcccacgaagcgctggcatgtcagtaaattcagcttttgctgctcccttctccagactgtactgaagggagccaatggtgagactaattgcagggatcaacagtagtctccttctttctaccataccaccgtggcaagaagagatgacccgagcacgacggcggcggccaggagaggaggagaactcgaaggcggagtgggcaggtcttgtcctatgaacagccatcttcgagacggacggggtagcggctgggcgggggaggagcggcgcctgccggcgaggcgccgggaggccgggacggcacgccggggatgacatggggacggacgccggcacccacagatctc

SEQ ID NO: 27255 - DNA, 754 bp, Triticum aestivum
  Clone ID: PAT_TA_27255
ccgggtcgacgggtggacaagattcaccttacttgggatataattcacttaaggattttttcccaacaatggaaatgagaccatatccacaatgttcaaacccagcatgtcttgagagacagaaagaatatatgcaatcaaaacctgctagagatgcagcagcaaaggctaagatggaagccgaagcatccgcagcaattgaatacccggttcacatggataacgagtggaacattagtgttcttgatgatagtgacacagcaacgtcaagcgttcaaagggctgcaacagacatccttccagaaggccttgtccgtgaacttccagatgaagatacctacgtggaaccacctgctgcaccagccagctgtggtgccatcgatgacgatctcgaggagctccagcggcaactcgacgccctaaactcatcttgacctcgcgcagatctggctcaaacagtgcattggaaaaccaaaccagatgccattgtttgcgtcccttctgacagagttagccatttcagttgatatagcctctgcttgttctaatcgagcggagaaatgttagctgcattttctagtcatgcaattttggatcgggtgatttagattttaagaggcgggtgttgatgagagttccgctatagacagaggttgaatagaacttatgaaccgtgacagcatatactgtaaaacctgtactgaactttctgtaagatgtgtgcctaccgacaaaatcatagataccgtgtttt

SEQ ID NO: 27256 - DNA, 891 bp, Triticum aestivum
  Clone ID: PAT_TA_27256
gtagcatcaggagtggacgagcgtacacttaagcgagatggtgtttgtgctgcttctttgccaactacaatgggtgttgttgctggactgctggtccagaattctctgaaatatctgttgaagtttggtcaagtttccccttacttgggatataattcacttaaggattttttcccgacaatggaaatgagaccaaatccacaatgttcaaacccagcatgtcttgagagacagaaagaatatatgcaatcaaaacctgctagagatgcagcggcaaaggctaagatggaagctgaagcatccgcagcaattgaatacccggttcacgtggataacgagtggaacattagtgttcttgatgatagtgacacggcaacgtcaagcgttcaaagggctgcagcagacatccttccagaaggccttgtccgtgaacttccagatgaagattcctacgtggagccacctgctgcaccagctagctccggcgctatcgacgacgatctcgaggagctccagcggcaactcgacgctctaaactcatcttgacctcgcgcggatccggctcaagcagtgcgatgaaaacccaaaccagataccattgtttgcgtcccttccggcagaactagcgatttcagtcgatatagcctctgcccagcagagaaatgttagctgcattttccagtcatgcaattttgaatcgggcgatgtagatcttaagaggcttatcagaggagcagcttatggaagcttgctatagacaaagaggtttgatagaaattgtgaaccgtgacagcatactgtaaaatcatgttagtagattggtactgaactttccagcaagaagttaaaaaataccgtattttaccaagaacgtaaaaaaaaaaaaaaaaa

SEQ ID NO: 27257 - DNA, 1032 bp, Triticum aestivum
  Clone ID: PAT_TA_27257
gccggccgggtttcggaaagtcggctcgtcgcccccgcgctccacgcgacagcactccgatccggacagccgctgccagcactccaacggatccacccggccggccggcggcgaccatggaggaggagctgcacgcgctgctccgcgacctcgacgcgctcaagcagctccccgaccccgcctccatcgaccggatgcgagatcgcgtggtgaagatgatgggcccgtccggcgccgctgcgacggccacccggtcgaagatcaaggacatgagcgcggaggtggtggacagcaacccatacagcaggctcatggcgctgcagcggatggggatcgtcgacaactacgagcgcatccgcgactactctgtcgccattgtgggtgtaggtggcgttggtagtgtagctgctgagatgctcactagatgtggaattggacgcctcttgttatatgactatgacacggttgagttggctaacatgaataggaatttatctccgccccgaccaggttggaatgaataaaacggatgctgctgtgcagacacttagcgaaataaatcctgatgtcgtattggagagttattctttgaatatcactacagtgaaaggatttgaaacatttttgggaagtctcaaagctaggatctctaagtgatgcaatcatgggtggggtgatttatatgagctgaggcgggtgctgatgagagttccgctttagacagaggttgaatagaagttatgaaccgtgacagcatattctgtaaaacctgtactgaactttctgtaagatgtgtgcctaccgacaagatcatagattccgtgttttaccacaaacatggctttgccaatgggcgcagcactggagttgatcttgttttgagctgtgttgataactatgaagcctcgtatggttgtcaatcaggcttgcaatgagcttcgtcaaacatggatgggaatctggtgtgtctgaagacgctgtttctggtctatacagctattagttcctgggtgaactgcatgctttgcatgg

SEQ ID NO: 27258 - DNA, 749 bp, Triticum aestivum
  Clone ID: PAT_TA_27258
aataggagtgcttgaagcacttctttggaggacaaactctaccttcgctatttctgaacatggagcacggactaacatttatgatgaggggaaagcgattgttcaaaagcacaaggctactcctgaagaagtagaggttcagctaactcaatatcgtcaagacggcatgccagatgaaaaaagactacatggattaaaagctttggctgaagcttctatcattgtgagggagctgaccccattgacgaatcatttcatgtgtgcttggttcaatgaagttgttcgtttcacatctcgggatcaactcagttttccgtatgtactatggcgtctaaacatgccaggaatcaacatgtttcctgtgtgcactcgaagggaccttgtgaacagtttgggtcacacaaggaaagtaaaacctcttacacagacgaatacagattcttccacggcatgacctttcttcttgttcatttgcggacagtcaactaaccggtggtttacgtggttctaggcttccacttgccttgatccacagttttgttgtaaattattcttttgattttcttcctcgagaaacatcatgacttggttgtacaaggacttgcacctgttacacttcaaaagctgttgcttttctgtatgttgacattattacctgtacaaatcacgttttcttttgtttggaaggagcagtattcttcttccattttactgtatgaacgttacctcccaactaaaaaaaaaaaaaa

SEQ ID NO: 27259 - DNA, 793 bp, Triticum aestivum
  Clone ID: PAT_TA_27259
cggacgcgtggggcagcatcttgttatccaggtttagttgaattccaaggagttttttataccccggactctggagaaatatactttgctcttgagtatatggatggtggttcattagcagatattatcagggtcaagaaattcataacagaaccagttctttcacatatgctacagaaagtgttgctagctctgcgctacttgcatgaagtgaggcgtttagttcacagagatataaagccagcaaatttgctgctaaatctaaagggtgatacgaaaattacagactttggtgtatcttctggattgcatgattcagttaccatgtgtgctaccttcctgggcagtgtcacatatatgtctcctgagagaattcggaacgaaaattactcatatgctgctgatatctggagccttggactaacagcattggagtgtgcaactggaagatacccatatgatgtaaatgggggcgaggccgacctcatgctgcagatattggaagatccatcgccaacaccaccgcaacatatgcattcagaagagttttgctcgttcatcgatgcttgcttgcagaaagatgctgatgcaagaccaacatgtgatgagctttagtctcattccttcatcaagaaatacgagggacctggtgtggacttggcagagtacaacagaagtgttcatgatccagcagaaagattatcacaaatagcacatatgcttgctgtacattactacctgatctttgacggtggtgatgaccaatggcatcacatgaagtcattctatggac

SEQ ID NO: 27260 - DNA, 1218 bp, Triticum aestivum
  unsure (1)..(1218): unsure at all n locations
  Clone ID: PAT_TA_27260
ctggtgcggggtggggtcagagtagcaggagttccaggtgaagctcgcgtcatggtggagtggaggagctcgtcgtacatcgccaccatccccaatctaggttgctccccctcctccttccccaggtattatctcagttctttgattctgtgattttgatttctcaatttgtgttttttcagatctgagatataaaaagaaaagaaataatctcgtggaattttagatctgcaatagaaacgaagagaaataatcttgtggaagagcctgactaaaaagaaaggggtgaatcatctgtttctcccatccatgtttgtttttgcaaattttgttaagatgcaggttggctattcttccttgttgtcagaatctgaagtatttgaccatctgtagccacttctatcatgtgtcgtatccttactctatttcaagttagttgttgattcaaacatgtcaatgaaagacaataatgttaaattggttccccaaaggccaaggtggtgatgatcactttgtgcttcttttcctttcgttaaaaaatgattcctctggttgatgttgacgtaggtttttatggtcatgtcaaccggtactccaactggcactgagatgaggtaatggtgtgggaattggggctgcaaggacgtgaaaatggcctagaagagagttagcaatggcatgcgtcctcaagtaatttcttgccaatggttttacagtgaaaagctgaagaagttgtgacgacaatgaaaggactgaaagatttgctcaaagcaaagacatctagccgagatacatgtggaacgaagaggagggatcttatgtagaatatgcgacttccttggtgctgaaagtgtgctattaagtctcagttgctcctgcaaaataggatcttaataaataaaggatatgcatcgccaagcagtttgttgtgtattttttccccttccaaccttattgatatgcctgttgctcaaggtgtttttacttgtttacatgattaacaagtgaatataaatttgaaacacaagttaataaatttagcgcagtccttgctgaaatccgtattattatatgttgactttcctttgataatataagctggtcttgttgccgcaatgattggtacgcttaattattttcatgcatacaagttgattgggtatcctgnatacattattacattagttaaaaattatgtttgtaatcngtaggaaccaa

SEQ ID NO: 27261 - DNA, 2245 bp, Triticum aestivum
  Clone ID: PAT_TA_27261
ggaggggctgcagcttgctgttgatgtcctcggctccaagaggcggcagaggtcctcggggatgcaacagcggctctgggaaggtggcgtcccagtggaggggaggcgttcatgggtacccggcatggcaggcatgcgaagtgccaggggcagccggcttgccctccgctcgaggctgaagcttcggcgggtggcatacaacaccggcgggaggagcctcacggacatctgtgaaaagtataaggtgtgcaaaagctgtggggtttctgtttttgagggctttggtgatctatctctcaaggatgatgctgatattgaccacccaagtttggctgttgagggagatgattgttccccgaacactgatactttggctcaagacacaggaacacttgttaattcagctggtcgtttctcactgttgcagaagtgttcaaggcttttcaagttctctcctaggacaaaggccgagcagtcatcggaacaggaagcggaaataaacattccttttggtgcgagattagaggaagcatcaccgagtgaaggagattatgagccaactcctgtctatcaggcagcaaataattcttttgatgctgagggtctcccttctgccagtggtgcaagggcggtgggggttcccgtttggcgggctttggcggtcgatctcccgagcgtgtcgccgcttggagtcgcagataattgtatagctgttcatgtaagtgagccatttgctggtgctcatgacatggcggctgacacaacaattgcctctgtgccccaaaatggtaaggactcaacggctgcccctggcgtttcaagttctctcctaggacaaaggccgagcagtcatcggaacaggaagcggaaataaacattccttttggtgcgagattagaggaagcctcaccgagtgaagcagattatgagccaactcctgtctatcaggcagcaaataattcttttgatgctgagggtctcccttccgacagtggagcaagggggaatgaagaatccgaaaggcttgatatagctgatgatatccagatcgagtcttctgttggagtcgcagataattgtatagatgttcatggaactcagccatttgctgctgctaatgacatgacagttgacacaacaattgcctctgtggaccaaaatggaaaggactcaacggctgcccctgaagtagatttgcaacctgaagcatcaaatcctccacggtaggaggtactgatcaagaggggtgaaaaagacaaagtcggttcgtgcagtgcttgaagatgctaaagtaattcttggtgagaatttagatgaaaagaatgatgatcaggaagattcagttactgttggtggtacacggaagaggcgccttggctggaccagatatcagtgaacaaggtgaataagcgatgcccatgacaccatcaggaagtgagcgtgggggcgtcgaagatgatgatgatgatgatgcccagcggcgcaaccccccgattgagaaacccttcaatttgtgccgcacgacagatcgcgagggcggctgagaatggcatctcattaggttgtttctagtgtgtcttgttttgaattgacgagccgtcggtagaaactactgctgatgacacggaaggaacctctaaagctgctgatagcaagaggacggggccttctgaatcagctgatggtgcatcgcagttgcaagagttctcccaggctgaaactgttgatgcccatgctactgccggtgaggagtatggtgatattgttgtggatggtgaacaaggtgaagatgcgatgcccatgacaccatcaggaagtgagcgtgggggcgtcgaagatgatgacgaggatgatgatgatgatgatgattcagagaggcaaaacaaatcgattgggaaaacgctatggtctttcttcacgacataacaagaggaagaataagaattgcatctgattaggttgtttctagtgtttcttgttttgcattgacgattcttggaactctaggttgttggtgtgttcggtgacgattcttgtagattttcttgcactcgttatgtcaaagcgtcatgtaattgggaatgagtatattttgtagtcagacatagtttgatggatggcgctcacagaatttaggtgatgccccatgtactcatattatggcagcgatgcctgtaacagtcgagagttgttgaggtttgtaattcttgttccttatcccacgtccaggttacttacttttgtt

SEQ ID NO: 27262 - DNA, 431 bp, Triticum aestivum
  Clone ID: PAT_TA_27262
gttttgtgccacatgatgccaatcatgcatcattcgttctctgaaacgccttggattgacctatccccacaatgtgagcggcgccgatttgaaggcgcaaaggaggtgctggagacatgggcggagatagtgatgaaggtcctccccggggatgtgctttcggcgtaatttgtgtgctccagcttccgcaccatcaaaccgaccaggatatcacgatatcgcggttacgtgctggcaacattgtccttgctgttttctgccatcgcgatggcgtcaattttcatttggcagtatttcgctgctgcccaaaacaataaccttgcttcccagccatcttagacatggaccttgtaacactttttgttgtaactaaataaatttttgttgctgtaactgtattaggcttttattgtatggaagaatatccccct

SEQ ID NO: 27263 - DNA, 1306 bp, Triticum aestivum
  Clone ID: PAT_TA_27263
gagttcggcgcggggggagctggaggttcgcagttggtgcgcgagcgagacagcgagtcgcggcgatggcggaggcgggaaagccgagggcggcggcgccctgctcgccaagacccggcacccccccccccacgtcctccgcccccacccccggcgccacccgccgcgccccggggctctactgggagcaaaggttgaaccatcttttgctgagagatcattaatatatcacagagattacctcaccactgctactattgtaacatcttctgcagtcaatatcactgagcatgctgttctgactgctgatggtcaatcacttgcatatgattatctcgttgtagctactggccatgtttttgcttctgctggaagcagaacagagaggcttgcggaattccagagagataacgagaagataaaatcttccgaatccgtgttgataattggaggtggtccaactggtgttgaacttgctgcagagatcgcagtagactatccagagaagaaggtgacacttgttcacagaggatcacgattacttgatttcattgatcaaaaggcttcgaagaagtgccttgattggctgacttccaagaaagtggatgtgcttatactgcaatcagttgacctaaaatcattatcagacacatagaagttctacaaaacatcagctggagaaacaataacagctgaataccactttgtgtgtatgccactttgtctgtattggtcgtggctacatgataccatcctgacatgatctttggacaccaaaatctgagtaatggtggaaaagaacctaagggtgaagggttacaataacatttttgcaattggtgacatcaccgatattcctgaaatcaaacaaggcctgaaatcaaacaagggtacctcgcccagaaacgcacgcgctgctggtagccaagaacctgaagctgctgatcaagggggcgcctccgagcaagctctgccacctacagcaccggcttcccgctggcgatcgtctccctcggaaggaatggaagggctggctcaggctaccgtacctgacgctcaccgggtgcataccagggatgctcaaatccaaggacctgtttcgtcgggcaagacgaggaagcaagctaagcctataaacctaagccgatctccagacaagaacaaataaacatgttgttgcacatatgtgttgtattggcttgtctggtgttttgtatgttcgagaatttaatggtgatgtaaatgtatgtagtacatgtatgcaaaggcctgcttggcctgcgttttggagtgagtttttgttcct

SEQ ID NO: 27264 - DNA, 382 bp, Triticum aestivum
  Clone ID: PAT_TA_27264
cccacgcgtccgcccacgcgtccgcccacgcgtccggagatcgacccatcatttggagttgaagcaactgagctttaccccgatgtgcattatattaccgtggatgaatacctaaataggttcctttaaactcctaaatcctatcgtccccaatattcatatactttgaataagtgttggaggttgtgtatttttattagaatggcacgtgaattacgtaatcagagtgtgagacctcaatcatgtgaggaatgcatcttgcattcccttgagcttagaatatataaactgaggttgtataaatttggaaattttagcttgatggaacatgataccgtatgtaacagcccgggggtttatgccaaattagaaattgtttgtt

SEQ ID NO: 27265 - DNA, 1413 bp, Triticum aestivum
  Clone ID: PAT_TA_27265
gcggccgcccgggcaggtacctcttggtcacgttctctggcttgtcctatttttccgctctgctgtacattttgccgctctgctgtgcagggcgtggggcgcaggggagggggaggggccgggtgctggtgataggcggcacgggctacataggccgcttcgtgcgtcgccgccagcgcacgcgagggccacccgaccgccgtcctcgtccgcgacgccgcgcccgccgacccagccaaggccgccgtcctccagggattccgggatgccggcgtcaccatcgtcaagggtgatatgtatgatcatgagagcctggtgacagccattaaatcagcagatgttgtgatctcggccgtgggttatcaacagctaccggatcaaactctcattatctcggcaattaaggaagttgggcatgtaaagagattcttcccatcaggagtatggtaatgatgtggatccgtaaccatgcgagttgaacctgcaaagacagtattcgggtgggaaagctcatataaggcgtgccattgaggctgaggggattccctacacatatgtctcttccaacttctttgctggtcgtttcttgcgaagccttgcgcagattggggtcacggagcctccaaccgagaaggttctcattatgggtgatggaaatgtaaaaggaatctttgcggcggaggaagacgtgggaacctacactattaaagctgtagatgatccaaggaccctgaacaaaatcctatatctgaggccaccaagtaacactttgtcccataatgagcttgtctcactctgggagaagaaacttggtaagacacttgagagggtgtacctcccagaggacgaactcctgaagaagattcgagagtcatcagcgccgctgaatgtagcactggcaatcagccactctgtctggttgaagggggaccacactaactttgagatcgacccatcatttggagttgaagccactcagctttaccctgatgtgccttacattaccgtggatgaatacctaaataggttcctttaaactcctaaatcctatcgtcgccaatattcatatactttgaataaatgttggaggttatgtatttttactagaatggcacgtgaattacgtaatcagagtgtgagacctcaatcatgtgaggaatgcatcttgcattcccttgagcttagaatatataaactgaggttgtataaatttggaaattttagcttgatggaacatgataccgtatgtaacagcccgggggtttacgccaagttagaaattgtttgttatttacaaaaaaaaacataagcatctcggcactagcttcgccattttgttaaatgatgaataagtgtcacacgccaaaaatctgaattgagattttttttaaaaaaaaaaaaaaaaaaactcga

SEQ ID NO: 27266 - DNA, 619 bp, Triticum aestivum
  Clone ID: PAT_TA_27266
acatgccctctcctcatccatgtcataagcatcaacatgtacatgctattctctcctcatagtaccttatttgaatggctccttcaggattggcacaaaaccaccgtccccatagcatccttggcacaaagcaacaatctcaatcctttctggagaagtatgtgccgtaaacaaggtgaagatttcatctggaaaaataggaacgatgtatacttcacaaggtggacatttaccaataacatatctaaagaaacaccaagctgaataacaggacagccatcacacggtatacattacgaagctgaaaaaagcatattatttacttcaaaagaggcactcagtttaaaaccaattcaggacgtgaaacctgaacacgcttcacaactcaccatgttcttcaaaatcggcagttggcaatgaaccgacccagtatatctaactcgaaccttcatttaggataaattaccatcagaagatgaataaaattaacccaggcagtcctgcggcatgttcagcaagtcatctttgccattttgttacataaatgctcgtcatgttgtcatccagtcatgcacagctgcaggccacatatattttcaatattccatatctttcaagg

SEQ ID NO: 27267 - DNA, 731 bp, Triticum aestivum
  Clone ID: PAT_TA_27267
cagaaccttgctgttggcccactgaaagggaggcatttcacgtattacaacagttgttcctggaactgatgaatccattgagaagttagttcagcagctttacaagcttatcgatgtacataaggttgatgacttaactgacttaccttttgctgaaagagaactgatggttatcaaagtatctggaaacaccgctgctcggcgggagatactagatattggtaatatcttccgggcagaatgtgtggatctttctgatcacacagttacgctacagctcactggggatcttgacaagatggttgcactacaaagactgttggagccttatggcatatgtgaggttgcgagaacaggccgggcggcactaatccgtgaatccagggtggactccaagtacctccgcggctactctcttccactgtaataagaagtcatgtgcaacgacgacccaagaagggtcacttggttttggttgagctgagcagaatgtgtaggcagctcagctttttgtgcggctgtggtcttgtttaggatgacttgtttcctctgtggtaatgtgttgacttgtcgaataaattgctcttggtagatgcaagtcgaggtttgcccatgtattgcaccgacaagcagaataagtacatgcctccttgtcttgcggttggttgaattgagtagaatgtgtaggcgacttgtgtctaattgcactcttctggtcgacgcggccgcga

SEQ ID NO: 27268 - DNA, 742 bp, Triticum aestivum
  unsure (1)..(742): unsure at all n locations
  Clone ID: PAT_TA_27268
catggcgtccgcccacgcgtccgcaacgatctcttcagtgagcttggcgaaatgcttgaagtagacaggcagacaaatgggaaagcatgtatattgactgacaccactcgaatccttcgagatctgctttcgcaattagagtctctccgaaaggagaatagcacactgcagaatgaatcccattatgttacaatggagaggaatgagctgcaggatgagaacagtgtgctccgcaacgaaattctggagctacaaaaggagctgacgatgcctcatgctgtgtctcactctgcgaacacagttttcccgtcacagcagccaatgcagccggccaccatcgcaagcgcagtattccccttgcagcagccactgctacagacaaccatcctggagcacccttatgcaccaccaccaccaccacgggaacttaagctcttcccagacgcggcatctgacgtcgaaggccttgaaccatcagaagatccggaggccaccaaccatatcacgcgcccgctggcaaggtacccaacagagtcagcttcgtggcctgtaactgtaagcctgggtctcccgaggatggaagatgaacaatgcagcagtggcacaaccggcagtagcaacgaaggtagtagctctgcctcctctaaaagattgagtagtaaagttcagccagtcaaggaagtttctctttgagcctagcgaatatacacagctgancattgcgtgtaaatacagacncatc

SEQ ID NO: 27269 - DNA, 651 bp, Triticum aestivum
  Clone ID: PAT_TA_27269
ttcccggtcgacccagcgtccgttcctttacttctttgccaacgctagtaggggcctttaggtggcgcgtctcctccggagtggcagccattcttccagcacatgcgccttttgttacaaaggaggtgcaggggagactgtgtgccttgggctgactggagcaaggaatatctttgagtccattgatcaaggaaaggtatattggaattagatacttctgattactaggaaaaagttgtgccgacaacgacgaaggcgcagaccgcagaaagcttcgggcagtaatctcaacaggcaaagaagatgttcaacaacatagtctccacatggaacaagaggaggagaagcaaatcgcttgaccagttgaatccttgggtgtaacggccgagctgtggcaggtgaaggagccgctgccgctgccgccgccggcgccgaagaagcgcaactgctccatggtgttcaccctcaaggagatggaggaggccaccggcatattcagcgacaagaacctcatcggcaagggcggcttcggccgggtttacagggggcgtgctcaaagacgggcagatcgtggccatcaagaagatggacctgccgacggcgaagcaggccgacggcgagcgggagttccgggtgggagatcgacatcct

SEQ ID NO: 27270 - DNA, 1098 bp, Triticum aestivum
  Clone ID: PAT_TA_27270
cagacgtgtgggtaagcaaggacattccaagcagagtacgatcttgtattagcaccgtgtcttgctcgatgggatcgatcaccgacatggcggtcatcaagatgctcctgctcccagcgctgttcgcattgctgctccgggcagcatcggcggctcaatggacgcccgcccacgcgacgttctacggcggcggcgacgcgtccggcaccatgggcggcgcctgcgggtacggcaacctgtacggcgcggggtacggcacgcagacgacggcgctgagcaccgccctcttcaacaacggcgcgtcctgcggggcgtgcttcacgatcgcgtgcgacacgcgcaagtcgcggatgtgcaagccggggacctccatcaccgtcacggccaccaacttctgcccgcccaactacgcgctcgccggcgacaacggcggctggtgcaacccgccgcggcagcacttcgacatggcccagccggcgtgggagaccatcgctgtgtacaaggccggcatcgtccccgtcaactacaggagggtgcgctgccagcggagcggcgggatcaggttcaccatcaacgggcacagctacttcgagctggtgctggtgaccaacgtgggcggcagcggcggcgtggcgcagatgtggatcaagggctcccgcaccaactggatggagatgagccggaactggggcgcaaactggcagagcaacgccaacctcgacggccagagcctctcgttccgcgtcaaatccgacgacggccgcgtcgtcacggccaacgacgtcgcgccgcccgggtggtggttcggcggcacgtacacgtccggggctcagttgtactgacccgatccgtgtgcatatccatgctgcatgaaaccaaatttaaacggtattcgtgtaatcacctgcagcttatcggtggccaaattaaccagacgatcgatcgagaagaccacgccgcctgcactgcacgaatgatgtttctgtacgtatactgaacagtatgtttctgggttgtgtgttgttccattgatcagtgtatttggctaccggctggatattcacgcatgttcagccgcaggaatgtgcttttttttac

SEQ ID NO: 27271 - DNA, 647 bp, Triticum aestivum
  Clone ID: PAT_TA_27271
gtcgacaaaggagccgaaaccgtgggcgttgacgtgggtgcggtgtatcgatctgaatgctgagaagagaccaaggatggatcaggtcgtccggatgttggattctagcgaaaccatacctcaagaggaacgaagaccacggcagaaccggatctctgagaatactgaaaccgtgccattgaggggcaagaacagcatcgagaagagtgatgcccctgagcatgaggagaggccccctcggccaaagagtcgtccattttcgtccaaatgaggtaaagaatgaaggaaagcctaaacattttctggagatataaagatagagagagataccagcgcgcggaagaacatggtggagaattcttctgaatacgtaacagattgatcgatttttatttttcacccctcggagcggggatttttgcatttgttgatacatggaatggaatgtacagtggtgtgtatgacggctcaaggatgtacagaactagcttgtaaaacggtctgaaaggctctcagctggtgtggttgctggtatgagctacagacttctcttatctctactatcgtattgtacacaccaagagtataaatcaaagaaaaagaaaaaaaaatgtttcgtgggtggttgtcacctgtcaaaaaaaaaa

SEQ ID NO: 27272 - DNA, 733 bp, Triticum aestivum
  unsure (1)..(733): unsure at all n locations
  Clone ID: PAT_TA_27272
gtgngaacgacggcggtgtcacgcatggcccccatccgtgcaccgggcatggacgtagtggtggaagagccgcaagttccagctcaacgccgacggtgtcgacatccattgcttcatccacgggctccattacttcgtccgcatacaggtttggagcggccggtccgacaagaatccaggccgggagcggcaccatcgccggcatggccggttcaggcgaagcaccagaaggtccagcaccatcgcgagcaccagatcctcgggcaccatgtccaagatgtggtccacgacgacggaaactgttctggcggcctccgaaccgccgaagatcacgggcattgcagtcgtggcggcgaagtccgccaagaccatggcggcggcggctctgtcgacgtcgaccgacaccatgaagaaggcgcaagaaggacaggagaccgcgaggcatcctcttaccttctcctttcttcccctctagtttgcttttttcggcgactgtcgctggcgtgatttgctctctcggcagagtagaagtgctgataacgtgtaaaagaacaaattgatcgaactgtcactttcattgatgatccagaggattaaatatagagggaatcgacgccaacgccatgaagggacgtatccgctcgcgggggcgtgggcatgtttcgaacggttgccagaggcaaaccacacgctagttacaagggaggattatccctaaataatataattagtt

SEQ ID NO: 27273 - DNA, 1104 bp, Triticum aestivum
  Clone ID: PAT_TA_27273
gagaatcattcgcccctccaggtgagctcagtatggtcaactgccgtttttacaaagtcgaactcaagtggctcccaagactcactcggacaacgttcacatgttggatggcttttgaagaactaccactgtcatttggtcatgtccctctgcttgagtttttgaacctcacaaatatcggtcttagtcggaacaaaatggtcatgttaagtacattactttgtgagacacacatacaagaactgcaattggggtttaaatgcgaaaagatttgggttcaaccagagtgtctgagcgaaaggctggcttctgcgttccacagactaaggattgtcagtctagttagcattcctgaagggtctgatcttacgtggacaattttcattttggaagctgcgccatcacttgaagagttgtacatgtcggtaattgatcatccgtgtgagatgataatggataagaaaaggaggacggaactcttgctttgcgaaaagaagggcgtcgagtgggaatcacctagatcaaatttcaagcaccgccgccttgccaagctcatcatcttttgctttgtaaattgcatggtgagttatgtcaggcgtgtcatgaaagcagcggtgaatctgaaggatgtgtacctgtatgatagactggcatgtagcaagtgtgaacacatggccatttttaagcctggtaggcttccacgggcaaagaagaagttgaatgcgatgaagaagttgttgacccagggcatcgagtcagctcccagaattcacctgctgactgattgtgaaatggaagctgaccatgctgcaagggttaaagactgcttatgttcctgaagataactgaaggctttttaggaagttcatgtaataacactcggttggagtactctatatgacttgtcagtttcttgtttgatctgcttttctttactcaaaaccagttggaagtagcaaaataagaattactcaatccggttgtaccgtaagtaaattttaggaccaggtttgtatttggatattcatgctatgatgtgttattgatgagtgcatcagttgatacggtcctaaaaaaaaaaaaaaaaaaaaaaaaaaaaaaaaa

SEQ ID NO: 27274 - DNA, 922 bp, Triticum aestivum
  Clone ID: PAT_TA_27274
gtacgaggtccggccgtctccgaacacagctccaacccacacaccaaaagcaaaagaagcggagcagctacaccggcctcgcgatcctttttgctgaatccacgcagataagcacaatggcggcgccggcgatgtttcctaaggcgaccaggaaggcctccgtgggcggccgggcgtggcggctgctgcggctggcggtgctctgggcgcggaaggggagcgcggcgcaaagcctccgcctgctcaagacgctgcggcacagccgcgtcgccggcctcggcctcggccacggcggccggcgcaacgaccggctgcactacggcgagcgggagttctccatcgacgagacgccggcgttccggttccgcaccccctccgcgcgcgtgctccggttcatcccctgcatcgcgccctccgtccccgacaccccaggcgtctacggcgacgaccgctacttcttccgcgacgaccgcaagagggacgcgagctgcgccggggacttctacgatgaccagccgagcgagtgcggcctggagagcctcgacgatggcgcggatgagcagctgctcgagcgcgcgatgatggaggcgagcgtcggctcggcgggagccgcggaggccggcgaggatgccggggtggacgtgaaggcggacgagttcatcgcaaagttctacgcgcagatgaagctgcaacggcaaatctcgtggctgcaatacaacgagatgatggaaaggagcgtctgctagaacaatagtgttaagattgtttgtttgctcaatcttgagttttggttcatcgatgtcaattgcaagttagatatacaaaaatgcagtaaaccgtatttgtcacatgtatatatgtgcatatatttctaaaaaaaaaaaattgatttctcaatttctgaactttgtatgcaaagttg

SEQ ID NO: 27275 - DNA, 578 bp, Triticum aestivum
  Clone ID: PAT_TA_27275
gcggtctcgccggtccctgaacctcagcggcggcggggacgggggcagcagcagcagcagcctcatgggcagcatcgcgtcgtccatcggcaagatgggccggcgcaaaaccgacagcagcgagctgcaggtgcaggtcgacgacaagccataaccatggaatgaatgccgagcctctcagcattcattcattcactcaccgtgttatcacgaagcatcataatacgtcatcgccaatgatggagctggctgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaagggggcgccttaaaggataaaagtttaacaagcgggaaatgaaatcaaaaaactcttttaaaggggccccaaaattcaattaaaggggcctttttttaaaacagtagtatggggaaaacccgggggttacccaatttaacccccttggaaaaaaaaccccttttccaaaggggggg

SEQ ID NO: 27276 - DNA, 1309 bp, Triticum aestivum
  Clone ID: PAT_TA_27276
ttggacgcttgggcatgcatacagggtcctctttgatgtggatggcaaccctaggttgtcatgttttggtttgatgaagaacagcagagatgggaaaagctacagtactaatttggctttcacacctcctgagtaccttaagacaggtagagtaatccctgagagtgtggtctacagcttcggtaccatcttgcttgacctcctaagtgggaagcacattccaccaagccatgcgcttgaccttatcagaggaaggaacatcaccgtgctcatggattcttgcttggatggtcacgtctccagttctgatggaacagaaatggtgcggttagcatcacgctgcttgcaatatgaagctcgcgaccggccaaacctgaaagcagtagtgtctgctcttgcaagccttcaaaaagacgcttctgctccttcacatactttactgggcatctcacaggacgctgtcaaggagaatgcagagcaagtttcattttctgctactgagaaagcttatgcgacagcagaccttgagcaggtgcatgagttgctggaaaatgagggatatgatgaggatgagacagcaagttttaatgtgtctttaagctcgtggcctggccaaccatctgagagtattcaggtcaagaagaatggagacgacgcttttcaatccaaagattttacgactgtgctggagtgttactcaaggtttatcgataccggtgcaatggagtctccgaccatgctagtgcggcgaggcttcgcaaacgtggtgcttggcaggatggaggatgcccttgaggacgcaaggagagcagaggggatatcacccgagtggccgacggcgcactacctgcaagggatggcgctcatcgggctcggcatggagctcgacggccacgagaagctaaggatagccgcctccttggaagcccagagaaccggtaggaactaggactgtatagagccgcccgcgatgacgcctcctcctctcttctgtacctaggtcgcctgcgcttttgggtgtcgtcggtccaaccagatatgcatgctttgcattttgcaaccagtggcagtagggttgttttttggcctcccctaacttgaattggtgtctctccttcagtggtttttacagcaaactcctaggctggcagttattactcctccgatatatccgtataagtaaaaaaaaaatgggcgatagcgttccgtggatttgagattgtaaatttgaccttattgtagtcttatgtctctctctaaattcatgtatatacagaactcaagagaatatctggtgtttcgcagcttt

SEQ ID NO: 27277 - DNA, 803 bp, Triticum aestivum
  Clone ID: PAT_TA_27277
aggaattcggcacgaggggtcgcatcgcacgcaaactttcgagtctcgagagaggcgacgaagagagcgagggcgagggacggcaatagggcttggaggatgggcgctggggaaggagaggcagctgggagcaaggagaagagcagcggcgtcgcccggacgtccctggacggcctgcgggacaagaacgtgatgcagctcaagaagctcaacatggcgctcttccccgtccgctacaacgacaaatactaccaggacgccatcgcctccaaggacttctccaagctcgcttactatagtgatatatgtgttggagcaatcgcttgtcgcctggagaagaaggaaggaggggtcgtccgtgtttatatcatgactctgggtgtattggcgccctaccgtggtcttggtcttggaacaaagctgctgaaccatgtttttgatctctgtgcgaagcagaacatctcggagatatacttacacgttcagacaaacaacgacgatgccattgctttctacaagaagtttggtttcgaaataacagagacgatacataattactatacgaacatcactccaccagattgctatgttcttaccaaatttatcggccaggctgctacaaagaaatgagcagacaccgtccctgctcttgtgacagagttgtgatcttgttgcagtttgttcttcattttcgttgaggtttaacattactttgagaacacgattaccttggctgcatcactgagacatcatttttacattgactgtgttctttatcccaaaaaaaaacggtctcgagacta

SEQ ID NO: 27278 - DNA, 847 bp, Triticum aestivum
  unsure (1)..(847): unsure at all n locations
  Clone ID: PAT_TA_27278
gggtctgatgcttgtcgcgtcggttaagccacccctgggctagctggctcctatttgaactgtgaaactgcgaatggctcattaaatcagttatagtttgtttgatggtacgtgctactcggataaccgtagtaattctagagctaatacgtgcaacaaaccccgaccggccggtggggcgcatttgtgagaccacgcgtccgaaccgctcctcgacctcctccatccgcccgcagctcgagccaagaagagatcgtcagccatgtctggccgcggcaagggaggcaaggggctcggcaagggcggcgctaagcgccacaggaaggtgctgcgcgacaacatccagggcatcaccaagcccgccatccgccgcctggctcggaggggcggcgtgaagcgcatctcggggctcatctacgaggagacccgtggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggctcttcctcgccccccctgcagatcccaaaagttggatgacaccgcgacttgtgtagttctctgtttgctctgtagttcgaactgtatcgtggaacaaagtggttcgcatgtgttgctggaaatcaaacctgtcccagtgaaaaaaaaaaaaaaaaaaaactcganggggggcccggtacccaattngccctatagtgagtcgtattacaattcaactgggccgnggntttaaaacgtcnngactgggnaaaaccctggngttacccaaant

SEQ ID NO: 27279 - DNA, 700 bp, Triticum aestivum
  Clone ID: PAT_TA_27279
attcggcacgaggcagcgtcggagtagacgggaatggcttcccgcctcataaccagatcaacggccgcggtcctcctctcccacctccgctccaggacgccgaatcctacccaccacctcctcacacatggagctgccatgtcctcccttctgggacccactcacggccttcctgccaccgccagatcacgccccctcctcgagccgactcggtggttctcttcgccggcgccggtggtggaggcgccgaggacggttgacggcctgactgtggactctattgccgacaagggctggacgatcctcgccgaggccgagagcgactggcgcagccacgccgccgccgtcgcgcagtccatcaggcttattaagaagcgtctcaagtggaaatggttactggagaggtcgaagcagttggctgtggtattggagaagccagacctctgggaggatccagtttttgctgggaatgttagtcgtgaacaaggcgagctcatgggcaagattaagtcagtgaaccaattcgagcaacaattgatggagcacatcgacatgttgaggcttgcacgtgaagagggtgacaatgaactcgagacggaatccatgcgagcattggccgatatgagaagagatgcaaaggagaaagaactcaatgcattgctttctggagataatgacgtttacccttgcttcattgagg

SEQ ID NO: 27280 - DNA, 427 bp, Triticum aestivum
  Clone ID: PAT_TA_27280
ttaagagaaggactggagcgagatcttcaccaaggcggttttcagtggctataaaattgtcaagaagctgggagctcgagctgtcattgaggtctacccgtaaggttgtgctcccaaagtaaagatgcttacatatgttgtggattgttgtgtgctcgctctaaggatgcataaataaaggagcgccttgtcattttccaaagagaagtcctgggtagatcatacaatagcaaggcgattatgtcttgttaccttatgatgatacctatggaactttcttttggaaaaaatagtatgcatttagagtgcttttcatatccaattacagtgatttccatatgtgtaccgtgtacaatatcatataccataagataagatcacaccttgtacttgttattgaaaccttgtcttattgactatatggtcc

SEQ ID NO: 27281 - DNA, 1308 bp, Triticum aestivum
  Clone ID: PAT_TA_27281
cggcatcccgacggcgatccaccgccttggcggcaccgcgtcgttgcccgacctgatggccgcgctgtcccttccgccacccaaggagccgtttctcagccgcgtcttgcggctgctggccaaatccgacgccctggcgtgcaccgaggccgggatctacagcctcaccccgctgtcctacatcctagtggacggcgtgctcatcgacggcgaggctaggcagaccgccttcccgctggccgtgacgtcgcggtaccacatggagtcaggtctcgtccgcgccgacgtgcgcaagaacgatcgtgcgctaccagtgccgtctccatttgagcatgtgcatgcggcggcgcccttcgacgagagcatgacgctcctcgatcatgagaccgacaagctcttctatgaggccttggccgcccatgaccatatggggatcggcacggttgtgcgggaatgccgtgggctgttcaatggtctggagtcactcaccgactgctgtggtggtgacgggacgacggccagggccatcgtcaaggcctacccgcatatcaagtgcaatgtgttggaccttccacaggtgatcgacaaagtcccgagtgatggtgttgttaactatgtcgctggcgacctcttccataccgtcccacctgctcaggccgtcatgctcaagcttgttctacacttctggagcgacgaggattgcatcaagatcctcgctcaatgcaagaaggccataccttcccgagaaatgggaggaaaagtgatcatcatagacatagtgcttggatcttctctagagacaataactgaaaccgaactgctgatggacatgctgatgttcatatgtaccagaggacgcaaggcaacgggatgaaaaggagtggagcacgatctttacgaaagcagggtttagcgactataagattgtcaagaaacttggccatcgaggtgtcatcgaggtctatccataaggttgctgcacccacgcgtccggcgtgtgttccttatgaaaagcggtgtgaaataagaaataaataagtacagtgccttactcgtcaatggaaaattgaacaaattcttaagtagacaaagggttaaggggtcggtcgcttcagaactgtatgcatgtaaccactcgtatgtatgtatgtatgcatgcatgtatgtacgtatatatgtgcgtacatacgtatgtaggaacttatgtatgtatgtatttatgtatgtatgtatgtggcatgtttgtatgttccaacaatttgagatgttaagatttgttgttttggtatgtgtataactttgtttttg

SEQ ID NO: 27282 - DNA, 606 bp, Triticum aestivum
  Clone ID: PAT_TA_27282
acggtccggactttttcaggaccgtttcgaaaccaaagctgatggatatggtaatgatggtatgtaccaggggacgacaacgtgatgaaaatgactggagtgccatctttatgaaggcagggtttagtgactacaaaattgtcaagaagcttggagctcgaggtgtcatcgaggtctatccataagttcgtgttgcgaatggtgtgattgtgaccatctagtataaatcggcgtggtacaataaataaataaataagcgaggcgtgtggtgcgttactatctaatggagaatgcaatgtaataaaagttgatagctaaaactttaagggctaccacatcgcacatgtggtaagcaatccaagttggatgaaacgtttggggcgtggtcgcgacaaaactagtatgtattttttttaggaagtatgtgcatgaaagttggtatcgagaagtgttgaggcactcggtgtgtatctacgtacgtgccatgtttgtatactccaacatgaggagatattatgcttaccatatctgtctatttgacgattggtaaatccacaaacatgaaaaattaagccctcggccagttaaaaaccaaacaaccccccc

SEQ ID NO: 27283 - DNA, 1357 bp, Triticum aestivum
  unsure (1)..(1357): unsure at all n locations
  Clone ID: PAT_TA_27283
gcaagaatggcagctcacatgacagtccccagcgacgcccagctgattaaggcgcaggctgacctgcagcgccacagcctcacctacctcacgtccatggcactcaggtgcgccatcgagctcggcatcccgacggcgatccaccgcctcggcggcaccgcgtcgttggccgacctgatggccgcgctgtcccttccgccacccaaggcgccgtttctcagccgcgtcctgcggctgctggccaaatccgacgcactgtcgtgcaccgaggacggggtctacagcctnaccccgctgtcctacatacttgtggacggcgtgctcatcgacggcgaggccaggcagatcgccttcccgctggccgtcacctcgcgggaccacatggagtcaggtttaggactggccgattggttaacttcgatggacctgtgccatcgccgttcgaggacgtgcatggcgcggccatcttcgaggagagcatgacgctcctggacccggagatggatcagctgatccacgacgccgtcgctgctcacgaccacatggggatcggccccgtgctccggcagtgccgtgagctcttcgaggggcttgagtctctcactgactgcggcggcggcgatgggacgacggccaggtccatcgtcgaggcctacccgcacatcaagtgcactgtgctggaccttccaaaggtcatggacaaagttcttcttcccgctgaagaaggagcagttaagtatgtttccggtgacctgttccacgtcgtcccacctgctcaagccgtgttgctcaagcttgtactgcacttctggagcgacgaggattgcgtcaagatcctggcacaatgcaagaaggctgttcctccccgggatgcaggaggaaaagtcatcgtcatagacattgtgcttggatctgtttcagggccaatgctggaaacccaacacctcatggatatggtcatgctagtggtgacaagaggccgacagcgcgatgagaaggactggagtgagatcttcgtcaaggcggggttcagtggctataagattgtgaagaagctgggagctcgagctgtcattgaggtctatccataaggttgtgctcccaaagtaagatgtttacatatgttatggattgttgtgtgctcgctctaaggatgcaaaaataaaggagcgccttgtcattttccaaagagaagtcctaggtagatcatagaatagcaaggcggttatgtcttgttaccttatgatacctgtggaactttcttttggaagaaatagtatgcagacagagtgcttatcatatatgtatgtgtacaatatcatataccataatatcaagtcgtgtatttgttaccgga

SEQ ID NO: 27284 - DNA, 1618 bp, Triticum aestivum
  unsure (1)..(1618): unsure at all n locations
  Clone ID: PAT_TA_27284
cgaagtggacaacccggccctgagagaaagagatagacggcaaagtgtggcagcccaggccgagaaggtgttcgtccccaccgacgccgagctgctccaggcgcagtcggacctgtggcgccacagcctctgctacctcacgcccatgttggcgctcctgcgccgtcgacctcggcgtccccaccgccatccaccgccccccgcggcggcgccgcgtccccatccggactggtcgcccccctctccctccccccgtcctagctgcccttcctcgcccgcctgctgcgccaactcgccacggcgggcgtcttcaatgccgccgacgccgggcctcaccccgctcccctacctcctagtggacggcgtgcgcatcgccggcgaggctagggccacccagaccgccctcgtcgcggcctcgcggtaccacgcggataccgcgatggggctggtggattgggctgagcgctttgggaaggacttcgatggatctgcacccgcgccgttcgatgacgtgcatgccgtggacgacagcgtggcgatcctgggtcttgaggacgcgaagctcttctacgacgcccacgctgcccttgcccatatcggcctcggaagggttgggcgggtgcgccgtgggttggtggatggtttggaggcactcaattgctgcagtggcggtgacggggcgatggggggggccgccaaggccatctaccgggccttcccgtacattcagtgcaatctgatggatctgctccaaacagtcgacaatgaacgtagttcttcttacgtggtggaggatgagtttgatactgtgttcctggtccccttcgccacgcccacccatgtcctacaggttctgctcctcgagcttgtcctgcacttcgaggatcgacgaaagaagcaccaaccttcctcaaaagcaggcaaaccatgccaagaactgggagaagaagtcagggtaatagacatagcgattgtgccttatatattgtgcctgggttgggatgctgaaaacctcatatcactgagaaggcggcacgtcgaatggaagacggccgcgggcagagagaaggagaagaagcgttaagtccacaaagggaaggaccaagtagatgataattttagtaagggaaggttgaggtggctatgatgtttcatcaaaggtcccttccaaggtgcgtgcttgtgtatgaagatcttgcttacaaatgtgttgttatgaaatagtgatagatgctcaatagaatgtataagtaatgtcatgttcttgatcataatggaaagaaagagtaaaggagtgcattgtcattatctaatataaaattcctggactagttatctttagaatagcaatggagcttatttatttataaaatttttatacactgttggaactatcttttctagtaaaatatagtatttatgataggtgtgctttataatatatgtaatatgataagtttaaaacaccataatttctagtcaaataatagttaaacaaaaaaaaaacaaaacccaaaattttcataagaatcgctaaatacctcaaccaagaaatccgcacctatccctccgtgtccgctgccggctatcccgcgttcactaaccctgaaaacccntg

SEQ ID NO: 27285 - DNA, 1526 bp, Triticum aestivum
  Clone ID: PAT_TA_27285
ccgggggggcgtccggctctgcgggtgtctcgtggtcgccagctgcttcgggttcacgcccgtcttctcggtcgccgtcccgccgacggccgccgcgtcgcgccctggaacttcgccctggaaccttccccagctcaactagccccgccggatggtcactgtggaaccaccttgaagttgtcaaagacctgtaacatagatgagccctccggttcctgcaatgttggatgatgaggtggatttcgtcgaagctgcgaaacctgctattactgatttggtcatccctgtgaggaagcttctgatagtggtgacaatcacttctgctcggccacaacaggcgtattacttgaatcgtctagctcatgttctgaaaggtgtaccacctcctctcttatggttagtggtggaatggcctgttactacctttgaaacagcagaaatcctcaggtcttctggggttattgtacaggcatattgtctgcaggaaaaatcttacaagtgtacggaaagattgctgtctgtcaaatggaacaatgcaatctatcatatcaaaaagcatcaccttggagtggtatagtgcactttgctgatgaagaacgatcatacatgggtgatgtatttgaagaaatgcggaaaatcaggcgcgttggtgcatggcctgtagcgaaccatgatgcaagtaagtacagggtggttgtagaagggcctacgtgtaaaggaaaccgaatcactggatggaacacaattccgaagaagggtgcaccccgtcgattcccaattggttttcctgggtttgctttcaacactacaatgctctgggatcctcaaaggtggaaccgcccagctagggattccgttatagtccactctggtggtagaggtggtctgcaggagtcacgatttgtcgagaagcttgttaaaaacgaccgtcaaatagaaggccttccagacaactgcaaccgggtcatggtctggaacttcgccctggaacctccccagctcaactaccccgccggctggtcactgtggaaccaccttgaagttgtcaaagacctgtaacatagagatcctgccaccggaagtcctctgctcctacaggccgtttctctcggcaagccggaaggatgataagccttgcggcggtgcagaggttctgaatctcgacttggcgatgccctctagcggcgctgctaaccgattgccctcctcctaaacagcccgcgcgacgggacccgcaaagtcgtagtgtcagtcatactagtagcagtgccaatcagaactgcctgaccaacttttttcctattttgtgtgctcgctgtattctttttgtgccccttcgtgtcccctccgtattcgccggtgcatactgccctgtagttttttttccccacggcctttctgtgtttatgatacgtttacagatgtaaaaaactgcagccattgcggctgttgaacagtgaatgcaataccacagatttgtaactgttgacccagttgaactctcaagctgtaagctgtgtcaatta

SEQ ID NO: 27286 - DNA, 721 bp, Triticum aestivum
  unsure (1)..(721): unsure at all n locations
  Clone ID: PAT_TA_27286
ctgccccccaaaccgaatttcgggcgccggcggaggggtaaggaggacatgctgcaattcccggcgctgatgcggcagtggccgtcgccgccgctgattccggcgtccacactcctccccgtgcccgcaactacccaggaggacgagctcctcctcgccatggccgactccgacctcgaggacaagctgaacgcgatccgcaagaccaacagcaacctggtgatcataggcaagcccaccaacgacatcaaggaggagtacgacgcggacgtggaggaggacgacgtcgacaacgtcgacgagtccgacggggacgacttcgaccaagaaaccggctgagccgtccggctcccccagggctccagtcccgagacgttgccctctctgcgaaccaatctgtacgcttgttggagcccgagatccccaattatctctagttattagatcaatctgtcccagctatcatactttactttgctacatggtgtttcgacgattcggggggttacctacccttggcattagcttgttaatgctgtcaagtatttatcgaaacaccgatatcaatcattactctttttgaatgacttactgaaaaacaaatataaaacatgatgatatggagtgcctttccctgggcgctggcgatttctattcgctcatgaanncgataaatggnaccgtattgactaggaattanacnaacncccttgatccttta

SEQ ID NO: 27287 - DNA, 507 bp, Triticum aestivum
  Clone ID: PAT_TA_27287
ctggggttccgggcagtcgtggacggccgcgaacgccgtgaagtcgtgggtggacgagaagcggaactaccacctcaacaccaacacctgcgacgccggcaaagtgtgcgggcactacacgcaggtggtgtggcgcaagtcgacccgcatcggctgcgcgcgcgtggtctgcgccgggaaccggggcgtcttcatcatctgcaactacaaccccccgggcaacttcaacggcgaccgcccgttcgcgttcctcacccttgacgccgaagccaagtagtatgtacgtgtgaatgtgatcatacatgcataggtgtgtgtgtttatgtgtgtggattttgaatatttacttctataaatatgttatacgtactgtacgtacgtaaataagcgcacattccggcctgcatgtatccatgcggctctgtggagcgtgtaagtgcaatcttttttttttaagaatgcgtgtaagtgtaatcatatacacctccatgcaaatgtctttccttt

SEQ ID NO: 27288 - DNA, 321 bp, Triticum aestivum
  Clone ID: PAT_TA_27288
gacggggaaggagaccaagtcgcccaagaaggccgccaagtcccccaagaaggcttagtcgattactgtccagtgcttcgtagtagaattagtgatcgctgtttaggtaatggtgtcgatgtagtaatgttctgttctgctttaagaaaaatgtcagaaatctctctgacttgcagcaaagaaaaaaaaaaaaaaaaaaaaaaaagaagcatcaaaataagtaagacaaacaaaaagaaataaccatacaaaaaaaaaaaaaaaaatttacacacacacataaggttaatgtcatttgtctgaaagatgaatggggcacaa

SEQ ID NO: 27289 - DNA, 841 bp, Triticum aestivum
  Clone ID: PAT_TA_27289
tcttcgcgtccgcccacgcgtccgcccacgcgtccgcccacgcgtccgcccacgcgtccgctagctagccatggcatcttccaagagtagtcttgcaatgttcgcactggtcatagtcatggccgtggtggccggcgtctcggcgcagaacaccccgcaggacttcgtcaacctgcacaaccgcgcccgcgcggcggacggcgtcggccctgtgacgtgggacaacagcgtggccaggttcgcgcaggactacgcgaacaagcgcgccgccgactgccggctgcagcactccggcgggccgttcggcgagaacatcttctgggggtccgggcagtcgtggacggccgcgaacgccgtgaagtcgtgggtggacgagaagcggaactaccacctcaacagcaacacctgcgatgccggcaaggtgtgcgggcactacacgcaggtggtgtggcgcaagtcgacccgcatcggctgcgcgcgcgtggtctgcgccgggaaccggggcgtcttcatcacctgcaactacaaccctccgggcaacttcaacggcgagcgcccgttcctcacccttgacgccgaagccaagtagtacatacgtgcgtgtgtgttttttttgcgggtgacgtgcgtgtgtttatctgtgtgtattttgaatatttacgtctattcttatgttacgtacagtacgtacgtaaataagcccacattccggcctgcatgtatccatgcggctctgtggagcgtgtaaatgtaaccatatatacctccacatgcaaatgtctttcctttatgttttccttgttcaaattcctgggaagctaagccaaaaataaaaacaaac

SEQ ID NO: 27290 - DNA, 791 bp, Triticum aestivum
  Clone ID: PAT_TA_27290
gtgcggcgctcgcggccgcgtgggccccaatctcgagccacctactagctagtcatggcatcttccaagagcagtcttgcaatgttcgcactggccatagtcatggccgtggtggctgacgtctcggcgcagaacaccccgcaggacttcgtcaacctgcacaaccgcgcccgcgccgtggacggcgtcggcccggtggcgtgggacaacaacgtggccaggtttgcgcaggactgggcggcgcagcgcgccggcgattgccggctccagcactccggcgggccgttcggcgagaacatcttctggggttccgggcagtcgtggacggccgccgacgcggtgaagctgtgggtggacgagaagcagaactaccatcttgacagcaacacctgcgacgccggcaaggtgtgcgggcactacacgcaggtggtgtggcgcaagtcgacccgcatcggctgcgcgcgcgtggtctgcgccgggaaccggggcgtcttcatcacctgcaactacaaccccccgggcaacttcaacggcgagcgcccgttcgcgttcctcacccttgacgccgaagccaagtagtacgtacgtgtgagtgtgatcatacatgcatacgtacgtgcatgtgtttatgtttgtgtggtttgaatatttatacgtctacaaatgttacgtacgtacgtaaataagcacacattccggctacatgtatccatgcggctctgtgcagcgtgtaaatgtaatcatatatgttctacgtccatgcaaacatctttacttttgttttcttgttc

SEQ ID NO: 27291 - DNA, 1168 bp, Triticum aestivum
  unsure (1)..(1168): unsure at all n locations
  Clone ID: PAT_TA_27291
gcagccggggccggcacgctgaccatggcttctatcttcagcgggtaggcagtcatggcacccatccaagaggagtcttgctgtggtcgcccacgccgctgtcctatggccagctgttccacgtgttagtgctagcaatcgtctgcactggcccgactcctggccgtggtggctgaggtctctggcgcagaacaccccgcaggacttcgtcaacctgccacaaccgcgcccgcgccgtggacggcgtcggccccgtggcatgggacaacgaacagtggccaggtttgcgcagcgactgggcggcgcagcgcgccggcgaattggccggctgcagcactccggcgggccgttcggcggacgaacatcttctggggttccgggcagtcgtgggcacgggccaccagacgcggtgaagctgtgtggtggcacgtagaagcagagctaccatcttgacagcaaccacctgcgacgccggcaaggtgtgcagggtcactacacgcaggtggctgtggcgcaagtcgacccgcatcgggctgccgcggcgcgtggtcctagacacggggaacgccggggcgtcttgcatcacctgcaactacaatccccccgggcaacttcaacggcgagcgccctgttcgcgttcctcaccctttgacgccgaagcctagtacgtgcgacgtgatgtgtgatcatacatgcatacgtacgtgcgtgtgtttatgttttgtgtggtttgaatatttatacgtctacaaatgttacgtacgtacgtaaataagcacacattccggcctgcatgtatccatgcggctctgtggagcgtgtaaatgtatgcaaacatctttacttttgttttgttgttcaaaacttggacctagccaaaaaaatagttgaacccttctaaaaaagaaaacagcgtaagtaaatataaaataaaacagttagtttcaaaagatgctatctatctggagtacagaggcaaaaaaaaaataaacatgcctatggaatcattagcagaattatgtataagtaactgtacctagtatgtggtgctgtgacacaatgttgtacttatacatctagctcagacattattaacatctgtatgcatgtatataatctataaacagacacatttgatttccaaaaaaaaaaaaaaaaaaaaaaannn

SEQ ID NO: 27292 - DNA, 708 bp, Triticum aestivum
  unsure (1)..(708): unsure at all n locations
  Clone ID: PAT_TA_27292
ccacgcttccggcttatgtcgatctcccctataagtacccatccatgcaaagtgtttatgcagcatcaagataccaaccaagttgagaagattaagtaataggcttcaggtccattcagccggctcgtccatcaacgatgagctccacagatgtcccagctagcaccgacggcctcgccggtgagtcgtggcagaagtcatggccagaggtggtgggcaagtccataaaggaggccagagagatcatactcaaagacaagcctgacgccgacatcgtcgtgctgccagccgggtcgccggtgacccgggacttgaggcccaaccgcgtgcgcatcttcgtcgataccgtcgccgacacacccttcactagctagctctagctttacaagcgcgaagaaatgtatgcgtgccccatccatgcatgcgcatgaataagtttttagtaattgatgaataaatgctggcatgtcgagcgtcagcatggcatggatttgtgtaacttttcgtttcgtctaccttttttcgagagagaatcgtttcatctacttatgtctacgttgtttgtgctttggactagttcctgtttgaaagagtactaggtttgtatctgagtactcattatccccaaaattagagaatggcatgcgctnnnnnnnnnnnnnnnnnnnnnnnnnnnnnnnnnnnnnnnnnnnnnnnnnnnnnnnnnnn

SEQ ID NO: 27293 - DNA, 1026 bp, Triticum aestivum
  unsure (1)..(1026): unsure at all n locations
  Clone ID: PAT_TA_27293
ggtcgaccggggcacataactcagtgacgcttatatcgatctcccctatatgtacccatccataaggggaggaaagatgagtatgaagaagcaagcagcctcctgtacgttcacctagccggtccatcaacggaccacgagctgggaagattaagcaataggcttcaggtccattgagccggctcgtcgatcaacgatgagctccacagatgtcccagctagcaccgacggccctcgccggtgactcgtggcagaagtcgtggccagaggtggtgggcaagtccataaaggaggccaggagagatcatactcaaagacaagcctgacgccgacatcgtcgtgctgccagccgggtcgccggtgacccggggacttgaaggcccaaccgcgtgcgcatcttcgtcgataccgtcgccgacacacccttcactggctagctctagctttgcaggcgcgaagaaatgtatgcgtgccccatccatgcatgcgcatgaataagtttttagtatttgatgaataaatgctggcatgtcgagcgtcagcatggcatggatttgtgtaacttttcgtttcgtctaccttttttcgagagagaatcgtttcatctacttatgtctacgttgtttctactttgtactagttcctgttctgcgccatgcatgcatgcgcgtgaataagttttagtaattgatgaataaatgctagcaatgccgagcatcagcatggcatgaatttgtgtaactttttgttcagtctactttttttttttggtgagagaatcgtttcatctagttatgtgtacgtttgtttgtgctttggactagttcctgttggaaagtgtactaggtttgtatctgagtactcattgtgcacaaaattagagaatggcatgcgctacctagtccttccaaaaaaaaaaaagtagactgaacgaaagttacacatatccatgccatgctgntgctcggcnttgctngcatttattcatcggttgccttggcctttccccgcgcttgcttgcttggc

SEQ ID NO: 27294 - DNA, 783 bp, Triticum aestivum
  unsure (1)..(783): unsure at all n locations
  Clone ID: PAT_TA_27294
gccggccgggctccgggtaggctgtcataaataaagtccgcctagatgtacgactaaaagacaaagttgagaccttggctcggctctctcccccgctacagtaggagaggcgattttttccccttccccgttcgatctagttcgccggcggcggctcgctggtttccccccctctgccggccgcttcggcggcgggagggtggggaaacctcggttcccgtctgtacatagctaggatggagtgggtggttcgccggcagcgccgtggagaggaaggcgctgtcgggttggtggtttgtggcggcggtgatcttctccggtggcggggttctgcggaatccgaccacttccccgcctccttcctggtgctcgtaactcggcggagttgccgtgcgccttcttcccgtgccggagtccgtaggcggcggctccggttgttgaaagtttggaagatgcaggtgatgaggtccagatcgaaggcgatggcgacgatgcaaggtggaggccctttgggttcgaggtccgttgacttcccgaccgccatgggactccgtccgatccaaggttgtagaggaggagcggcggcggcgcgccagcggcacgtcttcatcgacggcggcgtcttccttatccttaaggacttgtttgtaattgtcttatcttttgaggactgttctgtaagggtactggattaatatcacttggtctttcccgcaaaaaaaaaagttgctgcgtgtttctnnnnnnnnnnnnnnnnnnnnnnnnnnnnnnnnnnnnnnnnnn

SEQ ID NO: 27295 - DNA, 972 bp, Triticum aestivum
  Clone ID: PAT_TA_27295
cttgaattagatccattacatccacacacgcacaagctcatcgagctcaaaaacacctctcctcaggaggtagtttttgcttgtacttgttcatcccagcctacaaggcaatccaccacaccacactggagtagagtattacaccacattggtggcccgaaccagtataaactcttgtgtcccttattctttgtgttcggcaagctaagctttgaaatcgtggtgagagcatgagctaggggaagagatatcttcatgcgcaccctagagtttgaacctcaaggatttaccagaacccgtaatcccacagttccagagctaattatactactctgcagccaccacaatccgcccagctagagggttcatgcccatgattttatggccacagatcttcttgtatatgctaaaatcatcaaagggagacgccatatctgccacggtctttacgcggaaccatgcgcctgtcctgttgaccatctccaccgatatggacgccagtgaaccgtggttgcctgtgcatcgacacatcgaatgatgaatgggcagcagcggcccaccagggaggagaatctgaagaaaaaataagggagaatctgaatcgaccaacacaaactgccgagctcgacggagaagctaatggtgaggacagcaaaggagataaatgcgggcctcacgaatgatgaatgggcagcagcggcccaaccgaaggagaccccggaggcggctcggcgtagactaccgaccaccgtagtgcaacttgaccaggcgccctctcttgctcagtgcgccaccaccagacagagcggcagcagcctggacgtcgtcgcccttgccttggcgaccatcacggcaggccattccggcgactgctcggcgcagctcttgccgttgggtggtagcatctaccatggcacatcaccccggcgacggggcggcgccaacttcttcggtgacgagtatttagctcct

SEQ ID NO: 27296 - DNA, 1035 bp, Triticum aestivum
  Clone ID: PAT_TA_27296
cggacgcgtgggcggacgcgttgggccctcccgaccccgaaggcccaaacccccgtaggtctcgcccctcccgatccgaacccagacccaaaaccaacaccggcggcggctgcagcgatggcggcggcggcgatgaacacggacgtggaggcggtcgacttcgactccgacgacgacgatctcatggacgaggagggtgccatcgaaccctcgccggcccccgctccccgcctccgatctaccatcgcagggggcggcggcggcgacgacgatgccccgcgtaagactaaggggcgcggcttccgcgaggaccccaactcctcgtccgcgcaccgcgactcgcggttagctggcgcaggccgctctggcttcgacgccctcgcctccgatggcggccctggacccgtgcgctccattgaagggtggattgtactggttactggagttcatgaagaagctcaggaggaggacctccataatattttcggggattatggtcaggtcaagaacttgcatttgaatttggatcgccggactggatttgtgaagggatatgctctaattgagtatgagaactttgagcaagccaagcgtgcaataagagaatcagacggaactgagcttctatcgcagataataagtgttgactgggcatttagtaatggccctgtcaaacagagaagtactcggaagagatcaccgaggcctaatcgctcaaggagcccaccaaggagaagatacccttaggagcgacggaagtgcgagaatcatgggctttcagttgtttgcttgtcttatcgtaatttgacggcggcccttgtctctctgtaccaatttccggtagtagttgtatggcatcttcaaggtccttactttggtggatggagccatgtttgctcttgaagtttggcttgccagtttgagacaattgtagcctttgatgttggatccgtgatgtgttggattggaatgtttgtgccacaatttaatgaacttaaagatgggtaatttgtattattaaaaaaaaaaaaataa

SEQ ID NO: 27297 - DNA, 549 bp, Triticum aestivum
  Clone ID: PAT_TA_27297
agctacaaccgagtttattaagccttatcaggccgaaagaaatgctcgctgacgcacgcgagctttcacggatcgaggcaacacgctcatcacattacacagtagtagagaagagaactcctcgaatcacacatacatgaatcacatgcacatgccggtggttttcactgcgccgcgagcccagccgaggcgccgctggtgaacggcctctggctgttgcagtcgaggttgctcccgtagccgacgccgaggacgtcgcagtagcgcttgtagaacccgatccggtcggccacccgggggtcctgcccacgcccgcactccagcccgccgttgatgatgttggtgatcacgccgtacccgggcacccggccggccgcgttgtccgcggccgtcggcgtccaccggcccgtgatcaccgcgtgcgacgacggcttgttcgcctgcggggtcatccagaaccacagcgccgtcttgaacgacaccaccgggtcggccgccaccaggtccgggttgctcagcaggtgcacgccgatcgcgcctcgtccgaat

SEQ ID NO: 27298 - DNA, 1212 bp, Triticum aestivum
  Clone ID: PAT_TA_27298
cgggctgattgagcactatgcttgtcttgtagctgtgcttggtcgagcgggccgcttggtggaagcatacggtgttgttaagagtatgccaatggaacccaatgtgtctgtacttggtgctctcttgaatgcatgccatctgcatggactggtaaaagtgggggaggtagtcggcaggcagcttgttcaattgcagccatcaggtgatggcaggtacattgggttgtccaatatctatgctattgctaggcggtggcagaaaatttgactggcaagcatggtgatggaggagggagaagtgaaaagagcccctgggtttagcgggagagatgtcggtggaaggctccacaggtttattgcccatgacaaggctcattctggctcagcatatggttatgcgttgcttaatcttataacggtggaggtgaaaatgattgctgatgttgccattcagagtaacttcttacatacactgtttcacctgggtgcctaatttgtatctcaaaagtaagttctgcagcattctgatcatgcattctgcctgaatcatgggaaattcattgtagctcttggttctggttacttatgcatttctggtttgtgttgaacatttgactgccaaacataacctagttgtgtggagttcttctcagagccatgcagttgaagaagagatgaaatacatttgtgcgctgctacaggaagcagagctatagaagaagtatgacgtgtgcatatagtcttgagattctttgagctgccagcggaaaagtgcattctgttgctggacagcaatcagagagtaccaaacatcttcagtaactgtttcacctatggcttctgcttgtatggattattgatcatcagatagatagataagggcaagaacattccaaagaccactgactatttatgccagatggtgctgaaccatgtcgtagagatttcatcaatatacattacaagtatgcttcacaaattgatacgctggccatagtttttctcaagaatctgcagttgtagaaatgtaccaattgctaggatcatgtgccagaactgtgtatgtagcctgtgctgagctttgcccgttaacgagatctctggttgtgtatagcgctcaaaggtgaaaccacactgcacttattcctattttatttttttaatcttggttcccaaaattcgtgttgcttagttatatatttctatcaggcc

SEQ ID NO: 27299 - DNA, 511 bp, Triticum aestivum
  unsure (1)..(511): unsure at all n locations
  Clone ID: PAT_TA_27299
ggcganagaggcctaggactcgaagnacgcgtgaacaacaatggtcagcgaaatggagacgaggttaagttcagtgcattgaagatcaggaagacatgatttctaggcacaacagttcgcttgtcgagttggcgcctcccagtaagaagaggaaggaagggaggctgacgaacagtagagacaaagctccgtacgaggggatgacaaagaggagtcggttctgcagcatctgcaagactaaggggcacaagcgcacgacttgcccgcaacgaggtgatgccccaaaaatgcctagaaaagaagcaaagtgcagcaactgcgacgtcatcgggcataggaagaacacatgcggcagagctgctggccaaggtgctgatggtgatgtggtgtagatttaacccagaatttctgttgtaacaaaacttgtaaaaatgttgctttgtgttcctagccaacaagctggccagctcgccggtggacataaatgagtgtcacacggctatcattgacg

SEQ ID NO: 27300 - DNA, 910 bp, Triticum aestivum
  unsure (1)..(910): unsure at all n locations
  Clone ID: PAT_TA_27300
cccgccgcgatccggcaaccaaccgctggtactagtctctgtcccgccccctcccgattctccggggagtccgagcgagctcacgaacagcacgccagtcgactcgctcgctctcactctcccctccggcgcccgtagacgcagccggcagatccaagcaatggatttgagggcgttcttcgggggcaagaagcaggagccggagcagaacgggcacgccaacggggcggcgcccaacgggggcgtcaagaagaggaccgccgatttggccatctacgagcagtacgagcagcaggccaggcagccggagatgcgcgccgcagctattcgcgatgggaatgctgatgtgatccagaagcctctcctacctcagtttgagtcagctgaaatgcgtaacttagcagagacattgttgcgggatattatccgtgggagccctgatgtgcaatgggaaagcatcaagggactagagactgcaaaacgtctcctaaaagaagcagtcgtcatgcccataaagtacccaaaatacttcactggtctactatcaccgtggaaaggcatcttactttttggtcctcctggaacagggaagacaatgctggcaaaagcagttgctactgagtgcaatactacattcttcaacatttcagcttcatcaattgtcagcaaatggcgtggagattctgagaagctagtcaaagttctttttgagcttgcaagacatcatgcaccatcaacaatatttcttgatgagattgatgctatcatcagccagcgtggtgaagctcgcagtgagcatgaagctaatcgtcgcttgaagactgagctacttattcanatggatggnttgacaaagacaaacgacttggtatttgtacttgcagctacaaatcctccctgggaantggnt

SEQ ID NO: 27301 - DNA, 476 bp, Triticum aestivum
  Clone ID: PAT_TA_27301
ccgctccctttcccttgacgccttgccgatgtgatcccccgccgcctccgcccgcactccgtccccgcgccgatcccatcgcccctcgcccccaggaaatgtctcgccaccaccaccacgacccggccccgccgccctgctgctcctgctgcgcctgcgcctgcggctgctccccgccggcccccgccccggcgccgtgcggctactaccccgcgccgcctccccagccggcgcccgcgtcggaccagctcctccacgccatcgccgcgcatctcctgctaagctccgctcccccgcctcccacgccgccccaggcccaaccgccgccccagccccacccgcagcaccagccccaccctcagccgccgccgaatcccgccgcgcaccacgcgaatctctacgcctcctacgcttaccagtaccagcaccagcagcagccgggatccgccccccacgcggcctatccccagccgccc

SEQ ID NO: 27302 - DNA, 729 bp, Triticum aestivum
  unsure (1)..(729): unsure at all n locations
  Clone ID: PAT_TA_27302
gtgagctgcggccagccagcacgatatagaggagagccgaggggagtcgaggaagggacagaggggagaagcaggggagagaagagaaccaatggcgtctcgcctcctcttggccgtcctcctggcgtcgtccgcttgggttgcggcgtccgccggcgccggggacgaggtcatggtcccccgcccggcggcggcgctcaccttcggggagggctacacccagctgttcggggactccaacctcaggctccacggcgacggcaagcgagtccacatctccctcgacgagaggaccggctccgggttcgcgtcgcagggcgcgtacctccacggcctcttcagcgccagcatcaagctgccctccgactacgccgccggcgtcgtcgtcgccttctacatgtccaacggcgacgtgtacgagaagacgcacgacgagctggacttcgagttcctgggtaacgtcaaggggaaggagtggagggtgcagaccaacgtgtacggcgacggcagcacggcggtcggccgggaggagcggtacggcctctggttcgaccccacgcaggacttccaccgctactccatcctctggaccaatcgcaccatcgtgttctacgtggacgggacgccgatcagggaggtggtgaggagcgaggcgatgggggcgcagttcccgtccaagcccatgtcgctctacgccaccatctgggacggctccagctgggccacccn

SEQ ID NO: 27303 - DNA, 1433 bp, Triticum aestivum
  Clone ID: PAT_TA_27303
cggcacgaggtacgacgccatcagcaatgcacggcatttggtgtacatcaccggctggtcggtgttcccccacatcacgctggtgcgggacgggaaccagcaggaaaccctcggcgagctcctgaagcgcaaggccaacgagggcgtgcacgtgctcctgcttgtgtggaacgacgtctcctccattgaaggcttgtatgaagccggcctcttgggcacgagggacgaggtgacggccaagtacttccgcggcagccgcgtgcaatgcgtcctctgcccgaggaactggtccgtcagaggctacatcatcgaccccaagcgcccgtcgacacggtcgtttacagccaccaccagaagaccatcaccgtcgaccaggagctgcctgaatcttcgtccgggtcggacgggcgccgccagatcgttagcttcctcggcggcctcgacatgtgcaatggacgctacgacacgcagtcccactccctgttcaggacgctgggcacggggcaggcgcacagcaacgacttcagccaaatcaacttcagcgacgaggacgcgacgcttgacaagggtgggccgaggacgccatggcacgacatccattccaaggtcgagggcgccgtggcgtggccgcgtgggacgtgctgcacaacttcgagcggcgatggatgaaacaaggcggtggcaaggagcacctggtcgaccttgtggccctcgagagcaaggtcgctccgtcctcgtggccggtgacgctccccggcgaccacgaggcgtggagtgtgcagctgttccggtccatcgacagcatctccaccgtcggcttccccgactccatggaggctgcctatgatgctggcctcgttcaggacaagcaccgagtgttcgagaggagcatccaggacgcctacatcccacgccatacgtgccgcaaagagcttcatctacatcgagaaccagtacttcgccggcagttccttccagtggaaaacccacgactggcatagacccggcggacgtcggggcgtgccagcagatccccagagagctctcgctcaagatcgtgagcaagatcgaggccggcgaacgcttcgcggtctatgtcgtggtgcccatgtggtcggaaggcacccctacggggcgatacaggcaggcgatgctggacaaccagaggaggacgatggccctgatgtacgacgacatcgccgttgcgctgcaggccaagaagatcgacgccgaccccagggactaccttaccttcttctgcttagggaaccgggaggccaagagggagggcgagcacgagccggcaaaacgcccaaaggatgggacggactatgccagggcgcagaaggcacgccggttcatgatctacgttcactccaagatgatgataggtacagccggtactccattaatagtatctgatgttctgcttc

SEQ ID NO: 27304 - DNA, 1239 bp, Triticum aestivum
  Clone ID: PAT_TA_27304
cacgttggcccgctactcttctcctgtcctgtccaccagccgaactcagagctccgagctccgcctctgactccacctccggccacggcgggcaccatggcgccaacggtggagatcaggaatctcaccttcacctacccgggaatcgacggcaagccgccgcccggagcaccgcccctcatcgaggacgtctgcttctccctcgaagccggtcagcgctgccttctcgtcggctccaacggcgcaggtaagacaacgatactgaagatactgggcgggaagcacatggtggatccgagcatggttggggtcctgggaaggtcggccttccacgacacggcgcttacctcctccggagacctctgctaccttggcggcgagtggaggcgcgatgttgcctttgccggctaccaggtgaatatacagatggacatttcggcagagaaaatgctatttggtgtcactggcgttgatcctcagagaagagatgagcttatcaagattttggatgttgaccttacctggcggatgcacaaggcatcagatggtcagaggagaagagtccagatttgcatgggacttctcaagccattcaaggttcttcttcttgatgagataacagttgatcttgatgtgttggcaagagcaaatctgttgacatatctaaagaaggaatgtgcggaacaaggtgcaacaattatctatgccacacatatcttcgatggcctggatgactggccaactcacattgtctatgttgctcatgggaagttgcaactagcgctgccattagaaaaggtgaaagaaatgagccagttatcgctcatgagaacagtagagcgctggctgaggaaagagagggacgaagacaggaggaagagaaaggagcggaaggagaaaggcctcccggcattcgacaaggtcattgaggggagcagagtagtgaacaacgggtgggcagcaggaaggctcacttcgacgatagccggggaagagaacttttctttcagttcaaacagcgttcttcggtagtaatcccacactgcactttggttcttgagatgatgaataacagtcctatagcaccacactcgagggattttggcggtaacagcaacattcttgcacaaaaggaacagaaaatttgacaaaccatgcacgcctgctgcatgtatacgacaatgtactctgaatctatggtactgggcgtcgattattattgtttgattttttttgcgc

SEQ ID NO: 27305 - DNA, 709 bp, Triticum aestivum
  Clone ID: PAT_TA_27305
ccgcccccaggcccgcgcgccggcacaagtcgacgaccaaaaacagaggaagaagaagaaaagagatcgcggcccagagagagatctgagagagaggtgcttcggagatgcacgacttctgcttcacgatcccctacgggttcgcggtcctggccggcggcctgctgggctacctccgccgcggcagcaccgcctccctggcgggcggcgccggcgtgggcgggcttctcctcctggcagggttcgtcagcctcaaggccttcgagaagcgccgcaactcctacctcgccctcgcgctcgagaccctttgcgcactggccttgacctttgttatggggcaaagataccttgaaacttcaaagataatgccggctagtgttgttgctggcctcagtgttctgatgtcggcattctatctattcaaaattgctaccggtggcaaccatttctcgccaaagaaagagtagaccagacggtgcttggccaaactcaaagaccatatggcatattgtgttctgcattccaattgtaacttgactgatgctctatgttgtgcttgcacctttgctcaaatgttttgtatgcggacctgggaagtattcaccatgtaaatgaactaacatttcaattgtgcttcgccgaggtgcaaacttgtcttaaaaaaaaaaaaaaaaaaggcccctaccggtccaccttttttcctggtctt

SEQ ID NO: 27306 - DNA, 606 bp, Triticum aestivum
  Clone ID: PAT_TA_27306
ccgcccgggcccgcccagcggaggtctccttcccaagtgcttgtgctcgtcaggtgttccagaggatcgacgtggtgagccaggacttcgacaacatcgtggagctcgagctcggcgcgccgtggccgctgccgccggtggaggccacggccacgctggcacacaagtttgagatcaccggaatcgcgagtatcaagatcaatttcgacaagacgacggtgaagaccaaagggaacctgtcccagctgcctctgctggaggtgccccgcctcccggatagcctccggccgccggcgtccaacaccgggagcggcgagttcgacgtgacgtacctcgacgacgacacccgcatcacccgaggggacaggggggagctcagggtgttcgtcgtctcatgagctgatttttgctgctgctgctgctgctctcactctctctgtactgcttcaaattttttgcccctaaacaaaagtcttgtaatagttctctgtctaattttgccggagtagtattgtgatagaggctagcgtgcgttcttcacctatgggattaactttttctctctagcagattattacgttcggctatttcgttttggtttaaaaa

SEQ ID NO: 27307 - DNA, 451 bp, Triticum aestivum
  Clone ID: PAT_TA_27307
ggtgcgaagcaaactagtaacctcatacccctgtgccacaacattaatctctcccatgttcgtgttgatctcactctcaatgaagaggactctagtgttgtcatagaaggggaagccaccacttgcgggaagacaggggttgaaatggaagcaatggctgcagtgaccattgccggactgacggtttatgacatgtgcaaagcagcttcaaaggacatatgtataacagatatctgtctccagcacaaatcggggggaaagagtggaaactggtccaggaattagaagcttcagttgcttttctgaggatatgaatgcaggcctgaattcttacaccagaaggttttgatttgctttaaatttgtgcacactagatgttaaatctttgagccatcagagaaggttattttgaattccctgcctgttaatgcactgtccaactggttatatt

SEQ ID NO: 27308 - DNA, 680 bp, Triticum aestivum
  Clone ID: PAT_TA_27308
gcggcaccgtttcctctctgcggcagcaactcctcccatccatccctcgtccatcctggctcaggcgcgagagggtggagatgaggaggaaggcgctcgcacggggcttctccggcgacggcgtcctccgccgcagccgcccgctcccagcgcgccgcccgccaccgaaggggacaatagcacgagcaagaataagaaaggcgagatcggcaggaccatccgagacaggttatggtctttctctttccccagaagccgcctctcctgctggacgagccagagccacccgatccggcggagcaggagggggagcggcacggccggcgacgaacatggcacgccggtgaacgtgccggtgacggccaaggcaatcaggcccccctcaaggaaggtggtcgcggcagggaccagatccctgatcgaacgcaacgatttctacagccaagaatgcaacacgcacaagtagggagcctgtttttttctcttctcggatgctatccctgttttgggtgtgatactaaaattgtaggacgaggcattgccccctttgggacgtatacgagtttccccgggtaatatacgtaccaactcgaagctttgtactagtacaaaattgtgcaagttgatgagttttcatgagttccaaaccatgaaaccatagccaaaaaaaaaaaaaaaaa

SEQ ID NO: 27309 - DNA, 834 bp, Triticum aestivum
  Clone ID: PAT_TA_27309
gcacggggccgcgtggtcgcccccgaggtaccagaacccccaaatctcctcaacctccccggcgcatctccgacgacatggcccgcaccaagcagacggcgaggaagtccaccggcggcaaggcgccgaggaagcagctggccaccaaggccgcccgcaagtccgccccggccaccggcggcgtcaagaagccccaccgcttccgccccggcaccgtcgcgctccgcgagatccgcaagtaccagaagagcaccgagctgctcatccgcaagctccccttccagcgcctcgtccgcgagatcgcccaggacttcaagaccgacctccgcttccagtcctccgccgtctccgccctgcaggaggccgccgagtcctacctcgtcgggctgttcgaggacaccaacctgtgcgccatccacgccaagcgcgtcaccatcatgcccaaggacatccagctcgcccgccgcatccgtggcgagagggcctaggccgcaatctgcaatcaatatgccgtctgtccttgttaggttgagttcgtccgtggaagtgtgtgtgctattagggtttacgaatgtgtctgtgttgttcttgtcatggtggatgcgttatgcctaatctgatggtaccgtcttgttgccatcagcacattttcagtggaaatgaaaatgttggcttgctgttctcataaatctgcgtttgaatgactgtttccaacttctcaaatttctcccctgttttagttagcatgtcatattttgctctgattctgagcttgaattatcattccactgtcaattttgtaatgagtaatccggctagctgcctctgaacccg

SEQ ID NO: 27310 - DNA, 1151 bp, Triticum aestivum
  Clone ID: PAT_TA_27310
gcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgtgctcccgcaccaccgcactgcgggtcccggcggcgccccgcctccgctcgttccggttcagcggccccttcctctgcagcaaccttttctctggcgtcggtgactctttccaggatctctacctctgctcgggcgggccagtggccggcttgccgcccaccaatttgccctcggcggttcctcaccttgccaacatcaccaccctcaccatatgcagcattgccctccagtacgtgtctgcgtcactggccaccatcctcaaggagaccaatctccgcaggttgaaggagcttcaattgctcatgttcgggatggccaactccaatctcgcagacatttttagcttcctcaagacctgttcctgtcctcagttggagaggctcttcgtgcagctaccaacaaacacccatgattcgttcacgaggaattacttggacgtggcagaggaagaacagcctgaagacggattagaaaaccttcggttggccaagatgacaaacttcaaggggcatcacaatgagatgcgtctgctggactttctgctgacaaaggccagttgccttaagaaattgttcctggttgctcctaaagaggatcacccacaagggctaagaaagattcagtcagatgtgctgcccctttttcgaaaggcagaaattcttgaaagagcttcagcaggcacccagatagttttcagtgggcctgatagttctcacgcccagccattgcactcggaagtcttcatcagattttagcttgaaattagcaacagtgctgtagtccgattatttcttctaaatcattacatttatagctgttaggcaacaagcatgaatacaaatctgggacacatacagagtatggtagaacattttcgcaaatttgtacttcagatattctggcaagatggttaaaatgtgaggtgttaagatctgcaaaaaaaaaa

SEQ ID NO: 27311 - DNA, 550 bp, Triticum aestivum
  Clone ID: PAT_TA_27311
tggccaggagccccctgccgtttatttagtgctccattttttcattggcaagcatcctgccttgactaagtaaaatatgtgtaaagattggccaaagttcattgctcaaatcgagtcctggtagcaacaaggaaactgttgatagcacctgaataaggaaggccattggcgaactagcatgtcctatttaagctgataaagaggtggctggatctgatagtgaagatggtcccacaacgataggagaagaggagaggggatttctgaggcacaacaagcggctgatgaaggttctttggtcagacaggagtgtgctcagctggaggacatccttttggattatagttactactttgcatctcgatagaactagttttatttgcgtactagtgttgtatgtggtaaaaattgatggacaagatctgcagcctctcttgtacgtcctctcctctcccgtcctacaacaaaggtcacctcaatttggcgtcttgtctaaagagtttgtaattaacatcaccatcctgcttgtaagctcccgggattggcaatt

SEQ ID NO: 27312 - DNA, 493 bp, Triticum aestivum
  Clone ID: PAT_TA_27312
cgcggaggcaccgcaatcccccggcgtggagcacgtcgccggcgacatgttcaagaacgtgcccagcggcgacgccatcgtcctcaagtggatcctccacaactggaccgacgagcactgcacgaccctgctaaggaactgctacaacgcgctgcctgcgcacggcaaggttgtcgtcgtggaaggcatcctgccggtcgaaccggaggcgacgtccagggggcagcaggcgtccctcagcgacatgatcatgctcacgcacacggcaggcggcaaggagaggaaccagagggagttcgagcagcttgccaaggccgcggggttcaccggtgttaagaccgcctacatatacagcaacacctgggtcattgaactcaccaaatagctagatccgtcgtgtcatatctcttctcgttggttgttcctctccaaatctgcatgatgcgtaccttatctccttgatcctgaatggcgcataataaagggatttgct

SEQ ID NO: 27313 - DNA, 1340 bp, Triticum aestivum
  unsure (1)..(1340): unsure at all n locations
  Clone ID: PAT_TA_27313
acccctaccagcaaaccccgagaggaggcagaggcagctaatgggctccatggccgcggaaatgactgccgtcgaggaggcggcgagcggcctccctggccggctgacttccctgccgtcgaggaggaggcgtgcatctacgccatgcagctgtcgtccacggctgtcctgccgctgacgctcaagaacgccatcgagctgggcatgctcgaggtcgtgatgggcgccggcggcaagatgctgtcaccctctgaggtggccccgcggctgccgccgccggcggccatcccgcacgcgccggccatgctcggccgcatgctgcacctgctcgcatcctacaaggtggatgtcgtgctgaggtgggaggaaggcacgcaacgcccggacggtcacggccccacccccgtgtgcaagtggttcaacgccctccacctgggacggtcatctccattgccccgctgctccttctcaccaacgacaaggtccctatggagagcttgtatcatttgaaggacgcggtccttcatggtggcctcccattccacaaggcacatgggatgacaatgtacgagtacaccaaaacggacgcgcgcttgaaccgcgtcttcaacgaggccatgaagggctacaccaccatcatcaccgggaaagctcgtcgacttgtacacgggcttccatcgcatcgccactcttgtgggcatcaacttcgacctggcccacgtcatcgcggaggcgccgcattcacccggcgtggagcacgtcgccggcgacatgttcaagaacgtgcccagcggcgatgccatcgtcctcaagtggatcctccacaactggaccgacgagcactgcacgaccctgctaaggaactgctacgacgcgctgcctgcccacggctggcccgtcgtcctcggcgccaccctgccggtcaaccccgacgcggcgccccccgcgcagcgcgcggccctcagcgtcgtgggcatcctcccgctcacgccgggcgccacggccaggggccagcgggcgtccctcgccctcgcgatcgcccccgcgctcaccgctggcggcaccgcctgcatctacagcaacacctgggtcattgaattcacgaaatagctagatccgtcgtctcatatctcttctcgattgttgttgctctccaaatctgcatgatcctgaatggcgtatagtaaacgggtaataaacggatttgctaaaaatcaataccctttcctatactagttggcgacgccgccgcgttcccgtgtcaattagattttatgaaccgttaatnctcatgggaccgaattattacggcatagnatcaacgcttgttgctattaaat

SEQ ID NO: 27314 - DNA, 929 bp, Triticum aestivum
  Clone ID: PAT_TA_27314
aattttctattcaacgcgccaaatttatttctttattgatccatcccactgaatcatttgttaattattttgtagtaagttcaatacagggtaatatttctttctagtcaagcagagctaggcgcagaaaaaaaagatgcccactaattgcatcccaacttaaaccaagactaatgtgtttagcgacaattttttgcatcctgcctgacgaatgtcaaaagaaaaattttacggttccaccaggccattttgattggtgtggccttgttgggcgagaaagctatgtacctagtagaggttctaaaaaacaaccaccgtgcttcacttggcaaacctgaaaagatgatcatcgtgtgttcctaagaaaaaataagacgcccatagtcgtggttaatcttttcataataatgtgcttgtagatggggtgacggccttctgttgctcatagcaggatctacgtcgtcagctttgtgagggccaacctcaggcagctgttcttctggtagcagctgctcaccgccggcaacaactgctatgagacgtcgtcgtggctgcatggcagcatctttgtacacgagacggaggtcttaaccagcggactcttcagtcttttcgaccaggatatcatacgtgagttcccgatttgaggtcattgctggcagaagttccttaaacatggcatgccttgcttcagcttcaggaagtggtacaagaatccgcttctcaagccgacggagcatagctgcatctaattcccatggtagatttgttgctgcaagcacaaatactaagtcgttcgtttttgtcaagccatccatctgaataagtagctcagtcttcaagcgtcgactagcttcatgctcactacgagcttcaccacgctgactaataatagcatcaatctcatcaagaaatattgttgatggtgc

SEQ ID NO: 27315 - DNA, 2924 bp, Triticum aestivum
  unsure (1)..(2924): unsure at all n locations
  Clone ID: PAT_TA_27315
gcccccgtcgacgaagatgctctgcctcaccgccccctcctgctcgccatctctcccgccgcgcccctcccgtcccgctgctgaccggcccggaccggggatctcgggcggcggcaatgtgcggctgagcgcggtgcccgcgccctcttcgctccgctggtcgtggccgcggaaggccaagagcaagttctctgttcccgtgtctgcgccaagagactacaccatggcaacagctgaagatggtgttggcgaccttccgatatacgatctggatccgaagtttgccggcttcaaggaacacttcagttataggatgaaaaagtaccttgaccagaaacattcgattgagaagcacgagggaggccttgaagagttctctaaaggctatttgaagtttgggatcaacacagaaaatgacgcaactgtgtaccgggaatgggcccctgcagcaatggatgcacaacttattggtgacttcaacaactggaatggctctgggcacaggatgacaaaggataattatggtgtttggtcaatcaggatttcccatgtcaatgggaaacctgccatcccccataattccaaggttaaatttcgatttcaccgtggagatggactatgggtcgatcgggttcctgcatggattcgttatgcaacttttgatgcctctaaatttggagctccatatgacggtgttcactgggatccaccttctggtgaaaggtatgtgtttaagcatcctcggcctcgaaagcctgacgctccacgtatttacgaggctcatgtggggatgagtggtgaaaagcctgaagtaagcacatacagagaatttgcagacaatgtgttaccgcgcataaaggcaaacaactacaacacagttcagctgatggcaatcatggaacattcatattatgcttcttttgggtaccatgtgacgaatttcttcgcagttagcagcagatcaggaacaccagaggacctcaaatatcttgttgacaaggcacatagtttagggttgcgtgttctgatggatgttgtccatagccatgcgagcagtaataagacagatggtcttaatggctatgatgttgggcaaaacacacaggagtcctatttccacacaggagaaaggggctatcataaactgtgggatagccgcctgttcaactatgccaattgggaggtcttacgatttcttctttctaatctgagatattggatggacgaattcatgtttgatggcttccgatttgatggggtaacatccatgctatataatcaccatggtatcaatatgtcattcgctggaagttacaaggaatattttggtttggatactgatgtagatgcagttgtttacctgatgcttgcgaaccatttaatgcacaaactcttgccagaagcaactgttgttgcagaagatgtttcaggcatgccagtgctttgtcggtcagttgatgaaggtggagtagggtttgactatcgcctggctatggctattcctgatagatggatcgactacttgaagaacaaagatgaccttgaatggtcaatgagtggaatagcacatactctgaccaacaggagatatacggaaaagtgcattgcatatgctgagagccatgatcagtctattgttggcgacaagactatggcatttctcttgatggacaaggaaatgtatactggcatgtcagacttgcagcctgcttcgcctacaattgatcgtggaattgcacttcaaaagatgattcacttcatcaccatggcccttggaggtgatggctacttgaattttatgggtaatgagtttggccacccagaatggattgactttccaagagaaggcaacaactggagttatgataaatgcagacgccagtggagcctcgcagacattgatcacctacgatacaagtacatgaacgcatttgatcaagcaatgaatgcgctcgacgacaaattttccttcctatcatcatcaaagcagattgtcagcgacatgaatgaggaaaagaagattattgtatttgaacgtggagatctggtcttcgtcttcaattttcatcccagtaaaacttatgatggttacaaagtcggatgtgacttgcctgggaagtacaaggtagctctggactctgatgctctgatgtttggtggacatggaagagtggcccatgacaacgatcactttacgtcacctgaaggagtaccaggagtacctgaaacaaacttcaacaaccgccctaactcattcaaaatcctgtctccatcccgcacttgtgtggcttactatcgcgtcgaggagaaagcggaaaagcccaaggatgaaggagctgcttcttgggggaaaactgctctcgggtacatcgatgttgaagccactggcgtcaaagacgcagcagatggtgaggcgacttctggttccgaaaaggcgtctacaggaggtgactccagcaagaagggaattaactttgtctttctgtcacccgacaaagacaacaaataagcaccatatcaacgcttgatcaggaccgtgtgccgacgtccttgtaatactcctgctattgctagtagtagcaatactgtcaaactgtgcagacttgagattctggcttggactttgctgaggttacctactatatagaaagataaataagcggtgatggtgcgggtcgagtccagctatatgtgccaaatatgcgccatcccgagtcctctgtcataaagaaagtttcgggcttccatcccagaataaaaacagttgtctgtttgcaaaaaaagtccggctatatgtgccaaatatgcgccatcccgagtcctctgtcataaaggaagtttcgggctttcagcccagaataaaaacagttgtctgtttgcaaaaaaaaaaaaaaaaaaaccaatncncctataatgatcctatn

SEQ ID NO: 27316 - DNA, 1405 bp, Triticum aestivum
  Clone ID: PAT_TA_27316
ccacgcgtccgcccacgcctatactccatactacccttcctgatagcaatggacgaaacaacacctatactccatactacccttcattcacctgatggaggaagtgtttccgtcaaactccaagagcaaggcaggtcagatggcgggggaggcgatagcgggggcggagaagaagcctcggccaaagccagagcagaaggtggaatgccctcggtgcaagtctggcaacaccaagttctgctactacaacaactatagtatgtctcagccccgctacttctgcaaggcctgccgccgctactggacccatggtggctccctccgcaacgtccccatcggtggtggctgccgcaagcccaagcgctcggggacctccgacgcccacaagctcggcgtggcctcctcaccggaacccacgactgtcgtgcccccctcgacctgcacagggatgaactttgcgaacgtcctcccgacgtttatgtctgttggttttgagattccaagcagcctttccctaaccgcctttgggtcatcatcgtcgtccaacacggcggcgatgatgtcccctggtgggacgacgtcgtttctagacgtgctaagagggggtgcaggagggcttcttgatggcagcctcagtcagaacaatggctactactatggtgggccagccattggatcaggcaatgggatgctgatgacgccgccagcggtgtcatttggcattccagttccgatgcagcagcatggcgatctcgtggttggtggaaatggaataggtgccgcaactgcttcaatatttcaaggggccactagcgaggaaggagatgacggcatggggggcgtgatggggctccaatggcaaccacaggttggcaatggtggaggtggtggtggtgtatcaggaggcgtgcatcacctcgggactgggaacaatgtgacgatgggcaacagcaacatacacaacaacaacaataacgacagcggcggtgatgacaacaatggtgggtcatcgagggattgctactggatcaacaatggaggatcaaacccatggcagagcctcctcaacagcagctccctgatgtaagtgcaagaagaaaatgggaaatggaggtcattgaattggtgaagtgggtcaatcgttttcttactagtttcggcgcttcttcttcttttacttgcttgacttatttcgctccatcattttcatgttttgtttaagtggggattgttttgtttatttgagtgaaactccagacaatgtgtgtcatctgcgatgcttaattaagtattgtttgtttcatgacattagtaattgaaggatttatggtttaagctttatctaggtgatgttgtagagaatgcatgcacattattcttagttaagttgtttacccactgatcc

SEQ ID NO: 27317 - DNA, 699 bp, Triticum aestivum
  Clone ID: PAT_TA_27317
ccgggtcgaccggaggtgcgccattattcatcgacgagctcatccaaagagcggaggcacaaaagaagaggaagagcattcacacgggttcatatacacaagatgaggacaagtttatttgccaagcttgatggagattagccaagatccgaggaccggcgcgcaacaaaagggcattgttttttggacgagagtccacagaacattccatgaaaggaagatgtttaagccctaccaaattacaagcaaccgtggcatcggctctattcaaaaaagatggttgttcatccaacaagagtgcaacaagtatcaagccgcatttgagagcgttgaagcacggcccgtgagtggtctcgacgttggggacacggtatgctctcctcttcctagccctttccttgctacggccatgagacttcggccttgtatatgtttgcatgttcacttgttgttgatcatgtggtgtaggcatttcaatctttggtggcattcaaggcccggcacatgacaagccattcactcttacgcattgttggacgctcatcgacaattgccctaagttcaaggaccaataccgtgaactacaaaggaagagatgactgaagacagccaagttcgccggaggtggagatggcgaggcgttgaagaggccgaggggcaagaccaactccaaggttgatgacatacgtgatgcctcat

SEQ ID NO: 27318 - DNA, 604 bp, Triticum aestivum
  Clone ID: PAT_TA_27318
cggacgcgtgggcggacgcgtgggtttctccccctcttcctcgcagaaggagcagcaggtaatccggtcgaattgataggggagacgaggagcagcgatggccgccgctcgagcccgatggcggctcctcgcgctgcccctggcgctgctcctcgcgatcggctcgtcgcgcggcgtcgacgcggcgcccaagccccccgtccccaaggccatctccgacctgagggaggcgatcgtcaaggggctggggctccagtcggaggagctcaaggtgtccgggttcgacgtgagggacgcgctggtggggcacgcggtggcgtacgagttcgacatggaggtcgggaggaaggccgtgccggtgcggctgctcgaggacgtcaaccggtgggacttcgtcgacctgcccatcttccggtcccaggccgacgccgacgacacggcgctcgccgagatcgggcgggggagcttcgaccccacactgccgcccttccagctcgccgggcccatggagctatggatccaggacggcgacgacgtcaggctcgctttgccgcatgatgtggaagctggaaccctgaagaaagttgttcttgctgacggtgcg

SEQ ID NO: 27319 - DNA, 672 bp, Triticum aestivum
  Clone ID: PAT_TA_27319
ctagttctagatcgcgggcggccgctcgcgatctagaactactcgcgtgcgatccctgctgtcactgacgatgaggatgaatcgcctagccccggattgtggccctttttgtcattgaatgcatcagatggcagcctgcaggggcttgaagaactactggcgaaggttttgggtaagaaggccggtgagaagggcacgttcaagttggtgaatgcacgggcctcggcacaaacatatgtcaaaatgggattcacggtggagaagcggattgctgatggagaggtgaactggtctaacttgccagagtggagaacaaagcccaagaagttgagagcgcactatgaagttcttgctcgcgtggagcgtggccaggcgatcccggaaaggatcgcccaggtgcagcctttccaggtcgacgaggccatgtccgagagcatgctcactggaaacgtgtctagatcgaagatggaggtagtaaaccccccaccggtttatttcactttgtgagactgggaggggctggaagctttttatttccaaagctctacttgggatggatgtggcaaaatgtactgatttctgcggtaacatggaacttgtatgttatactggctagctttgtaaattgcgggcgcgaacaaggaggccttacagtgaagtgctgccatgagc

SEQ ID NO: 27320 - DNA, 1620 bp, Triticum aestivum
  Clone ID: PAT_TA_27320
cccacgcgtccgctcccccttttctttcccccccgagtgccaagtaaacgggtcgaattgataggggagacaaggagcagggatggccggcgctcgagcccgatggcggttcctcccgctgccgctcccggtgctcctcgcgatcggctcgccgcgcggccgcgacgcggcgcgcaagccccccgtccccaaggcccccgtcccccagggccatctgagccctgagggacgcgatctctaaagggagggggtcacggtgcgggggttcgacgtgagggacgcgctggtggggcatgcggtggcgtacgagttcgacatggaggtcgggaggaaggccgtgccggtgcgactgctcgaggacgtcaaccggtgggacttcgtcgacctgcccatcttccggtcccaggccgacgccgacgacacggcgctcgccgagatcgggcgggggagcttcgaccccacgctgccgcccttccagctcgccgggcccatggagctctggatccaggacggcgacgacgtcaggctcgcgttgccgcatgatgtcgaagctggaaccctgaagaaagttgttcttgctgatggtgcggtggtaacagtgaaaggtgctagggcggtgagcctccgtttgcccctcgaactaccacttcctctcaaccgcaccacatacaagggccgcctgtctagcttgctttccattgctcgagccctacgcggtgcagctcggtctaatcagaaacccctgatgtccctccggatcgagggtccaacctcattatcctcaaccccttccatgtctccgaatgacaagctcaagctcaaaaggttggccccaggtcaagtggagctctcctcgcgtgcgatccctgctgtcacagacgatgaggatgaatcacctagccccggattgtggccctttttgtcattgaatgcatcggatggcagcctgcaggggcttgaagaactactggcgaaggttttgggcaagaaggcgggtgagaagggcacgttcaagttggtgaatgcacgggcctcggcacaaacatatgtcaaaatgggattcacggtggaaaaagcggattgctggagaggaagagagtgaactggtctaacttgactggagtggaaaaccaagcccaagaaaattgagccgcgcactatgaagtccttgctcggtgtgcatgcgtaggccgaggcggatcccccggaaacggatcgcccagggtgcatgcctcttctccgtgcgaaggaggccatgtccgagagcatgctcaccggaaacgtgtctagatcgaagatggaggtagtaaaccccccaccggtttttttcactttgtgagactgtgaggggctggaacccttttttttccaaaggtctaacttgggattgatttgggaaaaagtaccgaatttatgcagtagagccggggattgttatgttatacggggccaggttggcaaaaagcggactgcagcaagaagcaatttgaatgcagtgcaacaatggctaaatttgaaaaatacgggcgcgaacaaggagggcttacagtgaagtgaggaaccttgctgatcggtcgttcccagtagacatctaaaaaaaaaaagtcgacgcggccgcga

SEQ ID NO: 27321 - DNA, 1963 bp, Triticum aestivum
  unsure (1)..(1963): unsure at all n locations
  Clone ID: PAT_TA_27321
ggcaagatagtacttatgattcctacaacagtcaaagctttcagtggaatcagtactccaagacagcgcctgcagctgacgcaaatgcttacagtacccaggcttccgagnaaacctagaagaaatgaagagagctacagctacaactaccctgaaagtggaaacacatgtgaccctgagagaactacttcaaggcgtggccggtttgcaaagcggagaaggcatagtaatgattatacgactgtggattatgctggagataacaaagaaacagtggttgcaagcacagagacaaatgctttcactgatgtggggcgggttaatggcacttcagtggaaaagatgagatctgcagtgagtgtaaggagagctaatgttttgagagagatctcccagattgatacacggggtctacttgttgagaaagccaaagaagccgtccggggaaaattgcaagagctgagcatggcagcatgttcacggtttgcagagaaaaggaagtcagaaggaaaggtatatcctagtgacaacaacataaaggcaaatggggtcctctctggcaagcttggcaaaggactcaagctatgcagttcaataagtgtcgacacccacatacctgcaactgcagctgatgaaaagaatccagaacagaagcgtgtgcctgtttcaattgatgtcccagatcctgacttccatgattttgataaggatcgcacagagagagctttttatagcgaccaagtatgggctacatatgacagtgaggatggaatgcctcgtctatatgcaatggtgcagaaagttctttcaatgagacctttcagaatccgcatgagtttcctcaattccaaatccaatattgaactgtcgccaataaactgggttgcctctggtttccagaaaacatgtggcgattttagggttggaaggtaccagattacggaaacagtcaacatattttcgcacaaagtcagctggactaaaggcccccgtgggattatcagaattattcctcagaaaggtgatacatgggctttgtaccgagactggtctcctgattggaacgagcttacacctgatgatgtgatatataaatacgagattgttgaagttattgatgatttcactgaggagcaagggctgactgtcattccattgttgaaggttgctggcttcaaagctgtgttccataggcacatggaccccaaggaggtgaggaggataccaaagggtgagctgtttcgattctcgcatcaggttccttctcgactgctgactggtgaagaaggcaacaatgccccggaaggttgtcatgagctcgatcctgctgcaaccccagtggaccttcttaaggttattacagaggtgaatgaagacgtggcggcgcagactgctgaatagaagagggcaacaactctgaacactgaagatagcttgggtgtctgaagtgtgaaatgtactacacagatgacaacaagtcaacatttgttggtgtcttagttctattatgccatcttatttttggctgatgacttggacaatactgccagggcaagcagcttatgtcgtggacttctgactgttaattcttaggcatttctaacactcggagtttatcgcgccatggatatcatcttctagagtaaaagaagcattgggaggcgattgatgcggcgactagtcaaaggaaagctatggagcctcatggcttgctgacggcgttactctgttcaggtatggtgttgagcataggagccatcaagttcgaggggggagacgccactggacttccccatgtacccggaaattattaatgtaccaaatttacctaagatgttgtatttcctttaatctatagcgatgcgtccttatataatgttgaactcgatgatttcaaaattctgatttgaactcggtgaactggttcggcaatttaatattatatttagtggaagcttgcccg

SEQ ID NO: 27322 - DNA, 704 bp, Triticum aestivum
  Clone ID: PAT_TA_27322
atcgctccatcatgccatatgataccatgcagatctataaccgctgttgtacagcagagataagcctcgggcgagttgctccagcaatccaggccacaattgtaggtgtttgtgtgactaaaggggagtggccttttaagtatggatgtaaagtttcttgcttcttttctcctgctgatgcaacggagggatgcgaggcagaagtcgttttgcttgaccgccgtgctaaaaggatgcgtgcgggatcagatgggtatctttctttgtcaagaaatgtcgtgtcagtgggattgcagggcacactccgagtcgtcacagaagcatactcagagtccggactcaatattgttcgaaaatatcacgctgaatttcctatccagcagagtcagatagatagtcgtgagtgctcagttgacggctccacattgaagatagttgttgcttggtctcgccttgtcattgacaaggatgatcttgtactcgatggttattgaaggaggaactgaggatgcacaaaggaacaatggagctggtggtgctgtgtgttaattccttagtttagaatggagctggtggtggcatgaagacgtggttccttagtttagaatgttgaatcgtgatgatgtctagtttgaaagacgagaattatcatatggtagtactgctgatgactaaaaaactatgcatgttgaggactttgtcca

SEQ ID NO: 27323 - DNA, 1510 bp, Triticum aestivum
  Clone ID: PAT_TA_27323
ccttcttcatggtcgcagtggtgggtgagttggccggcaccatctcgcttccttcttcgagctgctggcggtgtgcagctcgtcgttaccggcgcgccgccgtgctaggggctgcactcagtcccttgtgcacgtcggctcttcgcttcgtctgggcgccgtccctgggtcacccttccccggcttgggtgccgttggtttacccgttcctgttagaggtaatgacaaggccaattcaaccatcagagcacatgattctagtgcatcatcaattaaagcttgctttcatggtctgcttattggtgcccaagtcgatctgcctatggatgcccaagttacaggttagtgccataatgtatgaaatcagcattttgatgtgggagttcagtgctcgttatgtggctaatcaggcaaagacctctgaagagcgaggaatgttagaaaccccaattcgtgctcggcaaatagtgcctcgtgttcgcggcctttatgggatggacatttataagaataaggtcttagaattcttacaaagtgaacgatctgatgagtctatatttggattatggggcacgtcgggtgttggcaagacacggcttctttcactcatcgctgatagctttgccgattcatttcatcacgtcatatttcttgatggtggtagtagcgtcagagttatgcaaaatcatttcgcatactttttgaaattggattgggagacaatctcattgttggaggagcattaccgagctaaaatcatcatggagtacctagagcatgtcagttttttggttctgttagacgatgtgcaagatgaagtctacccagatttgacagctgttggtttgccgatggctcttgggcataggcaaaaggttattcttacgtcgaggagtcaggtagcatgtgctcgcatgggatgcaccatatcaaacactctggagatgaagtgtctcggggatgaagatgcttggagtcttttcgagtataatgcgggagtaaaaatcacagaagctgatactgaaatttatgaatatgcaaaaaagatggtttcagcatgtggagggttgcctagagccatatgtgctattggcataggcgtagccggtgccacttgcaggggaaaacatccagatgattggtggtttacctacaagcgtttcaaggctaaaaatctgccaccggaacgaatggaagaaatagtgcctgttctggtttaggcaacttgtgcgtggctcctaggagctgtggagacatggttggacttcattacgtgttgctgccacaatgaagtgttggaagagtccagatggcggcagtttgatgcttacttgtgaatatggtgtgatatgtttgatgatattactttttctagtatgtgttttcttgacttgtcagtcttctgatgcgtaaacacagagagcagaacaccttcatgctccttaagcactccgggcagttggccttttaaaaattgtattatataattggggccgtccgatctcctatc

SEQ ID NO: 27324 - DNA, 1313 bp, Triticum aestivum
  Clone ID: PAT_TA_27324
cccacgcgtccgcttgaattgatgagggacactctcaagtctcctttagatgagcaagttaaacgtgcccttcgcgtaccattgccaaggacattgaaaagggtggaaacactccattatatctctgagtacatgcacgaggaacgacataacccaactctattggagcttgcgaagctggaatttaaccttctacaacatgtacacttgaaggaactcaaatatctcactaagtggtggcgcgatctgtacaggtgtgtcgggctaaactatgctcgggaccgcctggtggagggttacctttggtgctatgcgatataccatgagaaagaatttgcgttctcaagaatatttcttaccaagcaattgatgcttatttccttgatggatgacacatatgatgcccgtgccaccattgaggaatgtcgacaactaaatgcggccatacaaagatgggatgagagggccacttctcttctacccgactaccttaaaaggttctatactgaactattgaggatatttaaagatgctacgagtgaagtgacaatttgtgacacttaccatgttgcctatgcccgaaaagcgtttcaagatctgtctgcttattatctccaagaagctgaatggttacaccagaatcacaagccaagctttaaagatcacctgagtttatcagccatgtccataggatcaccaacgatatgtgtaggtttgatggttggcatgggagatccagtcacaagggaagcatttgagtgggcagctggttacccaaaagtcgccatagcgtgcgggaagatagcacgtctaatggatgacattgccgcattcaaaggcgggaaggccaagggggatatggcaagctctatagagtgttacatggttgagcacagtgtcacaagtgaggttgccatttccaagatcctatcactgctagaagacgaatggagaactttaaatcaagctcacttcgaacatcactcacacctcctagtggtgcagcggattattaactttgctaatagcatgctagtgttctatgctgggaaaaatgcatataccttcagcataaatcttaaggagactgttgagagcctttttgtgaaacccattcccatgtagcctctaataggttgtgtggcagtttatcttcagcaaagatgcagtagcctctaataggttgtgtggcagtttatcttcagcaaaaatgcatgccatcgtgcatcataacttatgagttggagtgtgtgccctatatttttttctacatacagtataagttaatatggtaaagataagtaattgtactc

SEQ ID NO: 27325 - DNA, 757 bp, Triticum aestivum
  Clone ID: PAT_TA_27325
aactaccaaattgcccccatctgtgctcagaaatatgtcaccctggtcaatgcccgtcagtggatcagtgcatgaaaaaggttaatgtacgttgtgcatgcaacaccctgaaaaaagagtgggtatgtcaagatgttctcaaggagtaccgaaggtcttggtcgtgacccaaaagaagtagcaaaaggccagtttggagttggcctaattgcatgtggtggagattgtgtgaaaaaggtcaatgttccagctgcagagttacatcaacggaaagttcaggagaataagaaccctgctgcagaagtcgcaaacgtgcccaaacgtaggaagaagcgtgaccgtggagcacaggaacctgttcaggtttcaatgtggcagcgaatcaagtggtatctcgtggtgataactgcgttagctggattggtggtgctgggactagttatttggaaaggcgtctaccagatttcggattggatgaacgaaatggaagagcagaaggccagggaaaggcttctgagggctggaaggctgtaaaaagtacagaactatagattgactcttgttgtacccccagttatcagtttttgaggaccatttgacgccgcagtccagttttggagacatttaagtgaaggttgccattcttttgctccctcgttgtatcagaaggaagatgactgttgtattgtgtctgaattatggtgttgagtcgctgtaaatgcacaaatgatgtctgcctaaatatatgggtggtgaa

SEQ ID NO: 27326 - DNA, 704 bp, Triticum aestivum
  unsure (1)..(704): unsure at all n locations
  Clone ID: PAT_TA_27326
tggntgtgagtgtctctggcgcgggatcctggacgcctccggcggcggctggtgaaagggatagacggatcctggacatcttcggcgacgggtcctgaagggatcggcgccggatcctggaagcgttcggctgagggtcctcaactggacatgcaccggatcagtggaggccggatcagtggagaccagcggcggatcagtgccagggcggcggcgaagggatggagcggcggcggtgaagggatgaagagcggcggcgggcgaatgagggcacagactcggtcgtctgtttctcgctcgagggcacgagacctcgctcgtacgtgcgggggattggtttgtgatttattttcgctggttaattttcgccgggtttttctcgctggttaattttcgccggtttgttcgtgtcagatgggtgtgaagggaggttaggcgcgtgggggcggatgtgggactcggccctgagggtttttcttggttcatcgcggctgagcgggaggtgggagcaggtaccaaaaaaaccgggtgaggtgggacgaaagttaaacccggaatgcgacctaccaactgagatattaggagtagagattgcgctgtcctttccaattacttctgttgtcttactcttatcattaaacccccactacacctaaattctcgggcttgtgatgattgaatctttttaaggggtggtgcacact

SEQ ID NO: 27327 - DNA, 790 bp, Triticum aestivum
  Clone ID: PAT_TA_27327
tggggaagatcaaggagagagccagccatgtacgccaggaagaggtgcgttgccacggccatcgtgctggtgctctggctccaggccaccgccgatgccgcccgcctctcccctgccggcttgatccggcttccgagcaacggcagaggtcattatactgaccaagtcagggagtcaaaggtgatggattgtcaggatggctatgtggagagatgcatacgcatcggtattaccggcattatctgccgttgctttcctaaaaatggtgttggtcttactgaccaagcaatgttggcgacggctgcctcaccgagtaagattgacgaggagagaccgtcaccgaaaaactcccacgaccaaggtgattctactgatcaagtcaaggagtcaaaggtgacgggttgtcttgatggctgtggagagatgcttcatcatcgatacaactccggaacgtggttgctttcctaaaaacgaccgtgttcgtttcactattcaagcaatgtcagcgacggcgagctcaccgaggaagatcgacgaggagatccctttgccgcagaactcacacgaccaaggtgcgtgattgaaatgcatgccatgtaattagtaagatcttttaattaaatgttgtgtcaaggaacaccccatcgcgattcaatatcccagattggggtccttcctacagagtcaagggacttgtttgtaattgcccatttatgtcgaactgtaatcactgttgtaatatggttatatgaataaatttttgggatccttcgggatccctctctctctc

SEQ ID NO: 27328 - DNA, 422 bp, Triticum aestivum
  Clone ID: PAT_TA_27328
gcaccgtagagttgagtgcaaaattatcaaaacttggagaagttattacaagctagactctggaagtggctgacagaaaagggatgccaggctactggatgttgtttctatggtgggcgtagtgtgatggatacttagctatgaccacatatatgtactgtagtctctagatatattagaagaaataacatctttatttgtagtgtatatagtgccaaagtagcaaccccttgtgagattctctgttctgctataatgactgcagagaggtttatatagaccttattgagacccctcagagggagagagcctgtccttatttgtagtttatatagtgccgaggtgctgtcctgtcttagcctgatgggttgtgagcaggttatttatatgtctgagaaatggcaaagttcatgggtttgtgt

SEQ ID NO: 27329 - DNA, 779 bp, Triticum aestivum
  Clone ID: PAT_TA_27329
gattcggccgaggctgaagatgatggatggcatccgaacgtccgcctttcgtccgccttccgtccgtggatttgttagcaagacaagaggagtgaaggcatataaccattatggcaaggatctggagatggtttccgctgttttatgtgctgggctttacccaaatgtcatacagtgcaaaagacggggcaagaggacagcattctacaccaaagatgtcggaaaggtggacattcacccatcatcagtcaatgcaggagtgcagcaattcccattgccttatctggtttacagcgagaaggtgaaaactgctagcatttatgtgagggactccacaaacatatcagattatgctcttctactttttggtggttccttaagtccaagtaacaccggagaaggcatcgagatgcttgcggggtatcttcatttctctgcaccaaagcgtatcatagagttgatccagagattaagaggtgaattggacaaactccttcagaggaagattgaggaacctgcacttgacatcttttcggaagggaaaggggttgtggctgcggccatagaactgttgcacagtcaaaacatttaccactagatgctacatatacacgttgcagaaggcaattccccaactaaatgaaacccgtcctaagattttgtaatatctgtattctttagtaccttctgcttggacaagcacctttggctctcaggtttaggcgcacctgatatggattattttagtaattccaaaaaatgtcaaaaaaataaagttt

SEQ ID NO: 27330 - DNA, 803 bp, Triticum aestivum
  Clone ID: PAT_TA_27330
gcaggtgtggcggtagtcacggcactcggcagcggaatcggggaaggaaacgcaattccggatccgttcctctttctcggaccggccgatggcgtcggcgtcggcgtcggcggctttggagaaggctcggcagctgctggaggaggcggcggccgagtcgctgccgacggagcaggtggacgcgctgccctccgggttctacgacgccttcgtgctctgcggcatccgcgtccacgccgtcgagcccggccgcctcctctgccacttcaccgtccccgcccgcctcctcaactcgggcaacttcctgcacggcggcgcgaccgcgtcgctggttgacttggtgggtactgctgtcttctacaccgccggggcacaaaccagggctcaccactagagatgaacatctcctacttggatgctgcattttcggatgaagagattgatatcgaggccaaggttctgcgtgctggaaaagcagtaggagtggccactgtggaactgaagaagaaatctggcaaaatcatcgctcaagcccgctattccaagtatcttggcgcatctagtaaactgtgaaggtgtccttgcgttgtgagctgtaagcctgtaattgctcttgtttacttggcaatcttaatgtaatagaataatgttgtcttgaaatggaaaatatggaaattaattcaggagtatgctacatactgcattacaaggacctttgcatgcttcattgcagagttgaaataaaaatagaattatttctgctacattgatttatgcaaaaaaaaaaaaaaaaaaaactcgag

SEQ ID NO: 27331 - DNA, 978 bp, Triticum aestivum
  unsure (1)..(978): unsure at all n locations
  Clone ID: PAT_TA_27331
cananaaaaggagagcgacgggcgggcagcagcgtctcctccccctgccctcatccctattgccgccgccgggtcctctcctctccctatcggtgcgagtgggcgggtcgcggcttgtggagagcgaggagagggaggagacagatgcgtgaggaggaggaggccacggccgtcggctcctctcctctccccgtcggcgccagcgcgctggtcgcggggagtgaggagagcgaggagagggagggggaagatgcgtgaggaggaggaccaggcggtggcgcagcagccagattcgaggcgcgtgggcgcggaggcagccgcggtgggctccgacctcttcttcacgcacggcggcaggagcagctccacctctccactcccccatgcgtgagccctccacaaccccacccaccacaccgaggcggcgtccaaaggcggtcggcggtggcgcaggttctaatagatgagtgatgactaatggttgatgcaaaggaggaggcgtactgatggaagctggcagcaaaattaggagctctccgtccttgagcccttcttctcctctctccgcgccgtctcgcctcccctgctctcgcaccgccaccttccctgcctggcgctcgaggcgccatgattttggatcgggcggatatcttcaccgggagagtaggagcacttgctgttaatatgaacgatctctcactaagttttgttatggcattgtgccgattcatgatttaaacacgcaaaatgtctggtttgcatatttgtgccttgccctgttaccagcagtgtattttttgccgtaagaaagacaacaatgctttatttctttgactttttgaccgtgtctaatttctggtaaaagagaggaatttcagagagatagacaacctggagagctttgaatggttgttcgagtgtgccgccagtctcctcgccgccgctgttgcgtagctggcaccggtgtgtggcgactgc

SEQ ID NO: 27332 - DNA, 798 bp, Triticum aestivum
  Clone ID: PAT_TA_27332
ctcgtgcccttcccggcaccggcgccccttcgctagcgtccgcccacgcgtccggtggatctccggcgagcgcgagacgagctccgatggcgagcggaggcggatacgcctgggccctcgcggcgggcctcaacgccgcgctcgccgccatctccgccaagttcttcgctcccacgttgctgaaatacggcatggtgatacttttcaacgtgacaatgtgggggtgctacgtgaacagcctcaaagctttgtcgtccctccaggcaacggtcaccaacttcgccgccaacttcatctcgtcaggtcttgcagggtatttcctgtttcaggagcctctgccttccaagtggtttgcaggtgccagtctgatcattcttggtgtgttcatcctcagcaaatcaagcattgaggagaaagtgaactctgattgattgggagttgctacaagtctgttagctggggcataaatttttgagcttatgccactatttccagtggatgtttgctcgtcctgatgcaatgctaaacatccgaaaataatgtgtgcatttggtctcagctcatccactatcatgtacactagtacggtttgagatccagcacccaatttgtaatttgtaggtaagtgagcacacgatgtaggagttgcttgctttgcttttttccacggggagggcatttcaaactgctgtagcattgtcggtggatctatattttgcatttctcttgttgtaattttgtgacatcacaattaagctgatcacatactatttctagtttaaaaaaaaaaaaaaaaaa

SEQ ID NO: 27333 - DNA, 556 bp, Triticum aestivum
  Clone ID: PAT_TA_27333
agaagaaacatgcaattttattcgggcaaaagctttattcagaaacagaggtctgttatttccaagttgcaatagtactggccacacatgatgatgtatggcacttttattttgtaactcttcatcgatcaactaaacgttgatcgatctagctagcacatcacagatcttagcagacaccaccggcacaggtagctgtcatggggatgctgtagatggcgggggtgatggtgctgcacggggtggtggtgcaatattgtgggatgttcacgctgcacatcgacggaagggtctgaagcaccatcctcgttatctcaactggaacctgctgctgaggctgcctgaaactttgcccttgctgctgctgaggctggccgaaacgttgcccttgctgctgccgcatgatgatctgtgccacactacagaccgcctggcaccgagactgctccgagatctgggccagtggctggcagcactggtgccgcatcaactggcaaccgcttgcctgccacatctgtgactggacatatggtgttggcttcacttgttgcaggaa

SEQ ID NO: 27334 - DNA, 824 bp, Triticum aestivum
  Clone ID: PAT_TA_27334
gttttgtatcgctctctttttacttttgcattttgctcttgtgccatggctccatggcacaactatttggcatgagctttaacccatggcaaagctctcgccaagggggtttcagagagtgtacactcaataggctacaagcatctacaccacttcgtcaagtgaggtcgcaagcaggcctaaccgagtattttgatgaggaaaatgagcagtttcgttgcattggtgtatttgtcatccgtcgtgtaatcgaacctcgtggttatttgttacgcgataccacaacactcatggattagtctacatcatccaaggaagtggttctgccggattgtcttttactggatgcccagagacattccaaaaacagtttcaaaaatatgggcaagcacaatttgtacagggtcaaagccaaagccaaaagttcaaagatgagcaaccaaaaggttcaccgtttcaaacaaggagaagtcattgcactaccgcaggcattgtccattggttctacaatgacggtgatgcgccaattgggctttttatgttttcacgtaaccaacaatgctaatcaacatgaacctagcctaagggaattttgtggcttggcacttatagagtggaaacttccttctcccaaaaaaatttaaaggttttacattttcggcctcttggagaggccctgggctccaggggaaaaaatgcccacgcggcttaaaaacaaaaaaaaaagggggcgcaaaccccctggaaaacaccctttcaaaatttaaaaacgcctttttttcaaccccccggggcggaaaaaatcccccccccccccctcatta

SEQ ID NO: 27335 - DNA, 997 bp, Triticum aestivum
  unsure (1)..(997): unsure at all n locations
  Clone ID: PAT_TA_27335
ctcctcttcaaacgccatggcagccactggtttcgcttcgctctttttttacttttgcattttgctcttgtgccatagctccatggcacaactgtttggcatgagctttaacccatggcaaagctctcgccaagggggtttcagagagtgtacattcaataggcttcaagcatctacaccacttcgtcaagtgaggtcacaagcaggcctgactgagtattttgatgaggaaaatgagcaatttcgttgtgctggtgtatttgtcatccgccgtgtaatcgaacctcgtggttatttgttaccacgataccacaacactcacggattagtctacatcatccaaggaagtggtttcgccggattgtcttttcctggatgcccaagagacattccaaaagcaagtttcaaaaatatgggcaaagcacaatcccgtacagggtcaaaagccaaaggccaaaagttcaaagatgagcaccaaaaagttcaccgtttcagacaaggagatgtcattgcactaccggcaggcattgtacattggttctacaatgacggtgatgcgccaattgtggctatctatgttttcgacgtaaacaactatgctaatcaacttgagcctaggcataaggaatttttgttcgctggcaactataggagttcccaacttcactctagtcaaaacatattcagtggtttcgatgttcgattgcttgctgaggccttgggtacaagtggaaaaatagcgcnaaggcttcaaagtcaaaatgatgacataattcatgtgaatcatacccttaaatttctgaagcctgtttttacacaacaacgagagccagaatcctacccacacactcaatatgaggaacggcaatctcaggcanaacactctcaggaagagcaaccttcaatggggcagtctcagggagagcacactcaaacgggcaatctcagggaaagcacattcaggagagcaactttaaatgggcagccttaagcaaac

SEQ ID NO: 27336 - DNA, 699 bp, Triticum aestivum
  unsure (1)..(699): unsure at all n locations
  Clone ID: PAT_TA_27336
cggccgcctttttttttttttttgaggagaaatatttattaatactcatacattgatggatcttccaccccacaaccggccacattccctaggaattactcagcataaacttaacctatcacatatcataaaagcataatccagtcaacatagaggcctaggaactaaatcaacatttctcctttgattaccagatacgaaacatccatctatcggccttgagatgggacatggtaactgccacagtcggagccaggtttgagtggattcttgcagtaatcagcgacatacacaaccttatccatgcataccaccttctcaatctccttggtgaccttggagcacatgcacggtgcattgaccttctgaaccacactacaacatgcactcgacggagttatctttgggctcgcgggaaacatcacatatggtttgcactctcggattagccctttaaggtcgacggtacaatcttcagccgtcacaacaagaacaaaggcaagaaccaagagcaaactaaagtgttttgccataactactactactagtaatcggttggttacctctctcctagatgttaactggtgccgaattcctgcagcccgggggatccacatagttctagagcggcccgccaccgcgggtggagctccagcttttgttccctttagtagggttggttcgagcaaagngnnnatc

SEQ ID NO: 27337 - DNA, 1880 bp, Triticum aestivum
  Clone ID: PAT_TA_27337
cagctatgtcagccactagttttgtatcgctctctttttactgttgcattttgctcttgtgccatggctccatggcacaactatttggcatgagctttaacccatggcaaagctctcgccaagggggtttcagagagtgtacactcaataggctacaagcatctacaccacttcgtcaagtgaggtcgcaagcaggcctaaccgagtattttgatgaggaaaatgagcagtttcgttgcattggtgtatttgtcatccgtcgtgtaatcgaacctcgtggttatttgttacgcgataccacaacactcatggattagtctacatcatccaaggaagtggttctgccggattgtcttttactggatgcccagagacattccaaaaacagtttcaaaaatatgggcaagcacaatttgtacagggtcaaagccaaagccaaaagttcaaagatgagcaccagaaggttcaccgtttcaaacaaggagatgtcattgcactaccggcaggcattgtacattggttctacaatgacggagatgcgccaattgtggctatctatgttttcgacgtaaacaactatgctaatcaacttgagcctaggcataaggaatttttgttcgctggcaactataggagttcccaacttcactctagtcaaaacatattcagtggtttcgatgttcgattgcttgctgaggccttgggtacaagtggaaaaatagcgcaaaggcttcaaagtcaaaatgatgacataattcatgtgaatcatacccttaaatttctgaagcctgtttttacacaacaacgagagccagaatcctacccacacactcaatatgaggaacggcaatctcaggcaaaacactctcaggaagagcaacctcaaatggggcagtctcagggagagcaacctcaaacggggcagtctcagggaaagcacattcagggagagcaacctcaaatggggcagtctcaggcaaaacactatcaaggagaccaacctgaagaagggcaggaagggcaatctcaagaagaacaatctcaggcagggccatatccgggatgtcaacctcgtgcagggcaatctcatgcatcacaatcaacttatggtggttggaatggtttggaggagaacttttgtgatcataagctaagtgtgaacatcgacgatcccagtcgtgctgacatatacaacccgcgtgccggtacaataacccgtctcaacacccaaacgttccccatccttaacatcgtgcaaatgagtgctacaagagtacatctctatcagaatgccattatttcaccattatggaacattaatgctcatagtgtgatgtacatgatccaaggacatatctgggttcaggttgtcaatgaccatggtcgaaatgtgtacaatggccttcttagcccggggcaactattaatcataccacagaactatgttattatgaagaaggcacaacatgatggaagcaagtacattgaattcaagactaatgcaaactccatggttagtcacatcgcgggaaagagctcaatcctcggcgccttgcccgttgatgtcatcgccaatgcatacggcatctctaggacagaagctcgaagcctcaaatttagtagggaagaggagctgggagtattcgctcctaaattcagtcaaagtatcttccatagttctcctaccagcgaagaagagtcatcttaagagcgcatgagctaatgtcaaaactagctcatggactaaaataaacacatcattgagtgtgtagcactttgatgtttccatatatggtcttctcaataagatatcaacaaaggtccattgtgtttcatatgtttacctttttggaaatttcatgaactttgttttgggaaac

SEQ ID NO: 27338 - DNA, 1567 bp, Triticum aestivum
  Clone ID: PAT_TA_27338
tcctttttttatgaaacacaatggacctttgttgatatctctctcctcctcaaacagttatggcagctactagtttcgcttcgctctctttttacttctgcattttgctcttgtgccatagctccatggcacaactgtttggcatgagctttaacccatggcaaagctctcaccaagggggtttcagagagtgtacattcaataggctacaagcatctacaccacttcgtcaagtgaggtcacaagcaggcctgaccgagtattttgatgaggaaaatgaacaatttcgttgtactggtgtatttgccatccgtcgtgtaatcgaacctcgtggttatttgttaccgcgataccacaacactcatggattagtctacatcatccaaggaagtggtttcgccggactgtcttttcctggatgcccagagacattccagaaacagtttcaaaaatatgggcaatcacaatccgtacagggtcaaagccaaagccaaaagtttaaagatgagcaccaaaaagttcaccgtttcagacaaggagatgtcattgcattaccggcaggaattgtacattggttctacaatgacggtgatgcgccaattgtggctatctatgttttcgacgtaaacaactatgctaatcaacttgagcctaggcataaggaatttttgttcgctggcaactataggagttcgcaacttcactctagtcaaaacatattcagtggtttcgatgttcgattgcttgctgaggccttgggtacaagtggaaaaatagcgcaaaggcttcaaagtcaaaatgatgacataattcatgtgaatcatacccttaaatttctgaagcctgtttttacacaacagcgagacgcagaatcccgcacactcaatatgaggaagggcaatctcaggcaaaacactctcaggaagagcaacctcaaatggggcagtcacaggaagagcaacctcaaatggggcagtcacagggagagcagcctcaaatggggcagtctcaggcaaagcactcagggagagcaacctcaaatggggtggtctcaggcaaagcactctcagggagaccagcctgaagaagggcagggagggcaatctcaacaagaacaatctcaggcagggccatatccgggatgtcaacctcatgcagggcgatctcatgcatcacaatcaacttatggtggttggaatggtttagaggagaacttttgtgatcataagctaagtgtgaacatcgacgatcccagtcgtgctgacatatacaatccgcgtgccggtacgataacccgtctcaactcccaaacgttccccatccttaacatcgtgcaaatgagtgctacaagagtacatctctaccagaacgccattatttcaccattatggaacattaatgcccatagtgtgatgtacatgatccaaggacatatctgggttcaggttgtcaatgaccatggtcgaaatgtgttcaatgaccttattagtccggggcaactattaatcataccacagaactatgttgttctgaagaaggcacaacgtgatggaagcaagtacattga

SEQ ID NO: 27339 - DNA, 868 bp, Triticum aestivum
  Clone ID: PAT_TA_27339
tttttttttttttttttttttatcatgtaaaacatgcaattttattcggacaaaagctttattcagaaacagaggtctgttatttccaagttgcaatagtactggccacacatgatgatgtatggcacttttattttgtagctcttcatcgatcaactaaacggtgatcgatctagctagcacatcacagatcttagcaggcaccaccagcacaggtagctgtcatggggatgctgtagatggcgggggtgatggtgctgcacggggtggtggtgcaatattgtgggatgttcactctgcacatcaacggaagggtctgaagcaccatcctcattatctcgaccggaacctgctgctgagggctgcccgaaactttgccccttgctgctgccgcatgatgatctgtgccacgctaccagacgggcctggcaccgagcctgctcccgagatctgggccagcggctggcagcactgttgcccgcaccaactggcaaggcgcttgcctgccacatctgtgtctggacatgtggtgtctggcctgcactgctgcaggaaagcagcgcatgtgttcatctgccggctgtggctgcggctgcggctgcggctgctgctggcattgcccgtagccctggctacaggtagtgtacagctgcgcaacagcgcttgtcgccgtgaaggcgaggagagcgaggaggaacatggtcttcatggtggctggctataagcttgctttggtgtttatgtttgtgctcgtgccgaattcctgcagcccgggggatccactagttctagagcgggccgccaccgcggtggagctccagcttttgttccctttagtgagggttaatttcgagcttggcgtaatcag

SEQ ID NO: 27340 - DNA, 939 bp, Triticum aestivum
  unsure (1)..(939): unsure at all n locations
  Clone ID: PAT_TA_27340
tttttttttttttttttttttttttttaaggtgaaaagcttctgacatttcatttatcatgtaaaacatgcgattttattcggacaaaagctttattcagaaacagaggtactggccacacatgatgatgtatggcacttttattttataactcttcatcgatcaactaaacggtgatcgatctagctagcacatcacagatcttagcaggcaccaccagcacaggtagctgtcatggggatgctgtagatggcgggggcgatggtgctgcacggggtggtggtgcaatattgtgggatgtttacgctgcacatcgacggaagggtctgaagcaccatccccattatctcaaccggaacctgctgctgaggctgcccgaaactttgccccttgctgctgctgaggctgggcccgaaacgttgccccttgctgctgcccgcatgatgatctgtgccacggctacagaccgcctggcaccggagcctgctcccgagatctgggcccagcggctggcagcactgttgcccgcatcaactggcaaccgcttgccctgcccacatctgtgactggacatatgctgtctggctgcactgctgcaggaaagcagcgcatgtgttcatctgcggctgtggcttgcggttgcggctgccggctgcggctgctgctggcattgcccgtagccctggctacagggtagtgtacagctgcgcaacagcgcttgtcgccgtgaaggcgaggagagcgaggatgaacaggttcttcatggtggctggctataagtttgctttggtgtttatgtttgtgcctcgtgccgaattcctgcagcccgggggatccactagttctagagcgggccgccaccgcggtggagctccagcttttgttccctttagtgagggttaatttcgagctnncggatcaaannnnnanggnnnnaaa

SEQ ID NO: 27341 - DNA, 884 bp, Triticum aestivum
  Clone ID: PAT_TA_27341
ataatgtgagatacttgtgtgatctcatttatcatgcaaacatgcacttttattcagacaaaagctttattgagaaacaaaggtttcttatttctatgttgcaacggtactggccacacatgatgatgtatggcacttttattttatttttcacccttcatccatcatctaaactaaatggtgatcggtctagttagcgcatcacagatcttagcaggtaccaccaacacaggtagtggccatagggacgttgtagggggtctgagtgatggtgctgcatggggtggtggtgcaatattgcgggatgttcacgttgcacatcgatggaagggtctgaagcaccatccttcttatctcaatgggaacctgctgttgaggctggccaaaactttgcccttgctgctgctgaggctgaccgaaactttgcccttgctgctgccgcatgatgacctgggccacaccgcagacggcatggcaccgagcctgctccgagatctgggccagcggttggcagcactgttgccgcatcaactggcaaccgcttgcctgccacatttgtgactggacatatggtgtcgggctacactgctgcaggagagcagcgcatgtgttcacctgttgttgtggctgctgttggcattgccccatagccctggctgcatgtagtgtccagctgcgcaacgacgctagtcgccgcgagggcaatgagagcgaggatcaacatggtcttcatggtggttggctacaagcttgcttcgatgtttatgtttgtgcctcgtgccgaattcctgcagcccgggggatccactagttctagagcggccgccaccgcggtggagctccagcttttgttccctttagtgagggttaatttcgagcaagcg

SEQ ID NO: 27342 - DNA, 931 bp, Triticum aestivum
  unsure (1)..(931): unsure at all n locations
  Clone ID: PAT_TA_27342
ttttttttttttttttttttgaggtgagaggcttctgacatttcatttatcatgtaaaacatgcaattttattcggacaaaagctttattcagaaacagaggtctgttgtttccaagttgcaatagtactggccacacatgatgatgtatggcacttttattttgtaactcttcatcgatcaactaaacggtgatcgatctagctagcacatcacagatcttagccaggcaccaccagcacaggtagctgtcatggggatgctgtagatggcgggggtgatggtgctgcacggggtggtggtgcaatattgtgggatgttcacgctgcacattgacggaagggtctgaagcaccatcctcattatctcaaccggaacctgctgctgaggctggccgaaactttgcccttgctgctgctgaggctggccgaaacgttgcccttgctgctgccgcatgatgatctgtgacacgctacagacggcctggcaccgagcctgctccgagatctgggccagcggctggcagcactgttgccgcatcaactggcaactgcttgcctgccacatctgtgactggacatatggtgtctggatgcactgctgcaagaaagcagcgcatgtgttcatctgcggctgtggctgcggctgctgctggcattgcccgtagccctggctacaggtagtgtacagctgcgcaactgcgcttgtcgccgtgaaggcgaggagagcgaggatgaacatggtcttcatggtggctggctataagcttgctttggtgtttatgtttgtgcctcgtgccgaattcctgcagcccgggggatccactagttctagagcggccgccaccgcggtggagctccagcttttgttccctttagtgagggttaatttcgagcttggcggaantcaaanctancggaatcanancntct

SEQ ID NO: 27343 - DNA, 1946 bp, Triticum aestivum
  Clone ID: PAT_TA_27343
actagtttcgcttcgctctctttttacttctgcattttgctcttgtgccatagctccatggcacaactgtttggcatgagctttaacccatggcaaagctctcgccaagggggtttcagagagtgtacattcaataggctacaagcatctacaccacttcgtcaagtgaggtcacaagcatctacaccacttcgtcaagtgaggtcacaagcaggcctgaccgagtattttgatgaggaaaatgagcaatttcgttgtactggtgtatttgccatccgtcgtgtaatcgaacctcgtggttatttgttaccgcgataccacaacactcatggattagtctacatcatccaaggaagtggtttcgccggactgtcttttcctggatgcccagagacattccagaaacagtttcaaaaatatgggcaatcacaatccgtacagggtcaaagccaaagccaaaagtttaaagatgagcaccaaaaagttcaccgtttcagacaaggagatgtcattgcattaccggcaggcattgtacattggttctacaatgacggtgatgcgccaattgtggctatctatgttttcgacgtaaacaactatgctaatcaacttgagcctaggcataaggaatttttgttcgctggcaactataggagttcgcaacttcactctagtcaaaacatattcagtggtttcgatgttcgattgcttgctgaggccttgggtacaagtggaaaaatagcgcaaaggcttcaaagtcaaaatgatgacataattcatgtgaatcatacccttaaatttctgaagcctgtttttacacaacagcgagagccagaatcctacccacacactcaatatgaggaagggcaatctcaggcaaaacactctcaggaagagcaacctcaaatggggcagtcacaggaagagcaacctcaaatggggcagtcacagggagagcagcctcaaatggggcagtctcaggcaaagcacactcagggagagcaacctcaaatggggtggtctcaggcaaagcactctcagggagaccagcctgaagaagggcagggagggcaatctcaagaagaacaatctcaggcagggccatatccgggatgtcaacctcatgcagggcaatctcatgcatcacaatcaacttatggtggttggaatggtttagaggagaacttttgtgatcataagctaagtgtgaacatcgacgatcccagtcgtgctgacatatacaacccgcgtgccggtacgataacccgtctcaactcccaaacgttccccatccttaacatcgtgcaaatgagtgctacaagagtacatctctaccagaacgccattatttcaccattatggaacattaatgcccatagtgtgatgtacatgatccaaggacatatctgggttcaggttgtcaatgaccatggtcgaaatgtgttcaatgaccttcttagcccggggcaactattaatcataccacagaactatgttgttctgaagaaggcacaacgtgatggaagcaagtacattgaattcaagactaatgcgaactccatggttagtcacatcgcaggaaagaactcaattctcggcgccttgcccgttgatgtcatcgccaatgcatacggcatctctaggacagaagctcgaagcctcaaatttagcagggaagaggagctgggagtattcgctcctaaattcagtcaaagtatcttccgtagttttcctaacggcgaagaagtgtcgtcttaagagcgcatgagataatgtcaaaactagctcatggactaaaataaacacatcattgagtgtgtagcactttgatgtttccatatatggtcgtctcaataagatatcaacaaaggtccattgtgtttcatatgtttatctttctggaaatttcatgaactttgttttgcaagttgcattaaaaaaaaaaa

SEQ ID NO: 27344 - DNA, 1136 bp, Triticum aestivum
  Clone ID: PAT_TA_27344
cgagaaatgggccagttcaacctttggccaatggagttaaaaaagaaccacctgttaccttggtccataagaatttccagggcatactgaccaatgaaaccaaatgcttaagatgtgagacagtaactgcaagggacgaaacgttttttgatctgagtgttgacatcgagcagaatagttccattacaagctgcctgaaaaatttcagctccactgagactttaaatgccgaggacaaattcttctgtgacaaatgttgcagtttgcaagaagcacagaagagaatgaagatcaagaaggctccccatatattggtgatccacctaaagcgctttaagtacattgagcagcttgggcggtataagaagctttcgtatcgggttgtcttccccatggagctgaagatcagcagtacatctgatgatgtggatactgaatactctctctttgctgtggtggtccatgttggaagcggccccaatcatggccattatgtaagcctcgtaaaaagccacaaccactggttgttcttcgatgatgaaaacgtggagatggttgaagagtcaaccctgcaaacattcttcggttcttcgcacgaatactcaggcaacacagatcatggatacatcttgttttacgagggccttggtgcgaagagtttaggttgattttccctgttgtttttcttttctctttctttggagcatgcaagtttactgttgtatgtacacagctatttcaccacctccatgggaaattgttaatctcagagattgtgagtatgaacctgaggaaagccagattttttgtggttctagtgtacagcggaaaatggaaccttgctccagtgatgatgaaataaggcggcgcaagtcataaagtacgctcgactatactttccaccgacattctcaccaaggaatgtaacaatgcattgggttctatatgttgattctaatttgaagtttttatacactagatttagccatttgatgtgatagcagtgcccttcgaggcttggaatcatatgtccagttagaattataatagtatggtgtatgcttgactttatgatggttgaattgattgagcgagtttggctattgaggttacttttgaattcaaaaaaaaaaaaa

SEQ ID NO: 27345 - DNA, 409 bp, Triticum aestivum
  Clone ID: PAT_TA_27345
gccggccgggccgggagctagtgtcccacgcgcgatgagagtatttgtgctggttgtagtgcttgtcgctgcggtgctcctcgccctgggcgccggcggcgtgcaaggccggaggatgctcgggagccgagggggcggcgtggccccaagcccgccgtctgcgtcgccctacatcaataataatccatagtaatggctaactcatttgagaagcagaaagaaattgtattttctttcaggtagtctgctcagtctgatacgtagcttccacatgcttatgaagcattaagagtactgatggttgtacgtttgttctctcaagttattctgtaatgatcctatactattggtgtatcaaaaccttaagtcagatacagtgtaattttcgtggagtaccgagtaagccagc

SEQ ID NO: 27346 - DNA, 655 bp, Triticum aestivum
  Clone ID: PAT_TA_27346
caagtccgtcctcgtcggcggcgaggcggtcaacgtcccgtcggacacgtggggcggcgccaaggacggctccggcggcaccatcatcgactccggcacgacgctgagctacttcccggagccggcgtaccgggcgatccggcaggccttcatcgaccgcatgagcccgtcctacccgctcatcgccgggttcccggtgctgagcccgtgctacaacgtgtccggcgccggaaagatcgaggtgccggagctgtcgctggtgttcgcggacggcgcggcgtgggagttcccggcggagaactacttcatccggctggagccggagggggtgatgtgcctggccgtcctgggcacgccgcggtccggcatgtccatcatcggcaactaccagcagcagaacttccacgtcctctacgaccttgagcgcaaccggctcggcttcgcgccacgccggtgcgccgaggtctaggccggccggccggcctccgtgcattttgactgaaaatttgttgactggtaggagttcgtaggtggctctgctgactggatgggaagaagaaacggtgaagaaactgggttgtgtgtagaaagaaactgggtttggattgacaaacagagcctctctgaaaagacagtgttttgatgatttttgacc

SEQ ID NO: 27347 - DNA, 1015 bp, Triticum aestivum
  unsure (1)..(1015): unsure at all n locations
  Clone ID: PAT_TA_27347
acgaacccaaagggtctgcgatgcatgctatgataggcttgatccattgcagaacttactgataaattctgtcagcaacgcgacacaaactgcaaagcatgatgttatggattggacttctgcgagagggtggttgaatttgcctattggattaacattggaacacgagatatacaaggcagcagcatcccttaggagctacagtcaggtttcaaggataaacccgagaaaatctattccgcgtgcagtccttagtggagcaagtggacttgctatcttgacagttgtaaaagctggtgcatttcttacatacaaacttggaactggcttagtagttgctcgtaaatcagatgggtcatggtctccaccctctgctatagcttcagctggattaggatggggagcacagcttggcggtgagttgatggatttcatcatagtgcttcatggtcctgaagctgtgaagaccttcagtagccggatgcatttttcactcggtgcaggcttaagtgctgcagcaggacctgttggtagagtattagaagctgatgtgagagctggtaataaaggctctggagtttgctatacatatagtcacagcaaaggcgcatttatcggggtttcactagaagggaacattgttacaaccaggatggatgccaatctgcggttctacggcgacccgtatctgacgaccagtgatatacttatggggaatctggagcagccaaatgctgctaaatttctgtaccaagcgttggatgacctatactcaggtctggattgttagcacgacaaaaaaataaaaaataaatcacagtctgtacatatttgattttattccaactgttgctaagttgtgctgattctcaaaatgcttctgtcattttggcgagcagagtttgctccatgggtatgattcaaatgccatataaacagctacaaaacctgttgcctaagatggaagtctgtaaagttaatgcattcctatgattcaatcaanaaaaaaaaaaaa

SEQ ID NO: 27348 - DNA, 639 bp, Triticum aestivum
  unsure (1)..(639): unsure at all n locations
  Clone ID: PAT_TA_27348
ctgntgagctcgcaaaaatgtngatcctggagcgaaatttaagtgtacaaagcaagaggtagaaagggctattgtttcttctgagggtgatctagaaaagctgaggaggccttgaagacccagaagcaagaatcagcaacaaccgcatctaagcctgaagtgtctggtgattcaagtggcttggttaacaagcagcaggtcatgcttgcgcagaacccagcaaggcctcaaacaaatgggttctcttcagtaggggctcagcaaatgaggagagatgagaaggacccaaattacaagcttttagttaatggtagtggcccaaaagaacctgcagttaagggtttcaaccattggccacaacagtgaagtcagatttggtccgtcaacaattttttcaacccgagaagaggcgggttattgccaattcggttccatcagctccttatgtgacatcatctccggtgcctgttgcagtgccacaaattaaggcagaaacacgacatgtggcagcaggcaatgagatgaaaagtgcaatgcataacggaagcttgcgagatccggtagttgtgatgcagcgtcttcaatccgcagctgccaagcaaagtctaccatccacaagccattagtatgtnttgcatc

SEQ ID NO: 27349 - DNA, 618 bp, Triticum aestivum
  Clone ID: PAT_TA_27349
ctcgtgccgaattcggcacgggctccctcggcggcccgcttatctccctctctcgcccctctctctctctctcatccgacaggaacaggcagacggcggcggcaggaggtgagcggcggcagcgggaaccggcaggcggcagagctggaagaaggcgagcggcagcaggcggtgcctgctctgcttgtacttgtccctgcctccgcacccaccatcggcgcaccaggcagtcgccccctcctcctacgccttgagttcttggctgctggaccacttcctcggccgcagatcgggccatgagccgcaagcttcgcccttcaccagaagatctgctcttccatgcccagttcgagcctctccttccgttttttccctcagatcggaaagagcggcgtgatgcaagcatcagcaaaggcaagcaacatcgtggctttttggttgtgcgcaattagtggcgactggtgaaaattggctgatgttatatgtatgcatcgtgattgttcgtaaagaggatttctttgtgacttagacaaactcaatcacatattgtagttccctctgttcagactagatgatatatatgttttctgtttagccctccaaaaaaaaaaaaaaaaa

SEQ ID NO: 27350 - DNA, 1973 bp, Triticum aestivum
  Clone ID: PAT_TA_27350
cccccccccggcttcacctcacatccttcgcgagcggctgcaccgcctcgcccccgaccgagtcccacggcggcgcggttaagcacctcacctccttccccgtcgatggcggtaatccaacctccgccgactgaccggccgccgcaggccgcgcggctcgcgaccacttcttgctggtgctcggcgagggcgcggggcaagcgaggcggcaccggctcccgcgggctgcggagatgtctgaactcacaccctcccttgcagtggtggaggtaaaaaagcaggcgggggctagcgaagagtatgatgatttctgcaacaaggaattgaagccaggaatgcagcatcttgtgcaccagatggccccagttccaattacacctaccatttctgagtaggccgaaaggccttcaaggtaacaggcgccaccgcccctagagctaacggggatagggggagcgactctccaagctagaaagaaactggagtcgggtgcaactgacaggagcaagagttcttgtagtctcgggcactgacgatgatgagcgcggttacttggttaactctggagagcatacgtaatgttatccgagacgggagctagattgtggctgtatatggtgtcaccctagctgctgtttaaatgtttgtacttttctctacttaatttgctgatgatgattgtgtatgtactcccgctgttggtttatcagcagaaccgaataattttgggtaatcgttaattcaaggaccaaactgattgaggaataaattgggtgcaacatgcattgcatgcaccctctagcaacaaaacatcatggccatgtaccgtaaggtttacaagggagagttccgatgtccaaggtggttctccaaggaccttactagcctgatcatgcgttttcttgacacaaacccaagcaccaggatcaccttgccggaggtcatggagagccggtggttcaagaaaggtttccggccagtcaagttctatattgaagacgaccagctgtacaacgtgatagatgccgagaatgatatgctcgacctgggcctcccagaccctcttcctcaaccattgccgcctccacctccatctccatctccacaacaagttgatggagacgactcagggtcagagtcggacgcatcagtcgtgtcctgccctgccacatcgtcatttgaagagcgccacaggctccgcgggccactcccacgccccgcaagccttaatgcgttcgacatcatatcattctcaaggggattcaacttgtcggggctgtttgaggaaaaaggggacgaggtgagattcatctcgggtgaacctatgccagacattataacgaaattggaggagatcgcaaatgtgaagagcttcgcggtgcggaagaaggattggcgggtgagcctagagggcacaagggaaggggttaaggggccactaacaatctgcgcggagatatttgaactcacgccctcccttgtagtagtggaggtaaaaaagaaggcgggggataaggaagagtatgatgatttctgtaacaaggaactgaagccaggaatgcagcatcttgtgcaccagatggtcccagttccaaatacacctaccatttctgagttggccgaaaggccttcaaggtaacaggcgccaccgcccctagagctaacggggatagggggagcgactctccaagctagaaagaaacaggagtcgggtgcaactgacaggaacaagagttcttgtagtctcgggcactgacggtgatgagcgcggttacttggttaactctggagagcatacataatgttatccgagacgggagctagattgtggctgtatatggtgtcgccctagctgctgttcaaatgttatactttctctacttaattagctgatgattgtgtatgtactcctgcttatcagcagaaccgaataattttgggtaatcgttaattcaaggatcgaactgattgag

SEQ ID NO: 27351 - DNA, 405 bp, Triticum aestivum
  Clone ID: PAT_TA_27351
cggccgcgtgggccgccggctcgcccgactcttcgccgaggtcgccaagttcaaggccaggttcgacaagatggagaacaagtccgccaccaggcaatccgaggagtcgtgaatagctctgagctccaggttgtcttggccggcgtgacgtggttcgtcatcggagccgctgtcgccggcttccttcaggtggtgcttggaagaagaaacgagtagagatccagcgaatgaaatgtgcacgcgccgtggttagagaatagagatagaacaaagctgtaatttttagtactacattaatccgtccatacaataggatgaatagaaatttgttaggatatactccctccgtgccataatatgctactctcttcgtcctaaattataaaagtgtttctttacactagc

SEQ ID NO: 27352 - DNA, 918 bp, Triticum aestivum
  Clone ID: PAT_TA_27352
gtcccgtaccttacacctccaacctctagtccctctcctcgggcttctccccctttacccaaccaccccccttgttttccatgctccgactgtaacccctttcctccagctggtaggccaatgttaaaaccaccctgctttggtagtggccctaagctgcctccatttgtgcattcaccacagccatctgctgttccatcccccccagttcataaaccataccttcctccagcatttccaccaatccctggccgtgtagatcctccccatcccttaccatctccaaatcatgtaccaaacgcagtccctggaccaacttatcaaatgatgccgataccttcacccccagtgcctcattttcgacatccaattcctccacggaagaaacgaagtggcacaacaaccaagtctcctccaattgctccatctccgtattctctcctccattcctgaagtgatggtcagattgcttccaatgtatctgctccattgttcacaaatctatcctgaatacgaggtcgatgtggttgcaattttgctgcttggaacttcctgaactgggaatcgcaatatgatgctgcaaaggcggggttctgttttcagtaaaatttaactgtatggtgaattccggaccatctgaggcggatataactgtagatataggtctattttatacgaattctcagggatttatgttgaggccttacccctttaccgaattgtaaggtttcaccgaagggttggggacttgtggtagagaagaatgtgtactcttaaggtctcgccgaagggctgggggcttatggtagagaagaatgtactcatgctcttacctgtgacatattcagcatactacaactcgcatctttgatgtggcatttcctgccgaaaaaaaaaaaaaaaaaaaaaaaaaaaaaa

SEQ ID NO: 27353 - DNA, 508 bp, Triticum aestivum
  Clone ID: PAT_TA_27353
cggacgcgtgggcggacgcgtgggcggacgcgtgggctttctacctatgatcgtcatgaattgaattacaatcaaattgctttaagtcggttaccaatctccataatgggagattacacaattcaaacaattaggaattcgtctgaaagtaaaataaacaaagaaaaatcttcgaattcaagaacgattactgattactaaactttgattttgtctttttgttataaaaatctaataattctttattaaactttaaaattaaactataaagaaaaactactgcttattggaaattatttcttattttaaatcagactagattttcgtgatataatataatttataactatacagtttatacacaaaaaaataccctaatccttttttccttccttgaatcctttagttttagtcagttcatgaaaaattttatactattaatttctttttatccataatggatttacctgtaaccacacatgcagtactatgatctgtcttacccgtg

SEQ ID NO: 27354 - DNA, 1010 bp, Triticum aestivum
  Clone ID: PAT_TA_27354
gagatggtgtcggacgccagcaagaagaaggcggcgcagaagaaggccgccgccgccgcaaagaggggcgccaaggtgcccgcctcctcctccgcatcgtcttccgcctccgccaacaagactggggccaaggccgctgccgacgccctcgccgccgtccagctctcggaccgcacctgcaccgccgtgctcacctcccacccgctctcccgcgacatacacattgagtctctcactttaacattccacggccacgacctacttgtagacacagacctggagctcaactacggcaggcgctatggtttgcttggtctgaatggctgcggcaagtcctgccttctcaaagcaatagggtgcagggagcttcctatccctgaccacatggatatataccacctcagccatgagatcgaggcttcagacatgtctgcacttggagccgtcattagctgtgatgaagaaagggtcaagctcgaaaaggaagctgaagttttggctgctcaaatcttgaggcatgcgtgtggctggaagaaacgctgaagaaatttgaccgtacacttgttgtgacttcctgaatggagtatgtaccaacatcatccacatgcagaacaggaagctgaagctgtacactgggaatttcgaccagtatgtccagacccgatctgagctggaggagaaccagatgaagcagtagaggtgggagcaggaccagatcgcgtcgatgaaggagtacatcgcgcgcttcgggcacgggtccgccaagctggcacggcaggcgcagagcaaggagaagacgctggccaagatggagcgcggcgggctgagggagaaggtggcgagggacaggatcctgacgttccgcttcgcgaatgtgggcaagctcccgccgccggcgctgcagtttgtggaggtgacgttcgggtacacgccggacaacctgatctacaagaagctgactttggcgtggaccttgactcgcgggtggcgctggtgggtcccaacggggc

SEQ ID NO: 27355 - DNA, 1923 bp, Triticum aestivum
  Clone ID: PAT_TA_27355
caccccgtcccgcaacaccccgccccgctcgcccaccgggccgcgccggccgccgccgcctcccagccgccaccacaccacaccaacccccccgagacgaggggcggcgaggagacgggcgccgccgtcggacgcccgcacggcgccggcggcgcagaccaaggccgccgcagccgcaaagagggccgccaaggtgcccacctcctcctcacctgcatcgtcttccgcctctaccaacaagacgaccgggacgggggccctcgccgccgttcagctgtccgaccgcacctgcaccgccgtcctcacctcccacccgctctcacgcgacatacgcatagagtctctcacgttaacattccacggccccgatctacccgtagacactgagctggagcccagctacggcaggcgccatggtttgcttggtctgaatggctgcggcaagtcctgcctgctcaaggcaatagggtgcagggagcctcctatccctgaccacatggatatataccacctcagccatgagatcgaggcttcagacgtgtctgcgcttggagccgtcattagctgtgatgaagaaagggtcaagctggaaaaggatgctgaagctttggctgctcgtgcggcggccggggctccagcctggggccgcgtagctgggcggctacaggcctttgttccatccaccgcggtgctgcgcgccgctgactttttctctggctttggcttgtacaagcagatgcaggccaaggaaaaccagggacttctctggcggttggcgcatgagaattgctttggcaagagctctcttcatgaatcccaccatccttttgctcgatgagcctaccaatcatcttgcacccgccgccgggcctgcggcttgaagaaacactgtagaagttcgaccgggtaattcatgtgatattacagttgcaagacttcctggatggagtatgtaccaacatcatgcacatgcacaacaggaagctgaagctgtacactgggaatttggaccagtgtgtccagacccgatctgagctggaggagaaccagatgaagcacaacaggttggagcaggaccagattgcgtcgatgaaggagaacatcgcgcgctttgggcacctgcagtacatgctgaaggagtacccgggcaacgaggaggagcggatgcgggcggccatcggcaggttcgggctgtcggggaaggtgcaggtgatgccgatgcggaacctgtcggacgggcagcggagccgggtgatcttcgcgtggctggcgtggcgtgagcagcagatgctgctgctggatgagccgacgaaccacctggacatcgagacgatcgactcgctggcggaggcgctgaacgagtgggacgggggcctggtgctggtgagccatgacttcaggctgatcaaccaggtggcgcaggagatctgggtgtgcgagaagcaggcggtgacgcggtgggagggggacatcatggagttcaaggagcacctccccaagagcaagtgcggcatgtcggacgactgagctgaggcatgtttgttaccgagagagatttatctatctatctatctatctatctatctatctagtatgtttattagagagagaagaagatgcttgcttcggctgctgctgctggtttattagaagaagagttgttatgatgaagatgaagttatccatgcatgcatgcatgcatatgacgggtgatgcctaaactcctcatgtttgtgcggcggcaaaggcaccaaacagatgcgtgtaagcaaggctactacagtactatttactatcaaagttgttgcttgtcacctgaaactgaaactctgtttttattaagtttattcttggctggctggctggcttgtataatgaatgaattgcatacggcatgccgtatgtcacttgtattttattttt

SEQ ID NO: 27356 - DNA, 515 bp, Triticum aestivum
  Clone ID: PAT_TA_27356
gtttccatatgccgctgcaccatcatccactgccatgttgaggtggtggagattagcaggcagcagtctttgtggcgttgatggggaggtgtcttcgcggtgctgattgggaggttgagacctcgtggaatccatgttctcaggcggaggctaagttggcgatttgccactgcagttgtgaatcagcataagagatggcacacttccggtgtaggtgccgagggcctcgctagatccagatggattgttggagccgcaatctcgctcgccactctgcaggggttgttaaggttgatggcgagcctctacagggtgatgtagtgccattttttctttgaaaaaactcagactttattcatttgtaataagtaataagtacatcatttgtgaggagcattacaatttcatttaaaggctcctcaaaccaatcggaagtcaaagaaaatctagctggaaatcagggtgatgtagtggcagaggaaaggctgacgggacgaaatgaccctccttgcttg

SEQ ID NO: 27357 - DNA, 749 bp, Triticum aestivum
  unsure (1)..(749): unsure at all n locations
  Clone ID: PAT_TA_27357
aaacgtgctcaagccagtcctttggatattaatatctcatcttgctctgttaccaaaccacttggttttctaggtgcaacaggagtagtctgatgataaggctgaagctatttcagcaactgttgaaggaaagaatgataaggctgaccagtcatctctgaccaagaccgaaaacttctaaaaaggagctctactactggaagggaagggatattaaagaaatcaagacagtgactactctgcgccagctatgcagagattaattacctataggttacctatcctataatattagcttctcctcgattgacatctcaagaggaaaacggtcattcatgcaactaggctcaccatcaacaacgctccgctacaatgctctttgaccagcttcaagagagtctcttaatgcgtctgctacttgcatgaacaaagccacgaccaggaattatgtaaccagtgaactgaatgctccttattaagcatgctctaaaactagagtctttggctgctcaggtagctatctcaaagcaaagcaaaaacaaaaactcccgtatattatgaagtgaactctagcttattgtgcatgtgttgcttgactatggttcgtctttctatgcgtgatatgctgctccnaaaaaaaaaaaaaaaaaaaaaaaaaaaaaaaaaaaaaaaaaaaaaaaaaaaaaaaaaannnnnnnnnnnnnnnnnnnnnnnnnnnnnnnnnnnnnnnnnnnnnnnnnnnnnnnnnn

SEQ ID NO: 27358 - DNA, 854 bp, Triticum aestivum
  Clone ID: PAT_TA_27358
ccatgcgccccgacgccgcccatccagcttcccctccccgatgcggtgatccccactcacgccatctagccgcgcgccagccgccaccgcaaggcgcatgccgatgtcttcacgcgcaacgacatctccaaccttgtagacaccgcctacgccggggctgccgctctgcgcacagcccgtgaggcggcggttgactccctcttcgccgtgcaggccgagctgcgtggccaaggggaggcggtgaacgatggggttcgcaggatcacgggggcgaaggaacggctccagcgccggcttcaggacgtggtgatggccactgacagtccttgaggcctgggttgccgagaaccgcaagggggctgccgacgatgccactgaggcggagggggccatccagcctgctgacgtgctgtccaggcagatgctggagtgcacagctactgatttggcactcgaggacaccatctacgcgcttgacaaagctgtccaggaaggatcggtgcccttcgacggctacctcaggagcgtgcgcgcacttgcacgggagcagttcttccagcgtgtcctctgcaccaaggttaacaatgcgcagcagcaggcacaggttgctaggatggcagcacgggcaccacagtacgcctcctagccaagatgatggataggtcagtatacatgctttatgatcgatcaattccatccattgtaagagagtggctcagtgtaaagttggttcccgttgtcgttgatgtgtgtgcttactgaatatcaaacagatggatgtgtcacaataataactttattagtttgggtgttgtaagttcatggtgatgtttgtgtagggttgttgaactcgc

SEQ ID NO: 27359 - DNA, 902 bp, Triticum aestivum
  Clone ID: PAT_TA_27359
ccgggtcgaccccgcgtccgcgacctctcgggctcccccgtcgcgctcgcctcctggtgacgcccttcgtggcctcgccggggacggaccgcgtgagccgctccaacccgggcgcatggctcatcctccgccccgcgggcgacggcgcgtgggagccgtggggacgcctcgagtgctggcgcgagcgcggcggggcggggtcgtccgacagcctcggctaccgcttcgacctcctcgtccccggcgtcgaccacgccgtccccatcgcggactccaccatcgccgcgtcaaagggcggcaagttcgcgctcgacctgaccgccgcgcagccgctgagccgggggagcaccccgggctgcagcccgcgtggcagcggcgacttcagccagtggcctctggggaactaccgcggctttgtcatgtcagcctcggtggaaggcgagggtcggtgcagcaagcccacggtggaggtcggggtggcgcacgtcgggtgcgcggaggacgcggcggcgttcgtggccctggcggcggccgtggacctgagcatggacgcgtgcaggctcttctcgcacaagctcaggaaggagctctcgcacctgcggtcggacgtcctccggtgaccgccggtggccgggcggcaaacatctcattccgatccgacgagcaaactgtacaaagtagccgagaatttagctggttctttagttggttgcggccgtagcagttcgatcttggcgatgggttagtagtagttggttcagatcgccttcttttttgtgagcggcagtgtggtgtggttgtgattttttagttggctactccacttttagcctcctttgctagctgtgtttccctctatcaatgaaatgaaaccgagagcctttgtgatctaaaaaaaaaaa

SEQ ID NO: 27360 - DNA, 1012 bp, Triticum aestivum
  unsure (1)..(1012): unsure at all n locations
  Clone ID: PAT_TA_27360
cctccccccccccaccccccaccccccccccggcccggctcccctcgattccgccggaggctccgcgggcctcgatccggtccggctgcccgcgaccgccggcggattcgccggggagggagcgaccatgagcgaggtcttcgagggctacgcggggcagtactgcgagatctccgccgccctctcccgcaagtgcgccgccgcctccgccctcgatggcgagaagaagcagcagaagctgtccgagatccagggccgacgtgcaggagtctgaatcgctgatcaggaggatggatttggaggcgcggagcatgcagccgagcgtcaaggccgggctgctggctaaactgagggagtacaagtctgatctcaaccaacgtcaagggcgagatcaagaggctctcggcgcccaatgcccaacaggccacccgggaggagctcctcgagtccggcatgtccgacacactctcggcatcatctgatcagagaggaagattgatgatgacatcagaaaggttaaaccagtcttcagacagaattagagaaagccaaagaacagtattcgagacagaagaaattggcgtgtcgattcttcaggaccttcataatcaacgacagtcgctgctgcatgctcacacaaccttgcatggtgtggatcgacctacatcggcaaaagcaagaagatcctggcttccatgtccaagaggatggacaggaacaagtggatcgtcggcggcatcattgcgaccctcgtcttcgccatcctcttcatattgtacttcaagtttgcttaaccattccaaatgcagcatgtgcctgaattcagaatgtttgtgtgtgtggaatatgatgtatagcgacacttgccagttgcaatgtaaaacacaaaatatttgaaagatgtgttggaggcttctgtaaatgctcagcgcctttggcattctgataaaaaaaaaaaaaaaaaaccacctgggccccccccggcgccccaatcccccccnggaaacctggt

SEQ ID NO: 27361 - DNA, 607 bp, Triticum aestivum
  Clone ID: PAT_TA_27361
caagaccaaccccactttcttcgacgaagtctgaaaggagtacagcaagggtgactccaggtacgtcgccagggacaccgccaccgtcaccgtcgagggaatcacggccgtgctgaaaggccctgcctcgctgctcgcagtctatgctatcgcgtcgcgaaagtcctacagccacatcctccagtttgccgtgtgcctcggtcagctctacggatgcatcgtctacttcaccaccgcctacttggacggcttcaacttctgggccagcccgttctacttctgggcatatttcatcggcgcaaacagtttgtggattgtgataccgttgctgatcgccacaaggagctggaagaagatctgcgcggcggttcatcaaagcgagaaggtcaagaccaagtaattcctgcaacacagagggtttggttgcaaccaggacacactgaacttcttgttttaccacaatttgttggcttgtattgtaccctttgtaaactacattgcctgaaacaaagtatgttgtactacatacagtacattgtgttgtaacatcaaggagggcggctgtttattgctgcaaatgaaaattatatgccacccttgcatgggc

SEQ ID NO: 27362 - DNA, 1042 bp, Triticum aestivum
  Clone ID: PAT_TA_27362
tgcccagttgacgagtttacaatccatccagcccgtcgagttgactagtgccgatttcctccatctccatctccagctccggctcccagatcgggacggcggcggcgatgggcgcgcacccttacgtgccggcgggcctcgacctcccgggctacgtgccgctgcgcctcacccagctcgagatcctgggggcctacctcggcacctccctcttcgtcctcgtcgccgtctggctcctctccgggagatgccgcaggttgtccgggaccgaccgcctgctcatgtgctggtgggcgttcaccggcctcacccacatactcatcgaggggcccttcgtctttacccccgatttcttcaccaagaccaaccccaacttcttcgacgaagtctggaaggagtacagcaagggtgactccaggtacgtcgccagggacaccgccaccgtcaccgtcgagggaatcacggccgtgctgaaaggccctgcctcgctgctcgcagtctatgctatcgcatcgcgcaagtcctacagccacatcctccagttcgccgtatgcctcggtcagctctacggatgcatcgtctacttcaccaccgcctacttggacggcttcaacttcgtggggccagtccgttctacttctgggcatatttcatcggcgcaaacagttcgtggattgtgataccgttgctgatcgccacgaggagctggaagaagatatgtgcggccgttcatcaaagcgagaaggtcaagaccaaataattcctgcaacaggcatatagggtttgggtgcaacaaagacacactgaacttcttgttttatcaccagaaatttgcttccttgtattgtaccctttacaaactacaatgtcctgaattaagcatacgttgctacattgaaatggaacctttttaaaccacattgtccaagaaacaaagtatgcagtactacatacagtacattgtcttaagcaaccttgcagatgtcctcatactcgacggcctcgagaattcggccgggtgtgctcataacttgtatccgat

SEQ ID NO: 27363 - DNA, 590 bp, Triticum aestivum
  unsure (1)..(590): unsure at all n locations
  Clone ID: PAT_TA_27363
aaacaaaaaaggatcaaaattatgtatgtatatacctaaacagagtatgccagtataatatcaccgatagtttttttttctttcatatacaaatattgccgctgattacctggcgggcttcgtccttgaaagaaaaaaatcgaaggcacacatgagtacctgacaggcttcattctggaaaaaaatgaaatctgtgaggtattcgcatgctaagttgatgtaatgttgattaacgccttcattctccaggcttccttttcaaggcaaatactgtactggcatgtcaattctgaagaattctcccgatcaagttgatgaacgcaatttccagaatttaatcttaactgatcttctaaattgtactccctccgttccaaaataagtgtcgcagttttgaactatatcatttactcatggccaaaattaacccatcgctgcattctagttatttcagaggcttctcattgtcagatgatgaagaggttgcccctagcagagacgacagagatggacgcagcaaaagatncaaggagggtccaagcaaaggcacacctgccctcgtgccgattcggcacgagattcggcacgag

SEQ ID NO: 27364 - DNA, 660 bp, Triticum aestivum
  Clone ID: PAT_TA_27364
gagtggggacatcgctaataaattacctatgcctacaaatacagtgttcacttgcttgcaaaaaaaaaatcactttctttcaggactacattgctagtgtaataaaaatttaaagaagactcacgttccgacttttggttcgcgacaatagcaccagaaatttagtttccggctttggcccgcgacacccacgcttcttttctcacagtataacctctgacgcaacatgctgcccaagggacaccaaaacagagctgctggctcttctcacagattttagaacccgtaacctgaaccggccattgggttcgcggcaggtgcctgctcagattccttgatgtccaccacaacggcgtcagaggtgatgaaagtcttggccaccgatgcagcgtgctccaggcagcacctcacaaccttggtgggatcaataataccagcagccatcaaatcctcatacttccctgtagcggcattgtagccgtacctgaagttgtcattcacaaggaccttctcagtgaccacactgccattgacaccagcatttttcgcgatcagtttaagtggatagctcaaggatttcctcacaatttcagcaccgaccttctgttcatcattctcaagggtttctttaatggcgtcaactttcggacgcggtgggtc

SEQ ID NO: 27365 - DNA, 1554 bp, Triticum aestivum
  Clone ID: PAT_TA_27365
tcaataactttcttgcttataactcccaatcatcgttccatgtatatggaacaacagccagcattaccacaagactaagcaacaaattaattgagtgggtacatcgctaataaattacctatgcctacaaatacagtgttcactttcttgcaaaaaaaaaatcactttctttcaggactacattgctagtgtaataaaaatttaaagaagactcacgttccgacttttggttcgcgacaatagcaccagaaatttagtttccggcttaggacccgcgacacccacgcttcttttctcaaccattataacctccgtcacagtatgctgcccaagggtccccaatacaggcctgctgtttagaacccataacgagaaccggccattgggtttgcggcaggcgccttttcagattccttgatgtcgacccacgacggcgtccgaggtgatgaaagttttcaccaacagatgccggcatgctccaagcaacacctcacaaccttggtgggatcaataataccagcagccatcaaatcctcataattccctgtagcggcattgtaaccgtacctgaagttgtcattcacaaggacctttttgggaaccacgctgccattaacaccagcgttcttcgcaatcagtttaagtggataactcaaggatttcctaacaatttcagcgccgaccttctgttcatcattctcaagggtttctttaatggcatcaactttagatgcaagccttaaaagagtacaaccaccaccgacaacaataccttcctcgacagccgcctttgttgcattcagtgcatcttcaaccctcaatttcttttcttttagctcagtttcagtctgtgctccaacctgaatgcacagcaacaccaccggatagtttagctatcctctcgtttagcttttctttttcatattcctgttcagaagcctcaatttggttcctgatttgtgtaacccttttggttacttcctcctgcgtagtaccatctccaacaattgttgtcgaatccttagtaattacaaccttggcggcatttccaagaacttctttgtctgctttgtccagggacagtcctatttcttctctgatgacagtgcctcctgtcagagtagcgatatcatccaggtattgactcttgcgctctccaaaaccaggggctttaatagcagcaatcttcagttcacctctaagcctattgaccacaagagttgcaagagcttcctgctcaatatcctctgcgattattaaaattggatatccacccttaatagcgtcctccagaagagtgatgagatctctggcgttgttaattttcttgtccacaagaagcagcttgcaattctcatactccactgacattttttcactgtcggttacaaagtagggagaaatatagccgcggtcgaattgcatcccttcaaccacatagaggttgttttcggcactcttcccttcttcaagtgtaaccaccccctgtcgcccaatcttgctcatagcatcagctatcatgttgccaatttcgtagttatttccagcgcttac

SEQ ID NO: 27366 - DNA, 1050 bp, Triticum aestivum
  Clone ID: PAT_TA_27366
gatggaccctgcacagagcctacttgtgaaactgctgttcatgtgcacgaattcaatgtggacgttgctatttctgaggatggtcatggcacaatggcccttggcagcgtccaagcgtctacgacggaactaaaggatttggagagtggaagatgtctagaacatggaacaggtacttctttatctgcttgcaatgttcatcaaagcccactgaaagaacttagttatggtatttcagtaatccctgaccctgttgagcatgatggcacaggaacccctgtggctcttcaggagggaactgctgtcgctgcagaaccagaagcaatccacgaacctactcaaaatgaagatgttgagctggctgccataaagccagaggcggtggagcatgctggtacagaggccgatccaagtaaagaagcatctatacctcctcaagaggaaaccactgctgtagccttggttacaggaccggaacaaaatgaagaagcagatgcacctactcaagtcgaaccagttgctatagtgccagattccatggagcatgctagtaccgaagttgatcaaagtatagaaacatctgtgcgtctcccagaaaaaacttctgttatacctggtacggaaccagaagagaagaaagtagaggcatcctcccaagaggataatgttgaagcagttgctgcagagccagaacctgctggatcccaggaaaatgcagaagtttctaccaagcctagtcctatggagatagagtcggttcaggaaacagctatgctgggagaagctgaaaccaggcagcaactgccacttccgtctgccgagggcgtggtagccgaggctagtgaacctccagaggtgactgctatgaaggaaccagagttgctgagcactgaaccagcacccgatggtgaaaatgctaagcttggagaagccaaagctgaacagctgttgcagcaaccttcatcctgcgaggctatggcagcagtcacaggagagcttcctagcgcagcgggagcgaaaacggatggaacttcagacgtggtggctgat

SEQ ID NO: 27367 - DNA, 637 bp, Triticum aestivum
  Clone ID: PAT_TA_27367
gtgaaaaggaccattcccctaaaactattttggcaggcagccaatctttttgtgaagcctcagataaggacgttgccccagtgaaagatgatcacactgatccgcaaagtgaagttaatgttgttgatatgaatggtaccaaccaagactcagctgaaaccgaagctatgcagattgatggtgtctccaaaggatcttcaagtgatttgcctgctgctttacgatcgaccaattcaaatcagccggcagaacaagatggattagagaatagtccctctatatctgcttgtccgaaagaaaatgagaaattggaagaaacttctgatgaaattggtggtggcaattccaatcgtagtcggactgatggtgattctcatattatgaatctagttggttattcggaagactcagatgaggacgattctatccaggtagctgatgttggtgatgtgggatgtaaagaaactactcatgatgacatctcagctgtcgctagaggagcagaaccaggagatggaccctgcacagagcctacttgtgaaactgctgttcatgtgcctgaagctatttctgaggatggtcatggcacaacggcccttggcagtgtccaagtgtctacgacggaataaaggatttg

SEQ ID NO: 27368 - DNA, 1371 bp, Triticum aestivum
  Clone ID: PAT_TA_27368
ggacgattctatccaggtagctgatgttggtgatgtgggaagtaaagaaaccactcattatgacatctcagctgtcgctagaggagcagaaccaggagatggaccctgcacagagcctacttgtgaaactgctgttcatgtgcacgaatgcaatgcggacgttgctatttctgaggatggtcatggcacaacggcccttggcagcgtccaagcgtctacgacggaactaaaggatttggagagtggaagatgtctagaacatggaacaggaacccctgtggctcttcaggagggaactgctgtcgctgcagaaccagaagcaaagaaagaggtcgacgaacctaaagatgttgagccggctgccataaagccagaggcggtggagcatgatggtacagaagccgatccaagtaaagaagcatctatacctcctcaagaggaaaccactgctgtagccttggttacaggaccggaacaaaatgaagaagcagatgcacctactcaagtcaaaccagttgctgttatacctggtacgggaccagaagagaagaaagtagaggcatccacccaagaggataatgctgaagcagttgccgcagagccagaatctgctagagcccaggaaaatgcggaagcttctactcagcctagtcctatggagatagagtcagttcaggaaacagctatgctgggagaagctgaaaccaggcagcaactgccacttccgtctgccgagggtgtggtggccgaggctagtgaacctccagagaggtgactgctatgaaggaaccagagttgctgagcactgaaccagcacccgatggtgaaaatgctaagcttggagaagccaaagctgaacagctgttgcagcaaccttcatcctgcgaggctatggcagcagtcacaggagagcttcctagcgcagcgggagcgaaaacggatggaacttcagacgtggtggctgatgagtctcctgctgtcgtgggagaggaggtgctcaacactgaaactgcacctgatggtaaaaatccaaggccgagcgaggctgatacggcgcagtcgccacctttgcctgaagagggcaaggccgttgcagctaccgagcctgccaaccttgaggaggcggaggctactgatgggaagtagttagcgtgcaaaaatggaagcagatgttgcgttgaagaacctctgccgttagatcagacagagcatgtttgggctgatgaaactgagaagtaccttagactttatgcaagtgttgtatgtagaacataattaagaaacctgttgtattcagaggagttgttggtacataagttataactacctagtccctttgcaaaaaaaaaaaaaaccaacaacacccccacc

SEQ ID NO: 27369 - DNA, 2668 bp, Triticum aestivum
  Clone ID: PAT_TA_27369
acaggtttcagacaagggatataccgccgccatcctggacaggcaaacaaagccctctcctcttgtttgcacttcatctttttagtagcacaagctcagggagaggggagacagaagggaagagaaatggcggcggcgagtgtctccctgaagagcagcctcttcctatcttcccctctttccgacttcggcggcgcagccatctccatctcagcccagaataggagaaggtcatggcagccaaggggggcgagaatgcaggtggcagcagctgcagactccaagaacattctcatcatggggggcaccaggttcatcggtctcttcctctccaggaaacttgtccaggagggacaccaggtcacattgttcaccagaggaaaggcacccataacccagcagttgccaggtgaatcagatgcagagtatgcagagttctcttccaaggtgctgcatttgaaaggtgataggaaagactttgatttcgtgaaaaccagccttgctgctaagggcttcaatgtcgtctatgatattaatgggcgcgaggccactgaagtatcccccatactagaagcgttgccgaatctggaacagtttatctattgctcatcggcaggagtctaccttaaatcagacctgctcccacactttgagaccgacgccgtggagaattcgggcacgaggccatactgggcaggcaaacacagccctctcctcttgtttgcacttcacctttttagtgtcacaagatcatagaggaagggggacaagagatggcggcggcaagcgtctccgtgaaggtcagccttcttccggagttcccccctatcctaccttcgggccgccgccatctcgatctcgccccagcatcggagacggtcatggcagacgaggagggcaagaaagcaggggggagcaactgcggaggccgcaaacattctcatcatggggggccccaggttcatcggtatcttcctctctcggaaacttcttcaggaggaacaccatgtgacatggatcaccagaggaaaagcattcatcaccaagaaggagacacatgaatcagctgcagagtatgcggagtactatgcaaaagagctgcaataggttggtcttcaaaggtgctgcattttaaaggtggtaataacgaactgccgatggctttaatgacggatctgatattaatgggcgcgagcccccatgtcgtatcccccaatctaggagcggtgccggacctggaacagtattatctattgttcatgggcatgagtatactttaacatttgacctgctcccacactttgcgaggaccgacaccttaaagcacacgaaaagccggaacaagggaaagctgcgagacggagggcctgctggagacaagcggcgtgaacgggacgtccatcaggccggtctagcgctacggccctgtcaactacaaccccgtggaggagtggttcttccaccggctcaaggcccggtcgcccgggggtcgatcaccggttcaacgggaaccgaccgatccccatccctaacgctgggaaccagatcacccagctcggccacgtcaaggatttggcgacggccttcatcaaggtcctcggcaaccccaaggcgagcaagcaggtgtacaacatctccggcagcaagtacgtcaccttcgacgggctggcgcgggcattgcgccaaggctgggagggtttccctgagccggagatcatccaaatacaaccccaaggacttcgatttcggcaagaagaaggccttccccttcagagaccagcatttcttcgccgtcggtgggagaaggccagcaaggacctcggggttacgccggagtacgacctcctcgacggcttgacggactcgtacaaccttgacttcggccgcgggaccttcaggaaggaggccgacttcaccacggacgacatgatcctcggcaagaagctcgtgagcgtgtgagccgacctgaggcgtgcatggttgggcacatggctcatggcagcgcaaagcgtgtggcaactgcgtgtgcggtgtgcatatgtagcacagggaagacgatctcagttttgggatataggttgaggttcactcatccgatgaaatgtactgctgacgcctaattctctcgtggcattcggtgtatttcggttcagtttatactgtttataacaatatcagttttctaagaaaagaacctgaaagcaaagacggagcaattgcggatcggaacccaatagtgggggcgactccggctgtcgtgggagaggaggtgctcaacactgaaactgcacctgatggtaaaaatccaaggccgagcgaggctgatacggcgcagtccccacctttgccggaggagggcaaggccgtggcagctactgagcctgccaaccttgaggaggcggaggctaatgatggaaagtagttagcgtgcaaggatggaagcagatgttgcgttgaagaacctttgccgttagatcagacagagcatgcttgggatcaagagagaggatctaggggctgttgaaactgagaagtaccgtagattttatgcaaatgttgtatgtaaaacataattaagaaacctgttgtattcgaaggagtggagttgttggtacataagttataactacctagtcgctttgcaatactagtaccttgttgcacctcc

SEQ ID NO: 27370 - DNA, 1438 bp, Triticum aestivum
  Clone ID: PAT_TA_27370
gtctgcggggcggtcgtacaggcgcgcgaggcggggacggtgccgctgcccccacggcatatcctgccgcaccggctcaggcctgcagcgcggctgcttacgcggggcttgcggccccccccgcttcttctcctgcagcactcgggtgacaatagtaaccttactgaattggttgcggagctagatggtctacggaaagagcatcacagtctaagatctgccttcgagtatgagaaaaacacaaacatcaagcaagttgagcagatgcggacgatggaaatgaacttgataaccatgactaaagaggcggacaagttacgagctgatttggcaaatgctgcaaacagagcacatgcagcacaggttacacctccacagcctgggacaggacaagctgcagcggtttcagcagccacaaatccatatgcaagtgcatataccagtcacccctccgcatatcagcaaggaacttcccaagccgcggcataccagcagggaactgcccaagccgcggcataccagcaaggaaccccccaatccgcggcataccagcaaggagccccccaatccgcggcataccagcaaggagccccccaatccgcggcataccagcaaggagccccccaatccgcagcataccagcaaggagccccccaagccgcggcataccagcaaggagccccccaagccggagcatatcagcaaggagccccccaagctggagcgtatcagcaaggagccccccaagctggagcgtatcaacaagggacatacgggttacccaacagcctatgattctgccaccgcttaccagctgcatgctaatgcgtttgctagctattccggctatccagttccaggctatgcacaacccagctttccctggcaacgtacgctgcacctcagcagcacccagtttgccagttggcgccggctactgataccacaagcgcgttacggggcccctggcagcacgggatatcctgccgcaccggttcaggcaagcagcggggcttatgcggggcaagcggcgccaccagctccttatcctgcaacatatgacccaaccaaagcagcccagaggtgaaatccggggttgtaacctgaagatggcctgtgtgcctgcaaattttatcagaaatttctcaggcctcttatttccttcatgtacattcattcactccctgtagctttatgcacaccatggagctgctgagagtcgcagtttatggtctgagtcttgaattgatttgtatctcttgttttgctggatggttgaattgataggtgcagctgttggttaatatcagggatgttagaattactcttgctgttttgaaatcgcgtgaagcttagctgtgggtgttgagactttttaccctaaaaaaaaaaaaaaaaaaaaaaaaaaaaaaaaaaaaaaaaaaaaaaaaaactcgag

SEQ ID NO: 27371 - DNA, 540 bp, Triticum aestivum
  Clone ID: PAT_TA_27371
caacctcgactgagacttgttcgtagccaacataaggttcaagcgggagcagggttctacagcttcaggtgggcatcctccatggctgagcactgttcccagccaaggttttggctaagatgcgtacgacccgagagggagctgtttcagacgcactagaacaacagctcagcctggggtccgcttccaaccagagagcaggctcaacagagaaaaggggcgcatctaacgcttcttctggtaggaacattatcttgcgacctgaagtcctgataggccagcggtgcaccttcatacaataaagctggggttcgcccagctcgaagaggttgaaggaggatcttcatgcgtggttgcaaccgaggtacgggtaaatttgcagctgtagttcatgggcgcaaatttttgattaggagtagattctctcataaaattcatttagataggatgttgatacagagattgatagttttctcttaaatccttcgtttggctgacagatacagtacctgcccgggcggccgctcgatgtgcccaagt

SEQ ID NO: 27372 - DNA, 1558 bp, Triticum aestivum
  Clone ID: PAT_TA_27372
ggtgcaggggcttcccgtggtgctctccgggcgcgacatgatcggcatcgccttcaccgggtccgggaagactctggtgttcgtgctgcccctcatcatggtggcgctgcaagaggagatgttgatgcctattgtgcctggggagggcccgtttggcatgatcatttgcccatcacgggagctggccaagcagacatatgatgtcatcgatatgttcctcactccactcaagcaggctggattcccagaaatacggccattgctttgcattgggggtatagacatgaggacacaactcgatgtggtgaagaagggcgtacatattgtggtcgccacacctggacggctcaaggatcttctcgccaagaagaagatgaaccttgacaattgcaggtatttaactttagatgaagctgataggcttgttgatcttggatttgaagatgacattcgggaggtttttgaccatttcaaggcacaaaggcaaacccttcttttttctgccactatgcccaagaagatccagaactttgcaaagagcgccctcgtaaagccagttatcgtcaatgttggaagagctggagcagcaaatcttgatgtcatccaagaagttgagtatgtcaaggaagatgccagaattatatatctccttgaatgccttcaaaagactccacctcctgttcttatattttgtgaaaacaaagctgatgttgactacatccatgagtatcttcttctaaagggggtggaagctgttgcaatccacggaggcaaagatcaggaggagaggcaaaacgcgattgagttcttcaagaatggaaagaaggatgttttggtggctactgatgttgcctcaaagggtcttgatttccctgatatccagcacgtgattaactatgatatgcctgccgaaatagagaactatgtccacaggattggtcgaaccggtcgatgcgggaaaacgggaatagcaactacgttcatcaacaagaaccagacagagactacgcttcttgacctcaagcacctgctcaaggaagcgaagcaaagaataccaccagtgcttgctgagctcgttgacccgctggaggatgctgaagctattgccaaggagagtggtgtcaaaggatgtgcattctgtggtggtcttgggcatcgtcttgctgactgtccaaagctggagcaccagaagtctgtggcgatcgccggctccagaagagattactacggcggtggaggttaccgtggagaaatatgattgcatcatcatattattaagagtgtatgctttctcaaggggtaaaatgctgcagcttcagctcatccatgcttgagatatttagatgacctacatgcaatctgaagttccctccttagtcatcgtgtcatagaagatttgtcatcaccattgtgtttcaagtgatgatggcttttgatgtaatatatttttctgcatacgaagctgtactgttgtaaaatgtaatattgagtggcagatttttccggtgaggggggttttatttacttgagcactagtatcatttctaaatatcatcac

SEQ ID NO: 27373 - DNA, 729 bp, Triticum aestivum
  Clone ID: PAT_TA_27373
caatactaggcagggaggggaggaggagcgaaagaatcaaggggggcgatgccggggacgacgaggacatggctggtggtcgcgacggtgctcgtggccgccacggtggcgacggcgaacgtggagacgggtgagttgggggagtactatatgaagcgctcacaggaggcccggttccggcgaggcggccccctccatgacatcatcagcgccgctcatcgctaccaccagaacctcttcagttccaggtacggctcaggccggcggtacctcctggaggagggagaagcagcagccggcgcggaagcccccgccgactctaccggcgatgctactcctatccacaatacgctcagggatcacgaaatgatgggcgcataacttatactgattgatttcttattatttgcgtgcgtacatgtatgtgtgtatctgttactgcacaagttgttgaccttttttcttcttttccttttgctattatagctgcttctctgcggaaccaatatggtccacgcatcaaacctctgcaaaacatgtgtataaatgtaagcactgattatttcgtaacctttttttaacacagtttgtaactgctttctggcgggagattaatttgtaactaagtagtaatgtaatcatattttgtacggaaatcagttggtgctccaaacaaaaatattttcaaagtgtggaaaattccaaacaaaaaaaaaaaaaaaaaaaaaa

SEQ ID NO: 27374 - DNA, 580 bp, Triticum aestivum
  unsure (1)..(580): unsure at all n locations
  Clone ID: PAT_TA_27374
cctcgctcttcctccgcaagaaagagctccctctcccctccccaccccaccgcctccgccgacgaaccgatcgaatccgggaccccgatctcggattcgctcggcagatcagcgcgcaccagcccccaagcccccggatcctccttcgtcctccccaccgcgcgcttcagccatggcaggaatggcaccagagggttcccagtttgatgctaagcagtatgacagcaagatgaccgagttactgtaagttaactctaccaatttattgtctcagcctttggcggccatgtgaagctctcctttttgcacaaccgagtacatgcttatgaatttgcaggaaccaaggtgacactggggagtttttcacctcgtatgatgaggtgcacgaaagttttgatgacatgggcctccaagagaaccttcttagaggcatctatgcttatggttttgagaagccatcagccattcagcaaagaggaattgttcccttctgtaagggtcttgatgtgattcancaagctcagtctggaacaggaaaaactgccaccttctgttctggaatcttgcancagcttgacta

SEQ ID NO: 27375 - DNA, 607 bp, Triticum aestivum
  unsure (1)..(607): unsure at all n locations
  Clone ID: PAT_TA_27375
gccggccgggtcgggaacagccagngaggatccttgtcaagagggatgagctcaccctntgagggtatcaagcagttctatgtcaatgtggagaaggaagggtgtggccatcaactttgtgacccgtgaagatgagaggatgctgtttgacatccagaagttctacaacgtggtgattgaagagctcccagccaacgttgccgaccttctgtgatcggggcgggctgtggagaacatatggtaagggggtcctgacagggctttgtttttgttgaagtatcaccaactttcttgtctgtgggtgggggggttcaagtgataaatggtctgctggggttctactttaaagtcgtggtcgtggacaatttgggatttattaagttgaatttttgtagttgctaggctgtggttctatgtgctgaggagggaggcgttgctgctcatgctgctgttgctggagtcctcactttatttgttaagactatgtaatgaccgaatgatgttatttgtttgtgtcatccttgactctttacctaccgcatgtaatcctgcaatcggtacttttaatgctatcgttattgaaaaaaaaaaaaaaaaaaggccccta

SEQ ID NO: 27376 - DNA, 584 bp, Triticum aestivum
  Clone ID: PAT_TA_27376
accacactgtctctgccacgcacggagatatggaccagaacactagggacatcatcatgagggagttcagatctggatcttctcgtgtgctcatcaccaccgacctgctggcccgtggtattgatgtgcagcaagtctcccttgtcatcaactatgacctgccgactcagcctgagaattacctccatcgcattggtcgtagtggtcggtttgggaggaagggagttgccatcaactttgtcacccgtgaagatgagaggatgctgttcgacatccagaagttctacaacgtggtcattgaggagctcccggccaatgtcgctgaccttctctagattatatcttaggaatgcagtaaggtgcttgataaagttcgtttttgttgaatatctcccaactctcagttttggagtggtaaggtctgggtctgtttgaatcgtggttaaaggatggtctgagttttttttgttatgcaatgtccggaaatttttgtagtgcgtaggctgtgccatctcctgggttagctgggatagagtaactctcatgagtattttacttttcgttgtgaagttattttattgcgc

SEQ ID NO: 27377 - DNA, 837 bp, Triticum aestivum
  Clone ID: PAT_TA_27377
gccggccggtccgggacagcccaccaaaccctcgctcttcccaccgcaggaaagagctccctctcccctccccaccccaccgcctccgccgacgaaccgatcgaatccgggaccccgatctcggattcgctcggcagatcagcgcgcaccagcccccaagcccccggatcctccttcgtcctccccaccgcgcgcttcagccatggcaggaatggcaccagagggttcccagtttgatgctaagcagtatgacagcaagatgaccgagttactgaaccaaggtgacactggggagtttttcacctcgtatgatgaggtgcacgaaagttttgatgacatgggcctccaagagaaccttcttagaggcatctacgcttatggttttgagaagccatcagccattcagcaaagaggaattgttcccttctgtaagggtcttgatgtgattcagcaagctcagtctggaacaggaaaaactgccaccttctgttctggaatcttgcagcagcttgactatggattggttgagtgccaggcattggtccttgctccaacccgtgagcttgcacagcagattgagaaggtcatgcgtgctcttggtgactacttaggcgtcaaggtgcatgcatgtgttggtggaacttctgttcgtgaggaccaaaggattcttgccagtggtgtgcatgttgttgtcggcacacctggtcgtgtgtttgatatgttgcgcaggcaatccctccgcccagataacatcaagatgtttgtgttggatgaagctgatgagatgctttctcgtggtttcaaggatcagatctatgatatcttccagcttcttca

SEQ ID NO: 27378 - DNA, 1612 bp, Triticum aestivum
  Clone ID: PAT_TA_27378
aaatcctctgtttttctctctcctgcggacgcgtgggcaatcccctcatcgcctccgctcccacgccgccgaatccgagacctgatctcggattcaccgcagcgacgcgaccaaaccctcaggcgatccccggcacctcctccccgacgcttcagccatggcaggaatggcaccggaaggttcccagtttgacgctaagaactatgattctaagatgcaggagctgctgagccaaggtgagactgaggagttcttcacctcctatgatgaagttcatgagagctttgatgacatgggtctccaagagaacctcctcagaggaatttatgcttatggttttgagaagccttctgccatccagcaaaggggaatcgttcctttctgcaaggggcttgatgttatccagcaagcacaatctggaacaggaaagactgctactttctgttctggaatccttcaacagcttgactatggtttggttgagtgccaggccttggtccttgctcccacccgtgagcttgcacagcaaattgagaaggtcatgcgtgcacttggtgactacttgggtgtgaaggttcatgcatgtgttggaggaacctcagttcgtgaggaccaaaggattcttgcaagtggagtgcatgtcgttgttggtactcctggtcgtgtgtttgacatgctccgcaggcagtctctgcgccctgacaacatcaagatgtttgtcctggatgaagctgatgagatgctttcccgtggtttcaaggatcagatttatgacatcttccagcttctcccagggaagattcaagttggtgtcttctctgctaccatgccccctgaagcccttgagattacccgcaagttcatgaacaagccagtgaggattcttgtcaagagggatgagctcacccttgagggtatcaagcagttctatgtcaatgtggagaaggaagagtggaagctcgacacactgtgtgacctgtatgagactcttgccatcacccagagtgtcatctttgtgaacacccgccgcaaggtggactggctcaccgacaagatgaggggcagggaccacactgtctccgccactcacggagacatggaccagaacactagggacatcatcatgagggagttcagatcaggttcttcacgtgtgctcatcaccactgacctgcttgctcgtggtattgatgtccagcaagtgtcccttgtcatcaactatgacctcccaacccagccagagaactacctgcatcgcatcgggcgtagtggtcggttcgggaggaagggtgtggccatcaactttgtgacccgtgaagatgagaggatgctgtttgacatccagaagttctacaacgtggtgattgaagagctcccagccaacgttgccgaccttctgtgatcgggcgggctgtcgagaacatatgttgctaggctgtggttctatgtgctgaggagggaggcgctgctgctcatgttgctgttgctggagtcctcactttatttgttaagactatgtaatgaccgaatgatgttatttgtttgtgtcatccttgactctttacctaccgcatgtaatcctgcaatcggtactagtaatgttatcgttatt

SEQ ID NO: 27379 - DNA, 2096 bp, Triticum aestivum
  Clone ID: PAT_TA_27379
cccgggggggggtttatggagatgagggtgttgtttctcccccgcaaaatggtctgctggggctctacttcaaagtcgtggccgtggacaatttgggatttattaagccatgttttgggaatttttgtaatcgccgcgcaagccccctccactcccaccctcgctctccccaccgcaggcaaagagctcgcctccgctcccacgccgccgaatccgagcacctgatctcggattcaccgcgaccccgaaccctcaggcgatccccggctcctcccccccgccgctccacctcccgcgccgcagaatccgcggaaccgaccccggtttgacgccaacgcaggcaaaccctcagaccgcccccagccccctactccccgggacgacagcggagtcctgcacgtccccggatggaggccaagagtaaggattggaagacataggtttcgatgcagcagctgctgaacggaggtgtacttcagaatgtattatgaagttaacctgaggttcattaacgctttgatggaagagcagtccatctctaaaaggctcttgtgctgtttattcttgcgatgcataatatcctccagacaaaaggacaaggctactttctttcttggggtctggacattagccttgcatgcaagtattgtgttgactgggaaaaggtcctacttttcgactttctcttcctccaacggctctactaaggagttgaagagtggctggccatggccttgcacccccgtggctgctcctgcgtaccatgatcttgcatagcgttcggaggatgtgatgctgttgagttgtttgcgacttgttgcatgtgggtgggaatgctcattgcgtggaggcccaggtgtgtgtgcaacatggagtgcatgtcgttgttgtgcctgccgttttttgtgttcgactggtcttgtgttggacattctgcggcatgcagtctctgggccctgacaactcaaaagatctgtgtccttgatgaagcttgatgaaatgctttcgcgtggtttcaacgggaccagacctgctgtagactttacccgctgctgccagatattcacccatgagtgttgtcggccttgagagtacccttaccccctgagagaatctaagaattatctgtaactgtcgctaggtaagctggcttgccggctagacgcagtgcacggtccaagccgtctgggcaactcgcagactatatgcactgtgaaaacacggcagctgataggcgaggctcgctcagatcaggagatgaacggtacgatcctccacctgccgccctgctggacagaggcatggacgtggagcacgtctccacgtgatcattaaggagtacggaccacgctctccaggggtccccatggacaacagacctgcatcgtcgctggggttacgtgatgaagggggtggtggcagcaaattcgtgcccccttgtcaatcaaaagaactccgtcctacgccgaagccgttgctaccaaggttcgtgattgaccaactcgcaacctaacgtgtcagccgttctgatatcgggggggctgtctggaatccaaggaattgtggtggtccgtgaagagggatttgatttttgttcgagtaccaccgaagctttcttggacgggtgtctgtgggggagcttctaggctaatgtggtgtttacaggacgtggtttcctaccctatgaaggcctgatcgttgttcaatttgggcttttttaagccattagttgggcaatttctgaagttgctgggctgttgttgtattggctgatagattgaggtcttggtgaaggatgtttctagttctggattctttactttatttcttaagactagtgtaatgtactggacaggttgtatttgtttgtgtcatcctttgatattttctgaagttgctaggctctggttctatgtgctgaggagggaggcgctgctgctcatgttgctgttgctggagtcctcactttatttgttaagactatgtaatgaccgaatgatgttatttgtttgtgtcatccttgactctttacctaccgcatgtaatcctgcaatcggtactagtaatgctatggttattaaaaactgttactcctt

SEQ ID NO: 27380 - DNA, 755 bp, Triticum aestivum
  unsure (1)..(755): unsure at all n locations
  Clone ID: PAT_TA_27380
ggctctcctctctctctagttcgtgccgacgaccgccggcggtctctctcttgttcgtaccgacgaccnggccgacgggcggctggggctttggccatgcagctcggactcggcgcccggccaaccatgctctggttgttcatactctggccagagcatggatctggcgtctccatagactcctgcccagatgggaatcgagctgacattcgttctagctgccgaggaggaggctcgcggtcagaggtgatggagcgttgcggccgaagagggaggagaagcttgctttccatggacgcagcttctggggtgcccaatttgtagtctccctcctcggctccggcggacagagcgcatggatcaggtttcagagtttggcgtaatttacaacagaatgatcaaacaggtgaagactgaagagcagagcacctaatattggaaatgtccaaccttatgtcaagtttgtgatagtaaagttgcaggttgcaacccgtgctcaaaagatagagagctaaatccaagggtaagccatcacattttgaaaccaatgatcaaactggagccatcgctcaacatttctaccaatttcacttgcctttagaagatctggtacaacatgaatttgtttttccctcgagacccttttgttcccatgatttatttatttatgctgaaaaccaatgtgttgactgcagcttgatggaagtgtttattctctgcttgtacacacataaattcatgctcgatcatgtagg

SEQ ID NO: 27381 - DNA, 1357 bp, Triticum aestivum
  Clone ID: PAT_TA_27381
gctgttccccttgcgccccctcccctctctctccccaccggggtacgccgccaccgaccccccaccccccgcgccgcccgattcgcccccaatccccgccccccccccccaaatcgcccaatccccgagcccccgcgcccgattagctgcgacgggaccgcgtccggttcgatccgcggcgccggctcgatcgtgcggggggggctcgcgcgcgcggggggggccggcgcggcgcgatgcggtgggcgccaggcgctggccggcgcggccgcctaggctttacgccgtggtccgacgagggctgcctcgagcgcctccacgaaggagtaccacgcgctctgcaaggagccggtgccgcagatcgtggcgcgcccgctgcccaacgacatattggagtggcattttgtacttgaaggaagtgtagccacaccctttgaaggtggatattactatgggaagcttaaatttccctctgattacccttttaaacctccaagtatcagcatgacaacccccagcggcaggtttgcccctcacaaaaggatatgcctatcaatgagtgactttcatccagaatcttggaatcccatgtggtctgtagcaagcattctaacaggactcctctcatttatgatggatgatgctcttacaactggaagcatcagaagtacagatggagagaagaagcgtttagcaaaggcttctcttgcttacaactgtgagagcaaaaattgcccgcacttcaggaaactgtttcctgagtatgttgagaagtacaaccaacaacaagaaaaggagcaaactggcgcggaaccagacccccaggagaaccctgccccggctccttctcatggccgccgtcctgccaggcggcagctatggtgaacaatataggcagagccgtggccgaggtccgcggcgaaaagaagctgaagaagcgagtgcccttttggctgatggtggttatcgtctctgtttttggcgcggtgatggccttgcccctgatgcaactttgacagtaaaaagtcgaataaagtgtgacagcggtgccgtaattttgtatagctttctgttggtttgtgcaactcaattcttcatccgtggactaccaccttggagacatggtgatgaactcttgtgatggtaaaactgtagaaccgtattctcactcccctgacgagaaactctacaagctgctttatttgagcttcttggaactatgttttttttctaaaccaaatcctaacattgcttactttgctcgctgatgtttatcttcaaggtctagaaatgtatcaagaagtagaacacaattaatttcatgctagattaagaagggcttgctaaaaaaaaaaaa

SEQ ID NO: 27382 - DNA, 1422 bp, Triticum aestivum
  unsure (1)..(1422): unsure at all n locations
  Clone ID: PAT_TA_27382
cctgtcccggnntacnncgcggccattccagcgcccaaaaccccacccaccaccccaatcccctccccatcaaacagccctcgcgaactcaacgggaagcgactcacgcccccctccgccccccgcagatcgcctgccccgccgccgtgcgccgccgacgccaatggccgccgccgccgactccgggcccgagctgcggcggagctccagcatcgaccgcatcccggcggaggcgcgccgcatcctgcaccgcctcgccggcgagctctggggcgccgacgtcgaccccgccgcgctcgtcgtgtaccagctccagggcgccctcaccaacgaggtcttccgcatcacctggcccggcggcgagggcgacccgcgcaaggtgctcgtgcgcatctacggccagggcgtcgaggtcttcttcgaccgcgccgacgaggtccgcaccttcgagtgcatgtcccgccacggccagggcccccgcctcctcggccgcttcccccagggccgcgtcgaggagttcatcaacgccaggacgctctcggcgccggatctgcgcgacccggagatttccggcctgattgccaggaagctgcgggagtttcacgagctcgacatgcctggacccaaggacatctcgctctggcagaggctgaggcggtggcttgaggaagctcgcagcaggtgctcgactgaggaggctagggaattgcggttggagacgctcggcgatgagattgcggagctggagaatgtattgtccggggtcgatcagagagtagtattttgccataatgatttgcagtatggcaacattatgatatacgaagagaccagacaagtgaccttaatcgactatgaatacgccagttttaaccctgttgcgttcgacattgcgaatcacttctgtgagatggctgctgattatcatagtgatacaccgcacgtgatggactttacaaaatatcctgacgtggatgaacagcggagatttcttgaggcttaccttagttcttcaggagaaaacccatccgatgtagaagtcgaaacattgcttggcttgattgcaaagtacagtctcacaagccatctcttctggggtctctggggaatagtctcggcgcatgtgaacaagaacatcgacttcgagtacaaggagtacgcgaggcatcggttggaccagtactgggacacgaagcctagaatactgcaagcctgcaacccaaccagctgatcatgtgcatggctcgttctttttcttctatagcatccatcgcctctcgagtagctctgtggagtcctgtgactgtgagtcttgttcatcagccaatttggctgcaaatcgtttagggtagtagttgaccgtgtcgtgtaattagacctgcgcagaatagtcgattctacggtttacacaagctttctttc

SEQ ID NO: 27383 - DNA, 686 bp, Triticum aestivum
  Clone ID: PAT_TA_27383
tttcttagcccaaacacaacactcgtgtagctctcccctggtcgaagcagaggcatttcgacccaaacacaacacctcgtgtagctctcccctggtctaagcagaggcatttcaacgaacatgtcgctcgtcacagcttttctggcgggctcggcggcgccggcggtcgcgccacggtccgcccgcccgtcggcgggcttctttggggtcggcggagggtgcgcgctgtcagtggagtgctcgtcgcggccgcagaagaaagggaccaagcaccatatgaagacgcggcccaagaagacgcagcggtgggacatcaagcgccgccccattcagtacgagccgctgccggcgcttcccgatgactggacgctcgtcgccgccggtgagaaggaagatgcggcgccgcaggacgaggagaccacgcccgctgctgccgttgaggtcgaggtggtcgccgcccctgccgcccctgccgccgcagactgacgccgtgaagtccactgtgtcctctctgtattttatttccttcaactctccgcacgcatggtttttgcttgagattattaaaccaatgctacactttgcaattacaaccctgaattctacttcagtggccactgcacctttagatttagtggttgctttgctcggtaataaaaaaaaaaaaaaaaaaaaatgcaaaaaaa

SEQ ID NO: 27384 - DNA, 747 bp, Triticum aestivum
  Clone ID: PAT_TA_27384
gccaggtcgccccggcaccaaagctgctccgcaccccgcgcggcccaccgacgccccatcacccccgccaccaccccggcacgcccggccaaaaccctatcagctacgtccccgccgccgccccgatctccccgcgctccgccgccccgatctccccgcgctccgccgccgccgccgccgccgccatggaggacgacgccatcaccacgctcatggacatcgacgactccccccgcagcgctgccggcgccggcttcctcgacgacgacgacgagggggacctcctccactcccaccgcatgggcggccgcgggaacgaggcgcggggccccctccccttcgccggcttcttcaacaccttcgacggcgccgacttcgacgactccgatctggcctgatcgaggcgtcttccggtactagtaatgaagctgggaggtcgtcgatatggtgctggtggtctatctagttaggttattatgggtgaggtgaaactattccgaggcatctggagacctttcggtgatcaatctaagcatcgtactgctgcgctgcccttggatctcgtgttgtttggttaatatatgcaagtgccttaaattatccttgattagtatcatctctgcgaggttctctttaatagtacgattggttatgggattggtgctatgttatttctgctcaattgtggctgtgttggggaacgagctgatgctatgccaataaattagcttcgatcttaaaaaaaaa

SEQ ID NO: 27385 - DNA, 537 bp, Triticum aestivum
  Clone ID: PAT_TA_27385
gttttagcagatggactgaagaaaatcaaacagttcacagttgatttgagttcagtggagaccaatatggtattctttgatatggcggatccacgcatatcacctgccaaactgtgccaagccctgaaacaacgcaatgtgcttgcaatgccaacaagctccaagagcgtcagattcgtcgtccactaccaaatttcagatagcgacatccagtatactttaaaatgtatcgaggaagccgtggaggaaatcctggcctgcgacgccaaatcggagcgttgttcgaccaacggcacaagctagctaggccacacttcttgaattactacgtgattgctatgcatgatgcactatccagttcgtttgtgaaataattgattgcctgtggtcgtgtcaatgtcgtgggcatgtggtcgtgttcttctgtgttcttcagcttggggagcatgcaatgcaattagggattgttgtgacgatacaggtagatcaatggtctactttgtttggcgtattgtttgaccgtagtacccctcgtcc

SEQ ID NO: 27386 - DNA, 626 bp, Triticum aestivum
  unsure (1)..(626): unsure at all n locations
  Clone ID: PAT_TA_27386
gtgctgctgcntatgttgcggttcgcgacacagtaggcaagctcgccgatgaccataggaaggctaaagttttagcagatggactgaagaaaattaaacagtttacagttgatttaacctcagtggagaccaatatggtattctttgatatcgcggatccacgcataacacctgacaaactgtgtcaagtcctggaacagcgcaatgtgcttgcaatgccagcaagctccaagagtgtcagacttgtcatccactaccaaatttcagactagcgacgtccagtatactttgacctgcatcgagaaagccgtggaggaaatactgtcagggaatgccaaattcgagcgcctgacaaacggcactaccacgaattcatatgggcactaggccacttcctttcgcgccacctatggagtgcagcagtccagtatccagcttgtttgtggccgtggcctttgcagtagtgaagtagtaacaactttttttttttttgagggggaagtagtaacaactttgcagaataatctgtttctgtttgggccgatggaagccccccacttggtgtcaatgtgatatgttcacttcagcccggatgcaggaaatgttcgccaggccggcccatcatc

SEQ ID NO: 27387 - DNA, 2812 bp, Triticum aestivum
  Clone ID: PAT_TA_27387
cccacgcgtccgaaagccagaccactctcctccccactcatcttctctggcccaaccgcggctgccattcccatccgcctcggctggggctccatctgatccacggattctggtgcgcagttcctcagatccccctcttcatcctcttttaccaagttttgttgctttacgaatcgacgatgaacgcgtgcagtaagttcttgttcctgaatgatactgtacttaccttgcgatgcgcggtgctatgttattttgccccccttcccttcccttccaaccctcggtagatccattgttcttggagccgccgagcgcttatcctctcgccgctcttcaaaaatctccgaggaaacgcgtgacatgcatgcatgggcgcatggccccccaaaaggcgccaaagtttgtggttgttggaccagtagagttgtatgtatccttcctggggtcctccactgtggtgctcgtgtctgctgcgtcctaaggcactcttgtgatcttgtcctgtgcgatgtaaaaatggcgtctcctttttggccctcctggtttcagttttcaccgcttgcgtgtgggacactaggagtagccagtttccactttccaccacaccacagtgcagcaagatgttggatttcgcaataacgcatttgtccccgagggtaaattgcacagctgacagagcactacgtgttcccacgcgcacgtggaggtggcctgagggacgatgcccacctcaccactccttttcccatccgcctcggctccagcgggctccgtcccctccacggattctggtcccgagtcgtacgtgatcctgctgaagcgtgagctccagctacagccacacaggcaggatggtgaccaaggtggtgggccgccgctccgacccggtcacgacgccaaccgaggccatgctcggcgccatggccgcggcggaggtggacgacgacgtcctcggcgcggacccgaccgcgcagcgcttcgaggcggagatggccaggatcatgggcaaggacaccgccctgttcgtgccctcgggcaccatgggcaacctcgtctccgtcctcgcgcactccgacaccaggagcagcgaggtcatcctcggggacaactcccacagccacatctacgagaacgggggcatcgccaccctcggcggcgtccaccccagcaccgagaccaacaaccccgacaggcaccatggacttcgacaagatcgtagccgccatcaggcatcgggacggggccatgtattatcccaccaccaaggctcatctgcttggagaacacacacggaaagcactggtgggaagtgtctgtctgttgaatacaccgacaaggttggtgaggttgctcaaagtcatggcttgaagcttcatatcgacggagctcgtatttttaacgcttccgtggcactcggcgttcctgttcatagacttgtgagagccgccgattcagtttcggtatgcctatcgaaaggtttaggtgctcctgttggatcagttattgttggttcgaaggacttcatatacaaggctaagattcttaggaagacactaggtggtggaatgaggcaggttggaattctctgtgctgctgcccatgttgctgttcgcgacacggtaggcaagcttgccgatgaccatacgaaggctaaagttttagcagatggactgaagaaaatcaaacagtttacagtagatctaagttcagtggagcctaatatggtattctttgatattgcggatccacacataacacctgacaaactgtgtcaagtcctggaacaacgcaatgtgcttgcaatgccagcaagctccaagagcgtcagactcgtccacccactacctaaatttcagaccagcgacgtccagtatactttgaccggcatcgagaaaacagtggaggaaatactgtcgggcaacgccaaattcgagcgcctgacaaacggcatcaccacgaatttatatgggcaatagcccacggcctatggagtgtagcagtcagtagtatccagcttgtttatgtccgttgcctttgcagtagtgaagtagtagtacccactttgcagaataatgtgttgctatttgggccgatggaagccccccacttggattcatgggatactttgatgggcgggtaggatgcacgtaggaattctctgtgctgctgcctatcttgcggttcgcgacaccgtaggcaagcttgccgatgaccataggaaggccaaagttttagcagatggtctgacgaaaattaaacagtttacagttgatttagcttcagtggagaccaacatggtattctttgatattgcggatccacgcataacacctgacaaactctgtcaagtcctggaacagcgcaatgtgcttgcaatgccagcaagctccaagagcgtcagacttgtcactcactaccaaatttcagacagtgacgtgcagtatactttgacatgcatcgagaaagccgtggaggaaatactgtcaggcaacgccaaattcgagccgcctgacaaacggcactaccacgaactcagatggggcactaggcaaccggcctaatggggtgcagtcagtggggtcccgcgcgtgggtggccggggcctttgcagtagtgaagtagtaacaactttgcagaataatctgttgctatttgggccgatggaagccccccacttggtgtcaatgtgatgtgttcacttcagcccggatacaggaaaatgttcgccaggccggcccatcatcactcaagtgtactctaccttttcccagcaaagaaaaaaaaagaagaagtgatcctcaaaaaattaaat

SEQ ID NO: 27388 - DNA, 1111 bp, Triticum aestivum
  unsure (1)..(1111): unsure at all n locations
  Clone ID: PAT_TA_27388
gaatcctcagccggccatcgatcatctctcccactgaataccaccacgactggtgccagccatggcgaggcgccgccactcttcctctggtctcctatgcctcgtcctctctctcctccttcctcctcctgctccgggctgccatggcagcggacggtgcaggcgcgggacagcggagctagcagcaagtccacagccgccggcggctcctaccccacgcccacaaccaggcccacagccggtgccactacccattccgaacccgcagcctgacccaaacccacaacctttgccgaacccagacccaaaaccgcagccacagccggacccaaacccagcagccacaggccattaccgcagcctcttccacaacccactgccgaacccaaacccacagccacaggcctctaccaccaacagcctctgccacaaccacctgccgggcccaaacgcgcaaccgctgccattacaaccgctgccattacctccgcccctgccactaccaccgccgggcccaaacgcgccaccgctgccattaccgccgcctctccccctaccaccgccgggcccaaacccacagccactgccgcggctcatatccgcaggtacaaccgttgccggactcaaacacgcccgggcgacagaataacgcactacagggaccacttggaaatggtgcagttggaaatggcgcagccccagccttatattcatgcggtgcaacctacatacatatattctccataggtttatttttaatactattttgtttagataaagtgactcatgttactatttctctagactccataaaataatgtatcgattgggcatgatctctctgtatttacatttgtactagtatattatttgtaataaatttttatatgattgtacaagtagtttgtgtacttagaaaaagcagaaccatttgtgtatgcatttggtacacatgtcgttctgatatttttagttaaaaaaaaaaaaaaaaaacccccggggggggnccggtacccaatntcccccnaataaaagggtcgttttatccgncgcctcaccgggccggtcgtttttttaacagtcnnggactgggggaaaaaccccggncgtt

SEQ ID NO: 27389 - DNA, 414 bp, Triticum aestivum
  Clone ID: PAT_TA_27389
ttaagtttaagagcagtgtttgccttttttgtgcttgtgtgtgatcgatcatactagactgctattgagtttctactacttgccacctgcttgttattaaaatggttttgcatataggagtatagtagtactgtctatggacttgagtctaacagggatgcatatcgtccgacaaagtaaggcaatgcgattatgcactcggtaaggattcgagaaaccggcagccatttttcagttatgaaaagacggcgcacagagtcctcttccggttgaaaaaaaaaaaaaataagaccagaatccatagacattatactgagccaagctgttatcttactgtttgaatgaaatgaactacttttccctttttccataaaaaaaaaaaaaaaatatggcttcttttttggggggcccttt

SEQ ID NO: 27390 - DNA, 858 bp, Triticum aestivum
  unsure (1)..(858): unsure at all n locations
  Clone ID: PAT_TA_27390
ccgcacgcgcacgtccgctgcctgccacgcccgcccctgtcccccagggcggccacggccgcggcggcgacgctggcggcggccacctcctccctcctccggcgcacccccttgctgcggccgcacgggctccgggtctcccacgacttcgctccccaaagatttgcgcgccacattgcttcatcaacaaatgaagaggttgctgccaaaacagcggcagcgactgctgatactggaggaccgacgatttttgacaagatcattgcaaaggaaatcccttcaagcattgtctacgaggatgaaaaactggtggctgttaagagatattaacccacaagatcctgtccatgttctagtcatcccaaaacttaagagatgggctaactggacttgacaaggctgacccaaggccaagctgaaattctggggcagctgctttacgctgccgaagggttgtggctgagaaggaaggcgtagcagatggattccttgtcgtcataaacaacggagcagaaggatgtcagtcagtctatcatctgcacgtgcatgtacttggtggaaggtatatgaaatgtcctcgttgctatgtttactaacattgcacgcctttttttcttttgtatgatctatcataacactactcttgaattacttgtctgactgtttctcaaaagtggatgtactttccacctgcttcttactaaatggttttacgttattaccaaaaaaaaaaaataacaaaaactcgacaagatgcggagcattacaatttgaaactcgggcaaaatccctccggtnaaaaanggggccgtacaatnnccaaangtcttaacccccnagctctttaantcnacggaa

SEQ ID NO: 27391 - DNA, 627 bp, Triticum aestivum
  Clone ID: PAT_TA_27391
gtcgctttctcccggatggcggacagccttccctggtgggtgtgccggggaattgatgctggtgcaccgggcgctaagcctggacggcgagtatgccaggagttatgatgcttacagagtggatttggaagctggggtcctggccccagctaagggcttcaacgggcgcgccgtgttcatgggcatgttccgctcaatttctgtaccagctgaggctgcttacccctctgtcgctgctgatagcatctacctgggacacgattgtgatcgccagattcaggggtacaatatcgcggatggaagcagatgcagtctgattgaggcagtatatccgcgtagtattgtggattgtctccgctgctgcatccagggagtcggcaagcaacttgcttgagcctcaggacgaatgatgggtgtttgacgaatgccgggtgttactctttgctatgattctgtttctccggcgggtgtggtgtttgcggtgattctggtcttggcctactgctggtgtggtgtctgccgtgattctggtcttggcctactgctgggtgtggtgtctgccgtgattctggtgctggtcttatgcatcagttactgtgtatcagacagcattatcatatgtacctc

SEQ ID NO: 27392 - DNA, 686 bp, Triticum aestivum
  unsure (1)..(686): unsure at all n locations
  Clone ID: PAT_TA_27392
tttttcggccgctctagccggncgggccgggaaagccggccctcatcacgtcagagcaattggacgccgacgaattgtcccatcggccgagatgctcccacaacgaattgcgcgggcctcggccctgcgtagcggcatggcagctgctcgacgacttcctacgatccagcgccgaacattcctccccgatcagtacaccgacaagaaggtcattgatcagaagtaccccgaggcgcccagcatgaccgaggcggaggaccccggaatgaacggcggctacatcaacccaccccgaattaagcgacagttccgtgaccctcacggcaactggtgggatccccaggagcgacgaaactttggtgaacccattcacgaggataacgatgttttgggaatcttttctccctgggagtacacttggaccaccgccggtcccggtgccgtcatggtcggaacctttatcgccgttttcatgagcgtcactggaattgtttatcttaactaccccgaccgcccggcctacccccgagcctttgagggtggtctggagcgagagcttggtggaccaggagctacaagggctcgtatggagggagatgaggatccttaagcaatatgcgtttgtacataaagaaatggaatgcaagagattgaatcgcgaaaaaaaaaaaaaaaaaaggccccta

SEQ ID NO: 27393 - DNA, 615 bp, Triticum aestivum
  Clone ID: PAT_TA_27393
gacttcttctcatagtgggtgggggaggggagccaaccgccaagcgtcctgcgagcgggaggtagacgaagaagaagcaatggctcgcgcggggcaagggggcgggatggggagcgcggtgaacgtcgggatcgcggtgcaggcggactgggagaaccgcgagttcatctccaacatctccctcaacgtccgccgcctcttcgacttcctcctccgattcgaggccacgacgaagagcaagctggcgtcgctgaacgagaaactagacagcctagagcggaagctggaggtgctggaggtccaagtgagcagcgccaccaccaacccctccgttttcaacaactagctaagcctaattatctagaagaagtgctagcacgcggagttgaagctgcagagcttactgacgtttcagaggagcattctggctttgtgttgtgtgtttcctgtgtgtgtgtggcagtcaatcagtccatgtgtatgtatgtatgtacaagtcatgtactacaattaattgattgagatgttaatttcatatctttctgtatgttataatacgcacagttactaaaagaggaaagtagccctcaataaaaaaaaaaaaaaaaaaaaaaa

SEQ ID NO: 27394 - DNA, 1863 bp, Triticum aestivum
  Clone ID: PAT_TA_27394
gcaccaggcgccctccctcccccccgaccggtcgggggaggtggagctgaactgccaagctcggcgagtcgcgactcccctccgcccgcggattgccacgcaaaacgctggactagagccacgggaattcggacccgggtgccctccgagccctacgtgctgctattcgccgacgaagagccggcattcacgcagggtgcgggcgtctagctgcgccccttggctccccgcatcccgcgccccaacgcgtcggccccaccttcaccagacacgcgccccggggggcctttcgtgagagcgtagtgattggcaattactgtgttaggtgtgacgctttcgcccgtcaagcgagaacctgcggacttatcgactcgaagtggcctttctatctcctctgtcattggcttgtgctgcgtaatctacctcccctgggcatggcaaacgagtggtttggccaagggggccaggttttccctcgagagcgcaatgcatgccgaactcaatatgatacaaattctcagcgtcgtaagacatggttcaaaacgggtgatgtccggcgatctagtttcctcgaaggcgaaatataagccttggcccggtccaatagaagacggttgaccgtaacaagacgacagcatcgtaatggaacatcttctaacacgggggaatctcggagagacgtttgaaccggcagtccaggaaaagagacacggcctcgtcacgtgcccacaaagattggatgctcccatcccggggaccaatgaatcaaccaatgttgattatgtgtagtatacgaatatgagcgtgtgtgtcatgaatctcattcatgactgagatcaaagtgaagttgacgtattcacaatcaagcctttcccaagcaggctcaacgcagttcctccaagaatttctaatgggttaattccagggaggtttcatctcaggcatatcagcaagacaacagtggaagaaggatgcgaagggggccttatagcaatgtgaacaagtatctacttactggtaggtacagaaacatcatggacatgaatgcaggttttgggggttttgctgcggcgatcgagtccccaaaatcttgggtgatgaatgtggtgccaaccatagcaaagattgcaaccctgggggctgtttatgagagaggattgattggcatttaccatgactggtgtgaagcgttctctacttatccaaggacctatgatcttatccatgctagtggccttttcaccttgtataacaataagtgcagcatggaagacatcctccttgagatggaccgcatcttgaggcctgaaggtgctgttataatgcgtgacgatgtcgatgtcttgacaaaggtgaacaaactcgctcggggcatgagatggaacacgaagctagttgaccacgaggacggccccctagtgcgtgagaaggtcttgtatgctgtgaagcagtattgggttggcggaaaccagacggccgcatcgtgaagaacatattctaacacggggaattctgggatccacctttgaagctggcttcctggaattgagatatggagtcatcaggtgcgaacaaaaatggcctactcttctccggggtagcaatgaagcaaccaaggttgatcgagagcagtatattgttgtagcagttttgtaatttaatttcattcgtcactcggcatgaagttactctggttaattgaaggatgtattctcaagaaatattattgctttagtttctgtaattttgctcatgctgcaacttctgaatgtttgcttcattacccgtaaaaaaaaaaaaaaaaaaaaaaaaaaaaaaaactcgagggggggcccggtacccaattcgccctatagtggctct

SEQ ID NO: 27395 - DNA, 986 bp, Triticum aestivum
  Clone ID: PAT_TA_27395
cgctccgagccggccgggccggaacaatatccttctctctaccttcacgcctccaccacacgccgcgcttgcaactccggccagctcgaccggggccgaaaccaagcaaccccggcacgagcaagactccccgtagggcgtgcgctctactaccataccatggtgcaactcctcgtaaccgtggccaccgccgtgctgctgctcgtggccggcgcgacggcccagcggcagggctgcgagaacgcgacgttcccggccggccggtcgttcgagcggtgcaacaccctgcccgtgctcggggccagcctgcactggacgtaccacgcggcgaacggcaccgccgagctcgcgttccgcgcgacgtcgggcagcgccgggtgggtcgcctggggcataaaccccagcggcgccggcatgcccggcagcaacgtcttcgtcgcctcgcagggcggcagaggcgccgtgtctgtgctcaccaccatcctgaggtccacggccccggccctggacaacaccaccctccagttcgacgtgccggtgccgcccaccgcggagtacgcggccggcgcgtacacgatctacaccacggtggcgctgccggggaactccacgcagcagaacccacgcggccgggcggggccgctcagcggcggggacatattgccgcacccgacgtccgggcccaacttgcagagccttatgaggctggacttcctgtccggctagagcaccctcggcgccgaggtcgaggtctccgcgccacgccgcatagtcacggtgtaattatccgttagtgtcatcctcaacatcatgtagtactatatataaataaatcacgaggacggggcgtcggcccattgtctgggcagctggtgttgctgccagcccacttaagttcgagtcctggtttggacacgcgatgctcgtggagtttctcctataaaaaattaccaacaaaggttaacccttgggttggtctcatttat

SEQ ID NO: 27396 - DNA, 1269 bp, Triticum aestivum
  Clone ID: PAT_TA_27396
gccggccacgctccgacgcctcactcactcactcgcacgctccaaggcctcactccctcaccagcgacaccccgaatcccggcgtatggcctccacgatgccgcaccgcatcgcgctgctcctgctcctcctggcgtccacgcgcgcggcgaccgcggccggcgccggcgcctgcgcggccgagaagttcccggcggggaagacgtacgccaagtgcgaggacctcccgcagctgggcgccgcgctgcactggacctacgacgaggccaagtcatcgctctcgctggccttcgtggcggcgccggcgggtgccaacgggtgggtggcctgggccctcaaccccacgggcgagggcatggccggcgcgcaggcgctcgtggcgctcaagggctccggctccgccgcgcccaccgtcaggacgtacaacatcaccggctacgtgccgctcggcaaggcctccacgcccatcgcgttcccggccaccgacctcgccgccgactccggcagcggcggcaagatccggctctacggcaagctgcagctgcacagcgggatgaaggcggtgaaccacatatggcaggtcggcacctccgtcaccgccggggcccccgacaagcacgctttcgccgccggcaacctcgcctccaagtccaagctcgtcctctcgggcaaagcggcctccgcggcctcgccttcgccggcgcccgcccccatggccggtggcccgtccggatcggccggcagcgaggcggcgaccacggcgccttccgccggcaagtccccgtcgggcgcggccgcggccggcgtgtcggcgccggcactcctcggtgctcgcgttgatgggcctcctcgcggtgatggcatttcctttcctggcggtagcacgaatgaatgagtacgtactataattagtggaggtgcctgcgggcatggggggggggcgcagtgggcatggggaggaagcatttctcgaacaatatatttgttccatttttgtcgatcgatcttgctgcctattctttttcctaatttcgtttgaaataaaaggtggttggtgtaccgagctgttgtttttaggtatatcgagctgttgtttttgggtagacgtacgtagtacgtagtatgtactgctagcagtcggtgattattgtagtgctattgtggtcgacatgtcactgaatttatcatatgactgatatattttttatcatcagaggagtataagtgtttggtagcaaggaaaaaaaaaaaaaaaaacgccccctagta

SEQ ID NO: 27397 - DNA, 671 bp, Triticum aestivum
  Clone ID: PAT_TA_27397
accaccgcgaagtgaaatctcattctccaacaccagagcgtcgcagcagccagatccgcagccagcccagctccgatggcccgcaccaagcagactgcccgcaagtccaccggcggcaaggcgccgaggaagcagctggcgaccaaggcggcccgcaagtccgccccggccaccggcggcgtcaagaagccgcaccgcttccgcccgggaaccgtcgccctccgggagatccgcaagtaccagaagagcacggagctgctcatccgcaagctccccttccagcgcctcgtccgggagatcgcccaggacttcaagacggacctccgcttccagtcctccgccgtctccgcgctccaggaggccgccgaggcgtacctcgtcggcctcttcgaggacaccaacctctgcgccatccacgccaagcgcgtcaccatcatgcccaaggacatccagctcgcacgccgcatccgcggggagcgcgcctaggctgttcgtccggccgccaccgccacggttccatcctggttgatcctgattggattcgatccgtcctgttattctagtccacccgtgcttcgaattgttactactaggttctagttcaagtaacggtcgtttgctgttgattaccagttggaaaaattggaaaggaagtgatctattttatccac

SEQ ID NO: 27398 - DNA, 810 bp, Triticum aestivum
  Clone ID: PAT_TA_27398
tgttgttcgcttgtcgtcccccgtagcgagcacgctcccaggcgccgcctacctcctccccggcctcaccaggattcccatcctccgaaccccaccgcgagccagcatgagcgcggccgcatccacgccggacgcagctccgtctcccgccgccgccgcccccgccgctgtcggcgaggaagcgaggaaggaggccgaggacgtggtggtgcagtacgtggtgctgcggcgcgacctggcggacgcgtggccgctggggagcgtggtggcgcaggggtgccacgccgccgtggccgccgtctgggcgcaccgcgaccacccggataccgccgcctactgcgcgcccggcaacctcgacagcatgcacaaggtaacattggaggtgaaaggggaaacacagctgaagaacctggctgagaaactggaagcagccggtgtccggtacaagctgtggatagagcagcccgagaacatcccgacttgcatagccacagcgccctgcccaaagtcgcaggtagcttcgttcttcaggaagctaaagctttgcaaataacctaagaataatattgatccttgtctcctcccttacatgtgaggatcatcaaactgtggaaatcgtccggttttattttctttgcttatcttgttctccgggtttggcgttagtaaattggagccacacattttggccccatgttattgtgatacctgttttggtcttgcatcaactgattgtttctgtttaagaaatggatgtactcgtattggtatgacaaatattagagaatcgataactgtagtgttggagcc

SEQ ID NO: 27399 - DNA, 1725 bp, Triticum aestivum
  unsure (1)..(1725): unsure at all n locations
  Clone ID: PAT_TA_27399
acgggtcgacccacaggttcatcactgtccttcttgtgatattcagaaacctaagtgatgccaggtccctggagttgaagtctttgcatgatgatttcctgtgtctccaagccgaaggaagtgagctttgcgaggacaccaggatgatgaacaagaagcttggtgattttgaattcctggatgaccatcgcagcaaagatacaaccatgagcatttgtgaccggtctagtgaagaaaataatcacaaagaagttgacggcgctcttgttcaggaaacaaatgaaatgcggttggaggagatactcaagttacatggaaatgtggaaatgcttatgagcaaggagaaggcttctgtcgagatcagatcctgcaatgaagagatcacaaaattggtatcccacatgcacatggccatcatgaatgcagctctgttcaaggagaagatcgtcgagctcatcgtaacatgtgagagttatgagataagtgccatggtgcagaaggaggtgctcaaggaagatatcacccgaaggaattcgtatgtggacgagctgaaagacaagctaaatgctatagagattgagaacagaagactgaaggtcgatctgaatggtgacgtcacgatgttaggatcattgcagagcgaagtcagtgccctggagaaacaaaccgtgtcccttgctaatgatttcttgcaatcaaataagctcaaagtggaggaaaatgcatcatctcctcagcctctggaaaccatagtgggatccagtgatcagaatgcaaatgaaacagtaaaagacatggagctgcaaaaattgcgtggaacaatcaaaaggctccagaatgtggtcgcggatgccagtgtccttctcgagcaagagaggcttggtttcaatgccaatctgcaagaagcgaggaagcagatcgaggcgctgaagctcaaggagatcttggatgatgacttggtcgaaatgaactacgagcaaatgttgacacacatacagcttgatctcatccaaccttcttcaggccgtcgaaccgaggcccttggccagcagaagaaaattgcagctcaagcagatcacaaggttcatgaccttgctggaccaagcaatagccatgcgcgcgatgatttggggccaccgcagagcgagtcatttgacagtggcagcagcagacagtctcctgccgagctagtggtcgtgaaagagctgagcattgtgaaccaagagctaccaagggtccatcaccacggagccacaccaggagtggaagaacaaggtcattcagaggctatcttctgacgggaagaggcttcagcgtgcaaggaagatgtcggagaagattgggaggctggaggtggaaatgcagaaggtccagcaggccctggtgaagtatgaggaggagcagacgacgtcgaaaaccgtggttcagcggtcgaaggtgcaactggtggactatctctacggtcgaaggcgggaaagccggaagccgcggttctcgccctgcggttgcatgagagcgaaaaccatcgatgactgactctgccttcgttcgcgccgctccttttttgaaggcggagtgtggaaggctggggttttcagtttcagatggagcgactcattagttcatgtttttctaggtaaatacagaaaaaagaagtggtatgtaaggatatattgtaaatggtagtcatnaccgtaagcctatgtcataacttactgccgggtt

SEQ ID NO: 27400 - DNA, 973 bp, Triticum aestivum
  Clone ID: PAT_TA_27400
cgttttcaacttctgtaacttctaccttttgggatacacaaagtctcatttcgtcgagaggcttcctggagcttcaaaacatttcacttcaactttttagtctttttcagtacatcttcgacgcttgccctgctccctggagtagcgccttcgacgctcgccctgctccagcagtcgtcattcggcggattagccaccgtctatttggtgcgggacctacctgcgatgctaccatctgtagtctggatgcatcaaaaacaagatgaacatgtttattttttgaatgcttttcagtcgatgtacttcgtgacagtctgaatatgttgcccccaccatgccgatttactgctgcgacctcgttgattccccgccttcgaactgctccctcaatcccctccgtggaccactgccgacggtgggctgcaccttccacgggaagccacgtgaccgtgtagacgcacgtcttcattgagtcgctcactgcgcatatgtgtgtgtgttgtgtttgtgtgtgcgtggccgcgaccatgcttcgcatttcggtgttgtctatgtgtggtcgtgtggtcgtctcacctcaaacacatcctaggccggtgcatgagttgctgaggaaacgcccaaggttgtggcctctcgaccacaacttcatctcatggaaggtgttggatgtggacagccagaacgagttcaattccagatggctcatcgaggagaaaaagaagaggaacttgagtggtttctctgtggagaagggcagaagaaattgtgctctgaacatgcttgttgatacgcccatgagaacgggtgcatttttctatagatttttgtgttgctgacaaagctacacaagttgtatttttacaagttgaacttaacaatatcctctagaaagttcgtgcatggtgtggatgttcttttgacattgagctattaagtgcttgcaaaatctatagtgttgatccatcaacac

SEQ ID NO: 27401 - DNA, 768 bp, Triticum aestivum
  unsure (1)..(768): unsure at all n locations
  Clone ID: PAT_TA_27401
tactccaagttttttcctctctgagacgtagctttgtgatattaattaccggcattgttcatcctggggaaggagctgcgaggaagatggggatcgctgccatcgctcttattctggcgacgatgatcgcctccaaagccgcagcgcagaacaacggttgctcgagcgtgatgatgaccctatccccatgccttgacttcatcggaagcaaagccctggagcccggcttctcctgctgcaccacgctcgccggcatcgtccagaccgacccccgttgcctctgcatggttctcgatggcagtgcggcgtcatttggcatcgtcattaaccacacgagggccctggagctccctagcatctgcaaggtccaagcaccgccgattagccaatgcacagccatcccagttcctccagcaacagcgccagaagacccaccggaggagacgagcaaccaagtcgcagatgcacctaaaggaagcccgaattcgaatgcaacatcaagctccaggaactcaaagagtgcggcaaatttgatggtcactatgcttatacctacatgtgcattaatctatgtcttctaagtgttggacagtttcattttctgcagccttgtattaaatgacaagaccaataggataccatttagtatgatatatctttccgatgagtctcaataaaaaaatgtcgtgtcattcagcataagaagccaattaactccagcggatgtgaaaacatgaattaacacgntatagctagctacgttgacat

SEQ ID NO: 27402 - DNA, 1197 bp, Triticum aestivum
  Clone ID: PAT_TA_27402
aaaaaaaaaaaaatccattccccgttcaaacccagctcaccttcctccccccttcccacccgccgccggcgccgccgccaccgccgccccgggacgaacgatgctgctggtcagccaggccgccaacggctccctctccgcgcggcggctgccctccaagccgctcgccagccgccggggcgccaaccccgaccctctcttcgccgggccccgcgtcgcgcgccgccgcctcgcgctctccggcgccgccgacgcgcgggacgcgccccgccgcgcctccgcctcgcctcccgcccacgcggccgcgggcgagggcccctccggctcccccgccgccgccgaggaccccgtcctcctcggcgtcagcgacgaccgcgtgcccctcgagggcgtcatccaggtcgagaggcccggccaggccgacgcccagtccaagctcgtctcctacgcgaagatagggcttctggccggaggggatctgctttgcctcctgatcttctccgcgattgggaggctcagccatggcctgcccgtgcttgacgccgagacgttcaagacggccgacccgttcattgctggttggttgcttagcgcctacctccttggcggatttggtgatgatgccaaaggaagcaatggtgttgggaatgctgtaactgttgcggccaaatcctgggctgttgggataccgttaggaattgccattcgttcagtgaccgctggtcatattccacaaattcctttcgtcttggtggccatgggaagtactgggggtcttgttgactgcatggcgtgctcttgtttcccaagttctttcccgctggacagagcaagaaggatgatgtatacagaaagggaaatccttttgagcttttttgagttgctcacatcgctggtgcggaggtggtgagatcttaagctcaaaaaagcaaggattaccaccaaccttgtgtaagtacaattttgaaggccaagggcccaagatggaatagaaatagtcggagcatatgcagaaacttgtttggcaagatggtacagaggcaatgccatgcattctaatattattaagatgtagctgatccatcccttgtaattactgtatgcagcctgacccaatcattctaatactaatgaataaacttatgcacaaaaaaaaaaacctgcccgggcggccgctcgaaatcacttagtgaattc

SEQ ID NO: 27403 - DNA, 694 bp, Triticum aestivum
  Clone ID: PAT_TA_27403
gcacgaggtcacttgattggttctgttggactccacacggggcagagacaccaccgcattcgtctcaccggccgctaccgcagccgaccggatccatcagccgccatgcgtccgcgtccaccggattcagcggcggcggatccccgcggcctgcagcttcctcctcctcctcctctctctcctcatctcccccaccgccgccgccaagtcctctggccgccccatcaccgacaaggagatccgcgagaacaaggccgcctgctacaccgacgtcgagaacgggctgtggggattcgcgtgcaggtcgtccaccacggagaaggagaattgcgtgctgcgctgcctctcgccggagtgctacaacctcatatatggcggcgatccgcttgaggaaggggagctagactatgtccgcagccatgagtacaagtactgcatgcacaaggtatcccttggagaaagcttggatggtgtgaagggttccttcagctattcatgaaggatttatactttctgccaatgaagtgaacagagaaacattctccaagtctgctgtaaacagtaaactgtaacgtttcctaacatatggtgtatccttatgttgcattacgcagtaggtatatttgtatgaaattcttagtcaaaaatcaaacatatatctttcattcatttcatgctggaattagatcaaaaa

SEQ ID NO: 27404 - DNA, 565 bp, Triticum aestivum
  Clone ID: PAT_TA_27404
cgtccgggaaaaataacatcttggtggagtaccctttctggaagggtagtgaacggttcaatgagattgtcgatatcaagcacatcagaccttgcccgccacatgcatcagttattagtttctgcatcaatgatgatgttgaaggctttcaggatcacgcgtccgggccagggaagatcactgagatccatcccaagttaacgtatacatttaagttaagaacttcaggaaagaaggttcagttacaccagaacacactgaggcttcgatatgactggactgataaccaatggaagcaagttgcacagaatctgtcgggaacaaaattcacaggaggcgacagggttgaagtcagcagcgacgaggaaggtttccacggagcgtggttccaggggaccgtcatcaaatccgtgggacacaagttccttgtggagtatgatgcactgaaagacgatgacgagaccacgcctctgaaagaaaccataggggaggagcacatcaggccctctcctccggccatccctgtcaccagcggtttcaaggtccttgacgagatcgacgccta

SEQ ID NO: 27405 - DNA, 1146 bp, Triticum aestivum
  Clone ID: PAT_TA_27405
gcggcgtttccgttgttgcttgcttccccgcgattgttgcttcactttctccagaactcactgcgccgtcgaggagactggactgatgaccagtggacgctacttgcacagtatcggtcgcgagcaaatctcaccgggcccgccacgggcgtcgggtgctgcgtcctgcatcgtttcaacggagcgtggttccaggggaccgtcgtcaaatccgtgggacacaagttcctcgtggagtacgatgcgctgaaggatgatgacgagatcacgcctctgaaagaaaccataggggaggagcacatcaggccctcccctcctgctatccctgtcaccaacggtttcaaggtccttgacgagattgacgcctataccaatgatgggtggtgggtcggcgtgatatctgaggtcctcgacgaccagaagtacaaggtttacttcaaggcttacaaggagcagaatgactttgagctcgagcagctgaggcgtcactgcgattgggtggggggaaggtggatgcaggcttccccggcgctggagatgtgacagctgaagggacacacgcatctttgtacaggagcctgggataattagtagtcctacccatgagagtgtggcttcactagttatgatggttgctgaactgaagctgtgttatgcgcatagaaaggccatgcaaatcggtagtagatggcctttctgcattgccattcccgcagcaggtgatctagatgagatgttcgtcgacgggagactttcacctttcaccgtcacaagtaagatttcgtcgtgctttttatgtaaaccacctaagaacaaacctctgggaacatcgtcgctattcacgattccgcctgaaacatgagcctcgctgaactgaagctgtgttatgcgcatggaaaggccagcaaatcggcagtagatggcctttgtgcattgcaattcccgcagcaggtgagctagatgagatgttcgtcgacgggagactttcaccgtcgcaagtaaggttcgtcgtgcttttatgtaaaccacctaagctcgtcccgggctgagtttttaaactattcacgatgcaaagagtccccgcgtttgaaaatcgacccgtgctccccaaagcccgctgttgtgatttggggtaatatgtaaaag

SEQ ID NO: 27406 - DNA, 1120 bp, Triticum aestivum
  unsure (1)..(1120): unsure at all n locations
  Clone ID: PAT_TA_27406
cnatcaaaattgtcctcccagcttccccctccccgctttcttcccctctctgtcccaatctcgcgcgacgccacgaaaccctagcccccaaatcgctcgccggggagagggagggagggaggccggagacggacgccgctcgccggcgccgatggaggtgaagctgtggaacgacaagcgcgagcgggagctcctggagagcctggccgacctgtacgcgatcatcaaggccacggagaagctggagcgcgcctacgtccgcgacctcgtctccgccgccgactacgaggccgactgcctcaagctcatctcccagttcaactccctctcctcctccctcgccggggtcgtcaccatcccgcgcttcgtgcaggcctaccgcctcgactgccccgccgccctcaaccgcctcgtccagtccggcgtccccgccaccatcgagctccgcgccgccacctcctcctcctccgcgccgcccgccaccgcggcctccgcctccgccatcgcccagtgcgtccagagcttcatcaccgccatggacgccgtcaagctcaacatgctcgccaacgaccaggtccgccccctgctccacgacctctccacctccatggggaagctcggtaccgtcctgccgcccgacttcgaggggaaggtcaaggtgaacgagtggctcgcaaagctgcataagatgggggccggggacgagctcacagatcagcaggccagacagctcaattttgatctggaatcagcctatagtgcgtttatggcctcgcttcccactgctggcctgtgaacgatgatccgcttggttcagagttgcttcttcttttccgttttgtcatgctcttgtcttgcaatggtatacatatgtgtaatttggctcaaagctatatcgtttgtcgacaacaatgccaatcttatggaaagtgccccctacagatcgatcttcatactgattatagggaccctgattgtatcaacgtaaatgtgttaaggctccntcantgctgttggataaagatggtttgtccgatcgttcacttgtacatttgcnttgatacacgtgggcaaaatgaaantggttggtcatctgcaaaanaagggtttacaaaaccca

SEQ ID NO: 27407 - DNA, 862 bp, Triticum aestivum
  Clone ID: PAT_TA_27407
aacactacactcgctacagtcgttatcactctcgcttccctactctgcacttcactcgttaaaagtcagaccactccaaaacaaccctcaaaaaaacatccatcaaaatgtctttcttcaaggctgccgctgctgctggtctcctcattggagctgccaatgccactcctcactacgctgcctacggtaacggtactgagtacaccactgaggtcctcactgccatcaccacttactgccctgagcccaccactcttactcacggcaacaagacctacacagtcaccaagcccaccactctcaccatcaccgactgcccttgcacagtcaccaagcctcagactgagcactacccccagcctacccccggcaagcccggtcaccccggcaagcctgagattcccgctcctcaccctactgctcccgctcccggaagcctgagtacccccagcccggtcatcccgaggctcctcacaccaccggccccgtccccgttaaccctaccggcagctctcctcctgagggcaccaaccctgccgtcgtcactgctgctgccggccgcatcgcccctgctggtctcttggccttcatcggtgttcttgctttcttctaagctattcaaccgcatgcttgtcacgaatatctggccccaggacacgatatacgttgacgttaaaaagcgttgggaccctttttttaatgattaattcatacatgatatgatggatgaactacgattggaaggaaacggcgggtatatataattcagttctacaatttgcacataaatctcaggatagaggtgcacaaatcttaatactacaaagttcatctggaaaaaaaaaaaaaaaaaaggccccta

SEQ ID NO: 27408 - DNA, 606 bp, Triticum aestivum
  Clone ID: PAT_TA_27408
ggtagatccagcagctagcaaaagaggagcagagacggcaagaagaatggcatccaaaacagcgctcatggctgtggctctgctcgtccttgtggccggcgatcttgtccatggccacaccattctgccgccgctcgggcgcgcccggcggagcctcggctggatgcaaggcatgaagggagggccccctagtgggcatgcagccatcagagactgctgcttctgctgcccgccgccgcaccatttcttgggtgcaaaaaggcgaggaaagcagccgggccggcggcgtggaggaacgcaagttcatcgcgcctgtgccagggttcaagctcccaccccttcctccaaacgctgcctgaagagatcacatcacagagtgagcatgccacggcatggaccatcactaggtctatcaatgaataaaggtgccggagtgttcaaggatgctttatatatattgttcaataagtaaggcagcgtcaatctgctatgtttaagttactaagtatgatgccgccttcgttcagtaactgtaaggttgcagcatcagttgtaataatgggagaaaacagtgagcattcagatcgaactagctcggttcttgag

SEQ ID NO: 27409 - DNA, 688 bp, Triticum aestivum
  Clone ID: PAT_TA_27409
ggtttgggggtagatccagcagctagcaaaagaggagcagagacggcaacgaagaatggcatccaaaacagcgctcgtggctgtggctctgcccgtacttgtggccggcgatcttgctcatggccacgccgctgcccctcggacgcgcaactgcccggcggagcctcggctggatgcaaggcatgaagggagggccgcccagtggcatgcagccatcagagactgcccgccgccgcgccatttcttgggtgcaaaaaggcgaggaaagcagctgggccgacggtggggaggaacgcaagttcatcgcgcctgtgccaggattcaagctcccgcccctccctccgaacgctgcctgagaagagatcacatcacagggtgagcgtgcatgcgtgccgtgacattgaccatcactaggtctgtcaacaaataaaagtgccggagtgttcaagggtgctttatatatagttccataataagtaaggtagcatccatctgctatgtttaagctactaacgatgccgccttcgttaagtaactgtaaggttgcagcatgagctgtaataatgggagaagacggtgagcattcagcttgaaatagctcagttcttgaggcagcgtctgcctgcgttctgtaactggggggtgcctgtaccggctgtaataaagggagaaaacagcgagcatactc

SEQ ID NO: 27410 - DNA, 933 bp, Triticum aestivum
  unsure (1)..(933): unsure at all n locations
  Clone ID: PAT_TA_27410
aatcaaccctagcctccccatctccacctccatcctccgcgcccccgctctgcacgccgccggtccctcaacaccctccatcctcgtccgccgtcagccgccgagtgcgcggccgcacccgtctactccgccgctccaagcctccgttctccgctggatctgcacctcatccgctccacggccgcgactcaagctcgaagacagtcgaaggtaatttgcaagcagcagccatggcgtctcgtttttggggacagggagacagtgactccgaggaggaggtggacgagatcgagtcagaacaagggagtgatagcgagaaatcagaagccggtgatgggggacgcgatgggtccaagaaccgctatctgaacaaatatacacaagacagtgacgactctgatactgagagtcaccgcgtgattcgctcgttgaaggacaagcgcaatgatgagatgaaagctactgccgaccagatgcgcaatgcaatgaagatcaatgactggattagcttgcaggagtgttttgacaagttaaacaagcagcttgacaaagttgttcgtgtcaatgaatctgcgaaaattccaaatgggtatatcaccactcttgtgctactggaggacttccttgctgaggctcttgcaaataaggaagccaagaagaagatgagcagcagcaatgcaaaggcgctaaatgctgtcaagcaaaaacttaagaagaaccaacagcagtatgaagacttgatccagaagtgcagagagaatccagagagctttgaagatgatgttgcagataataaggatgtggatgatgatgatgatgagagtggtgacgatgtcgtggatccggataagatggcctctgactcagaagnnncnnnnaatgaagacgatgtcagtcaagatngtggagcctggnnnaagaagttgagcangn

SEQ ID NO: 27411 - DNA, 514 bp, Triticum aestivum
  Clone ID: PAT_TA_27411
actacgaaacaatcagtcatccaattttctctcactaagagggaaggcaggaaggcagccgggcagggggcgacgggaaggcggcgacggtctggggagcggcaggaaggcggcgacggacagggcagcagcgggaaggcggcgacggacaggagagtggcaggaaagcagcgacggtctggggagcgatgggaaggcggcgacggatagggcagcgctggctttgcgggtagcgaagggagaaacatcaaggccgtggtaggaaagatgcaagtcatgttctaacggcctctgctcctctggctgcccatccaacctgcccgccggtcgcccttcttctccctcaccgtgtacgacagcgagattggccttcgaggttcgatggataatggaaaagtcacctatctgaaaatgtggagccttgttatttgctattttttttcttttatgtccatgtaataattcgaacaagatttgtacgtgtgactgtcctagtcttccgctctgctgctcc

SEQ ID NO: 27412 - DNA, 853 bp, Triticum aestivum
  unsure (1)..(853): unsure at all n locations
  Clone ID: PAT_TA_27412
acagcaccaagtcaccaacgaccaccagcgcctcctactgtcagcctcagctcactcgaagttagcaatggcggccgcgaccatggcgctctcctccccggcgatggccggcaccccggtgaaggcctccagggcggcgcccttcggtgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgcgggcctctccgccgaccccgagaccttcgccaagaaccgggagctggaggtgatccactgccgctgggccatgctgggcgcgctcggctgcgtcttcccggagctgctcgcccgcaacggcgtcaagttcggcgaggccgtgtggttcaaggccggctcccagatcttcagtgagggcggcctcgactacctcggcaaccccagcctggtgcacgcgcagagcatcctcgccatctgggcctgccaggtggtgctcatgggcgccgtggagggctaccgcgtcgccggcggcccgctcggcgagatcgtggacccgctctaccccggcggcagcttcgaccccctgggcctcgccgaggaccccgaggcgttcgcggagctcaaggtgaaggagatcaagaacggccgcctcgccatgttctccatgttcggcttcttcgtgcaggccatcgtcaccggcaagggcccgctcgagaacctcgncgaccacctcgncgaccccgtcaacacaacgcctggtccttcgccaccaacttcgtcc

SEQ ID NO: 27413 - DNA, 2627 bp, Triticum aestivum
  unsure (1)..(2627): unsure at all n locations
  Clone ID: PAT_TA_27413
gtttccgatccctgcaaaactcgggccacaaacgacccccacacgcgcagggtctcccctcggcgagcgcggacaccgcacgaatcccaaagcagcccgtaaccctagccgacatggccggcggcaagcgccgctacaagcgcaaccccaccgccggcgggccccgtcacagcgccggagccgggcgccggcgctcgctcccagaactcccttccttcgtctcccccacctccgtcgccgccgcgtttggcccttcctcctcgggcggccgggggcgcggccgaggcggccggcgcggcgccgcggcggaacccgccaacgccgtccccttcagctacaccgccgcccttcgcccgtgccccgcctccgccggcggggcgacgcaggcgctggaggtggccatagacaccggctcctgcgccgatccggccgcctccgcgtcgatgtactcgtacgaagtggtcggagggatcgggcttggattccacggcgacgaggaggcggagggccaggaggaggccggtgagggcgcgccgcatctaggattgggattccacgatcgtatcgaagaagagatggacgctgaggttgaggaattggaggaggtctccttcgtgacgccgaggcaggctaagagcaaagggaggcagaatggtggatttatctccatcgggggagtcaggatctacagcgaggatacctcatcaccggaatcagaggggatgggcgactccgatgaggaatcagattccgattacgaggtgagagatcgcaatgccgatgttgatagcgatgaggaagatagtgatgatgataagggggatccggagtctgatgaggacggttcggggtcagactccgaggagggtctcagcattggggactcatcggttgatgatgagattgttgccgattacatggaggggattggtggcagcgaggagctattgagcagtaggtggttgaatggcatgaaattggttgattcagatgatgatgagatggatacagacgatgatgaggacgggttcctaaagaagggcaaggaaaagcttgagggttatgcactaatgcgtgcatctgagcagtatgggatgaagatgcccaactcggctgaaaggcggaagggaaggagctctaatggcagggattgtggcaggggcctggctagtatacaagttatggggctggaggatgtgatgatggtaaaggatgcaaggatggcaaacaggtcaagtaaggggtcgaaggcttcatcgtcatctcagctctccaggtcctggcccgatgcggccaggaagagcaagaaatatcagagggtnccaggtgaaaaaaagaagcacaagaaggnacacattgcgaagaaacgccgtcaacggatgctaagtagaggagttgacttggagcaaatcaatactaaactgaggaagatggttgtcaatcaacttgatatgttgtgctttcagccaatgcactctcgggactgttctcaggtacaacgcctcgcatctatttatcaattgaaaagtgggtgtcaaggttcaggcaataaaaggtttgttacggcgacattaactggacagtcttcgatgccatctgcagatggtcaagttcgacttgataagcttttggggactgagcctgaggactatagtgtcaactggaacagctccaaaggtccagcaagagcgaagggtctttcagctccagggaaattggcgaggcacagcgattcttgtgggaagaacgttccaacgaaaaaggtctcatttgcggagcgtcctgtatcttttgtgtcttctggcactatggcggaaactgttaccgaggcagtagcagttggctcaacttctggcgatgtgtcatgtgagaaggttgtcggaagcgactccaagctgggcacctttgagacgcacaccaagggctttggttccaaaatgatggcgaagatgggattcatcgagggcactggccttggcaaagatggccaaggcatattgcagcctgtccaagcaattcagcgtcccaaatctcttgggttaggtgtagaatttgacagcgaattggaggcggccaaagcaaggtcagagccaccggccaaagcaaggccagagccaccggctaatgcaaggcgagaactgagtagaaccaggtcagaaccgaggcgcaacacacggccactggagatgtacgactgcggcacttttgagaggcatacaaagggttttggatccaaaatgatggtgaagatggggtttgttcctggttctggcctggggaaggatggccagggcattgtcaaccccttgaccgcggtaagacgaccgaaatcgcgggggctgggagctaccgacaagtactaacatgttgcgacatcaagtttgctttttatttatgttcctgtcatgtacgtacttgttgcctcttggatcacctaggtgtgtgtatgcagggagagcacagcctgttgtctgcggcaatagcaggcttcagggtttcgatgcccctttgcagttcaagtagccataggatttcccttacttacattgcaacaagacattactgctgttgtttatcatgttgatttcgcaatcctcttatcaagcattctgattcagctgtgctat

SEQ ID NO: 27414 - DNA, 797 bp, Triticum aestivum
  unsure (1)..(797): unsure at all n locations
  Clone ID: PAT_TA_27414
atttcacaggtcattcgttccagatccgtcgtccttttcccaccgccgactctccacatctgtgttttcttctatcccaaccccttccttcctctatctcctaaacgaggcaagcagagttcgaccactggggggcgtcatcgactcgccgccaaggagttgcgccatggcgtccgctgcaccccaaagccaacggtgcgatggcgtctacttcccgagcgaatgcgaccaggcgctaagggctccactttccgagcggcagcggcgggcggggactacgacctccacttccttgggcgttgatgggtagtctcttttgcctcgcttccggtttgactggctgctttagcgtcggctggtattcttcacccaaatcagtgtcaacgggctaactgaccttttgttgctgattcccttttggtgcttctttgggctggtggcgacatcaacgagcttgactttggtcatcgggagatctaggtagatgattcagcggcttctccgccgagctacgagctcttccagtttgcaggtggcgcgacggtggcgaggtggattgcaacgcactggttactctgtacagatctgagggaccagtttgtcattttctttatttccaagattttctttgtaatatggagcaattgtaatttgtgtgtgtgtgtttcattttccttttacttgtggttgtaatttgtgtttctgtaaattttttattaagtgatacaagcaaaaatcttagaaaacatatgtggcttgaaatgttatcttaaaataaaaaaaaaaaaaaanaaggc

SEQ ID NO: 27415 - DNA, 818 bp, Triticum aestivum
  Clone ID: PAT_TA_27415
gaccgcgcggactgtgtagcgtgtcgcgggagagaagcccaaagctttggcggagccatggcggaggaaaccggagcgacggcggcttcagggtcggcagcgggcaagatgacgatggtggtcggggtggacgagagcgagcacagctactacgcgctgcagtggacgctcctccacttcttctccccgggccagcagcagcagtaccgcctcgtcgtcgtcacagccaagcccaccgccgcgtccgccgtcggcctcgccggaccaggtgccgcagaggtgctgccgttcgttgaggcggacctgaagcggagctcgctgcgcgtcatcgacaaggccaaggagctctgcgcgcaggtgagcgatgctgtctttgaagtggtggaaggggatgcgaggaacgtcctctgcgaggcggtcgaaaggcatcacgcagagatgttggttgtgggcaaccatggctatggagcaatcaaaagggctgttcttggaagtgtgagcgattactgcacccaccacgcgcactgtactgtgatgattgtgaagaaaccaaagcacaagcactgagcaacgcccagctcagtgattagtatttgagctttcgtgtgtatagccaatgtgtgcatgtttgtgaataaatggatcgcggatgtcacaattcacaacttcagagtagcgaactcctgcaagtggcccacaatatcctacatgtggattcttgattgagatggtgaataactgatgacgtgcctcatcagaacagtgttatttgtgatgcagatgcatcaattgcacgaatgttgtatgtatatgtaatc

SEQ ID NO: 27416 - DNA, 1038 bp, Triticum aestivum
  Clone ID: PAT_TA_27416
cggacgcgtggtccagacccgtcgacagaccgcgcggactgtgtagcgtgtcgcgggagagaagcccaaagctttggcggagccatggcggagggaacgggagcgacggcggcttcagggtcggcagcgggcaagatgacgatggtggtcggggtggacgagagcgagcacagctactacgcgctgcagtggacgctcctccacttcttctccccgggccagcagcagcagtaccgcctccgtcgtcgtcacggccaagcccaccgccgcgtccgccgtcggcctcgccggaccaggtgccgcggacgtgctgcccgttcgttgaggcggacctgaagcggagctcgctgcgcgtcatcgacaaggccaaggagctctgcgcgcaggtgagcgatgctgtctttgaagtggtggaaggggatgcgaggaacgtcctctggaggcggtggaaaggcatcacgcagagatgttggtcgtgggcaaccatggctatggagcaatcaaaagggctgttctcggaagtgtgagcgattactgcacccaccacgcgcactgcactgtgatgattgtgaagaaaccaaagcacaagcactgagcaatgcccagccttgactcttcgctgaacccagtttgtgcatctttgtgaatttgtgcatctttgtgaataaatggatcgcagatgtcagagtttgcaacttcagaagttcagagtggagaactcctgcaagtagcagacaatatcctagtacatgctacatgtggattcttgattgatatggtgaataactgatgatgtgcctcatcatgaacagtgttatttgttatgcagatgcatcaattgcgtgttatttgtgatgcagatgcatgaacgctgtatgtatatgtaatcaagactgcaagttccttgcagtggacacatgtgttcagttcttgtggaactgtatgtaatttgtgaatgtatgcttctccgttacacagaaatcccctcgcgtaaacgggcccccttcctcaggaccccagttgccccgccaaaaaaaa

SEQ ID NO: 27417 - DNA, 721 bp, Triticum aestivum
  Clone ID: PAT_TA_27417
cgtggctgttgagatgtgggcgtggtttgtcccctctcctaccgtggcgtcggagcccgtggctgtgtaggtgtggcgggatgttgctgccatggaaaaggaggtggtggctatgcgattagagaaagagcaggatacgaaagcaagaaggttcggcagttcaagcacctctgcctcacagatgccacctggaaggactctgcctcggagcggttcagcacgcaacatgtgatgctgatatgaagcattaaaaagaccttggagcatcccttgtgtagttagttgaatcatggcatccagggaccctctgctgacttgtgtgtagagaaaacaagaagacattacatcttggttgcctgcccagaagtgtcgagcctgagcctgaccctgatcgatcgtgcctactacatctcgtggtcgcggaaatcaatcaatcaatcagcgactcgagtcgggtgaagttagtgtcgttgatgagatttggtggtgtttttattcattttctatcgtggaatcgaaacactttgttgtataggtatggtgtggccttgcaatattttttgtttgtaatcctactccccaagagcttgtgtggtgttttatgctagccaagttgttgtgaataataacatgatgatgatgatggtgctgttgagctggtgggcctttgtgctggtaagctggtgtcccttttttgggaggtgaattcccaaaaaaaaaa

SEQ ID NO: 27418 - DNA, 640 bp, Triticum aestivum
  Clone ID: PAT_TA_27418
gccggccgggctgccgtggaatgtgcgccggctggttgttggaatttaattgtgctcatcatcatccccgataccaaagcccatcttcttctccttgaaatctttttgggttcacagatttggaggatgtcttgcaactgtggatccggttgcagctgcggctcagactgcaagtgcgggaagatgtaccctgatctgacagagcagggcagcgccgccgcccaggtcgccgccgtggtcgtgctcggcgtggctcctgagaacaaggcggggcagttcgaggtggccgccgggcagtccggcgagggctgcagctgcggcgacaactgcaagtgcaacccctgcaactgttaagctgcatgcactcgtacgtacgtacgtgtgatggtgtgagagtatacttgaataacgagcgtctgatctgatggagtcgagcaagggtgcgtgtgcgtgtgatttgcttgctcgctctccgcctatgctctgcccatggtgtccttgtgtgtatgtgtgtgcgcatgtctccctgtaattgcttcatctatctccactatggatggagtgatgaatatgtaagaatgaaagatttacctaattaactagtcctaaatcgctacttcagtcgcctgatttttctaaa

SEQ ID NO: 27419 - DNA, 1410 bp, Triticum aestivum
  unsure (1)..(1410): unsure at all n locations
  Clone ID: PAT_TA_27419
atcacttccccgatttgattgagttgagcccgacgcccccaccccaccgaccgcgccttccccaccacaccgcagctccggcgggcccgaaccaaatcaatcgccggatccccctccacctccaccgcccatggagctggcgacgcgcgatctcgcggcgctgggcgcggcggacctggtgcgggtctccgccgcgatcccgcgcgccgcgccgcgcaccttcgcgctgctcaccgcctgcctcgtcttcccgctctccttcgccgtgctggcgcactccctcttcacccaccccatcctccgccgcatccggacctccgactacaccgccacctccgcgcagtgggtggcgctcttcgcctaccagttcctctacctcatcttcctcttcaccttctcgctcctctccaccgccgccgccgtcttcaccgtcgcctccctctacgccgccaagccggcctccatcgcctcctcgctctccgcgctgccgcccatcctgccccgcctcctccgcaccttcctctgggtctcgctcctcatgctcgcctaccacgtcggcttcgtcgtcaccgtcgtcctcctcatcctcctcttcgacccgcccatgaccgcctccaccccgccccccctctccttcctcctcgccctcctcgccgtcgccttcctcttcctcgccatccacgtctacatctccgcgctctggcacctcgccagcgtcatctccgtgctcgagcccctctgcggcctcgccgccatgtccaagagcaggcagctcctccagggccgcactcgcaccgccgccgtcctcgttttctcctacttcgccatctgcgggctcatcacggggatgttccgttcggctgtcgtcaaggcgcggggcgaggaggggagcctcgacatgagcttggccggccggataggcgtcggcgctctgctcgtctctgttctcgtctgtgtcaatctcttggggctgctcgcgcagagcgtcttctactacgcctgcaaggcctaccacaaccaggagatcgacaggaccgcgctgtacgagcacctcggcggctaccttggcgagtacgtgccgctcaagagcaatatccagatggagaacctgtgagattcgtaagctgctcactcgcctgctccttccaaatactagctgtgctgttggatcttgctctaaagaagagcatggcgttgccaggacttcatttagttttcttgtttctagtttattgtgcttgcctgttgtaatctgtaattaataataatgcgcagtatggactgatctgtggtatgcaacataaaggaagttctcattctgctgcaaaatcatctgtgtttgttactccctctgtcaacttatataagacgttttggtagttcaaatnatttagggtaagtnacagaggt

SEQ ID NO: 27420 - DNA, 914 bp, Triticum aestivum
  unsure (1)..(914): unsure at all n locations
  Clone ID: PAT_TA_27420
atttccgtgacctcctgctctcctctcctctgctcctcctccaccaccacctccctctccctcctcccccagagctcaccagacgccactagctccgccggcacaagcgaggtgcgatgggcaactgccaggcggccgaggcggcggaggtcatcatacagcaccccggcggcaaggtggagcgcctctactggcccaccccggccgccgaggtcatgaagaccaaccccggccactacgtcgcgctcgtcatcctccgcctctcccccgactcctctgcggccgcgggctactcggcagccgcggcctccgtcgtcccaggcgcgggcgccgccgccaagatcacccggggcagaagcgaggcgcggaggcgcgtgcttcatgggcaacaggtctaccgcctcatcaccgcgcaagaggtgaccaaggcgctgcgggcgaggaagaacgacaagatgcggcggtgcgaggccatcaagcagcagcacgaccagctccggcgcggcgacggggcggagcagggcgcctctcccccggacgcgaacgcgaacgcgaagcagcggggggagggcggcggccaccggggctcgcgcgggcgccgccgcgcaagatcacccgggtcaagctcctcaagcccaaggacgtgctccacctcggcaaggtctacggcccaatcacggagcaagaggtgtagaaggcgttgcggcactgcaagctaatcgacgtatggacagtcggcttcatcaagcagcactacgacttctccccgcacgccgacggggcggggcgctgggacctacccaagcaagccaacaacggtgtaaaagtcggaacgggcgcgcgggcccagccgccgggggggaaagncgaattgggcntcctgaaaaatcccaaccngggggaaaaaaattaat

SEQ ID NO: 27421 - DNA, 951 bp, Triticum aestivum
  Clone ID: PAT_TA_27421
gatagcagtgcagaggagatcagatcacgagacgagatggcggcgtcctcctcctccccggcggcggcggcggttgggcgagcggtggaggaggtgcgttcggcgctgaacgagcacgctgacgtggtggccgagctcttcggccgcgtctccaccgagctccgcggcgggttcggccccgccgtcgacactttcgtcggcttcttccacgccgtcgactggaaggaaccttggttgatcggcatgataagtttccatgtcattctgctactggtaaccatcatctccaggaggaacatcaatttccaacttatcttgtcagctttaacattttctggtgtattccttgccgagaaactaaacacgttcttaggacaaaactggaagagcttctcaagccagaattactttgatccccaaggcctcttcatctcggtcatgtggtccggtcccttgctcctgattacgatacttattctggtgaacacccttgtgacgctctgcatgctcatggtaaggtggaaaagggccgagctcaagcaccgtgctcgtgaggcccgtagccaagcaggagtgatgatgctgcctgccgtgctcatgaccgcgctattgtggagcggaggaagaaggagctgtgctgctgacgtgctcttgaactgcggatctgttgtgcggtaggcgattaagctgctgatctaacggagaagtttgattggaacagtaaagtgtaaggttaattagtcctcgattttaattgatggtctcgcttttggtctctgatactgaagcacacggttttacacatgtattagctgctgttcgtcaaatttaagggatatgtttgtgtagggagctctgaatgttatttggatggctgcaggagccaagttcatcgtatatgcattgctttggatgatcttatttggatgactgcaaaaaaaaaaaaaaaaa

SEQ ID NO: 27422 - DNA, 1044 bp, Triticum aestivum
  Clone ID: PAT_TA_27422
tctccctaacgccaggcccacttctaacgctctgcgtcttcccacccttctcttctccatcacgagcgccggcggcggctggtagagaggcgagccgaggggtgctgctacgagcggaagaggcgaggagatcgagcgagcgatggggcggaggatcctcaacgacgcgctgcgcacgatggtgaacgcggagcggcgggggaaggcgacggcgcaactccagcccatctccggcgtcatgatctccttcctcaacatcatgaagcaccgaggttacataaaaaatttcgaggtctttgatccacatagggttggaaaaatcaccgtggaacttcagggaaggattaaagattgcaaagctctcacttacaggcaggacctcagagctacggaaatagaaaaatacagaactaggatgcttccaacacggcagtggggctatgttgtggtgaccaccccaaatggcgttttagatcacgaggaagcaattaggcagaatgtaggtggccaggtcctcggttacttccattgagaaggaaaacacagttatcccatgctgagtcagctctgggttgcattgttatctttctgttatgatgactgaagtcattttatttggacatttagagcttgctgcttttgttcatggccagcaaaaaatgcgattacatctcagaagtatgtctcgcaacactgacataaatattgtaatccttctttgggacaggtatttctgtaggtgtaatacacccatgtacttcgagatacacgagtaaagctctagtttgagcatctacgatcttgccgctgggctgcattgtttatctttctgttatcatgactgaagtcattttatttggacatttagagcttgctgcttttgttcatggccagcaaaaaatgcgattacatctcagaagtatgtctcgcaacactgacataaatattgtaatccttctttgggacaggtatttctgtaggtgtaatacacccatgtacttcgagatacacgattaaagctctagtttgagcaaaaaaaaaaaa

SEQ ID NO: 27423 - DNA, 897 bp, Triticum aestivum
  Clone ID: PAT_TA_27423
tcatggctaactacggatccgactctgatgatgacaatgagccggcgacggttgccggtggtgctccggagccacaggaagcttcggtgctgcttcctcctcctcccctcgaccttctgcagcccccaaatttcgtagattactcaacaattgcacaggggagtcgcatccggagtttcccccatgtggaaggaactatgcgctgcatgtctacacccctgttgtcattcctttcaacgcaagaaaacagctgaccctcgttatgagaagagctgcatcacttgtgccagatctctatgctgtagatgcagattatgcactttcggaattgtgtaaagatgagcaaaaacttgagaaagtgcttctgggcagggagttccatgtaagcttaggaagaactgttggaattcaggtgcatcaaattgactccctcgtcgcaatgcttcgtcagaagtttcaatcacaacagcggtattggatggagttcaacaaatgggagcattttgtcaatgatgattctacacgatcatttctttcgctagaggttacaagaactgggttaccagagataagtaaacaaatacatatggttgatgaagtatatcgattgcacggtctccctgagttttacaagaatcctcggccacacatatcactggcgtgggcattgggtgatgttagctccaaattgaagcaagcaactaaggagattgaaaaatttgagaacagcatcatctcatctaaaaactgtaatctgagatgcaatttcagtcgtatagtgtgtaaagtaggcaagaaggtctacgatatctgtaaaattggagactgaagcagcgttcttgtacacctgacttgcggtattaccgagttttatagagtcaatacctttggttgtac

SEQ ID NO: 27424 - DNA, 516 bp, Triticum aestivum
  Clone ID: PAT_TA_27424
gccggccgggttcggcagataaccccaacgatggcgatcaacaaagtagctctcgtctcagccgtgctgttgctggtgatctcttccgctgctgctgctgcagggagagatgttcctccagtcctccccaaggacaacgttctgcgcgaccacggtatcatgaataccccagaggagaacggcggtcgctccgaatccaagatatacgccatcacgcagccaatattccatcctccctacgtcccaccttgtgcttccaaggccgttcgtgcgagcggggtcaccaaggacgagaagcgttgttaggagggcaagtgctgccgagtaacttgcatctccagcggatccctgtcaagatgtgaacatgtggatcgtcatctggtataaaataaggataaataatgtacccgcgttttgctactggctttgtaaagcaacatctatcaaacagtatgttactactaataaagacctatcgattatgtctccaaaaaaaaaaaaaaaaaggcccctagg

SEQ ID NO: 27425 - DNA, 575 bp, Triticum aestivum
  Clone ID: PAT_TA_27425
cggccgctcgaccggccgggcgggatcgaagtccatcttacatatgaggaaacacactctcgccctcttcctcctgctcctgctcctcacctttgcctcccatggggcatggtgtgcagcagcagcgcgaagcgccatggctgaggatgcggctcatcatcatctgaggcctcatcaccatggcaagaggctcctggagatacagactcccaggaaggtcgggcacgcgacaggaggatctggagggggcagcagcggcggcggcaggagcggtggcggcggcacggacacaaggccacacaacagcaagaatggcggtgccatggcgctgccagctccagcgacctccgtcctggcgctcgttttcaccactaccgttcttctctcggcgctcagcttctgaagccctatactcatctcgattgcgggcgcggtactagtatgtgtgtattcttgcagtttcagaaactgtttgcataatgcttgtgggtgtcggagtgatatgctgtttattacgtactggctatagtatttatcctgtttgtgtgcttaaaaaaaaaaaaaaaaggccccta

SEQ ID NO: 27426 - DNA, 681 bp, Triticum aestivum
  unsure (1)..(681): unsure at all n locations
  Clone ID: PAT_TA_27426
gtccccactctcgccggcccactcctggttcactccttttgctcccttaggaaacacactctcgccctcttcctcctgctcctcacctttgcctcccatggggcatggtgcgcagcagcagcgcgaagcgccatggctgaggatgcagctcgtcatcatctgaggcctcatcaccatggcaagaggctcctggagatacaggctcccaggaaggtcgggcacgcgacaggtggatccggaggcagcagcggcgccggcaggagcggtggcggcggcacggacacaaggccacacaacagcaagaatggcggtgccatggcggcgctgccagctccagcgacctccctcctggcgctggttctcaccgctaccattcttctctcggcgcacagcttctgaagcactccctccgtttttttctacaaggcatttcggacagctgacattgaactgttttgcgcattgtctgaattgtctagacgtcttataaaagcgaacagagggagcactgctcatctcgattgcgggcgcagtactagtatgtgtgtactgttgcagttccagaaactgtttgcataatgcttgtggagtgatatgctgtttactggctatagtatttatttatcgggtcatgaaaaaaannnnnnnnncctaaattgttgaattacttgtgtgttggct

SEQ ID NO: 27427 - DNA, 223 bp, Triticum aestivum
  Clone ID: PAT_TA_27427
cgcgggcggcggcaagacatgcgctgcaagctcgcacctttgcttctctctgttgaaggtttgaataacgtacacatgtagtacggggttacatgtgtctctgctgctgtttcaacggtagtagtggtcgtggtcgtcgttgtcatcgtcagtggttctgccgacgatctttacagtttgatttactagtatatcaagcttaaatggacgaaaatgcttcttc

SEQ ID NO: 27428 - DNA, 711 bp, Triticum aestivum
  Clone ID: PAT_TA_27428
ccgacccctgccgctcactcccccccacccccatgaagcgatcgcctccgagcggcggcatcccagggcttctgaggaacaagatgttgggtctcctgcgtgatgctctgcgtggtgctcctcatggtcacgctgatggcggcggcgggcggcggggcgcgccggctcgtctgctgtggccagggaaacggcaactgccgcacttgcgccctatctgggtgtgcgtctggcggcatgtgttgccgcgcttgcgggccgggcggcgggccggcctcaccagcggcgccccttgcgcttccagctcccgcttttgcctctgattaatggacagttgtagcacgagcatatgttggtctgcggttgcctcaggcggcggcgccgacttcaacgtcgtcccttggtctggggagctttgttatagttttcaattagttacacatgtagaacgaggttacatgtggctgctgctgtttcaacggtagttgtcgtcgtcaccgtagttgtcatcgtcggtggttctggtgacgatttttacagtttactactagtatatgaacgaaaatgcttcttcatctgtctggtctattgcttgccatgtgatgtgagctttcctatgtcgttgcctccccatgtttcgtgatttcgtctggtcatgttttggctagagtgggagtattgtacgcacatgttactttgctctcaaaaaaaaaa

SEQ ID NO: 27429 - DNA, 868 bp, Triticum aestivum
  unsure (1)..(868): unsure at all n locations
  Clone ID: PAT_TA_27429
tgctcttcctgatcgattggtttgtcgatgttgggatcctcgatggtgattagcaactgaatcgtggatggaagtacactttacttcaaaggattgcacacatatgaagcggttgttgatgaagtcatggaaaagggacttgccaatgctacacagtcatgaaatctttgtctgtttcactcttcttccatacatgatatgcaaggttcttgggatgctcggtactgttgccaggaggtacgaaatggtttgatctgtcaggcatggattgctgaagcacaaaatacaagggggtgcatgaggaggcgagagctgacggcaaccattggaggaggtctggtcggtcgaagagtaaggcgtgggcaactccggagagatttggcttgagcaaatgtcgatgctgctgcaatgagaagaccctttctgcatgtaattcaggcaatagctgagctcccagcctcctaagactggcatgggcacatcaataagggcatggagcccatcaaagaggaggtcggagcggcgttggacctggatcaactcatctaaatcaagcggccggcctcggctgggagtcaccgacgctccacctggacggcgtcggctgggacagctccacatgcaatggctggccggggaccagacctcgacaggaacgtgttgccctttgagccggtgcagagcgacaagttcgtagcatcgttatagttttttgcacaaagatagaccctgtagtactgattaggtgaaacagatcgatgtggcactggtactgaactgaagcaacaatttgttcaacaaaatatgatccaaatagaaaatgagtgcgcatattagtttctattcgtcgccggttttgtgccaaana

SEQ ID NO: 27430 - DNA, 688 bp, Triticum aestivum
  unsure (1)..(688): unsure at all n locations
  Clone ID: PAT_TA_27430
gatacctatatttgagaagggatatgagaaggatccagcagttgtagcgaaggaagctattcagnaagccactcggaacaaatcagatgttgttcttgttgatacggctggtcgtatgcaggataatgagccactgatgagagcactctccaagctcatcaatctcaacaagccagatctggttttatttgtgggagaggcattagttgggaatgatgcagtcgatcagctcaacaagttcaatcagaaattggcagatctttccactgttcccacagcgagactgatcgatggtatcctgctcaccaagtttgacactatcgacgacaaggtcggagccgcgctgtccatggtttacatatccggatctccggtcatgttcgtcgggtgcggccagtcctacactgacctgaagaagctgaacgtgaaatccatcgtgaagaccctcctgaagtaaaatggtagtgctagtacatgtcgtgctccgatatgtgccgcattcaaggagtctctgttatatctccgaaaatcccccgtgacatcgtcgttttctcgtttggtttggcgtgaaactgtcgtccctagcaaacttttctggttgctgttaacttgttctgttgtgtggatcgtcgtgcttggttgcctcgtcagaaattaattataaatacaataatatgtgccttgtttc

SEQ ID NO: 27431 - DNA, 934 bp, Triticum aestivum
  unsure (1)..(934): unsure at all n locations
  Clone ID: PAT_TA_27431
ggnaaaattccggcagctgcnacctcgaggccgagcgcgcgccgaggccatgaagaagtcccggcagcagcccgccaacccctcctccggcgctggccgggcgtccggtggccccgccggcaagaagctcggccccaatgctcgcagtcgtggtgggggcggtgctgggaagaagaattctgggtctgggaaggatgattctgatggcgactccgggaaggagcagaacggtggtttcaccgctaacggtggtagcgtcgccaagggtgggcacgagaacggctccactaaggacagctctcgcaccgccgcccgggctgttgttgctgacagtgacggcaaggagaacggggaccccaacgacggggccttcgatgtaaataccttgcgtaagaagacaggaggaaagaagggcggcggcggcaagaagaacgatgtgaagaaggcggccaaggccgagcccaagaaggctgtcaagcagatgagggtctgggacgacaagccgcccaagagcgagaagctggacttcacggacccggccgacgagagaggggaggaggtgattgagaaggtgcttaccgaccagggggacagcatgatggataaggatgaggatctgagcagcgatagtgaggacgaagaggatgagggagaggagaatgctcaagctggccagaagaagaagggctggttctcctccatgttcaagagcattgcaggtaacaatgtacttgagaagtctgatctgcaacctgcactcaaagctcttaaagatagactgatgacaaagaatgtggctgaagaaatagcagaaaagctttgtgaatcagtagcagctagccttgaggggcagaagctagggttccttcacaagaatttcctttttactgttcagacagctactggagggaggcttcttctttccgcattttta

SEQ ID NO: 27432 - DNA, 2237 bp, Triticum aestivum
  Clone ID: PAT_TA_27432
gcacgcggccttcgacgcctccgcaaggaagcaaggaagcgaaaccaccgatcgacttctcaaggctggcgacgatgctgggggggcagctcttcctgtcgggggaaggcctcatcttgtcgtcgtccggccagcccctgtgtcatgatggccgcatgtggggcctcccgatcctggtgctgttgagcacctgcggactcatgctcgcaggcttgagatacctatatttgagaagggatatcagaaggacccagcagttgtggcgaaagaagctatccaggaagccactcgaaaacaaatcaagatgttgttcttgttgatacggccggacgtatgcaggataatgagccactcatgagagcactctccaagctcatcaatctcaacaagccagatctggttttatttgtgggagaggcattagttgggaatgatgcagttgatcagctcaacaagttcaatcagaaattggcagatctttccactgttcccacagccagactcgtattgtatggctatcctgctcaccaagtttgacactatcggacgacaaggtgggaagctgcgctgtccatggtttacatatctggatctccggtcatgttcgtcggatgtggccagtcctacactgacctgaagaagctgaatgtgaaatccattgtgaagaccctcctgaagtaaaatggtagtgctagtacatgtcgtggtccgagcatgtgctgcataccaaagagtctctgttatttctccaaatatccaccgtgacctcgttgtcttcgcgttcgatttgatgaggaactgtagtacctaacgaacattaaagggcggctgttaacttaagatgtagtatgggtagaaggcggctaagtccgagcccaagaaggttgtcaagcagatgagggtctgggatgacaaaccgccgaagaacgagaagctggacttcacggacccggctgacgagagaggggaggaggtgatagagaaggtgcttaccaaccagggggacagcatgatggataaggatgaagatctgagcagcgatagtgaggacgaagaggatgaggaagaggagaatgctggggctggccagaagaagaagggctggttctcctccatgttcaagagcattgcaggtaacaatgtacttgagaagtctgatctgcaacctgcactcaaagctcttaaagatagactgatgacaaagaatgtggctgaagaaatagcagaaaagctttgtgaatcagtagcagctagccttgagggcaagaagctaggatccttcacaagaatttcttctactgttcagacagctatggaggaggctcttcttcgcattttaactccaaggcgatccattgacatattaagggatgtacaagctgccaaggagcgtggcaagccatatgtcgttgtttttgttggagtgaatggagttggaaaatctaccaatcttgcaaaggtcgcttattggcttcttcagcataacctcagtgtcatgatggcagcatgcgataccttcagatctggtgctgttgagcagctgcggactcatgctcgcaggcttcagatacctatatttgagaagggatatgagaaggatccagcagttgtggcgaaagaagctatccaggaagccactcgaaacaaatcagatgttgttcttgttgatacggccggccgtatgcaggataatgagccactcatgagagcactgtccaagcgcatcagactcatcaagtgagaattatttttattagtgggagaagcagttctttggaatgatgcaggagatcagctcaattcgcacaaccagaaattgccagatctttccactgttcccgctgcgaggctgattgatggtatcctgctcaccaagtttgacactatcgacgacaaggtcggagccgcgctgtccatggtttacatatctggatctccggtcatgtttgttggatgcggccagtcctacactcccccctggaagaagatggtagtgctcattctgaagaccctactgaagtaaaatggtagtgctagtacatgtcgagctccgatatgtgccacataccaaaagtctgctatatctccaaatatccccagtgacctcgttgttttctcgtttggtgtgaaactgtcgtccctagcaaacttttcaggttgctgttaacttattctgttatgtggatcgttatgcttggttgcctcatcagccttgtttcttaaaaaaaaaaaaaaaa

SEQ ID NO: 27433 - DNA, 734 bp, Triticum aestivum
  Clone ID: PAT_TA_27433
tcggcagctgccgcgcagcagctgacgcacgggctcgcctttctttccttcccccgacgagcgatcggcgtcggcgagagcgaaatccccgcaccaaagaatacgcgtcgccgtcaagccgtaggtcacagccaccggtctggtcggtctcgccggggcggcgtcggttgggaccggagggaggtacgcgaggggcggacggtggaggagcgatggagcccctggaggcggcgatagcgatcgtgttcaacgcgctgctgctggtgttcatggtgaagctcttcttcgccatgttccagatgaagctcgtcgtcatcctcttctacctcgtcgtcctcctcttcgccctcgccttctccggccggggccccgccggcttctaggttaggtccttcgttttttttccccttgcttcggttggctccggatccatccttggagctgtaacagcggtgctagaccatacctacctcggtgcatgtctggttggttggtttaacaaactggggaaatttagtctacagtatcatggtgactccgggctgcaaattgtgtgaactcggcgaattaagaggtagtacagctttatatgagccctagttgagattatgtggacttagtcggcgctttcttcgattgttctgtacaatcttacttgtggattcgtgatgtagcctctgctaggcgtgctcttcttcttgaaaatcctgaggcagagtgttcttttcaaaaaa

SEQ ID NO: 27434 - DNA, 810 bp, Triticum aestivum
  unsure (1)..(810): unsure at all n locations
  Clone ID: PAT_TA_27434
atgctctcttcgccgcctctgcccgccgccgccctcggtcttcttctccggccgtccgccgccgcccgccggtcttcttctccagccgtccgccgtccgtcctccttcccctccacatctgcccctaatcttcttcggcgccacccacagcctcatcaatctccaacctcttgttcccgtgcttctctgatttggatcgagatgggagtcctggatcgagttagggtctgtgttcttctccaacacaaagccatggagtgaccgacccggatttgacttggctatcataagaaggaagggtcctcgaccggaatctgccccaggcaggacctcaatggcgacctgcaggcccggcctctgtctctttcgactccctctttttgcgacctcaagaagctgcggcggctcatcctcgaggccaagctcgtgcaattccgacgactccaggcccaatttatttcctgctctatcgggtccaagtgatgcgccaaggggatttgcaacagctttcaggattgttcagttgcatgctaagaaaaaaaataggtctgaggggaaccacttctttggcgtgttgctccagtagttcatgatgatgagggctgaaggttttactcgaagtcgtgttatattggagttagcgcctaaaaaaatgacagtgtatctcctgngggaggaggtgggagagatgtagcaggtagaagatggaccgtggataagaaagaggaagggataaagtgtcaatcagcaatgaaaactttagtatttgtgatgtaaatttgaatgctaanagtttgaatttttttcctt

SEQ ID NO: 27435 - DNA, 1657 bp, Triticum aestivum
  unsure (1)..(1657): unsure at all n locations
  Clone ID: PAT_TA_27435
gnnnnnnnnttganncccttttnantcnnctnagctcgaaattaaccctcactaaagggaacaaaagctggagctccaccgcggtggcggccgctctagaactagtggatcccccgggctgcaggagctcggggattccccagtccgccgcccccgccgccgcgatgatgcagtcgcacatgccgtcgccggcgaggctgggggtgaccgcctcgtcgccgtcgctcccgcccaaccagtctcccgcgaaccccacctcctcgccgccgcaggccaacccgccgtccgcgagcgcggccccgtccgcggccggaatcgcggtcccaaccctaaccacctcgccggcgctgctcccgctcctgccgccgctcccgcgcgcgcagtcgctgctccacctcatctcctccctcgcctccaaccttttcgagctctcgcccaaccgcgccgcctggatctcgtcgtaccggggctcgctccccaacttcctaccgtcgtcgtcggcttccgcggcgcctacgccgctgccggccccggtctccaccaccaaggaggccatgtcgatgctcacctccctccagacgcagctcttcgagaccgtcgccgagctgcaggagaccctcgacctgcaggacgcgcgcgccaagctcgctcgcgaggcgcgcgccaaggatgcttcgctgctcgccttcgcgaagaagctgcgcgaggcccaccacgtgctcgaccgcctcgtcgacgactacgccgactaccgccgcgatcccaagcgcccgcgcggcgccgccgctgttgacgagcccgagccggtgtcgcagggcgacttcggcgcatccctgcactccaagctcaagctggatgacatcttgacctatgcacatcgcataagctacacgacctttgcaccgccggagcatggtgctgggctgcctctgaggggtgcattgccgtctgcgccacaggataacgagctgcggatgtcacagctgtatcagtttgctgatttggatgttggggtgcccaagaaacccctggaaacgaaggagggggtcacagcagagatggagtccatgccgctattcgagctaccggaggaagagcctccgcggcccatttatgctaccaatcacagtgccaccaggttggcagaaaggtttgcctgctctgcttcctgttattccaatgccgccacctggatggaagcctggggacccgatcgagctgggtggcatcattcctgctgtcaagcctgaggaacaacgacccagtgtgccgattcctgttggggtgcagccaatggtgccaagggcccaagagccaatacaggtcgcagctgtgaaccttgacattatcagttctagcagcgatgagtacagtagcgacgtcgggagctcagatgaagacgatgaggactaatgcttttgtaagctcgaccatttcataatttgtgtgtttccatatccagtgtagctcatttaagtgtaagctttggctagtattgtgtcatgtgcttgtctgtttaaactgctgcaacacaaaatctattcaaataatagatttgacttaaaaaaaaaatagtttagtacagcattcactagatcactttctgtgataaatacagccagtctaaatgttcaattttcttgacctttgttcaaaa

SEQ ID NO: 27436 - DNA, 728 bp, Triticum aestivum
  unsure (1)..(728): unsure at all n locations
  Clone ID: PAT_TA_27436
acgcttacgctctcgcccacgcgtccgcatcttcttactgggggcaacttgctgctcctcccggatccgaagctcagtcccgtggccacgcagattatctccggaaaatcatagtgcagggtcgatcctccaagtcaaccaaagttgtagatatcatgaccgaagagaacaagctgatcacggtgaaacctgaaaccagagtcctgaaagcaatgcagctgatgacagacaagcgtatcaggcacatcccggagatcagcggcaccgagatgatggggatggtctccatcggcgacgtggtgcgcgcggtggtcagcgagcacaaggaggagctgaaccggctcaacgcctacatccagggtgggtactaggaccccgccgttttgcagggcgtccctttgagtgaactctacaataacgaccagngtgatgatgacgaaatagccgtgtttcttcgcggacaatggctgttgaacttgaatttgcgtgtgtgatgttttcctgcttatttagtgcatatttccgtggccgcgcgccgccgcgtgcttgtttctggagcgtatagaccatccatctcagctgatggtgatagacgcagaataaagcttgggagtgancccggaaaaaaaaaaaaaaaaaaaaaaaaaaaaaaaaaaaaaaaaaaaaaaaaaaaaaaaaggggcggcccgccgcgactagaaactaattagtntctagaaccgcgggcg

SEQ ID NO: 27437 - DNA, 1157 bp, Triticum aestivum
  unsure (1)..(1157): unsure at all n locations
  Clone ID: PAT_TA_27437
cgatctgttgtttttcacgtcattctgctagccggctgctgttcaccttagatttagcagaagaaacgctgaaagggggcggaaagctgtcaccggaaaaacaaaatgcagcgagcaattcaagctatnnnntcacatggcagtgtgctcaaatctgctgtcctgcaacacatcagtgttgtgaagcctgctatgctgcctgctgtgttcccgcgcttcatgtcagtatcacctgctcaaatagaggagagtggatttgagagcagcactgttgcggacattttgaagtccaaagggaagagtgctgatggatcatggctctggtgcaccactgatgacagtgtctatgatgctgtcaaatcgatgacacagcacaatgtgggagctttggtggttgttaaacccggggaagataaatcaattgctggcatcgtcacagagagagattatctccggaaaatcatagtgcagggtcgatcctccaagtcaaccaaagttggagatatcatgaccgaagagaacaagctgatcacggtgaaacctgaaaccagagtcctgaaagcaatgcagctgatgacagacaagcgtatcaggcacatcccggtgatcagcggcaccgagatgatggggatggtctccatcggcgacgtggtgcgcgcggtggtcagcgagcacaaggaggagctgaaccggctcaacgcctacatccagggtgggtactaggaccccgccgttttgcagggcgtccctttgagtgaactctacaataacgaccagggtgatgatgacgaaataggccgtgtttcttcgcggacaatggccgttgaacttgaatttgcgtgtgtgatgttttcctgcttatttagtgtatatttctgtggcggcactcgccgccgcgcgcttgtttctggagcgtataggccatctcagcggatggtgatagacgcagaataaagcttgggagtgtcccggaaaggatacttgagtttcaccgtgctaatgttttcttatccgttgttgtcgacagtcattcgtttttcaaaaaagaatatattaatatcgcgaagataccaattagaccaatgtgtcgctacattagctttgatatgtcatgcaaggttgcatcgaccagatgcaggtcttcctccttttctaaa

SEQ ID NO: 27438 - DNA, 1469 bp, Triticum aestivum
  Clone ID: PAT_TA_27438
ctaatccgccccctcccgagacgccaagccccaaaccccttgccctcccaaaccctaaccctaaaacctccgccctcccgccgccgccgccgcccgattcccctccccatcctccgcatcctccgtccggcttgaacgatgtcgtccgacgaggaggtcagggaggagaaggagctcgacctctcctccaacgaggtcgtcaccaagtacaagaccgccgccgagatcatcaacaaggctctgaagttggtattgtcagagtgcaagccgaaagccaagattgttgacatttgtgagaagggtgacaatttcataacagagcaaactgggaatgtctacaagaacgtgaagaggaagattgaaaggggcattgctttcccgacatgtgtatctgtgaacaacacagtctgtcatttctccccactggcaactgatgattctgtactcaaagaaaatgacatggtgaagattgatatggcttgccatattgatggttttattgctgtggtggctcatacacatgtcatcaaagctgggccggttactggaagagcagctaatgttcttgctgctgcaaacacagcagcagaagttgcaatgaggcttgttagacctggcaagaagaataaggatgtcactgaagcaattcagaaagttgctgctgcttatgattgtaaaattgttgaaggagttcttagccatcagctgaaacaatttgtcatcgatggtaacaaagtggtacttagtgtttcaaatgctgatacaaaggtggatgatgctgaatttgaagaaaatgaagtgtatgcaattgatattgtcaccagcactggcgagggaaagccgaagctactggatgagaagcagaccactatttacaagagagctgtagacaagaactatcacttgaagatgaaggcatcaaggttcatcttcagtgagattagccagaagttcccaatcatgccattcactgctagggcgctggaggagaagcgtgcacgcttaggtttggtagaatgcatgaatcatgagctgttgcagccataccctgttctacatgagaagcaaggcgacctggttgcccacatcaagttcaccgtgttgttgatgccaaatgggtctgacaagataacttcacatccactacagcaactggagccctcaaaatccatcgagggcgatgctgagattaaggcttggcttgctttgggcacaaagtcaaagaagaagggtggtggcaagaaaaagaaaggcaagaaaggagatgcggcagaagtagcagagcccatggaggtttctaaggacgccccaagccaggaataattctcattttttttgaattgcttcctttacgtttgtacctgctctttgctgcatctgattgtgttatattacattcagctgtggggatttgagccccttttttgaagtgtctaatgaaaatggttgatcctggtgcacatcacatc

SEQ ID NO: 27439 - DNA, 1694 bp, Triticum aestivum
  Clone ID: PAT_TA_27439
gccccttccctcttccattcttatccccccccccccggcaccccaaaaccccaagcgtccctcccccatccttcttcctccccgcaactcgctgctcctcccacaaccgaagctcagtcccgtggccacgcagacacaaaatgcagcgagcaattcaagctatcggatcacatggcagtgtgcttcaaatctgctgtcctgcaacacatcagtgttgtgaagcctgctatgctgcccgctgtgttcccacgcttcatgtcagtatcaactgctcaaatagaggagagtggatttgagagcagcactgttgcagacattttgaagatctaaagggaagagtgccgattggatcatggctctggtgcaccactggatgatagtgtctatgatgctgtcaaatcggatgacacaagcacaatgtggggagctttggtgggttgttaaaacctggggaagataaatcaattgcgggcagtcgtcaacagagaggaagattatctcccgacataacttatagtgcatgggtcgatgcctccaagtacaaccaaaaggctggagatatcatgaccgaagaaaacaatgctgatcacggtgaaaccggaaacgagaagtcctgaaagcaatgcagctgttgacagaaaagcgtatcagacacaatcccgcgtgatgagcggcacggagatgatggggtatggtctgcgatcaggcgaacctggtgcgcgccggtggtcagcgagaacaaggatgtagcttgaacctggttcagcgcctacgacccgcgatgggtaccagaaccagccgtattgcagggagtccctataggagtgatctctacaataacgcatcagggcgaggatgacgaaatgcgacgtcttcttatgacagaaaaatgggtatttgaacatgaaaatgggtcgatgatgttttcctggagatttatgtgcatatttcctgggtcagcgcgcggccgtgtgctcgtttcttagtagagtatagaccatcgatgcacccgcgctcagctcatacacgcagggttgaagcaaggagccctcggccttggagaggattccctggataatgaactcgaataactatcagggtgttgatgaggaaatacgccgtgttcatgctgcggacattggccgtacaacttaattttgggcgtgtgatgctttcctgcttacttcatgtatactaccgtggccgcgcgcgcccccaagcacttcgaggattacgggtttctggagggtatagaccttccatctcacataaaggacaataaaggaaggagttaagccagaagaaggacggggaagagaggagatcacggctggccctggcaaagaactatagagatttgtatggacgcaccaagccgagaataatgctcgtttttttcgaattacttgcgttgtgtttttaacttgcctcttggctgcatctaaattgtgttatatttctctcatctgtggggttgttgactgttatttttttacgtctcccaatgctaaatctgattgctttatattaaaatcagctgcggggattaaagtacatttttttgtgtggtgtgtcaccagaatgtttacctgtcagtaatgattataaatctggctccaggttcttatgtatggtagtgctgaatgtttacctgtcagtcatgcttatgaatccggcaataacttagtgaattc

SEQ ID NO: 27440 - DNA, 1002 bp, Triticum aestivum
  unsure (1)..(1002): unsure at all n locations
  Clone ID: PAT_TA_27440
ccaccccgccgcgggcgctggcgcctcaccgcccccgctggccgcgccgcggcgccaccaccgcgcacgccagccgcgccgcccacgccccccccggcgacgccttcggcaaggcactacgcgcactccgcactccctcccacgccgcccccgcactcgagcacgagcacccgccatggcgcgccccgcccacgccgtcgtcctggcgctgcctgaccgtcgtcctcgcgctggccccccgggcggcctcgcagcagccgccggaggagccggcacagccgtcagcggactcccagcgaaatctgccgggcatcacatctcgtgtctcggcggccacgccgctcccagcgcgcggcgggggcgccaaggctttcttcgccggacctcaaaggatctgctgcctagttcgtcccatgtagcatggttctgcgaatcctcatgcaacgcgcgcggcatccccatcttcctgacgcgcgctagggccccccgctctgcctttgggggcactgcggccgccctcacgaactgcagcctgaaactgcccgtcgtagcccatatccacgcccttactgaagcacatacaccaacttcctggcatcaaccccagcaaccatcagcccaagcccagcgaaatcggcagcgaccaggtctcccgtctcggcggcaaccctcctcctagccgcggtgttggcgcctctgctctcctactactacctctgaagatccatggcatggtttgttccatgaattactgtgatgtgtatgggcattgcgccacgatttagtgactactttgtggagagaacttattctgctagctgttcggtttagcttactgttgcctgaactacgaattcttattggcaccaagtagttgtactatattggcatggtgtcttgcgaatacatgaaaaaagccaaaaaaaaaaaaaaaccaaaccatcttacccggcgctccggtctgacccgccaatggctcgtttaaactctgacgggaaaacn

SEQ ID NO: 27441 - DNA, 650 bp, Triticum aestivum
  unsure (1)..(650): unsure at all n locations
  Clone ID: PAT_TA_27441
aacgacccacttcgtcgccttccagttttggtaggaagcctcttttggaagtcgccgaggaggccatggcccgtacgaagcagaccgcccgcaagtccaccggtggcaaggccccccgcaaacagctcgccaccaaggcggcgaggaagtcggcgccgacgaccggcggagtgaagaagccccaccgctacaggcccggtaccgtggcgctccgggagatccgcaagtaccagaagagcacggagctgctgatccgcaagctgccgttccagcgcctggtgagggagatcgcgcaggacttcaagacggacctccgcttccagtcccacgccgtgctggccctccaggaggcggccgaggcgtacctggtggggctgttcgaggacaccaacctgtgcgccatccacgccaagcgcgtcaccatcatgcccaaggacatccagctcgcccgccgcatccgcggggagcgcgcctaggccaggccagcgcgcaaccgccaccgcctgccgttcctcgcgcgctagtactagtagttgatttccttgtccttttagattagattctgtaagctcgtagtgagtgaaaggcaacttttgattcgctgtaaaaaaagaacacgtgattggttaccgtagctgcnnnnnncgtnn

SEQ ID NO: 27442 - DNA, 2123 bp, Triticum aestivum
  Clone ID: PAT_TA_27442
gcggccccccggtcgggcgccggcgagcacagccgtgtcagggacgccaccgacaagcggatggccctgcttgagatcggctccgtcaccgggcagtccgagtactacggcctgcggagcggcaacgatggcgactgaggcgccgacttcgaaaagggcgcctgccgccagcacccgtactggcgtgagtgctcgaagaaatggaatgcctctcccgctgaggcccaagctcacagagagacagccgaatccgtcagctggtgaactagtggacgcactccccagacgtcattcagtctccccatctctttttgttattctgcctgcgcatctctttctgttctcacttcttcggtccggacgagtagatccgcacctaccagaggtgcgcgagcgctcaccctcgaggcctgtgccacgagtccaagccccatgtggcctcttgcggcgacggcgaggggccgagggttcagctctggcgccggtccggcaggtgggcactgggctccgtcccggctcggaggaccaagaggggcggcttgatgcgcgcgacctcggtgcgccgctacggcaggaagcacaaccgcacggtcgcgaagcccatgtcggccgaactcgccatactaagccggggcgccccaccattgagagcccggacggggacagcatagactgcgtgcccagccccagccagcctcccttcgaggaccctttagctcaagcaccacaacgaccacaccatgcccccgttccgccccgtgggccgctccttcggcgccgacgtcaacagccatcgaggctggctggcaggttagcccggaacctctatggggacaacaacacaagactgttcacctactggactagtgacgcgtaccaggcaacagggcgctacaacatgctgtgctcagggttctggcaagaagacacacctgagcaccccgggcccctcgtccgtcgaccctgccatgctcaaggctcgcggtacgacatcagcatactcatatggaaggatccgaaggagggtcactggtggatgcagtttggcaaggagtacgtgctgggttactgaccgcaacgagttcagcctctcccagctttgagcgctggggggttcctttgggcaggacctgaacagcattgaagcagggtggcaggtcagccctcgactgtatggagaaaacaacacctccctcttcacctactggactagcgatgcgtatcaggcaacagggtgctacaacctgctctgctcggggttcatccagacaaacaaccagatagccatgggcgccagcatcttccctatctccaactatggtggctcccaatatgatatcaacattttggtatggaaggaccccccggccggagcgccaactgccagtgacgtgacaaagaacgcaccgaccatgactgacgagtgagtgcgtacctggcgggcagtgcatcgtggtgcaccgtcgtcgggcaggtttgttaggcctacatgatgataggtgtcatgtgaatgggtccgggtgttgcctcccccggtggtggggttcggcttgtcgtgcctcttccagtgcgtccatcttgcggactcatccaacaacctcaatgcgccgcgggggatcggctccttcaccgagcagtccaactgctacgacgtgcagaacggcaacaatggcgactggggcacctacttctactacgggggccccggcaagaaccccaactgtccatagcctccaagaaatgaaatgaactgccactgctgctgcccaagccctaacaacaagacaacacgcacccccttgacgcctatgtattatccagtaaattagttcattcacaccccaagcctttcttcctttttccatatcttttttgtgatttttttcttcttggttttctgttttcaagttttggttcgaggagttgattaacttctaggtaaggtaaggcaagtgtttgacagatcatgtgggtttgttctctgcctcggagagatgttggtctgagtctgttctggggaggcgtgtggtcaagtttctgaagagaaacaggcctgtttggttgggctggattattttatttctcccatgtccccaacctctctgtcaagttgtgcgaaaaaa

SEQ ID NO: 27443 - DNA, 1047 bp, Triticum aestivum
  Clone ID: PAT_TA_27443
ccctatcccgtttgccacctatagctcccgtccgtgcgccgtctcctctcctgttcccctcctccgccgccgcgctgctgctcaagacctgcaagatcggcgccgcctccgtgaacgccaccccgccgaacaagaaaaaggggaagaagagacgcaaccccgtcgccgggccagcggcatgaggagcttcccggtggccggcggccgcaacgtctccctcgccctcttctccgacgtctccaacagccgggagctcctcgatctgatgcagtcggggaagctggagccggaggccgctttcatcaacgcatcgcttgtgccgggcgtgttcccggtcctcgccgcggcgcacaaggcgctgctctccaagtcgagggagtcgctgaccacgaggaccctgcactcggagctcgtctacaactgctctggctcgaagcatataacagagtccctgaagcggtgcggtatcgccgatgacacgcagtatatccctcgcggcgcggtttgatgcttcagatgaagagatgaaagcactggaaaagctcatcagcggaacagagattgatctgtcagaattggagacaagagcagaccaaccaaagattctgaagcaatacaaaataactccacaggaactgtcaatatctacactgccagaggcaatccgtgtgcaggattgctgcccgactggccctctgaggtcttagaacgatggccaggacgttcgacatgcagatacgagtcgaattctttggacgaacgacgcatctgttgctacccctgcccatgctctagatcgcggcaccgccgggggtaatccctgacagtatgaattgcattatggtaacatttagtcctggatgctgtagcaacaactggatatatgtatggtcacaggctcacagcttgagtgtttcgaagaccacttcattaagatttaacgcaagcaaccttcagtgatgttgcgatgttgactcagatctgttgtttttcggtgacattgcggaacacgagtaaaatcagcgaaatacgtgggccgggtccgtg

SEQ ID NO: 27444 - DNA, 806 bp, Triticum aestivum
  Clone ID: PAT_TA_27444
caagtgtgtgttgcaagcagcacgatgtgctgggggagatcattgcctgctcatttggttgttgtgatgggaacccagtattatgatggtcgggagagtgctcatactgattatccaataactgatctgctacagatgatgggtcatgctagcagacctcttcaagataactcagggaagtgtgttatattgtgccatgcacctcggaaggaatactacaagaagttcctttttgaggccttccctgtggagagtcatctccaccatttcttgcatgatcatatgaatgctgaggttgttgtgggtgtcgtagaaaacaaacaagatgcagtggactatctcacatggacattcatgtacaggcggctgaacaagaaccctaactactacaatctgcagggtgtaagtcacaggcatctgtcggatcatctttctgagctaatcgagacagtgttgaatgacctggagtcaagcaagtgcgtggctgtagaggaggatatgtacctgaagccgctcaaccttggtctcattgctgcttactactacatcagctacaccactatcgaacggttcagttcgatgctaactcaaaagactaagatgaaaggtctcttggaaattctagcttcggcatcagaatatgcagagcttccaagtcgcccaggcgaagaggaatacattgagaggctagtccgtcaccagagattctctattgacaagcccaggtatgggtgatccacatgtcaaggccaacgccctgctgcagtcccactttgcaggcacacagtggtaggggaccttgcagc

SEQ ID NO: 27445 - DNA, 2366 bp, Triticum aestivum
  Clone ID: PAT_TA_27445
attcgattagcgtgtcgcggccgagtacgcccaacctgggtctcatcgctgcgtactactacagcagcgacactaccattatacggttcgcttcaatgctgtctcagaactccatgtccaaagatctatctgctatagttgctgggtcatgctagtatgccgcttcaggaatactcccagccgtatgggaagtaattcccaggttattggggtggcagcggccttgggttcctatttgaagccttgcctgtggagaggcatctccaccctttcttgtatgatcatacgaatgccggggctgttgggggtgttgtagaaaaccaaccaggcgcaggggactgtcttacatggacattcatgtacaggcggctgaacaagaaccccaactactacaatctgcagggtgtaagtcacaggcatctgtcggatcatctttctgagctaatcgagacagtgttgaatgacctggagtcaagcaagtgcgtggctgtagaggaggatatgtacctgaagccgctcaaccttggtctcattgctgacttactactacatcatgctagcaccactatctgaaacggttcagttccgactgcataactcaaaaacggaccaacgatgcaaaggccctccctgcaaaattctaccctccgtcgatctggcatatggcatccgtgatggcgacgacgtcagggccggtgacgacgtgactttgctggtgactctggagcgtgacatgaccaacctgccgaactctgaggtcgggccggtgcacgcccccaggttccccaagaccaaggaggaagggtggtggctggtggtccggcgacagctccacgaagcagctgctggcgatctaagagggtcaccctccagaaaagggcccgtgtgaagctcgagttcaccgctgctgtggagccagggagcaaggactacatgatctacctgaagtcggactcagatcttcgctgcggtcacgcaaaccagttcagagtcggtatctaggctgctgcaggcgactcatttcacccggctagaacccctttataatcccgagtttagccgaaatggtaagcccatcgagtagcatctttctatcttggctcgagatgagcaatcgatgagatgcggggaccttgctggcaggctgtcaaatctctgagctgcaggacgtggtccagttcttcaagcggttccccaacgtcgacatgacctatgaagtccgtgagggcgacgacataagggccggtgacaatgtgaccttgcaggtgactctggagcgtgacatgaccaacctgcccaactctgaggtgggcccggttcacgcacccaggttccccaagaccaaggaggaagggtggtggctggtggtcggcgacagctccaccaagcagctgctggcgatcaagagggtcaccctccagaagagggcccgtgtgaagctcgagttcaccgctgccacagagccagggagcaaggactacatgatctacctgatgtcggactcgtacctcggccgcgaccacgctgacaaatggtgacgcaaggcatgtgggatcgtgactctgtgctgctccaactcccacacttcacgagggacctggcccggagatgccaggaaaatgaagcgaagcccatcgagagcatcttcgatctggctgagatgagcatcgatgagatgcgggacctgttgcagctgtcaaactctgagctgcaggatgtcgtcgtgttcttcaagcggttccccaacgtcgacatgacttacgaggtccgcgagggcgacgacataagggccggtgacaacgtgaccttgcaggtgactctggagcgcgacatgaccaacctgcccaactccgaggtcggcccggttcacgcccccaggttccccaagaccaaggaggaagggtggtggctggtggtcggcgacagctccaccaagcagctgctggctatcaagagggtcaccctccagaagagggcccgtgtgaagctcgagttcaccgccgccgcggagccagggacgaaggactacatgatctacctgatgtcggactcgtacctcggctgcgaccaggagtacgagttcaccatcgacatcaaggaagctggaggcgactaatttcaaacacccaaaactcttttttatactgggtttttgctcttatgtagacaatattatgtgacctggaacttatcatctttttgtctgtaatgtaacacctgaagtttagctttgattcagtgtaacatgatgcacacgtacgttattgtgtttttgtatggcgacgaggaggatctacactggttgctgacgttgcacttatccccgtcgcgcgcggcccggccccctgatcccccccgaaaaaaaa

SEQ ID NO: 27446 - DNA, 1101 bp, Triticum aestivum
  Clone ID: PAT_TA_27446
gcttcttacacaaacagaggagaggagaggggagaaaggcttgatcttgaccggccggcgtccatggcggcggcggcggcggcggggcagcagcagagggtggtggtgatgcggcacggggaccggctggaccacgcggagcccatgtggccggccaacaagccgcggccgtgggacccgccgctgaccgacgcgggcgtcctccgcgcctggaccgtcggcaagcgcatccgggcgcaggccgccgccgacggctacgcgctcccccgcgtcctcgtctcccccttccgccgctgcctccagaccgccgcgcaggccgtcgccgcgctctgcgccgtccccgacgacgccgcgctcgccgccgtcctcgaccccagcgccaatgtgcccctcgacgcctcccgcgtcaaggtgtcggtcgagtatggactgtctgagatgatgaatgttgaagcgatgggtgctatcgtcagccaggtgacgcccagtgtcgagaagtggttccctgacctggcagaactagaagccatcttgccacctggaaccatcgaccattctacaaagccgctcttcctggaggtacccaagtggggagagtctgtgaggggggccagaatcagatacgctagcgtgatcaaggctctggccgacaaataccccgacgagaacctactcttagtaacacacggtgagggtgtgggttcctcggtggcgtgcttcggggccacgggcatggaggtctacgaggtggagtactgcgcatacaccgtgctcgagaagcagcctggcggtgagggcggcggtgatgagagcgtgctcaaggtggtggcggatcggagcggcccgaccacgggcatacactacctggtcacctgatgaacacaatcaagcagcatgatgccatcgccatcatcataccgctcctcgagcactggacggtcacggggagcttgattagtttagttctgcaacaatccgcatttgtttccacgagatttggtgcttggtgtgtcatctttagaaaaccatggctggctcgacccggaatttgtttgtactgccaatcatggtaataattagctacactgttttttataagac

SEQ ID NO: 27447 - DNA, 675 bp, Triticum aestivum
  Clone ID: PAT_TA_27447
cggccgctcaggccgcatgcgtccgcaactcccaccaaaccaatccgaccaaccccaagaaacaccgccggccgcagccaccaagaaccatccatggcgaccctgttctgcgcggccgcagccacctcgtgccgtctcaccttcccgcttgccgcgccggcgccggcgccaggccttggccgcggtcggtcccgacggggcatggtggcggtgcgtgcggaggcagacactgccgctgctgggagcgggataaatccggccatccggaaggaggaggccaaggtggtcgacaccgtcctggccggcgagctctccaagccgctcaccccgtactgccggtgctggagatcgggaacatttccactgtgtgacggaagccatgtgaagcacaacaaagcaacgggtgataatgtgggccccctgcttgttaagaagtagaatgagttatttttcctcaatttgtgttgagtggaataatgtgtatatcgtagttggtataacgtttttctcgattgtaatgaagttccatgctgcaacaaccctgttgatcaaaagagcagaattaagagagaaattgccgtgctacaaagcaaaataagcaaaataagtatcaattctgctataataatatatcaaaaaaaaaaaaaaaaaaaaaaaaaaaaaaacaaaaaaaaa

SEQ ID NO: 27448 - DNA, 547 bp, Triticum aestivum
  Clone ID: PAT_TA_27448
gccggccggttcgcggtactgtacgcccgaatcagaaagacacgcatctcctcacagtaaacagcgatcggccggccgtgcgcaccggaggagagatcagactcggggtgacatggcgacggccaccgttcgcctctccgccggccgcctgctggcgctggccgtggtgctgtgcgcgctcacggcgggcgagtccgccaaggcgaggtacatctcgttcgacgctctcagggccggccagccccttgtacacggggtcggtgtcccggcgccggccccggccccggcccctgtaagcgccggaggggtcaaggccccggcagccgtctcatccatggcgccaacctcgacggcggccgcggcagcggcccggccgatggaaggtggcgccgtcgtcgtcctccgtcacctgctccacgcttagatacatgccctgcatgctcttcacttgatccttgcattgtgtacttctactacttcgctgtacgtacgaacgtactcgtaataagtaaataaaattccacagtggcatgtccatgtttgtacg

SEQ ID NO: 27449 - DNA, 665 bp, Triticum aestivum
  Clone ID: PAT_TA_27449
cggccgctcaggcggcgggcgggacctgaatcgtacgcacgcacctcgtcgcgactgaacagcgcatacgatcccagcccggtctgacgtactcaccggaggagagatcagactcagagtgacatggcgacggccaccgttcgcctctccaccggccggctgctggcgctggccgtggtgctgtgcgcggtcatggcgggcgagtccgccaaggcgaggtacatctcgttcgacgctctgagggccggccatcccctcgtacatggtggcggtgccccggcgccggcccctgtaagcgccggagggaacaaggccccggccgccctcgaggttgccgccatgggtgagactgctgccgcggcagcggcccggctgatggaaggtggcgccatcgtcctccgtcaccagctccacgcttagctgcatgccctgctcctcacttgttcttgatgctgctactactacttcgctgtacgtacgtactcctataagtaaataaaagtccaccctggttgtggcgtgtcaatgtgtgttaccaatgcaagtgagagggaaaggttcacgatcgaccgcattgcggatccaagcttgttaattatgaatgatgtaggtgtaatcctcatgtctacatacgtgaccgttatacaacctcttcagccttgaaa

SEQ ID NO: 27450 - DNA, 805 bp, Triticum aestivum
  unsure (1)..(805): unsure at all n locations
  Clone ID: PAT_TA_27450
gctcaggcgaactcgaccagaaaagaagaagcgagaagaaagcagaatgccaacgagcggcagaatcaccaatggcgggcgggggcgtgtccgggggcgcggcagcgctggaggtggcaagaccgctggaggtgccgaggcggaagggctacccgggcctgttgtggaagagcagcaagatcaccaccacccgcaggaaaaacggcaagagacgcctaaaacccgtcagaaagaccgcagcagatgcaaaagcttcttctcaagcaaaaacgtcgtcaacatcaagcacgcctgaggagtctcatagtcagcagtagatagatatgtcaactcatggaaagaggtgaagaaactgttatgaacgtttcgatgatgggcagttagcacttgcataattatgcgtggaggcctaaaacagcattccttcctgtaatatttttaacgtttgtggtgttatgaagtttgaacaagtgcatgcaggtacacatagactttcttcatcaagaggatattccctgccgccatgggcatctctgccccacctgcttacataagcttgtagcatctcttcccacttcatgaaagttcactatctctcttttttttgtttatgacattagtacattgcttatctgaaactaattaggcgccatttgtgatgagattttttcttgaaattttgaagatatccgtgaaaaaaaaaaaaaaaatgttacctaagggggccggtaccaantcncctanatgatctaatangcgcgccacggcgtngttaaantctacnggaaacctgcgtaccaantat

SEQ ID NO: 27451 - DNA, 1510 bp, Triticum aestivum
  Clone ID: PAT_TA_27451
tcgagggccggctaaccgccgcgactacccacactcccccgcaggcgagggcgagagaaggggggaaagtgcgcgcgcccctcgccgccgccgcagcagcattccgaccggatcggaccagggccctccccctccgcccgcgacgcgtcgccggagatggcgtccccgaagcggctcccgtactcctccgcgggcgctggcggcggagcgaggcgcggctccggcgcgctgccgccggtcgtggtcctcgtcttcctcttcgtcctcgcgccgtcgatcttcttcgtcgtgcgcagcggcggccacgtccacgtcgcgtccgatcccaggggtgctgatggcaaccaggaaacagattggcaagagcaactggcaacaaacaatctgaaatctgttttgtctaaggaggtaatcgatgctatagctgctagtcaacaagaaacaggcactctgaatcttgacttctttagggatcatccctctccttcttggaaaactgatgatctagttgatcacaagatgaatactaatttggttgttgacgacaaggcaaaagctcaaaacagttctgcagaacatgtacctctaatatataaagcacccaaggatggttcagtgatggacatcaagttgatacagcagcaaaaatagctcgaaggaaactacgggagataaggcgggaaaagagggcaatggatttggtatggaaagatgatgaagcgcttgttaagctggagaatgcggctattgagcgatcgaaggttgtagattctgctgtccttgggaaatacagcatatggagaaaagagaatgagaatgagaactcagattcaacagtcaggttgatgagggaccaaattattatggctcgtgtttactctgtgcttgcaaaatcaaagaacaagcatggtctttatcaagaactgcagagccgaatcaaggaaagccatcgggccgtaggagaggctactgcagatgctgaccttcatcgcagtgcacctgatagaatgagagcgatgggtcaagttttaaccaaggccagagaagaattgtatgattgcaaggtgataagtcagagactaagggcaatgcttcagtcagcagatgaacaggtcaggagcttgaagaagcagagcacatttctcagccagttggctgcaaagacgattccaaacagcattcactgcttgtctatgcgcttaacaatagattactatctccttcctgtggagaaacggaagttcccgaggagtgaaaacttggaaaatccagagctctaccactatgcacttttctcggacaatgtcttggctgcctctgttgttgtaaactcaaccatcatgaatgccaaggagcctgagaaacatgttttccatcttgtgactgataagttgaactttggagccatgaacatgtggtttttgctgaacccacctggcaaggccactatccatgttgagaatgtggatgagtttaagtggttgaactcatcgtactgtcctgttttacg

SEQ ID NO: 27452 - DNA, 678 bp, Triticum aestivum
  unsure (1)..(678): unsure at all n locations
  Clone ID: PAT_TA_27452
gtcgcccgcgcccgcctcggcggcgggctcctccccgccggcgccccccgcctcctcgggggcgtcggccccgtgcgcgccttcccccccgccgtcgtcggcatccccctgctctacaacctcgacatggttaacgtcgccgccgacagaggaacgaaggaacacagcagcggctgcgtcaacggcaaggcgaacggcaaccgctgcatgctggtccgatccagccatcatcggcccgagcgagcgcagcgccggccgctccgactgccgggtacacgggaacggcttcatgcaagtctgatcgattcgaagcaggttgagttcagttcagctagaggaagacgaaggcgtttcgatcagtccgatctcctgctccttttacatgatgattactattatcttaatcttagtgcatgtgtatgtaatatgcaccatgaattggtagtgcagtgcagtgcagcacagcacatctctgaacctgggaaggtactactagctttcttttcactcagacaagtcgggagggggtttcttgtcagttagtcggtttctggcttgtcagtagctgtggtgcgtgtcgtgtggatcgagttagttgtactaccagaaattcggaatgacatggaacccatgcatagcatagcaaatgacaaaaaaaanaaaaaaaaagccggcggc

SEQ ID NO: 27453 - DNA, 678 bp, Triticum aestivum
  Clone ID: PAT_TA_27453
gccggccggaatcccatcaccacacgatccaagtttaagctgcacgtacgtacaccatggaaggtaagagtggtctccgggctgtgatcctcctcctgggcgcggtcctcgtcatagggagcttggtgccgctggcccaggcagatccgacggccgccgccacaggagctgcggacgccaagttctgctgcaaggacaagatagggagccactgctacgccgcctgcatcacgcagtacggccccatcccgttctgcgcagaaatgtgctgctgtgtgcagcttaccagcggtagatgcccgaggcaatgccctaccccggccgaccccagactttttcttgcgaacagctccacctccgaccttctcaccagcaacgccgttgaggttgagagctgcacgctgaggtgctcgtccatcgtctgtgacagcatgcgcaatgttatcgatggcggcagcgaggggacgaaagccgtcgtggagcgctgcggcgatgcatgcggccgcttctgtgccggcgccggcggcgctgcatcccttgatgcttaatggagtacgccctcatgcgtgcgtccggatgcgctagcagctgcgactacactgagcggcccagagcagatgcatctctgtgtttgctctttgttgttttttttcagtacagataattggattccaccat

SEQ ID NO: 27454 - DNA, 926 bp, Triticum aestivum
  Clone ID: PAT_TA_27454
gccggccgggacctacatccaccatcacccacatatcgatccgtacgccatggaagcaggcaagggtagtctccgggctgtgatcctcctcctgggcgcggtcctcgtcgtagggagcttggtgccgctggccgaggcagatccgacggccgccgccaccggagctgcggacgccaagttctgctgcaaggacaagatagggagccactgctacgccgcctgcaccacgcagtacggccccaccccgttctgcgcggagatgtgctgctgtgtgcagcttacgagcggcagatgcccgaggcaatgccccaccccggccgaccccagactttttcttgcgaacagctccaccttcgaccttctcacaaccaacgccgttgaggttgagagctgcacgctgaggtgctcctccatcgtctgtgacagcatgcgcaacgcaccgttatcgatgtcggcagcgtggggacgaaagccgtcgtggagcgctgcggcgatgcatgcggccgcttctgtgccggggccggcggcgttgcatcccttgatgcttaatactactactatgcatgcatatcatgcacgtacgcgctcatgcgtgtgtccggatgcatgtgctagctgcgactacactgagcggcccagagacgatgcatctctgtgtttgctctttgttgtttttcatcagtacagataattggattccaccgtatgatggcatggcacgtacccaagccagtgtgacgacgtcgccttggatgtggcgcacgttcttctttctttgttccagtataagttcatcatgtggcgtgatgtgttcatgcgcatgtacgtgtcgaacgagctagcatgatgtatcatcctagcttgccaatggaataaaagtttgcccgatatatcaactttcttcaaaaaaaaaaaaaaaaggccct

SEQ ID NO: 27455 - DNA, 810 bp, Triticum aestivum
  unsure (1)..(810): unsure at all n locations
  Clone ID: PAT_TA_27455
gggccgggaaatacanaaanaaaaaaaaaaaaaaaaaaaaaaaaaaaaaaaaaaaaaaaaaaaaaaaaaaaaaaaaaaaaaaaaaaaaaaaaattccccgacacacgcacgcacgcacgcacgcctcgcgggctcgaaaattttcatcgccggaaaacctcgacgtacgtacgtacgggggggggtacccgcaacatggccgccgccgggcaccggacgccgttgccgttgccgctgctcttcctcctcctcctcgccgccgtcgcgttgttcgcggggggggccgcgggggacgacgccaagccgaccatcctgaccccgggggccaagacccccggggggtccttcgagggcgacaagccgggggacgaccccatggacgacaaggacgccgcgcccgtcggttcccccctcggcaccaccatgaccgagcccaaaccggagcagtccacgcccggcgccgccgggggcgacgcgccagcgcccagggccgcctcctccctcggggcccgcctcgggggggccgtcgccgtggtcgcagcggccgccggcgtcctcgccttctaattaagctccgtccagggagatcaactacgtactccggtgcggccagctccatgcacgcggggtcgccggcaatggcggatccaggccttcacccacgctcatcgctcttccattcatcctctctctttctctctctctctctccgtatatatgtatctaaccacgtacgtacgctggcatgcacgacactatgaaactgcgagagcacacgagttaattaaagaccgtggtgcgtgcaacata

SEQ ID NO: 27456 - DNA, 564 bp, Triticum aestivum
  Clone ID: PAT_TA_27456
ttgagtgactacaacagccaaaaggagtctactctccacttggttctccgtcttcgtggtggtatgcagatttttgtcaagactttgactggtaaaaccatcactttggaagttgagtcttctgatagtattgagaatgtcaagcaaaagattcaagacaaggagggtatccctcctgatcaacagcgtttgatctttgctggtaaacaattggaagacggtcgcactttgagtgactacaacatccaaaaggagtctactctccacttggttctccgtcttcgtggtggtatgcaaattttcgtcaagactctcactggtaagaccatcactttggaagtcgagtcttctgatagcattgagaatgtcaagcaaaagattcaagataaggagggcattcctcctgatcagcaacgtctcattttcgctggtaaacaattggaagacggtcgtactttgagtgactacaatattcaaaaggaatccacccttcacttggttctccgtcttcgtggtggtttttaatttttaaataaataaaaaaacaaccatgtttttgtgtgc

SEQ ID NO: 27457 - DNA, 784 bp, Triticum aestivum
  Clone ID: PAT_TA_27457
ctttgttaaaacacttactggcaagaccatcactttggaggtcgaatcctctgatagcatcgaaaacgtcaagcaaaaaatccaagacaaggaaggtatccctcctgatcaacagcgtttgatctttgctggtaagcagcttgaagatggccgcaccctttcagactacaacatccaaaaggaatctactctccacttggttctccgtcttcgtggtggtatgcaaattttcgtcaagactctcactggtaagaccattactttggaggtcgagtcttctgatagcattgagaatgtcaagcaaaagattcaagataaggagggcattcctcctgatcaacagcgtttgatctttgctggtaaacaattggaagacggtcgcactttgagtgattacaacatccaaaaggagtctactctccacttggttctccgtcttcgtggtggtatgcagatttttgtcaaaacctttactggtaaaaccatcactttagaagttgagtcttctgatagtattgaaaatgtaaagcaaaagattcaagacaaggaagggattcctccagaccaacaacgtttgatctttgctggtaagcagctcgaagatggtcgtactttgagtgattacaacattcaaaaagaatccactcttcacttggtccttcgtcttcgtggcggtttttaaataacaaagacactcgtttttcatgttttaaataaaaccagtcatttgtatctgtaaagcaatctgtgtattgtcatacatatgattgtatgatatctctat

SEQ ID NO: 27458 - DNA, 256 bp, Triticum aestivum
  Clone ID: PAT_TA_27458
aatggtcttatttttgccccgagcgcaatgtccgcacatgggttaacactttcccaatggaagacatcattgatttgatccattgggaaagtgttaacccatggatcaaatcaatgatgtcttccaatttgtccgcgatgctaagcctcgttacagagctgtcgtcatgaactaatcctttcattatgcatcttcatatccctgtacaaaaaaaaaatctaaaaaataataaaatgcttattttgtctcaatatcc

SEQ ID NO: 27459 - DNA, 565 bp, Triticum aestivum
  Clone ID: PAT_TA_27459
cggtcactttggtgttcaatgggctaaagctatgggtgctgaagtcattgcttttgatgtgatccctgataaggtggaagatgccagaaagttgggatgtgatggttatgtattgatgcaaaaagaagaagaaattgaacctcactacaactcattcactcacatcttggctaccaagatcgttaacaagtgctggcctacttatttgaacatgctcaagaagaacggtatcttcatcttgtgtgatattcctgaagttcctttgtcaggattgagtgctttcacaatggctggtaaacaattgactattgctagttccttcattggatctccctctgatattcaagaatgtcttgactttgcctccgaacacaatgttcgtacatgggtcaatactttccctatggaaaaaattaatgaagccatccaatttgttcgtgaagcaaagccccgttacagagctgtcgtcatgaactaatcattttaattacgcattttcattttttactaatttgttatattttgataacgtcaataaatcttctaatttcttttgttctcaacc

SEQ ID NO: 27460 - DNA, 603 bp, Triticum aestivum
  unsure (1)..(603): unsure at all n locations
  Clone ID: PAT_TA_27460
tccgntacaaaaaaacattaaatatgtctggagaaacttatagtcctggggtctgtcctggaagaagtaagttttgtatcttgtattctttcaattgtgatttaacattgaattataggtcaacctcttcaaaagtctgaagtcgaattctgtaattgggatgaaaacatggttcaaatggatatcatttgctgtggtgtgtgcggtactgatctccacactgttgatgaaggttggggacctactgaattcccttgtgttgttggccatgaaatcattggtaaagtaacaaaggtcggaaataacgtgaagaagatcaaggttggcgatcgttgtggtgttggctgccaatctgcctcttgccaccaatgtgactattgtaagaagggtatggaaaatctctgtgctgttcatgctgtatggtccttcaatgatagatatgaaaatcctaccaaagacaagacctatggtggttttgccgagaagtggagaggtccccaagactttgtggtcaagattcccgataacttctcttctgaagttgctgcctctttcctttgtggtggtgtcaccactttcacccctctgaagcgttacaatgtc

SEQ ID NO: 27461 - DNA, 1197 bp, Triticum aestivum
  Clone ID: PAT_TA_27461
ccccgcgtccgcccacgcgtccgcccacgcgtccgcccacgcgtccgaaataaataacaaaaatgtctgaagaaactttctctgcttacgtctgtcatgccaagagccaacctcttgaaaaatccgaagtcaacttctgtacttgggacgaaaacatggttcaaatggatatcatctgttgtggtgtctgtggtactgatcttcacaccattgatgaaggttggggacctactgaattcccttgtgttgtcggtcacgaaatcattggtaaggtaacaaaggttggcagtaatgtaaagaagatcaaggtcggtgatcgttgtggtgttggatgtcaatccgcctcttgtcacgaatgtgattactgtaagaagggtatggaaaacttgtgttccgttcacgctgtctggtccttcaacgatagatatgaaaatgctaccaaagataagacctacggtggttttgccgaaaaatggagaggtcctcaagactttgtagtcaagatccctgataacttttcttctgaggttgctgcttccttcctctgtggtggtgtcaccacattcactcctttgaaacgttataatgtcagcaagggtgacaaggtcgctgtccttggtcttggtggtctcggtcactttggtgttcaatgggctaaagctatgggtgctgaagtcattgcttttgatgtgattcctgacaaggtggaagatgccaagaaattgggctgtgatggttacgtgctgatgcaaaaagaagaacagatcgaacctcactacaacacattcactcacatcttggctaccaagattgtcaacaagtgctggcctacttatttcaacatgctcaagaagaacggtatcttcatcttgtgtgatattcccgaagttcctttggaaggcttgaatgctttcacaatggctggtaagcaattgaccattgctagttccttcattggttctccatctgatattcaagaatgtcttgattttgcctccgagcacaatgtccgcacatgggttaacactttcccaatggatcaaatcaatgatgtcttccaatttgtccgcgatgctaagcctcgttacagagctgtcgtcatgaactaatcctttcattatgcatcttcatatccctgtacaaaaaaaaaatctaaaaaataataaaatgcttattttgtctcaatatccaatatcg

SEQ ID NO: 27462 - DNA, 479 bp, Triticum aestivum
  unsure (1)..(479): unsure at all n locations
  Clone ID: PAT_TA_27462
cccacgcgtccgtggctcttcgcattgttcctgattataccctgaaaccgttaagagcacattaaatacaactcatagtgaatacggtggccacgatacttttcgttatggtactcgttccatcaagaatgaagttttgcccaagcaccctcttgaaagcagattgaatcaatgggaagaaacacaatgggaattaaagctaaatttagcacgtcaagcatatggaatgcacgcaccagttaagcttatgatggaaagaagcatcgttgaaaagcgccagcgtacacctattatgcctacctcaaatttacacctggatattttgatgggtagagatgaaacaattgactatgaagattttctcaacgaccctagcttatcgactgattctatggatttgcatacaagtatggaacataagctcaagttataagtgaataaatattattctttgtttattattgcttatccccnnnnna

SEQ ID NO: 27463 - DNA, 683 bp, Triticum aestivum
  Clone ID: PAT_TA_27463
tctcagaattttgagttctttgatttttgattctgatcttggaaaaaaggaatcagccaaatatgaagatctttgtctttgcctttatcatggccctcatgattgccttgattggagctgattcatctgatgaggaatatggtcggcatagaaaacatcatcatagaggacgctctgaaaatttttattatcagcaatatccaaaatttcagagatattatgatgataaataaccttataatgctacacaggaatccacaacaggattacagaggcttcatggaaagtcctacttgctctcttactcatgatgattcttcctattcaaaaatcctttaaacatctagtaacattaaccccaatacaatacatacacccaaagtacttataaaatcatgttttaaagtataattcaaaaaagtacagttttatttttattatgttatatattatattggaatttaaaagtgatttgacttatcaataatttctagcttttcagaaacaaaaaagaaatccaatcaaatagtgttatagcagcaacacacactgagattaatgataaatatttaaaaaatagtagtaatggtagtctctgaactgtttgatttttcccctattttgttctctgtattcatagcactataaaaaatactcacatataataaattgattcatcaagc

SEQ ID NO: 27464 - DNA, 926 bp, Triticum aestivum
  Clone ID: PAT_TA_27464
ccgttctcacatctcagcgtcattcatttcaagccgccgcagcgtcattcatttcaatcaccgtgtgtgttgaaagaactgaacatggccatgagaggcaacaatgtcaagaccttggcgttgatgctcgtagttgtgggtcttgtggcactccagcaaacccagcaagtacaagcatcccactgttgttgccatctagactccgtccctacctactttaagtgccgcgagaaatctgatagcaccgtctcagagtgctgcggttcttctgatggctatatatcagacgccgctggatttgaatgcaagcccggttttatagatatagagacagcactgcaagccgtcaactactgcaagctggggtgcaaagcttccttgtgcaacaaagtaactccatctgggaaagatgccatggaacgctgcactagtggatgccacgatctgtgcaccaagaacaatgccgaaattgcgcaagtcgtcacagcttaactagttatgccaacgagctgcatctgacaagcccgccaaggagtgtttgtgttgccttcaataattggtgccaaatccaataaggatcatgagctgtatgatatgcatcttcctgcaaggatgtatagtgctcgatcgtcatttcttgttaaatgttttatgttgtatccttggcaaatggcatgatgacgccatgcttttagtgaaatcttgtttagtttgcaaattaaaaagaaaatttgttctaacgaaaaaaaatactaaacactcccccggcccccagggctaaacaattttgtagttggcaaggggtcttttgaggttaatcaaagcatgggcagtcaattagtgtttcaaaaaaaaaaaaaaaaaacgagaagccccagacgagttctcgcctgcccgggcggccgctcgaaatcactagtgaattc

SEQ ID NO: 27465 - DNA, 638 bp, Triticum aestivum
  Clone ID: PAT_TA_27465
gtaagaagtccttttgaagttattattcttggtgatagtggtgttggaaaaacttcgttaatgaaccaatatgttaataaaaaattctctaatcagtacaaggctactattggagcagactttttaacaaaagaagtaatggtaggtgatcgtttagtgacaatgcagatttgggatacagcaggtcaagagcgtttccaatccttgggtgttgcattctatagaggcgctgattgttgtgtgcttgcatatgatgtgaataacagtaaaagctttgaagcattagatcagtggcgtgatgaattcttagttcaagcttctcctagagatcctgagcgcttcccttttgtacttcttggtaataagattgacgttgaagaaggtaaaaggatggtttcacaaaagcgtgctatggcttggtgtcaatctaaaggcaatgtcccctactttgaaacttctgcaaaggaagctattaatgtagaacaagcttttcaaacaatcgcaaagaatgcgttatctcaagagacagatgttgacattgattttcctgataccatccaaataccaaacggaagacaagagtatgatcaaggatgtgcttgctaaatattaataaagccttgtgttattaatacagt

SEQ ID NO: 27466 - DNA, 894 bp, Triticum aestivum
  Clone ID: PAT_TA_27466
gcagcccgcgatcccgagcagggacgcccaacacccacctccttcgacgtgcgccgtcttctccggccgccgccggggatttgcagccaccggacggtgaggttctctcacccgcgactggccttgggcgccttcatgcccgctcctcttcagctctgtggatctgcatcgcgcgccgacgccgatggccctggagccgccgcgattctggtcggcgccacaaggtggaggtgcattcctggtggtggccgagcgccgcaccgccgcctgccccgccgcggcggacgacgaggccacctcctctcgtcgaggtcttcacgcgacggtaaccgtcatgcctccaccgcgctctgggtcagcatccttctgcaagctcctcgccgacctgctcgagatgccgccgtgggaagagagctgagcgccgcctgctctcctacgctgacgcggctggcgtcggggctgcctatctgtgcgtgatcctcgcgcgctgcagcgagcaccaggccgccgcgctcccggtgaatgcagctacctatggaccgaaggtaaattgccatcgtttcccctctgccaccacccgccatgccccacagcgttggaggaggtcgagggagttcgagctcgaccatcacggcacacatgcacatggcccctgctggcattgacaccctcccctgcagaaacaaagcatacaagagaattactctttcagcaagtgaagagctacttttatttgtgatgatgcaaaaaggagtccacatccctactatcttgtagcctacagcagcacaacttgactcactgatgaagataataccagtgtttttggagttatttctcactgcactaatgaatttgagcactatcttgtattgtatcatttatctagtcact

SEQ ID NO: 27467 - DNA, 1489 bp, Triticum aestivum
  Clone ID: PAT_TA_27467
ggtcaggcttaggcgtcccaggcggcgttacagtacgtccattcggcgccttaatctcgtgacgacacagacaccaacctcctgtcctgcaccaaacgctcgcaacaagagaaagaaagatcgttcgttcgtttccaacgagattgatcggcctgtctagtctagccatcaatgtcgtcgctccacaggtgcctgccgtggctgatcctcctcctggtgctccgcgacggcggcggggggacggcggtggcggctgccgggaaggtgccggcgatcatcgtgttcggcgactcctcggtggacacgggcaacaacaacttcatcccgaccatcgcgcggagcaacttctggccctacgggctcgacttcgcggacggccaccccacgggccgcttctccaacggccgcctcgccaccgacttcatctcggaggccttcggcctgccggcctccatcccggcctacctcgacaccacgctcaccatcgacgacctcgccgcgggcgtctccttcgcgtccgcctccaccggcctcgacaacgccaccgccggcatcctgtccgtgatcaccatggcggagcagctcgactacttcaaggagtacaagctgcggcttaagctggccaagggcgacgcgcggggcgaggagatcatccgcgaggcgctctacatctggagcatcggcaccaacgacttcatcgagaactactacaacctgccggagcgccggatgcagtacacggcggcggagtacgaggcgtacctgctggggctcgccgagtcgtccatccgcgccgtgcacgcgctcggcggcaggaagatggacttcacggggctcacgcccatgggctgcctccccgccgagcgcatgggcaaccgcggcgacccggggcagtgcaacgaggagtacaacgccgtcgcccggagcttcaacgccaagctgcagcaggccgtcgtccccaagctcaacaaggagctccccggcctgcacctcgtctacgccgacacctacgacgtcctcgacgccgtcgtcaggaagccctccgactacggttttgagcacgcagagcgagggtgctgcgggacggggatgttcgaggccggctacttctgcagcctgagcacctcgctgctatgtacgaaccccgacaagtacgtcttcttcgacgccatccatcccacggagaggatgtacaatatgctcgccgataaagtcatgaacaccacgcttcatgtatttctctgaatttcagttcagttttctcggttgagaagacaatatatggagggatgactgtatatgttgtgtgtgcgtgtttatgttctatgaaaacgagacatcatgttacactgatccatggcgatcgaccatgtgtacatgtagtacgcaatggactgtaaatgaaaccttttgctagttttgtactccctccgttgctgacagctttataatataactcgatccgaggaagtgactgggaaaaaaaaaa

SEQ ID NO: 27468 - DNA, 130 bp, Triticum aestivum
  Clone ID: PAT_TA_27468
ggcgcttgtgttcgttgcagcaagagtaaccttgtacgaagacatggcctgagagacttcctggttgtccccatgatcggttgtaaagataccatgatgatgatgaaaatttcgcctacgagtttatatc

SEQ ID NO: 27469 - DNA, 500 bp, Triticum aestivum
  Clone ID: PAT_TA_27469
tgactcgcacggccgccagttgtgggggatatctggagaattcgcccttctaatcacgactcactgagtaaggcgtggtgcggagggcggtacaatacttggggcactatgcttttctagttggaaatgtgcttttaaatctcatctcaataggtgaggaaagtgtttgcgctgcctgaacttcattatcaaaggcttgtactttcatctgcatggctgtggcttggatccggaccttgggtggcaaggcataggaattcacttctggaactttaaccacagctgcatgcacatgcttgagttcaactggagaatggatggggcccttggggacctgtagctcgtcttctccatgagatgactttcctaccacaccatcatcagttttcgacgttctctgggagttgctggaggatcggttgacttgcagtagtgggggagagtgtgagtacctgcccgggcggccgctcgagccctatagtgagtcttatcagaagggc

SEQ ID NO: 27470 - DNA, 456 bp, Triticum aestivum
  Clone ID: PAT_TA_27470
ttttcggacgcgtgggcggcaacgcggtgacggcgcgggacgactacttccgcatggtgtacgacgccatctacgcgtctgcgaagaggggcgggccgtgcgctgggggcctcttctggcaggtcttggcgcccgggatggagagctggaccgaccgctacgccgtcgtgcttgagcgcagctccaccaccgccgccatcgtctcccaggagtacgctaggatcggcagaatcacgccgtgagtctagcttgagtagatgcatccacgggtgcgttccgcctcgcccgcgcgttgggggaacagcctgcaggaagcaaggacccacgagtcgtgttaggatagttgcaatcgtctaattaggtcaagattgctcacaaataaggctaacatatgtagtggcataccaaggaatgaggtccccattataacatattaataaagattaaaggttttct

SEQ ID NO: 27471 - DNA, 586 bp, Triticum aestivum
  Clone ID: PAT_TA_27471
gagcagcaggtggagttcatgaagaaatggatggcgtcgcacaccgaggacgcggcggcggcgctgcggaagccgctgctggtggcggagttcggatggaagtccagcggcaacgcggtggcggcgcgcgacgactacttccgcatggtgtacgacgccatctacgcgtcggtgaaggggggcgggccgtgcgccgggggcctcttctggcaggtcatggcgcccgggatggagagctggaccgacggctacgaggtcgtgcttgagcgtagcccctccaccaccgccgtggtctcccaggagtgcgctaggatcggcggaatcacgccgtgagtctagcttgcgtgtatgcagccatgggtgtgcattccgccgcgcgcgcgcgcgtgcgttggggaagcagccctgcagggaagcacggactcacgagccgtgttaggatagttgcaatcggctaattattacgtcaagattgctcacaaataaggctcacacatgtagtacgtggcataccaggaaatggaggcccccattgtaacatactaataaagatttacccgcaaaaaaatactaataaatatttttt

SEQ ID NO: 27472 - DNA, 760 bp, Triticum aestivum
  unsure (1)..(760): unsure at all n locations
  Clone ID: PAT_TA_27472
gatcggcctcgagggcttctacggggactccgcgccgcagcgcaagcggttcaaccccggtgggaattacagcgcgggcaccgacttcatcggaaacaaccgcatctccaccgtcgacttcgccaccatccactgctaccccgaccaatgggtgccggggtcgacaagcgagcagcaggtggagttcatgaagaaatggatggcgtcgcacaccgaggacgcggcggcggcgctgcggaagccgctgctggtggcggagttcggatggaagtccagcggcaacgcggtggcggcgcgcgacgactacttccgcatggtgtacgacgccatctacgcgtcggtgaaggggggcgggccgtgcgccgggggcctcttctggcaggtcatggcgcccgggatggagagctggaccgacggctacgaggtcgtgcttgagcgtagcccctccaccaccgccgtggtctcccaggagtgcgctaggatcggcggaatcacgccgtgagtctagcttgcgtgtatgcagccatgggtgtgcattccgccgcgcgcgcgcgcgtgcgttggggaagcagccctgcagggaagcacggactcacgagccgtgttaggatagttgcaatcggctattattacgtcagattgctcacaaattaggctcacacattagtacgtggcataccccanggaaaaaaattggaaagggcccccccccaattttggtttaacaattacctttatttaaaatgaanttttaaccccg

SEQ ID NO: 27473 - DNA, 714 bp, Triticum aestivum
  Clone ID: PAT_TA_27473
tgtcccctcgtgcctcacccccggccccggcgccccgcggccttcgttcgccaacgccggcctagctatgcaagccaccatgggcaacagcaaggccgcggtctgcgtgctggcgctcgtcctgtgcggcctgctcgccaccgacacggcggcggcggcgcggtgcgacgcgagcgcgctgaggccgtgcctgggcgccatcatgctgggcggggcggtgacgccggggtgctgcgcgcggctgcgcgcccagcgggcgtgcctgtgccagtacgcacgcgacccgtcctaccgcggctacgtcaacagcccaagggcgcagagcgtcgtcgccgcctgcggcctccccaaggcccaagtgctgatcgcccgcccggcgcgctatacatatcgactccgccccgtgtggccggcgtcgtgcacgatgccgggcaccggtggacggcggtctacgtaatgtaatatgtggttaattacacggtcgacgacgccatcgagctggcacgtacgtgcgtgcgtgtacggttgagttgtggacgtctgtctaaataaacgtggtttgctccaagctgcgcaagcatatatacgtgcgtgcgttgaggcggctggttgtgtacgttctctcatgttttcccccagcattaattccatctgtttttttagacaaaaaaaaaaaaaaaaaaaaaaaactcgagactagttctctcacctcgg

SEQ ID NO: 27474 - DNA, 765 bp, Triticum aestivum
  unsure (1)..(765): unsure at all n locations
  Clone ID: PAT_TA_27474
tggatgacgaatacgattatctttttaaacttgttttaattggtgattcaggtgttggtaaatccaacttattgtccagatttacaacaaacgagttcaacttggagtctaaaagtactattggtgttgagtttgcaactaaaaacctcgaaatagataatcacactgtcaaggcccaaatctgggatacaangtggacaangaaagatacagggctatcactggagcttactaccgtggtgctgtgggtgcacttcttgtttatgatatcacacgtcaatcctcttttcaaaacgttcaacactggcttaaagaattaagggaccatgcggatccaaatatcgtgattatgctcgtaggtaacaaggtcgatttaagtgaatctagccgacaagttactacagaggatggtggatcactggctgaacaagaaggatttttatttgttgaaacatctgccttagatgctactaacgtcgataaggcatttgctactgtttttgatacaatctattcaaatttgcctaaaaagaccaatcaatccgccgatgctgctacaaatcaacctacggccggagaacgcattcaactgagacctcctagtgtccgaggcctgagttctcgtgaagaaaagggacaacaaaagaaggagaatggtggtggatgctgttaatgctttattaaactaatcttactttgccttgatttaaaaactgtttaatgtcacgataacgtaacaaataaatatcgttttcttcaagatgt

SEQ ID NO: 27475 - DNA, 613 bp, Triticum aestivum
  Clone ID: PAT_TA_27475
ccccccatccgtccgcttttgcgtccgaaaaaatactaatacatacacaaatgagtgaatattgtcctgtttatgctcctttctttggcaccatgggttgtgctgctgccatcgttttcagctgtctcggagctgcttatggtactgctaaatccggtgttggtctctctgctatgggtgttttacgtcctgacttggtcttgaagtgtattgtacccgttgttatggctggtattttgggtatttatggtgttgttgtctctgttttattatctggtggacttgctatgaagcaaacactctttagcggctttgttcaaatggctgctggtctttcagttggtctttcttgtcttgctgctggtattgctattggtattaccggtgatgctggtgtacgtgctactgctcaacaacctagaatgtttgtcggcatgatcttgattttgattttcgctgaagtattgggtctttatggtcttattgttgctttgattttaaacaccaaggcctctggtactgaaagtgtttgtcaataagcggtttgattgaaatagcacatataaaatatataccgtgtaatatgaaataaaatgtataacattcaattatg

SEQ ID NO: 27476 - DNA, 1675 bp, Triticum aestivum
  Clone ID: PAT_TA_27476
gctctctctgcctctctctccctctttcacacaccgcctccccctcgccctctctctcctcgcttccattccctcttcttctagctagcctgcttcggtgcccggctgggttgcgcccccgccgcgctggcggagatgtctgaggcgtcggtggtaaaccaggcggaggtggaggacgcggcggcggcggcgctgcccgggctggacctgccgccgggcttccggttccaccccacggacgaggagatcatctcgcactacctcacccccaaggcgctcgaccaccgcttctgctccggcgtcatcggcgaggtcgacctcaacaagtgcgatgccatggcatctcccaggcaaggccaagatgggcgatgaaggagtggtacttcttttgccacaacgaccgcaagtacccgacgggggcgagcacgaaaccgcgccaccgagaacggctaccggagcggccactggcacggacaactgatatcctccggcgggatggtgcctccttcatcagtatgaagaaagacgctccgtcttctacctcatgaccctcgccccccgcggggaggaagaccggctgcgtcatccacgagtaccgcctcgagggcaagctcgctcacccggtcccgcgttccgccatggacgagtgagccgtgtacaaggttttctacatagagctcacgaccaccaacggggcaatggcagcggcggaggccgggatcgagcgagtcagctccttgggcttcatcactgacttccttgactctggggagctgccgcccctcatggaccctcccttgggcggcgacgtcgacgaagtcatcgatttcaagtccacctctgcctacgccaccggtgcccattccggactccaggttaagatggaacagcacatgccgctacatgtaccgcacatgatgtactcgagcccctacttctccctgccggccgccaactccggcgacatgtcgccggcgatccggaggtactgcaaggcggagcaggtctcggggcagacgtctgcgctcagcccgtcccgcgagaccgggctgagcaccgaccccaacgccgccggttgcgcggagatctcatcggcggcgacaccgtcgtctcagaatcaagagttccttgaccaattcgacgagtaccccgccctgaacctcgccgacatttggaagtactgaagccggccggagctgcacctaccacatgattctcgctcgattggttctggctcgttgattaattactcagttggattacttaacttggtgtgtgatgctcgtgttagtggtttgctgatgcagcatcatcttctttccggaggactctcgggtcggatcaggttactatctatccagacagaccgacagacctccagggattagctaggcatccttaatcatgttattaaattaattagtcctaggttcatatcttgatctgtgtgtacatatcactacaactatattctgattgtgattaattactagcagtagcagcatgatggttatacaattaatgtgtgtagattaggggggacgacttcagatccatttgtgaatcgattaatttgggcgccgttgatgagccagccagctagctctactactagtagctttgtatgtacatgtaccaccattgatcattaattgcttgagtttgacatgtcact

SEQ ID NO: 27477 - DNA, 886 bp, Triticum aestivum
  Clone ID: PAT_TA_27477
aacgtttattagtttatgtgtatcccaaaagaagaagaagtgctgacgctgttgcaaaattaaatgcaaagtttgatcgagtaataagcaagaaacgtgaggaacttcaaaatggcatttttagtaataagccagataatgaaaaagacttggttactttgatgttggaagcaggaatgcaagaagatatttcgataacaaatgaggagctaaggcataatatggcagttttatttgtggcaggatatgatagtacctctaactcattatctttctgtctataccatctagccaaaaacaagcgtgcacagcaaaagttaagagaggaaataatcaatatacttggagatgatgatatggatattgttccttctttagaagagctgaaacagatgaaatacatgaacatggtcattaaagagaatcttcgactcaatatgcccgttgacttgatattcccacgcaaaacggttgaagacacattcgtggcaggtacttttattccaaaaggcacaaatattgcagttgatataggtgctcttcaccgtgatccaagaagctggaaagatcctgatgaattcgtacctgaaagattcgaagatgatggagaacaaaaggagcatgagggtttagcatgggttccattcagcaatggaacacgacagtgcattggaatgaactttagcttaatgaagcaaagacttgttttgaccatgttattgagaaagtatgaggttgatttgccaaaggattctatccattatgatcatattatatacgaaagaccaatttatatttgtcccgattcgttagagttgatattcacaaagcgttactaaattgacttttattttgaatgaaataaagctacagacaagtcttagcc

SEQ ID NO: 27478 - DNA, 562 bp, Triticum aestivum
  Clone ID: PAT_TA_27478
aaatcttcctaaagtcttttttgacattgctgttaatggccaaacttccggccgtatgactttcaagcttttctctgacactgtccctaaaactgctgaaaactttcgtgctctttgtactggtgaaaaaggaaaaggtatctctggaaagcccttgcactataagaacagttccttccaccgtatcattcctggttttatggctcaaggtggtgattttactacgggggatggccgtggtggtgaatccatctatggtcgtacatttgaagatgaaaactttactttaaaacacaagggtaagggtcttttgtctatggctaatgctggacctaatacaaacggttctcaattcttcatcacatttgtcgacactccttggttagatggaaaccacactgtctttggtcaacttgttgatggaagcaaagtattgagccttctggaacaacatggttctcaaagcggtatgccaaatgcaaagattgaaatcgttgactgtggagaactcaaggattaaataaaaatggattacaatgctttctatataaacgtgttcttc

SEQ ID NO: 27479 - DNA, 1269 bp, Triticum aestivum
  unsure (1)..(1269): unsure at all n locations
  Clone ID: PAT_TA_27479
ggccgccgccgcgccgccagcccaccgggnagcaccgccggagaaaccagccatggatcggtaccagcgggtcgagaagccgcggcccgaggccgccgccatcagcgagaacgagatccgtatcaccacacagggcctcatccgcaacccccgcgcccgcgccacctccctcctccaggaaaaacgggtgaaagaaattgtgttgaaggccatgggacaagctatcagcaagacagtggctattaccgagatcataaagaaaaggatccctgggttgcatcaagatacaacaatcagttcagtcagtattactgatgtatgggaacccattgaggaaggccttgtaccattggagatgactcgtcatgtttcaatgatctcgatctccttgtcgcctaaggagcttgacacaaattcacccggatatcaagctccattgcatgcagagccacttaaacctaggtaccagcaagttcagcgatatcaacaacagcaccagccaagacaaaatcaagttcaaacagattcatatgtacgtggaagaggcagagggagaggaaggggcttgggtgggtgggctgggtatggtggaggttatggtgggtatgataataaccaaggaggttatggtggatatagcaaccagggaggatacggccacaaccaaggtgggtatggcaatcatggaggatacggccacaaccaaggtgggtatggcaaccagggaggttacggcaatcagggagggtacggccaaaaccaaggtggctatggagggggttatggttatgaccaaggtggatatgggggatatgataatggtggctggaattacaaccagaacagaggccgtggtggcggtgggcgaggaagaggcaactggggatacagtggtccaggatacgagcgcggtggccgaggtgcaggcggcccaggtggcccaggcggcaggggctacgtgcggggccgtggtcggatgggccctggccgcgggcgcgggaaccagaactattaggtcacatagtgctgtattgttgcaaaaaagagagacagaaggtacgcgttctgtgaatcggaaccgaaccttggcgctgtttcattgtgaaccatcgactaggcttcccagtttttagctataatcgccaatggtatcggtaccattgcttccattctgtgggattttgacaagcatgttatgttgttcctgggacacctttactgtatctaagagtgcagttttgaatagtaaaaaaaaaaaaaaaaaactcg

SEQ ID NO: 27480 - DNA, 877 bp, Triticum aestivum
  Clone ID: PAT_TA_27480
cttaaagactagttcctgaggaggccattccagaggtatcaacctacttgtgtgaaagctttggtaataaagccagaattgattacggaacaggacacgaagcaaatttcatggcgtggttgctttgtcttgaaaaattaaatgttcttgaacaaaaggatgacacagtggttgtgttgcgtatattcgtaaaatacattagggtgatgagacatcttcaatttgagtactggttagagccagctggctcacatggtgtttggggccttgatgactaccattttcttcctttcctttttggttcttctcaacttttagaccataagtatattaaacctaaatcgatacacgataaagatgttgttgatcagttccatcaatcgtacatgtatcttgcatgtattcatttcatcaatagcgtcaaaaccactgcatcattacggtggcattcacccatgctggatgatatttcagcatgtaaaacatgggctaaagtgaatcaaggcatgatcaagatgtacaaagcagaggtgttggcaaaattacccatcatgcaacactttatgtttggaagcttgatatcttttgacggaggtcaagtaatgagtgctgaacttgatagtcactgcggtcatgtacataacactgataatcaagaaacagaaaacgaacaagagtatcccgaatgctgtggtataccggtgcctagtgcaatcgcagcagcagcagtctcaaaaaacacaagtattttccgtcctcttccttttgactaatgatgtacttagtttttaaaggctattgatgaaaagaaaagcccttacatgaaagggattttgtaactgaataaaatatagtaaaaaatatggttggcatattc

SEQ ID NO: 27481 - DNA, 2148 bp, Triticum aestivum
  unsure (1)..(2148): unsure at all n locations
  Clone ID: PAT_TA_27481
cggacgcgtgggncttccaaactgtgaaagcatttccattccagggatgttggcagaaaaggatgactgggtcccccgcaaggatggaccttatatctggctcaaccatgaacccaccgaggccaaaagccatgtcgcagccgccacaccaacccatcctgaggaagctggccccaaggacgatgccatcagcaaaagcagagcaccaagtctgcctgcttcctcagccgggagcgaggagtccctgaaatccatcgacgagtcagccgaagaccctcctgcagaagcatctcatgcacagtctctcctggctgagaccgcctctcctcctcacccggacgctaccgacgagccgaggaaaccgctgctggccacggagaagctccaggcagactcatcggagagcagggcgggatccccaccgtacacctccctgagggccatcatacctgctggggaacagcagcagcagcagcaggcggtggcggctgcagcgggctctgttggagatgatgcaaagcggaagagcgggatgcggagcccctttcttgtccgtttgaaattcttattttgcttacattgctgattcgtggtgggttcgtttgacattcatattttacgaatacatccagttcgtagtagattggccaaaagcgaaagtatctagaattcgttccatagacctgaaagtgatactgtagcatctattacaagaaacgcggaccaaaacttgaagtcgtgggatcgccaagactgcacgaagaacggtcacatcaccaaaacctccatggatcccggtaaggaggaacacattcctctgtcggggggagggggtgaaaggatgccacagccttctgtagcaaaggccccttaaaatcccgctgcttcctgagcctgtaggcattcaccgattggacaatgtcttccgcttcagcggtcacccgtacattgtaccgaaccaaattaggtgctggtgccgattttgttggtgatttccgagcaatgtcttcatagtcccactaggagtcgccctcaaacatcttcggtgtgtgcatcaaaggaccgaactctcccccattcgctcgtttgtggttcccttcaatgaagatcggtcagacatagcgcgatcagccacatcttttgcagccttaacttttcttgtctgtcggaaggtagaaagcgtgagcttggtggcccgaatcgagactgagatgacagcattgttgatcatgtcaaggcgctccgatacgatgcgttgccgtgcatcaggagatagtggcgccgcagaggaatatcgctccgatttcctggactctacccatctgaaggaggttttcttccctggcagctgaaccgggtaaagaaaagagtaggcgttggtctcatctaccagcatggccatcttcacgccgtcgtcgtccacctcggtagcagcagcgcacgattctactactgtaatcgggaggacgattgcaaaggaggagacgaggccggacagcacgagctgcctcctctccagcccgcggctccacgaatcgggcgcgcacgagcacgagaccgccctcctcctggacggcggagcgcaccctgctgcgcaccagccgcgcccttgctcctggggtggaccgcagaggaggaggagcgagggaggggggaggccggggagagaagcgccgccgccatggccgccctgtcgccggtggccggcctcactcccggcgaggaagggcaggcacatcgttgagaagatgcgggagaacgcgaggaccaacagcatggagagaaccacctccgcgtagttaattagccgggagcagcaagttcggtcagtcgtgctctgtcgattctcttttcaatcgggaaacctgtgtatggtagctaagctgaatcattccagatgcatgtcacacatgtataaatgttgattgacaatgaacatctaggcagaaccagctaggacaatgtgtacccttagcttaatggtgtttcagtggtacctgagtggcaatcaccatactgaacttttgtaatgtcaaattaatggcgtttcagtagtacatgagtgacattacatggtcctacaaatttatnangctcanttatcatctagggcagaacatcttaatgaaacattcttctgacaaaaaa

SEQ ID NO: 27482 - DNA, 1188 bp, Triticum aestivum
  Clone ID: PAT_TA_27482
gggaaacctaaaattgatgcgctgcatccatctgcaaacagtctatcgtccggtcgtcccacggcgatctctccgctacaaatcgtgtcgagcgctgggagccaatctggtgcaaaggtaaaccctcaggaaccttcagcagctcgtgctgcaacatccaatgaaattggtaccgtggcagcaacaattgaagttagaaaaagttctggaccagaccgtggcgagtccaagagaaaacatcgttctggaatgcgtgatgatcaaggatccaaaaaacccagggtaaaccctgaggaaccttcagccgttcgtgccacaacatccaatgaaattggtaccgtggcagcaacagttgaagttagaaaaagttctggaccagaccgcggtgagtccaacagaaaacttcgttctggaacgcgtgatgatcaaggatccaaaaaaccgagggtaaaccctgaggaaccttcagccgtttgtgccacaacatccaatgaaattggtgccgtggcagcaacagttgaagttagaaaaagttctgggccagaccgtgatggatccaagagaaaacatcgttctggaacacatgatgatcaaggatccaagaaacccaggaagaatggtaaacttgcaaaaagtgaaatatcatgcttggccatgcttgagttgaagctactcaagatagacaaaacctacggttccgacagattcaaggaggttgctcgagcagcaacacacaccgtcttggcttcctacggactggagcatactccatcagtagccctggcactccccaaaccggtctgcaagcacagctgcagaaccggatcttccaaaccgtcagcgatagccaacacctgcaaggaatgcctgcgtggtttcgtgaagcaagccatcagttcggtgttggccagcaagcagatggatcaaactgccgcctcttgctagggtttagactgcgtctcagattgtctttcacggttgtgaaaggaaaaattcttttgtcttacctagtgtgtagacagatgttgtatgtacatttccgtagcgttttttggtgtaacctacctagctgtgtagtggttgcttggcttggttggtagacctgatccaggacaagaaacatagtacttgaatgggtttcaatcaagaataataacaaaagaaacatagtacttgcaaaaaaaaggg

SEQ ID NO: 27483 - DNA, 726 bp, Triticum aestivum
  Clone ID: PAT_TA_27483
gcccacatccgcagccgacccccccgggccggccgctatctccacggctaaccacaccggcctgtggctagctagcttagctgcacgtaacaagaagtccagcatggcctcgcgcaacgccgcacccgtgttcctcctcgcgctgctcctgtcgtgggtggccatgagcagcgcggcgaggaagctgcaggagcaggagacggctccgcccacggaagaagagccgtccgcgccacacctgaccgtgccggggctgccagactacgagctgccgccgatgcccaagtttgagctcccgccattcccagagatgcacctgccgccgttcccggggacgccgtggaagccggcgacgcgcacgcccacccttaccgggttcttcttcccacagccggagccggaggccaatccatgagggcttcttcgttgtaccgtgcacgtatgtagcgttgctcgtgtgcttgtttatttgtggtatcaaacgagagtgtgccgattcgtacggccgacgttatcctgtgagctcctgcgactcgtgatcctgtctacgtctatgtacgtatgtgcctagacgggatgtacatgtgcattatatatgtttatacatcagtaagtatgtttatagctttacaagggtggggtgcgctgacagataaatgtgttgacagaatttcttgtatatccaggatgagtaatgctcaaatgcaaagcgactgatgagcagcg

SEQ ID NO: 27484 - DNA, 1048 bp, Triticum aestivum
  Clone ID: PAT_TA_27484
cggcctcgccggcggccgtgccaccgtcccaaccaaggtcagtcgcctcccgcatcggcctcgtctcgtcttccgtctccgcccgctcgcctccgcccgccgaccggcctcgccagcggccgtgcgtccccgtggtcgtccctcgtgttcctctcggtttccgtctggctttattaggcgcctaagggcacgccacagagagcatggactccacgtcttggtgctatcggccaccttcgtggaaagggcttttcaatgtgcccgcagagttgcacacatttgcgccatagtctacacctcggaccgagtggtcgtaccagctcgtcggcaccagctacacaacagatgtggtgctctcaattctggcggatcaaggtgttcgccagctttatcccaagggcccagatatcgacttcaagaaggagctaaggacactcaacagagagcttcaactccatatcttggagctagcggatattttagtggagaggccatctcagtatgcccgcagggttgaagacatttcacttattttcaagaacttgcaccatcttcttaattccctacgaccacaccaggcaagagcgacattgattcacctccttgagagccaaatacagcgccgtaagcaagcaattgaggatataaaacagaggagagaggaggcacaaaggctgcttggggaatcactggttattattgagggaagccagcagcaggttatgactccaatgtgaaggcctctgatatcctgggtttcaggttatgactccagtgtgaaggcctctgatatcctgggtttcctggtgccaagttggctggattaagatgaagtattggcgtgaggtgaatgcattctgctgtttgctcgtagaaatagcctagtgacaattatgagaaatttctagctttcaaagatgaattatgcatctgcgtgtgctgtgaagcttttaagcactgaacctggtcagctcgatgttggatacttccattgtaatgtttagaatcttttttttttcaaaacatgttttcaaccggaacgcaaaaa

SEQ ID NO: 27485 - DNA, 864 bp, Triticum aestivum
  Clone ID: PAT_TA_27485
acaatttccattgggtggtggtttattcttttgttttgtttataaaaatgtcaagcaacagcagcaatactgatttaatcaatcaattattatctttacctgttgatttcactatggatccacttgttattcctacaatcacaaatgtagttcgtccaaagaaatcaagagtgacacttgaagataaagatcaaaagacaaaagaaagaattttaagaaatagagcagcagctcaagagtctcgagataaaaagcgtcgttatgtttccgatttggaatcgtcgaataagagacttgaagaagaaaatggtcaaatgaagaagaagatgaagcatttggaagaagaaaatatgtcgttggcttgtcaactggaatctatcagtaaacaatttgctgctctacaggctcaaatcaagtttaatacaaattctacttttctctttaatgacttttgcggttcagcacggatcgtaaagaaggaaataatttgtgtttaaagaaaaaagaaaagaaaagaggaaatcatttcaactcacaagtactactccaccacccagtggaaactctctctctctctctttctttttctttttctttctcccctttttattttccttttccctgcagcggaggttattaaaccagaaagtaagaatcaaagtcaactgctagttccatcacccatcttatcaccttctctgtcaaccgatgaagattcttctgtttattcaccaaacagtcatgatctcttggatgatttattggattggaatggtcaacaacatactttataacaaaaacattcttcttttctgcatacttcattaataaatacataatacattttcttttttattattctgt

SEQ ID NO: 27486 - DNA, 1083 bp, Triticum aestivum
  Clone ID: PAT_TA_27486
cccaccccactcctccccgccgccgccgccgccgccccgctccgatccgccccgcgccgcgcggatcgccgcgccatggaccagtacgagaaggtggagaagatcggggagggcacgtacggggtggtgtacaaggccaaggaccgctacaccaacgagacgatcgcgctcaagaagatccggctggagcaggaggacgagggcgtcccctccaccgccatccgcgagatctccctcctcaaggagatgcagcaccggaacatcgtcaggctgcaggacgtggtgcacaacgagaagtgcatatacctcgtcttcgagtacctcgacctcgacctcaagaagcacatggactcctccgcggacttcaagaaccaccacatagtcaagtccttcctctaccagatcctgcacggcatcgcctactgccactcgcaccgtgtgcttcacagggatctcaagccccagaacctgctgatagatcgccgtaccaattcattgaagcttgctgacttcggattggcgagggcgttcggcattcctgtccggacatttactcacgaggtggtgacattatggtatagagcaccagaaattcttctgggtgcgaggcagtattctacccctgttgatgtgtggtcggttggttgcattttcgccgaaatggtgaatcagaaacctctatttcctggtgattctgagattgatgaactcttcaagattttcagaattatgggcactcctaatgaagaaacctggccaggtgtttcttcgttacctgactacaaatcagctttccccaagtggccatccgtggatcttgcaactgtggttccaacactcgaacctttgggacttgatcttctctctaaaatgctctgcttagatccaaccagaagaatcaacgcccgaaccgccctcgagcacgagtacttcaaggatcttgacgtgtcctcgtagattatgtcccctgctgctctggtaattaagattgcgtcggttgctcgacagcttcctgaatccttccggactgtgtgctcctttttttactattctttttgactttgcttggtagagagaaattat

SEQ ID NO: 27487 - DNA, 1324 bp, Triticum aestivum
  Clone ID: PAT_TA_27487
gcccccctctccccctcccccccacccccccaatggcggcagcagcagcagcagcagcagcagcttcgcccgccgcagccgctctcccccgcccctcctccccgtgatccccttccccttcccctcccccgcttcctcctctcccccctcccgcctcctcacccatttcccacgcccgcgccgccgccgccgccgtagcattggacgccgacccgatggagcagtacgagaaggtggagaagatcggggagggcacgtacggggtggtgtacaaggcccgggacaggaccaccaacgagaccatcgcgctcaagaagatccgcctggagcaggaggacgagggcgtcccctccaccgccatccgcgagatctcgctcctcaaggagatgcagcacggcaacatcgtcaagctgcacgatgttgtccacagcgagaagcgcatatggctcgtctttgagtacctggatctggacctgaagaagttcatggactcctgtccagagtttgccaagagccccgccttgatcaagtcatatctctatcagatactccgcggcgttgcttactgtcattctcatagagttcttcatcgagatttgaaacctcagaatttattgatagaccggcgtactaatgcactgaagcttgcagactttggtttagcaagggcatttggaattcctgtccgtacatttactcatgaggtagtaacattatggtacagagctcctgaaatccttcttggagcaaggcagtattccacaccagttgacgtgtggtcagtgggctgtatctttgcagaaatggtgaaccagaaaccactgttccctggcgattctgagattgatgaactatttaagatattcagggtactcggcactccaaatgaacaaacttggccaggcgtgagttccttgcctgactacaagtccgccttccccaggtggcaggcagaggaccttgcaaccgttgtccccaatcttgaacctgttggcctggaccttctctcgaaaatgcttcggttcgagccaaacaagaggatcacggctaggcaggctcttgagcatgagtacttcaaggacatggagatggtacagtgagctggctatgtggtagtgactggcatatgtatgagctgagctgatcatttgtattcgtttgatcactttcgcgaacgcccgacctgcccctgttcggcgtttttggctgtcgtcgcaataattcagggggcggctgtgtgtcgtgcactaccaactgctgctacattgtttaccatcttggtctctattgtactgataaaaaaaataaacatcacaaggaatca

SEQ ID NO: 27488 - DNA, 299 bp, Triticum aestivum
  Clone ID: PAT_TA_27488
ccagagccctgtgtaaaattgacccccattggtcaatccaaaagactgctgccatcctgaaacaaaagaagcttcatgcagccacctgctctgagtcccaggtgaagaaagggccatccatgcaccctctccctctatattttggcaatttcatagaggcatggcattttacattggcaaagactgaactcctatatgtagcttaagcttgtatcactaggcttgtaatctgtattatcgactgtaagatacagttaattaaatcatatttcagtatttccaaagctttgttttcccac

SEQ ID NO: 27489 - DNA, 1711 bp, Triticum aestivum
  Clone ID: PAT_TA_27489
ccttccccactctgtccggttccggccccgcgctccccctcccccctctcgccccgcctagccgccggcgacgagctccagctcaggttgccttttcccacggtcggcggcggaggaggcgggcggcagaggacatggagcccatgagcgtggacagcagcggctgcggcggcctggacgcgcagatcgagcagctcttgcagtgccgcccgctcgccgagcaagaggttaaagcactatgcgagaaggctaaggagatattgatggaggaaagcaatgtgcagccagtcaaaagcccagtgacaatctgcggtgatattcacggacaattccatgatcttgttgagcttttccggattggcgggaagtgtccagatactaattatttgtttatgggggattacgtggatcgtggatactactccgttgagactgtttctctcttgcactgtgcgaaaaggttcgccacccacatcggattacaatcctccgcggaaaccatgagaggtcggcagatcacacaagttatatggattctacgatgaatgcctacgaaagtacggcaatgcaaatgtatggaagatattcacagatctttttgattatttcccattaacagccctggtggaatctgaaattttctgcctgcatggtggtttatctccatcgattgagaatcttgatagtgtgcgtagcttggatcgtgtccaagaggttccacatgagggtcctatgtgtgatcttttatggtctgatccggacgatcgatgtggttggggcatttctcctcgtggtgccggctacacttttgggcaggacatatctgagcagttcaatcacaccaacaatctcaaacttgttgctcgggctcatcagttagtcatggagggatataactgggctcatgaacaaaaagttgttaccatattcagtgctccaaactattgttaccgatgtggcaacatggcatccattttggaagttgatgactgcaacgctcacacctttatccagtttgagccagcccctcggagaggtgagccagacgtgacaaggagaacacctgattatttcctttgagtaaactggctgcaccatttctcagcttgtattgcgatagtccgcaccgatcagtgagattctgctggatccaaatctgcacatgagccaacaaacaataacaaaggggtgtaccagagccctgtgtaaaattgaccccccattggtcaatcccaaaagactgctgccatcctgaaacaaaagaagcttcatgcagccacctgccctgagtcccaggtgaagaaagggccatccatgcaccctctccctctacactttggcaatttcatagaatcatggcattttacattggcaaagactgaactcctatatgtagcttaagcttgtatcactaggcttgtaatctgtattatcgacggcaaggttcagttaattaaatcatatttcagttgcagccacctgctctgagtcccaggtgaagaaagggccatccatgcaccctctccctctatattttggcaatttcatagaggcatggcattttacattggcaaagactgaactcctatatgtagcttaagcttgtatcactaggcttgtaatctgtattatcgactgtaagatacagttaattaaatcatatttcagtatttccaaaaaaaaaaaaaaaaaaaaaaaaaaaaaaaactcg

SEQ ID NO: 27490 - DNA, 617 bp, Triticum aestivum
  Clone ID: PAT_TA_27490
attctggcgtagagggagatgccatcccaaacccaaagcataaaccccatctcctctcctctcccctcatctcatggcttctcccgctctcaaattcgccgccgtcatgctcctggccgccctctgcgccaccgcgctagccccggccatatcggggcagccgacggatgacgggctagcgacgtgcatcgcacgctgtgggtgtgtgccctgcccgaaagggaagttctgccccactgtgtgcacgaccccgcctgcctgcaaggccaaatgcgagtcccagtagtccggcgcgggctggtaggccggctgcgacctggcgacgccccctgcgcccgccgctgctgcgaccgtgagcaagcctgcgagcgcatgatgctgaagccaacactgtattgtaagccctgtatgtctggatgtattgtgtgtgtctgtgctgtgatgtggtaataaaatgtcaacggatcgatccatgagacaaaaataaatatatggaaatgttatctttttgtcacagtcaaacttctgtgcaagtatattgtcaacagatatccatttatcacgagacaatatcaaatatatggaaatgttatcttcaaaaaaaaaaaaaaaaaaaa

SEQ ID NO: 27491 - DNA, 841 bp, Triticum aestivum
  Clone ID: PAT_TA_27491
gtgcgagaaccagacgtacgactgctacgccaacctcgccctgttgaagctctaccaattcaacccacaccttgcccgtgacgagaccatcaccaacatcctcgtcaaggctctcaccgtcttccccagccccgacttctccctgggcctctccctcctccctccacacgtcctagctcctctttcatcttcattacacaacccagctgctggcgacgcgccgctatcagaagctgtccagaagctcaacgagctgaggaatttgcttgaaggtgccgactactctaccttctggtccacactagactccgacgacctgtacgccgacttgattgccgatgtctcagggtttgaggagctgatgcgcgtacgcatcgctgcaaccgtcagccaggcggtgcgcgaggttgaccgcagcatcctcgagtcgtggttgaacctctctggcagcgagttcgacaacttcgtcggaagcgtttgcgggtggaacatcgatggtgccaagatcaaggtgcccatcaacaaggacaacgaggctaagggcaccgttgtccgcgagaacgtcaagttcgatcaattcgcaagggtcatcaagagggcatacgaacagcccgcatgagcgacacgatttatagtatgacgacatgaggctacggtttgcacggtcggcgtttgaggcggacattacaactgcattagtatgcgacagaagcgtactagctggccttcgacgaccgcacaggttgatttcgatggcttgctatataccctaaaagtacgctgctatgagcagtgcctaggagcatgaaatctctatgggctaacaaagatccaatcacat

SEQ ID NO: 27492 - DNA, 617 bp, Triticum aestivum
  Clone ID: PAT_TA_27492
caactttcgaaaggttgttgttattgacggtaagggtcaccttctcggtcgtcttgcttccatcatttccaagcaagccctcaacggtcaaaaggtcgttgttgttcgttgtgaagaattgaatgtctctggtgaattcttccgtaacaagttaaagtaccacgcttaccttaacaagcgctgtcttgtcaaccccacccgtggtcccttccacttccgtgctccttctcgtatcttgtacaaggccatccgcggtatgattccccacaagaccgctcgtggtgctgctgctttggaccgcatcaagcttttcgaaggtgtccctgctccctatgaccgtgttaagcgtatggttgttcccgacgctctccgtgtccttcgcctcaagcccggacgtaagtacaccaccattggtcgtatctctcacgaagttggctggaagtaccaagatattgttgccaagctcgaagaaaagcgtaaggccaagtctgctgcttactatcaacgtaaggttgctcttgctgccatccaaaagaaagctgttgaagctaaagctgaatctgtcaaggaaattaactcttccattgctgccctcggttactaaattataaataaaa

SEQ ID NO: 27493 - DNA, 446 bp, Triticum aestivum
  unsure (1)..(446): unsure at all n locations
  Clone ID: PAT_TA_27493
cccacgcgtccgtaagggtgttggccgtcgttttgccaacattgcctgtaagaaggccgatattgacctcaccaagagagctggtgaactttccagtgaagaattggaacgtattgtcaccattctccaaaaccctgctcaatacaagatccctaactggttccttaacagacaaaaggatattgttgatggcaagtctagccaagtcatctccaacgttcttgacaccaagtaccgtgaagatcttgaacgcttgaagaagattcgtgctcaccgtggtctccgtcactactggggtgtccgtgtccgtggtcaacacaccaagactactggtcgtcgtggacgtaccgttggtgtctccaagaagaaataaagaacctgtggaaaccaatacatatttttttttgtttttcaaataaaagattccttgtttgtaaaactcanna

SEQ ID NO: 27494 - DNA, 533 bp, Triticum aestivum
  Clone ID: PAT_TA_27494
cgagagaacactttccaacacattctccgtcttttgaacaccaacgttgacggtcgtgtcaagattcagattgccttgacctctgtcaagggtgtcggtcgtcgttttgccaacattgcctgtaagaaggccgatattgacctcaccaagcgtgctggtgagctttccagtgaagagttagaacgtattgtcaccattctccaaaaccctgctcaatacaagattcccaactggttcctcaacagacaaaaggatattgtcgacggcaagtccagccaagtgatctccaacgtactcgacacaaagtaccgtgaagatctcgaacgtttaaagaagattcgtgctcaccgtggtctccgtcactactggggtgttcgtgtccgtggtcaacacaccaagacgaccggtcgtcgtggacgtaccgtcggtgtctccaagaagaaataaaggtaaagaaaagaagatgtggatgaatcaaaggctgattggattcaatagtgtttttaataataaaaaaaatgtactttattggg

SEQ ID NO: 27495 - DNA, 594 bp, Triticum aestivum
  unsure (1)..(594): unsure at all n locations
  Clone ID: PAT_TA_27495
cccgggtnnncgacccacgcgtcctccgcgtccccaaaaccagaccaaatcttcggcgagcccatcggcacattctgagagcggagaggaagcaggaggcggcggatcaaggagaggagactagaagatgggtggcggcatggaggtgaacaagaaccgctggatcgaggagtggaacgccggccgggagaacctcgagctcaacttccgctttacccgccgcagcctcgccgtcatcggcctcttcggcctcgccgtccccatcctcgtctacaagggcatcgttcgcgaattccatatgcaggacgaggacgccggccggccgtacaggaagttcctgtgagcgtcgcctccggtggatgtcgagactccgagccgtctgcagggtttcggtcagggagaaggaatctccattcggtttgtttcccgtactgttgtagtcagaccggcgtattttgttctcacatgtgcgcgatatgtgttaaataagatgtaatgaaatgctgttcttgcaattgctgaaacctgagaagtctgatttggttaatttgaggtgaatatttgtgttatgcaatcttatttatgcttggattg

SEQ ID NO: 27496 - DNA, 935 bp, Triticum aestivum
  unsure (1)..(935): unsure at all n locations
  Clone ID: PAT_TA_27496
agcgtggtcgcgcccgacttcggcgagcccatcggcacattctcagagcggagacgaagcaggaggcggcgaatcagggagaggagacgaagaagataggtggcggcacgggagggaggcgagtaacagctgggagcgaggagtggagcgccgcccgggaggacctcgagctgaacttcagctccgcccgccgcagcgctggccgtcaccggcctcttcgcccccgccgtccccaccctcgcctacaagggcatcctcggtgaactccatctgcatcaacaaggggcatgcgggcgcgtacttgcaagttccggacgaggcgtcgccggccggccgtgtaggagacttcccatcctggcagcaggcgcccccggtggagggtgaaggactccccaatggcttctggcacgcttttcctgttcatagcaagcgggggttcttcgatcccgtttggtttgcccgttactgtttgaaagacagtatccggagtattttgttctcacaagttgtgaaatctgagttaaataagatgtaatgaaatgctgttcctgcaattgctgaaacctgagaagtctgatttggttaatttgaggtgaatatttgtgttatgagattgaacttatgccaagatcaaacggggtgggagagcttagctgtgtgtggccctctcttgtatttgaaaattgattcttgtctgcgaccttgatttttactgggcaaaaaaaaaaaaaaaaaactcgagagtacttttaaagcggccgngggcccatngatttttcacccgggtggggtccangtaagtntncccantttcnccctntagtgngtnntntttacaattnnctnggcccntngttttanaacnnnngaanggggaaaaaaccctngnggttacccaanttaattcgnctttgnngnncaatccccttttnccg

SEQ ID NO: 27497 - DNA, 1024 bp, Triticum aestivum
  Clone ID: PAT_TA_27497
actagttctagatcgcgagcggccttctctttttttattttcttttctcggcaattatttcgtaatcaatgcagatgacacataaagtagaaacgcgttcaaaggaagaaattttattagaaccttataactatttaatatctcatcccggaaaagacattcgatcaaagctaattgctgctttcgattattggcttaatgtaccaaaagacgctctaaagattattacaaagacaattgaaatgcttcatacagcaagcttaatgattgatgatgttcaagatgattctgatttaagaagaggtgttcccgttgctcaccatatctatggtgtgcctcaaacaatcaatacagcaaactatgtttactttcttgctctacaggacattctcaaattaaatattcctgaaatggtagctgcttatacagaagaattaatccatcttcatcaaggtcaaggaattgaattatattggagagatagcttgacttgtccaagtgaggaagaatacattgacatggttaacaataaaacaagcggcttgttaagacttgctgttcgattaatgcaagctgcaaccaatagcaaaatcgattatattccattagtaaacatcattggtattcattttcaagtacgcgatgattacatgaaccttcaatcaaatacatacacacaaaacaaaggcttttgtgaagatttaacagaaggaaagttttcttttcccatcatacatgcaatcagagcagaaccaaagaacaggcagttattaaatattattagccaaaaacctacttctgtataagtaaagcaatatgcattggaaattatcaaaagagcaggaagttttgaatacgtccaagaattccttcgccaaaaagaacaagaagcattgaatgaaattgaacgattaggaggaaatccaatgttggaaaaagttatacgagcattgtctttaactaatcaaaccactacccactgaaaaaataataataaaaagaacatattaactgtttatatttc

SEQ ID NO: 27498 - DNA, 479 bp, Triticum aestivum
  unsure (1)..(479): unsure at all n locations
  Clone ID: PAT_TA_27498
atcactatnggactcccaatttcctgtagaagaagatttaaataatactgtagactcttactctgttactattaatggcttcatcttttgtacgcgtcatggcctagaagtatgctctaaatgtcctacagataatcgatcagcgaataatatgatggtggaagatatgcttcatgacaagctatcggaagaagaatacacaaccaaatggaaaggtgatgaacgagaacctttttcagttgcccacaagtggactcgggtcgctaaaggtaaaccgggttgtatggcgcacaaaacggtggcgtgtgatgaatgctttaattggggtgagcaactctaccgtggtattcacggtggtcgtaaaccgagagtgtctcgtcttcagcgcaagagtcgtgatcacaccgacaaactatcataactgcttctctcctttttaaaataaaaaagaagagaccctcacattttgtacgattttc

SEQ ID NO: 27499 - DNA, 1078 bp, Triticum aestivum
  Clone ID: PAT_TA_27499
cctgatcttgtgcaatttgtaagtggatttgctgatgtaggagaagaaattgtaaaatgcggtgttaaacatgttacattcattggctcaccaggcgttggtaaattggttcagaaaaatgctgccgaccatcttgttccttgcgtgcttgaattgggtggtaaagattgtgctatcttattgaaggataccgatttggtccaagctattcctgttttgatgcgtggtgttttccaaaactgcggtcaaaattgtattggtattgaacgtatcattgttgctgaggaaatctatgataaggttgtggatgaaatggactctcgtatatctaaacttcgacaaggttctgttcttgttgatggtgagggtgtggactgtggagcaatgactatgggcaatcagtttgaaaagcttgaaggtcttgttcaagaggctgtttcacgtggtgctcgtcttcttcgtggtggtaagcgctaccaccacccttcacacaaacatggtcagtactttgaacctactcttcttgttgatgtcactcccgatatggccattgctaataatgaagcttttgctcctatcatggttatcatgaagcatcaaggccctgatgatgctgttcgtattgctaatgaatgtccttatggccttggttcttctgttttctctgctgataagtccttggctgaaagcatatgcttgcgtctcaaagtgggtatggctaatgtgaatgattttgcagtcaactatttgtgccaaagccttccctttggaggtgttggtatttctggttacgggcgtttcgctggtcaggaaggtcttcgtggcctctgtgttcccaaagctattacgattgatcgtatccctggtgtcaagacacctattcctcctattttggattatcctatcacaagcgctgccaatggttggacttttgttgaaagtcttgtcaatttagtttaccatcccgaaatccctgctaaaatcaaggccatgattggtcttgctaaagcacacttgtaaaaaataaataagaaagaaaaataataataaagttacataatctgctttttctctcctt

SEQ ID NO: 27500 - DNA, 583 bp, Triticum aestivum
  Clone ID: PAT_TA_27500
ccaacctgagcgctgaagaacagaaggttaccaagaaccccatgcgcaacctcagaatcgaaaagttggttctcaacatctcagttggtgagtctggtgacagacttactcgtgctgccaaggtgctcgaacaattgacaggtcaaactcccgtttactccaaggcccgttataccgtccgttctttctctattcgtcgtaacgaaaagattgctgttcacgtcactgtccgtggccctaaggctgaagaaatccttgaacgtggtttgaaggttaaggaatacgaacttaaggctcgtaacttttctgaaaccggtaactttggtttcggtattgacgaacacattgatttgggtatcaagtatgatccctctattggtatttacggtatggattactatgttgtcatgggtcgtcccggttaccgtgtctctcgtcgtaagcactgcaaatctaccgttggtgtcactcaccgtatcaagaaggaggaatctattgaatggttcaagaaccgcttcgatggtgttgttagcaacaagaactaagtaaagcacttgaaataaattgagtttatgtgcattag

SEQ ID NO: 27501 - DNA, 403 bp, Triticum aestivum
  unsure (1)..(403): unsure at all n locations
  Clone ID: PAT_TA_27501
cttattttgcgctatgtctgccgaactcgctgtcgtttacgctgctctcatccttgaagatgataacattgaaatcactgctgacaagctccaaactcttgttgctgctgccggtattgaagttgaacctatctggttctctctttatgctaaggccctcgaaggtcaagatcttaaggctcttctcttaaacgttggtgctcctggtgctggtgctgctgcccctgccggtgctgccggtgctgccgccgcttccgatgcccctgctgaagaagccaaagaagaagaaaaggaagaatccgatgacgatatgggtttcggtctttttgattaaattgcttaaaccggtttcatgttctttttttcccgaaaataaaaacttgtattttgcaaatattacana

SEQ ID NO: 27502 - DNA, 549 bp, Triticum aestivum
  Clone ID: PAT_TA_27502
ctgcgcggcactgacggcaaggcgccgggcatgatcgggtggtggccagccaaggcagtgaccttcgtggacaaccacgacaccggctccacgcaacacatgtggcccttcccttctgacagggtcatgcagggatatgcctacatcctcacgcacccagggaccccatgcatcttctacgatcatttcttcgactggggcctgaaggaggagatcgatcgcctggtgtcaatcaggacccgacaggggatacacagtgagagcaagctacaaatcatagaggctgacgccgacctttacctagccgagatcgacagcaaggtcatcgtcaaactcgggccaagatacgatgtcgggcacctcattcccggaggcttcaaggtggtcgcgcacggcaaagattatgccgtatgggagaaaatataagcaaaattaccggagctcatgatgtccacgtagtacgatttagtacttcctccgtgtaaaagtgaggatgagggacatccattgtattttttatataaataataatcaataagtatttccgct

SEQ ID NO: 27503 - DNA, 1108 bp, Triticum aestivum
  Clone ID: PAT_TA_27503
ccccgcgtccgccgacttcggggccgccccggacatcgaccacctcaacccgcgcgtccagaaggagctcgtggagtggctcaactggctcaggaccgacgtcggcttcgacggctggcgcttcgacttcgccaagggctactccgcggacgtcgccaagatctacatcgaccgctccgaggccagaaggagctcgtggagtggctcaactggctcaggaccgacgtcggcttcgacggctggcgcttcgacttcgccaagggctactccgcggacgtcgccaagatctacatcgaccgctccgaggccagcttcgccgtggccgagatatggacgtcgctggcgtacggcggggacggcaagcccaacctcaaccaggacccgcaccggcaggagctggtgaactgggtgaacaaggtgggcggctccggccccggcaccacgttcgacttcaccaccaagggcatcctcaatgtggccgtggagggcgagctgtggcggctgcgcggcactgacggcaaggcgccgggcatgatcgggtggtggccagccaagccggtgaccttcgtggacaaccacgacaccggctccacgcagcacatgtggcccttcccgtctgacagggtcatgcagggatatgcctacatcctcacgcacccagggaccccatgcatcttctacgatcatttcttcgactggggccttaaggaggagatcgatcgcctggtgtcaatcaggacccgacatgggatacacagtgagagcaagctgcaaatcatagaggctgacgccgacctttatctcgctgagatcgacggcaaggtcatcgtcaagctcgggccaagatacgatgtgggacacctcattccgggaggcttcaaggtgggcgcgcacggcaatgactatgccgtatgggagaaaatatgagcaaaattaccaaagcagctctacgagttttttacaatatgaatgacatacatattagtccgagctcatgttgtccacatagtacgatttagtacttcctccatgtaaaagtgaggatgagggacatccattgtatttttgataaaataataatcaataaggatttttgcactcttggctt

SEQ ID NO: 27504 - DNA, 1140 bp, Triticum aestivum
  Clone ID: PAT_TA_27504
cccacgcgtccgcccacgcgtccgtcctcttccaaagctcaggcagaagctgaagaacatggcgaacaaacacttgtccctctcgctcttcctcgtcctccttggcctgtcggccaacttggcctccgggcaagttctctttcagggtttcaactgggagtcgtggaagcacaatggcgggtggtacaacttcctgatgggcaaggtggacgacatcgccgccgccggcgtcacgcacgtctggctccctccagcgtcgcagtccgtcgccgagcaaggctacatgccgggccggctgtacgacctggacgcctccaagtacggcaacaaggcgcagctcaagtccctcatcggggcgctccacggcaagggtgtcaaggccatcgccgacatcgtcatcaaccaccgcaccgcggagcacaaggacggccggggcatctactgcatcttcgagggcggcacccccgacgcccgccttgactggggcccccacatgatctgccgcgacgaccggccctacgccgacggcaccggcaacccggacactggcgccgacttcggggccgccccggacatcgaccacctcaacccgcgcgtccagaaggagctcgtcgagtggctcaactggctcacggaggagcgcacggacggccggagcatctactgcatcttctagggcggcacccacgacgcgcgcctcgactggcgcctccacatgatctgccacaacaactggccctacgacgacggctccggcaacccccccaccgactccgactccggggccgagccgaacatcgaccatctcaacctgcacatcagcgcccgccagcgcacgtcgctcgactgccacctactaatcatagagcctcactccgacctttacctagccgagatcgtcagcaaggtcatcgtcaaactcgggccaagatacgatgtcgggcacctcattcccggaggcttcaaggtggtcgcgcacggcaaagattatgccgtatgggagaaaatataagcaaaattaccggagctcatgatgtccacgtagtacgatttagtacttcctccgtgtaaaagtgaggatgagggacatccattgtattttttatataaataataatcaataagtatttccgctactac

SEQ ID NO: 27505 - DNA, 1552 bp, Triticum aestivum
  Clone ID: PAT_TA_27505
cccccacagcgcacccagcacgagctcaagaacaaggcgaggaaacactcgcccccctccctcctcctcgtcctccttggcctgtcggcctcctttccctcccgccaaggccagtttcagggtttgacctgggagtcgtagaagcacaagggcgggtggttcaaggtccagctgggcgaggtgcacggcggcggcgcccgccgcggccggccccgcgcgcctccgccggccgccgccgtcgcacgccgcgcaatggtacaggccgggccgcctgtcggacctgggcacggccaccgacggcaacaaggaccacctccagtccccgatcggggcgccccagggcaagggcgtcaaggccatcgccgacatcgtcatcagcaccagcacggcggaccgcaacgacggccggggcagcaactccatctccgagggccgccacccgcgccgcgcgcccggcccgcgccccccccgtgatctccagcggcccccgggcatacgccgacggaacgggcaaccccgacagcggccccgacatcggggccgcccgcgccgccgcgccgcccaccccccacctcaagccgggggtcatggagaggctctcctggagcccgaccgacctcacgttcgacggctggtccttcggcttcgccaagggctactccgtggacgtcgccaagatctacatcgaccgctcggatgcccgcttcgccgtggccgacatatggacgtcgctggcgtacggcggtgacggcaagcccaacctcaaccaggacccgcaccggcaggagctggtgaactgggtgaacaaggtgggcggctccggccccggcaccacgttcgacttcaccaccaagggcatcctcaacgtggccgtggagggcgagctgtggcggctgcgcggcaccgacggcaaggcgccgggcatgatcgggtggtggccagccaaggcggtgaccttcgtggacaaccatgacaccggctccacgcagcacatgtggcccttcccttctgacagggtcatgcagggatacgcctacatcctcacgcacccagggaccccatgcatcttctacgatcatttcttcgactggggcctgaaggaggagatcgatcgcctagtgtcaatcaggacccggcaggggatacacagtgagagcaagctgcaaatcatagaggctgacgccgacctttaccttgccgagatcgacggcaaggtcatcgtcaagctcgggccaagatacgatgtggggcacctcattcccggaggcttcaaggtggccgcacacggcaaagactatgccgtatgggagaaaatataagaaaattaccagagcaactctgcaaattagtcatgttgtccacatagtacgattttagtacttcctccatgtaaaagtgaggatgagggacatcaattgtatttttcataaataataatcaataagtgttttcgatttcttaaaaaaaaaaaaaaaaacgagcgacgatccgtcaagcgggggcccggctcccccttccccctgctggtggggcgcgcagcctctatcccttt

SEQ ID NO: 27506 - DNA, 986 bp, Triticum aestivum
  unsure (1)..(986): unsure at all n locations
  Clone ID: PAT_TA_27506
gcgccccgccggcgaacaccccaggcccggcaccagggttctctgcaccgctgccagtagtagtgctccgagggaggggaaggaggtgctggtccagcacctgcttgtcggcgaaaaggacgccaggcttctggtagatttggagaagagcatcgcatcaggggcggacttgagtgatttagccgtggagcactccttatgtccatcaaaagagaatggcggtatgcttgggtgggttcggaggggacagatggtaccagagtttgaagaagcagcatttagtgcgcctttgaataaagttgtacgatgtaagacaaaatttggatggcatttagtgcaggtgctctctgagagggaccaatgcttgctgcaagatattcaaccagaagagcttcacgaaaaaatgcaagatcctagttttattgaagaagctcaattgattgatgttcgggagcctgatgaagtggagagagcatcccttccaggcttcaaagttctacctctccgccaatttggaacctggggaccagtcatgacagatgaatttaatcctcaaaaggacacttatgttctgtgtcaccatggcatgcgctcgatgcaggtagccaagtggctgcagtcacagggattccaaaagatttacaacgttgcgggtggaatccacgcttactcggtgaaagccgattcttccatcccgacttactagccgtcataccgatcagcgttccaaccagaggcttctctgcgtgctttaccatgctgaactaaaatcatagtccggtgcctgttggtagaacttggcattggttttgtgtcgatgccgggattcagagctaaaattttcttctcacgcgaaatcttgtactatcaagtcattttttcagaagttgtcaacggaactagtacggatcgtatcaatatgaatataaatgaaatattcgagagatgatcattcgaagaataatcntcganttaaaaaaaaaaaa

SEQ ID NO: 27507 - DNA, 619 bp, Triticum aestivum
  Clone ID: PAT_TA_27507
gacccacgcgtcggcaaaaagaaaagctcactgttaaatcaaggactcatcgggttttcttggttacttttgttcttctttttaggctcttatctgatcactgagacttggacttggggttatcgtggaaaatggacaaatataaacacttatatgccgcgcaaggaaaggatatttacagaaaaagaattattaaagtatgatggaacagatccttcattacctatttacttggctatagatggcgaggtatttgatgttacgaaagggagaggatggtatggaaaaggaggtagctatcatcatttctcgggtaaagatgcagcaagagcctatgtgacaggttgctttcaagaccacttgacgcatgatttgagaggtttaaatgaaaatgaattgaagggtgtagcacattggaaaaagttttatgaaaatcatcacacttatcataaaattggacgtgtcatccatgaccctatacctcaagatgctcccttaccaaaaccatgtaaatctgctatgaaacaaaagccttagaggatatgtgtctttttctttttttaaaacaataataataatgcatttataaaagactctcaaaaaaaaaaaaaaagggcgg

SEQ ID NO: 27508 - DNA, 233 bp, Triticum aestivum
  unsure (1)..(233): unsure at all n locations
  Clone ID: PAT_TA_27508
cggacgcgtgggctgatccagctgcgctgcaagcacatcttccattcggcctgcctggagcagtggctgcagtcccgcgccgattgtccgtactgcagggccggcgtcgtcctatcctaccacggaaggagtggcctggagtattagcagggcgttgcggcttttgtaaaagaaggaacactcgagttgctacttgctgtgtgcttttaaaaaaaaaaaaaaaaaaanaaaaa

SEQ ID NO: 27509 - DNA, 978 bp, Triticum aestivum
  Clone ID: PAT_TA_27509
cgctcccgccgaccgccgcgccccgctgcttcgacccccccccccccccccccccgcttcccccgcccgccccgccccccgctcgccgcgcctcctccgccgcccgccgcccccgtcaccccgtgcgccccccgccccaccgaccacccaaccaacgcggacggcgccccccggcagaacaaagggcacccacacggaacatgaccgaccccacaagacacagcgccaccccatcaaatgaccgacttcctgatgcggttcagcaagccaaggagaggcttcatcaaaggctccgaagtgtagacctattttcagggagaaggcaaacatcaccagccgtagggacccctgcgccccggccggcgccgccttcggtatccggtctctgcgcttcagcgcctgccccgcccgcccaccccactatgcgcttcagctcccgcccctcccggtcagcctcccggcggtggcagcgccccgcggtctcgggccgctccccggccgtggtcgcgccgctcgccctggggcctgcctccgtgacggcgccgtggactctccaaggaacaattcgcgatgccgtggacgcggagtcctcagtggactgttcgatatgccttgaaggatgccatggtgcatcagacgggctgatccagctgcgctgcaagcacatcttccatttggcccgcccggcgcggtcgccgccgtcccgcgccgcctcgccgggcggcgccgccggcgttggccgggccttccgccgtttgtgtaagaaggaacactggagttgctacgtggtgtgtgtcatgtgacttcttgccgtctgcttcccgcgatgtttgcttcaggatcaagttttgctgcagaaggcttgaaacagagctggcctcgctgcacctcctaagtctgtaactcagattctgcagtcctctgtgcacataatcctgctctttttaataacagtgttagaggctgaaaaaaaaaaaa

SEQ ID NO: 27510 - DNA, 568 bp, Triticum aestivum
  Clone ID: PAT_TA_27510
ctcatcccttaagctaatactctcacactcttcttccataatccgcgcggcggcccatggagcctgggctggcgcggcggctgtggcacgttgtgctcgccgtgtgccacatgctgcgccgcggactctgccgcaagcggctcatgatggacctgcacctcctcctcggccgcggcaagctcgccggtcgcgcgcttcgcggcctcctagcccaacccgccacggcccatggccatggccaccgcatctcctcctcctccacttccgccatggcgtcgttctacggacaccacgcgcgggcggtggagttcagctgcaccaccacgccgtcgtacccgcagtactacgggctcttcccctttaagagccgcggcgggcgcagcggaggcggtcggagcaccgcccgcgacgactacagaggcctggatgccgctgcggtggcgcgggcgttcgagatgatgagcgccgacgtggagtccggaagagccacgccggcggtggcagggatggcgacggcgacgccatcaccgatggtggcatggatcctgagccgcagcccccctggtgt

SEQ ID NO: 27511 - DNA, 599 bp, Triticum aestivum
  Clone ID: PAT_TA_27511
cccagcgtccgatgggtcgtgtcattcgtgctcaaagaagggtgctggatccatcttcaaatcccacaccgttggccgtaagggtgccgctaagcttagagttttcgactttgctgaacgtcacggttatgttcgtggtattgttaaggaaatcgtccatgatcctggaagaggtgctcctcttgccaaggttgtcttccgtgatccctacaagtacaagcttcgtactgaaaccttcatcgccactgaaggtatgtacactggccaattcatctatgctggtaagaaggcttctttgaacattggtaatgttatgcctttggcctccatgcccgaaggtaccgttatctgtaacgttgaagaaaaggttggtgaccgtggtgctattgctcgtacctctggtaactatgctaccatcatcggtcacggtgatgatggcaagacccgtatccgtcttccctctggttccaagaaggtcattccttctacctctcgtgccgtcgtcggtattgttgctggtggtggtcgtattgacaagcccctcttaaggctggtcgtgctttccacaaatacagagtcaagcgtaacagctgtgccaa

SEQ ID NO: 27512 - DNA, 564 bp, Triticum aestivum
  Clone ID: PAT_TA_27512
ggggcgcgcgcaggggcagtacatcgtcgcctcctccaagggagggttcgagctgatggtgaccatgaacgtggtgctcacgtcggggacctacgcggggagctcggtgaccgtgatggggcgcgacgacaccggcgtggcggtgcgcgagctggccgtggtcggcggcacagggcagttccggatggcgaaaggctacgtgctgtggaaaaccgtccgccccgacctgctggagctcgacatctacgtcaacccatgagtcactgcccactgcccactcggccgattcagcgtgcatgcgtcagtgacctgtggcagcattacgtaagtgttgcgcgtggtcgttcaaaataaaatcagtgttgcaccttgtgttacaaagcgctacgtgaatgtttgtgatattgtttttagtgtttcttttattgtgtcattctttttttttcgcgggtgagtgtcattatttttgttggtctaagtgcaacggattatgagcacctgtcatatgtggatgctgcttgtgtttgaatcaaataaatattttgcaactaaacaataataatc

SEQ ID NO: 27513 - DNA, 871 bp, Triticum aestivum
  Clone ID: PAT_TA_27513
gccaggtacggactagcaagcgctgtagtcttccactcatcccggccatggcttgcttcaagctcaaccccacgtccttcgcgctcgccgcagccgtcgccgtcatcctggcggtggcggcgccgcggccggcggccggggcgtcggcgcacctgcacgtgtacatgcacgacgtgatgggcgacagcgcgatgatggtggtgcgcggcccgcggggcaacttcggcaacacggtggtgatggacgacgtgctgacggagggcacgtcggcgtcgtcggccgccgtggggcgcgcgcaggggcagtacatcgtcgcctcctccaagggagggttcgagctgatggtgaccatgaacgtggtgctcacgtcggggacctacgcggggagctcggtgaccgtgatggggcgcgacgacaccggcgtggcggtgcgcgagctggccgttgtcggcggcacagggcagttccggatggcgaaaggctacgtgctgtggaaaaccgtccgccccgacctgctggagctcgacatctacgtcaacccatgagccactgcccactgcccactcggccgattcagcgtgcatgcgtcagtgacctgtggcagcattacgtaagtgttgcgtgtggtcgttcaaaataaaatgagtgttgcaccttgtgttacaaagcgctacgtggatgtttgtgatattgtttttcgtgtttcttttatcttgtcattctttttgttggtcttagtgcaacggattatgagcacatgtcatatgtggatgctgcttgtttgaatcaaataaatattttgcaactatacaataataatcaaacaaattgggcattgttattttgaaaccaaaaaaaaaaaaaactcgag

SEQ ID NO: 27514 - DNA, 1443 bp, Triticum aestivum
  Clone ID: PAT_TA_27514
ttttcgctttcgccgctctgcacggcaatcacagggtgcattaatccgctaggattacaaatcggaacgatagattcactgcggctggaaatatctttgcaatgacaatacataaaattccactgattggtctcaaacccggagcacacaactacagctaacaacatcatagaaacatagatggccctttattacaacatctagtcctttgtactctactgcgcattccaacccgaggggcagtaagttcttccagttgtggctggaacacctcactcataatgtcacgaccatcagctgcttcttcaactggcaaattatcccttaaaggttgattatttagccaaaggaacccctgcacttgcgagaccaacataagcaacttttagtcctccgacacccagaattaccttggctcttgaccataatcatatgtaagctctgtcattggaggaatatgcttaattgcaaagaaggcgatgtgtggatatccctcatcaccatggtcatatagaactggttgccaaaaaacattaggtgagcagctgtggttcatgaagcgagctatgttaccagtatgttttgcactaataattattggcaactgcttagatgattcgtttaagtcagaaagactgggttcacccagtaattctggtgcatagttccatcttaagttctgctccgaaggaggggtctcaaagatataatcatcttctgcatcaagagcattcttgtcaacaattacacctgcatattcacagataaatgtgcctgctcggattggatcccaactacgcaggccccaacctcgatctcccgtcttaaacacttcaaagtggatctggatacctttttgtacaacccggttccggcaattatgtaaacaagtgcatgaatcattgcactcgtataacataggcatccgactaacaagtatgcctgaagcactgtaaggaaggtcaccagcatttcgatgcgtacaagaacagttgttatcaccgggtaggcatacgcttgtgcatttgcagccttgcatctttctcattgagcttggggaattcatgtagttaagtttagttgtataggtgaagtggctaggacctttctcatcgtcaacctcatttacaaggcagataggcttactttccacaccgtatgatatgtcgtgcaatataacacgatctctagaggatggattttccctccatttttcagtcttcttccacactgcaatgccatcaggttgtccaggttctctgagcaacttgtgtttaaacatattgaaaccagatttccctttctccacccaggcttctctgatctggtaaaggccatcatatatgtatatcttaccagttgaacaagtcaagtctttcacagtgcgaacgactctaatgggattacccctatgcaaactcctctccagtgcctcgtgccgaa

SEQ ID NO: 27515 - DNA, 341 bp, Triticum aestivum
  Clone ID: PAT_TA_27515
accaaaaaagattttcgccccgctttatatataaagcaaagatccacatcacccgatacaaacgcacgccatcaccacacacacccaaggcaagaaacaaaggcgctgagcgcagcaaaaccacccctagcactactaccacgaagagacgaagccgcatacgacgaaccgtgaactttaaggcggcgccttcaggaaggaaacgacaccggaatgccgtgatccgaggatcagagtttcccccggagccgcacgacgagcggtgagagccgcgacgacgccttcaagaagggaatgagttcgccccggcgccggtctgtcgcaagaaagagcaggttttc

SEQ ID NO: 27516 - DNA, 1347 bp, Triticum aestivum
  unsure (1)..(1347): unsure at all n locations
  Clone ID: PAT_TA_27516
gcaaaaaaattggccacctcatgtcattaggaagcatgtttgaaatcttgatgaatggttctacaacgcgataatcaggacacatgatgcaaattaattccccatgctgacagtgaatctcaatgccagctcgattctcgattgttgaacaagaaatatagatctacactggaccactaattagctgttatccgtggccgccgtaaggaggggctgtttcttggtatcatcccacttgttcaatcttttatgcgcctcctcaacctctttgctccaatcggttctgatggtgacccacagtagaatggccgtctgcatagtcgttcctccaatcatgccactccaaatgccctttacgccgaggttgaagacaaaaccgagaacaatgccaaggggtacgcctacgatgtagtaacaaccaatgttcacgtatgcaacaaactgttgccatccacatccaacagcaacacctgacagtacaggctgtatgccattgagaatgagcgtgatggcaaggagcgggcagagatccgccaccgcgtcggaaactatttcactctctgtgaacaagtagctgatgtggttgcgtaggcagagcatgacaatggcaaagacaacagagatggcagcacagagcgaagtgacgacccacactgagaaaaatgctgacttggggttgccggcaccgagctcattgctcactcttacacttgcggcggcgttgaaacctactgagatcatgaacacccaaccggagattgtcatacacacagagagggaatccagggcgatctcggggtcggggagcaagccggcaatgagcaccaggatctgaaagtaccatgtctcaaggcacagcatcacagccgacgcggcggagagcttgagaaaggccggcaagccggagaaggcctgccaggtgaacccggtccacgtctcccggcaggccgggctcacggcgatgtacgcgaactgcgccgcgacgatgacccaccagctcaggctgagcaccagcgaggcgccgagcaggccgaggccggccttgtagacgacgacccagctgagcagcaggtgcagcacgagcgtgcccgtggagatgtaggcgctgggcaggacgatgctctgcgcctgcatgaacttctggatcgggaagttgatggcgtacgcgaagatctgagggatgaggccgtagacgaagatcgacgcggcgtgggcgatctccggtgacttgccccagtagcacgaggagcggctccgagaaggcgtagatcgcggcgagcggtatgccggtgcagcagaggagcacggcggagcgttgcaggtaggttccgagcatgtcgnctttng

SEQ ID NO: 27517 - DNA, 959 bp, Triticum aestivum
  unsure (1)..(959): unsure at all n locations
  Clone ID: PAT_TA_27517
tcaagaaatccctttgccgtatcctcttggtttgggcccatttgctggttggccctggattccttgggtccgcttcctgccgcgacttgccttcctcatggttcactcgctgtgggttgcgttacgttctgggtggttgcgtttcccattagtagtgctcatcataacacctctattaagatgcttaaagaagttgtttttccgaggtttggagtccctagatatcttaatgactgatggtggttcacattttattcgtggcgcttttcgtaaaatgcttgctaagtatgatgttaatcatagaattgcatctccgtatcaccccacagtctagtggtcaagtagagttgagtaatagagagctcaaattaattttgcaaaagactgttaatagatctagaaagaattggtccaagaaacttgatgatgcactatgggcctatagaactgcatataagaatcctatgggtatgtctccgtataaaatggtttatggaaaagcatgtcacttacctcttgacctagaacataacgcatagtgcgctattaaagacctcccctgcgatttcaaacttgcccgtgagaggaggttatttgacattagctcacttgatgaatggagaacccaagcctatgagaatgcccaattgtttaaagaaaaagttaaaagatggcatgacaaaaggatacaaaagcgtgagtttaatgtaggtgactatgtattgctatacaactctcgtttaagattttttgcaggaaaacttctctctaaatgggaaggtcctttcgttatcgaggaggtctaccggtccggtgccataaaaatcaacaacttcgaaggcacaaatccgaaggtggtgaacggtcaaggtatccatctcctcagctctccttatcccataactagtgatgccccggtcccggaggatantaaggaacttcanaagttcaacnccaaa

SEQ ID NO: 27518 - DNA, 867 bp, Triticum aestivum
  Clone ID: PAT_TA_27518
cctcaaatgtaagaacaattaaaattcagcattgacagaatccaaacttatttaaccaccgtcatatggaggggttcctattacttatactagacagaaacatcggagataatgatccatacaagtcactcacgctaaccactacgaaaccaaccaatcatatcacatcaggaagcatgggcaaccactctccggtacaaactagcgcgtggccgtcagaagaaaacgtacaacgatcggcgaaactttccaacatcgaatcatcggcggatcagaagacggcgagcttgaggaggacgccagcggtggccgcgagaatggggccgacctccatgcggtagccgccggacccggacggggtggtaggcggcgtcccggccgcgggggtaccggggctggagtcgccggctgtgacggcgagcttcatgccggcggcgcagtgggtgccgatggtgcagatgtagtagttcgcgccggctttgagggtcatggtggtggcgccgctgttgtcaccgttggtgttgctggagcaggcgtcgtactcgctcttggtgacttcggtcactgtgtgggcctggctggcgtagttgaacacgagcttgtctccaactgcgaaggtcttgccgctggcccaggtggcgtagttggcgccggtcgtccacccttgcccgtctccgacggtgaacgttgccgcagaggccgccgcagcgcaacccaggacaacaaggagcgcgatcagaggggaggcgcaggccatggtcgaagtgaaggctcggagctagctcaagagagggaatcaaacgtgtggagtagacgaaggagctaagcttggctatcgatcgatgtctctcgcgccgtaggcacgag

SEQ ID NO: 27519 - DNA, 1074 bp, Triticum aestivum
  Clone ID: PAT_TA_27519
atcaacccatatttatttggatgatactaggtggcaaaatcatatacatagacaatgacataacttcagtcccttcaacaagcacagaagagagagagaacaaaataacaagtgatagatcatcaaagtaatcatccattaataggtgcatacaagtgtcagcattcatatacaattccagagtttgaacctttactcctcagtcagataagacatgctccctctgtttatttttactccgcacattaggtttgtcttaagtcaaaccttcaaaagtttggccaagtttctgctaatatgtggagtgaaaaggaacagcatgagtacttcactgtttttgcttgttcatccaagactatcatctttttcttctgcatgtgcctctgtcatccaccaggcaaaaccactcacaatcacagggcctaaacaacagccccccataaaatgtatgcagtccataattctttgtgatcttgaatgcaaacgccagtaagggtcattgggtttaggcttgactagtacagaaagatgacgcgccagccgaccattttgccggactatcttgccactaacgttgtagctcctttcaaggccagaaatcatattgtacagctcctctttcttcccatcgatttgcactaggcggcttgcaacatctttttgttgctcagctgtgaggccattcgtgttgatgagccgtggcaggaaccgctgttgatcctctgccgcagtcgatgagatgccgaacccctgtggtcttcggagcgtgaatcgaccaagtgtcctcgccgcatatcgaagtgccaccatccctgattctgctttctcttgaacctagcgtggcctgcctatgcaccgggcggcggcgttgatgtgtgggagcggcggctgctccagggagggaggcgctgctgggatcctataccggcggcgtggcagcgcggaggcttcggcccgcggcggagggccggcagtagtggcggcggctaggaaccctagcagtcgcgctcggaaagaaggcctctcttgtcgggagggaggcgctctcttcgttcgtgggctagggaatagtgc

SEQ ID NO: 27520 - DNA, 667 bp, Triticum aestivum
  Clone ID: PAT_TA_27520
ggaaaataaataaaaatttattatttatttctttttggtataaataatgcctttgtttctttttcttttctttttttacaactttgaaccttcagtaacaaaagtacaacctttatcaatgttggtttttaattcaggagaagcatcgatcaacaacttcttttcatattcattaacgtttccaatgggtaaaatcttttcaacaccactaggacccaattcaacgggaacagagaaatattcaagttcactaccaaccaaatccttgacagattgggcaccagatttatcagcatccaattgaacataggtacattcaacaatgcccttctttccagcaaaggcagcctcaatgatgtttgtagcgaaacgagcaccagcataagccatggaaagagtggcagaaccagcaccatccttggccttgacaacttcatcaccaccaaattgaatacgatgagttaccttctcaatttgttcttggtttaacttttcaatgccggggacctgtgagagtaaaggtaagatggttacgccgctgtgaccaccaatgacgggaacacgaagtgaattaggttcaccaccaattaattcggatacaaaggtggatgcacgaacaatatcaagtgttgttacaccaaagattcttttggggtcataaacattg

SEQ ID NO: 27521 - DNA, 500 bp, Triticum aestivum
  Clone ID: PAT_TA_27521
gatagaaaaggagaaccatgtattgataagaacgaaaaatcctcttgggctgcagtacaaggcacacaacccaatgtttattagtgtcatagctataaagaattacaagctcaacacatgatagaccacaccatatcaacttaacacgagaaagattattacacattacacaatcatcattcagattgggacataaactccctcgtaacaccatgtcagcttccttttgctccttgtactgcagcccaacactgcaaacacttggccccagcttccatctgctcacatcgcaaccagttgacttgatacacaagaacagcaccccgagtggccgccggcgcccgctcccgcttccttgctcgagcgtcgccggcgcgggaagtcaggacgggcaacgcttttccggcgacgcgcgcctggcctccatctccctcctcccccgccatccacgcgccaagagctagccctccactccgagatggctcgacggtgagaaatcg

SEQ ID NO: 27522 - DNA, 525 bp, Triticum aestivum
  Clone ID: PAT_TA_27522
ggacgataaccaacggactcttcatctattgatgcacataaccatagacacaaccacatacgaaagttcattcatttgtggcatggcatcaataagatgcaaccacacgagagttttatttggtagtacaacaagttacttgggagaaggtctaggcatagatgatagattcatcagcatcgatctagtgatcttcgatcctgaagtactccagcacgtcctccctgctagcagcggcggtgtcgtacgccgccatgaactccctgaacacgaactccctgaacttggccgggttctcctcgctcaccatctccggcgccgggccgataaggcagtccatcttgggcatgatgagcgtcgccacggacatcctggccacggcggagttggtgagggcgcggtgctccacgctcgccagcacgccgttggtgacgatctccatctggtgcccgaagttgatgatgaaggcgccgggcaccgggcggacgaggatccaccgcccgcggtacctggcctggagcccgg

SEQ ID NO: 27523 - DNA, 1272 bp, Triticum aestivum
  Clone ID: PAT_TA_27523
taggggccttttttttttttttttttgggaccaaacaatttctattgatgcacatgaactttagcacaaccacatacgaaggttcattcattcctcccctcccgtcttcgacttgcggccccgcgcgtcgtttatttggtacatcaaccaggtggttaggaaaaagtctaggcatagatgtagttcatcagcatcgatctagtgttgtggatcctgaagtactcaagcacgtcctcccggttagcagcggcggtgtcgtacgccgccatgaactccctgaacacaaactccctgaacttggccggattctcctcgctcaccatctccggcgccgggccgataaggcagtccatcttgggcatgatgagcgtcgccacggacatcctcgccacggcggagttggtgagggcgcggtgctccacgctcgccagcacgccgttggtgacgatctccatctggtgcccgaagttgatgatgaaggcgccggggaccgggcggacgaggagccaccgcccgcggtacctcgcctggagcccggcgacgtcgccctgggagagcacggtgaggaggtggcggtcgcagtgcgggagcaggcccagcgtgacgctcgggtccgggcacggtgggtagtagttgacgttcatctgggtgtccccgccgctcaggtctcccgcaaagaagcccccgtcgaggccaagcccctcggcgatgagcaggagcagcgtctgcgccagctcgtgcacctgtgcggagaactcggcgagggagctccggaagctctccggcttggccggccagtggccgacgagctcgtcggagaccgggtggcagcggagcttgaggtagtcacgccagtagcgcgtctggttccggtcgtaggaggtgctggaggcgacgcggaagggcttgctctggtcgtcggagcagtagggcagcttctcctccgccggcatcgcgaagaactccgccgacgccttccggaacgcccgcaccgcgtcctccgccacgccatggttcaccacctggaagaagccgaactccttgccggccttgatgatctcctcggctacaaggcggcggcggcccgcgtcggagaggtaggcacgctggaggtcgacgaccgggagcgcgacgtcggagctgggcgcgtcgtggagcagggcggcacgcttctccggcgggaagacgtacttgtccggcacggaggcgtgcagcgggcggttggacagcagctccatacctgaccctgatcgatagatgaatcaatgcggc

SEQ ID NO: 27524 - DNA, 590 bp, Triticum aestivum
  Clone ID: PAT_TA_27524
acccttattttttttttaaagacgtccaagcacaccgacgaccaacttttattagcaccctagctagattacaccgtacgaagcaaaatacttgtaacaaggaaatggcatgcacaacgcatgtagaccttactagattaggaataaggaaagcggtacacgaaacaggagaggagcactacgaagatcacgagggtggtcgtggtgcgcggctaactagccagctgatccatcggtcgatgaagtggctagcacggtttcttgcagaagcacttcctttcgaagtcgtggaacttgcacttgccccaagggaagccctcggtgttgcagacgtgttcgcagttgtcgtccctccagcacgctccgcggtacctgtggctctgcgactcgcagtgcctgtgcccgtgcctcgcctccgccaccctcatcgtccccatctctgtggcgacgaggagaagaaggaccaagaggacggacgcaaccatacggcgagaggtcgacgccatttgctctgcttgcgtagaatgtctaccttatgattctggtggtttcgcaacggatgctgtagtccaacttaaggttacagtgat

SEQ ID NO: 27525 - DNA, 551 bp, Triticum aestivum
  Clone ID: PAT_TA_27525
atcgtggatacatataaaatataaaaccgataggccttttgctttatttattttcaccaaatttaggagtacaataccttccttttacaaaatacaatagccgttacattagaaatgtgaaaagttattcaaccttattccttgacgtgtcgtcccttcaatcacatcacacacaaatgcatgcatgtaattatatatcggtataaatagcagtatggtagatagattcaccgtgcgtcagtcaagcgtcggccaaatcgacgaggagaggtgtgtcgttgtctcctttctccacggtgaaggtcttgagcatctgcttcccggtcgccgtgcaggtaacctcaacgacgtacctctcgtagaagcccctgaacttgaagttgccatcgccgtcgacgttcccgcgggcgtccgtcttccactcgttctggagattgaggaacatctggccggcctcattgacggtgccgtcggcgtcgacgagccaggaggctcttccactccctcctggggggctgaggggaaaacctgggccgggcctccgttggacg

SEQ ID NO: 27526 - DNA, 1354 bp, Triticum aestivum
  unsure (1)..(1354): unsure at all n locations
  Clone ID: PAT_TA_27526
natttcatgactagttcagccaggtgctgctggccgctgctcccgtgctttcctttcaccccttactcttcggtacgtgacattaaaagtgggcaaaagagtttccaccttatcccagcctcccatgactcgagtgtgaagcagtttggcaaggatgtttgtcgcatcataaacttaagcgacgtattgtccacatgttctacatctagctgtttgctctggctagcaagccagaaaaggatggaacaggtgagttcctcatttgctcttgagcttgctttatctcctcgggatctatgttctccatcatcttgggcataacgacgaccattaggaccataaaaccgaccatcatacccatggggctcttcaagagggacaaattgacacacggtaccctccgtgcactatattaatcaaataattcatggctagttcagcccaggtgtttcacaaggttttccattacaaacctattacatcttagaatacagtagaatacattaaaagtgggcaaacgagtttccaccttgtcccagcctcccatggaacaacattctgactcgagtgtgaagcagttcggaacggatgtttgtcgcatcataaacttaaaccacatattgccggcatgttctacatctagctgtttgctctggctagcaagccagaaaaggatggaacaggtgagttcctcatttgctcttgagcttgctttatctcctcgggatctatgttctccatcatcttgggcataacgacgaccattaggaccataaaaccgaccatcatacccatggggctcttcaaaagggacaaaatgttgaaaggctccctcggctcatagtattgctcttctttcagaggttccaaaacaagctcatttagaactcttctgttttcagtcaatgctgcttgaatgtgccctggattcctggcactgatgtccactcgaactggtgaaaagaagtaaccaagtgaggagacttcgatcaaatgtgtcccagcaggcacgttgtggaaggcaaagtagccgtctggcctggcgaatgtaactttctgaccaccattaagtatcactttcgtgtttgatgtcttggctggaagaccaaagccccttgcagcgtcgatcttgatgcggccggcgatggtgtatccctcgacggatccgggctggtccgcggccgcggggccgaggcacgccgcgaggacggcggcgaggacgaggagggcgcggagggggctcatcgtcgccgcggcggaggtcgtcgccgtgtcgtcgtcgcgcgagcacgagagcttctcttctcttctctcctctccaccgtctgctgtgccgtccccctgccccgcgggc

SEQ ID NO: 27527 - DNA, 727 bp, Triticum aestivum
  unsure (1)..(727): unsure at all n locations
  Clone ID: PAT_TA_27527
tggcntcctgcagctgggttcctgcaagatcataccgnaggacctgcacttcgtgctgcggatgcgacacatgttcgagtacctgagcctggagagccactcgaacaaggcgaggaggatggagaacccccacggcgccaagttcaagaggagcttcacgttgccggcgaggatgagctcgtccaactcgccgtccccgtcggtgtcggcgtcgacggggccggcgccgcggcggccccagcgccgcgcgagggcggcccctgcgcagcccgcgggcagcgccttctcggacctcctgcgcacgctcgcgtcgtcgctcggccgcgcaacgcatgcatgcatgcggcgatcgatcatccttacgacgacaaacgtacgggctttacgttttcttgttcccactttttgctttgttccaaccaaccaggctatgttcaagctcttttagcggcaggtttggagtttgcttcggcttaattagatcatggaaaccttcttttttgcaccttctagctgtgtacgtgtctcgatcgatctgggcgtagtagctagctagcttgtagtgcaagaactgatacatgcatgcatgcagagatgggcatgagtttgctgccatgatggctggcaagctatatggtgcaatgatggtgatgtacaataatatgcaacacccaatactacgctccttttccttccgaaaaaaaaaaaaaaaaaaaaaaaaaaaaaa

SEQ ID NO: 27528 - DNA, 1043 bp, Triticum aestivum
  Clone ID: PAT_TA_27528
gaggttactaatgtaatgtttatttgtctttctatgtgaaaaattgataaatgacaaccaaaaataggaagtaataagatgatgaagatatttgtaatgaagcagcagcagtgtttccaactggatcaggcgtgttacctgtactgaattgaaagtttctaaaataagttgaggtattaacaggtgtagcataactacttgatcctccaccaaaaaaggtactaaacatcatactggatacaccaagattttgattgctacggaattgaatattttgttgattgatcatcaatgaaccatcttgccatacttccaagataccattcgaattggatccagagtttagcttgacataaatttcaatttgtgaccatttcatagttgagaagcgaattacacctcgagaaaaggaggtaccataatcactgttgcagatcacttgttttgagttacaaagtgaatctgacgtgggtatataagcataggcttctccagcaccgccttctctccacatcattcgtactgaaaaacaattctcaccagtcgctttctcacctccagaacagccttgagatatatctccaccaaatatgcctggtaacttccctcctttaacccaatcaaagttagaatcgaatgccacatcatacttcaagagagctgtgttatattctgtttgtccattgggtaatgaatagaactctgcaccacctttaacacccccgttcccatttttagttccaacaggggcatatgaaccagcaggatagttcactttaaggacagtatttgttgaattggtatcaatgggatcgtttgtgaaactgatatcttcaggagcataaaagtttgatgcaaaccaattagaggtgatgtaactcactgcatctgaggttattggtgcagaaggcattgttgctgaccatgtttgagttaaatttaaagaagaagctctagttgaaacatctgcactgacaaacgctgtgatggacaataaactgatacaaatcaaatgcatttaatcttttgcccctttatttaat

SEQ ID NO: 27529 - DNA, 533 bp, Triticum aestivum
  Clone ID: PAT_TA_27529
gaccaaaacataacccccccaatttcacgattaccattacaaagcaaatcccacaatttttaaaaagttttcaagaaactcaacatttgatagttaccgacacaacattggaaagtcgactggcaaccattaagcaaagcaaaaattctggcgaccgcataaattttaacatacagggggattaacacttgacctttttcaacccatgtgcaaagtacaggaaagttggatcaacagctccctccttggagtaggggaacaccacgccgccattattatgcatgcttttgccaacaaaaaactgaagggccttgagcttgctaaaaaaatactttgggggaaactcaacattttttttgaaaacatttagggcatcccctttaaacttggcaaaaagggtcttgatgtaacgcttcatgtgaaaaataaactggtttttggaaaaaacagggtgctcctgaaaacggaaggggtcaacaatgtcaaccacctttacgggctggtcattgacacccttattattaccaccaccc

SEQ ID NO: 27530 - DNA, 1324 bp, Triticum aestivum
  Clone ID: PAT_TA_27530
gtcgacgggcggctgctctatagtgacatatacagatatgctcatgtagttatgtgtgctgcagatttattggatctgtggactgtggccaaccattttgattctaactgaacattttcgagctactggttgctggtgctatttttcttgcagctggccatgctcggctgcgggtggttgctggtataccgctcactccaccgtccactccactccagtccagtgcagcgagtgtgcgcgagcaagcagccaagaagcacacacaggagatggcaatggtgaccaccggcctcgtggccgtggcgtcgctcctcctgctgctcgcgggcggcgcgtcggcggcgacgctggcgctgtacaacaagtgcggcgagacggtgtggccgggcatccagccgggcgccggcaaggagatcctggcgcggggcgggctgcagctgctccccaaccgcgccacctccatccgcctccccgccggctggtcgggccgcgtgtggggccggcagggctgccgcttcgacgccgcgggccgcggcaagtgcgccacgggcgactgcggcggcgccctctactgcaacggcgccggcggcgagcccccggccacgctggccgagatcacgctgggcgcgtccgccgcggcgctcgacttctacgacgtgagcctggtggacggctacaacgtggccatcgacatgcggccctaccacgggtccggcgccaactgcctccccgccggctgcgtcagcgacctcaacagcgtctgccccgcgggcctcgccgtccgcggcggcaacagggtcgtggggtgccgcagcgcatgcgccgccttcggcagcgccgagtactgctgcacggggcagttcggcgggccgcagcagtgcaagccgacgacctactcgcggctgttcaagcgggcctgccccaaggcctactcctacgcgtatgatgacaagacctccatcctcacctgcgccgccggcacctcctacgtcgtcaccttctgcccccaccgccgctagaccatgccaccgccacggatcctgatccaaacctgaagacagtgatagtatgttgattcagttgaggcattgttgctgtgctgttcttaggttcttgctgtcgttgcgtcctgtgttagtgccgggatcgataataacaccagtggtattcgtagtcgtagtagtagcagtgaactgaaccagtgatggtttgtggtaggcctggatgggtataatagtatggttgggtataatggcagtatatgcagatcgaactacttatatttttcaaaaaaaaaaaaaaaaaaaaaattcgagactagttc

SEQ ID NO: 27531 - DNA, 1386 bp, Triticum aestivum
  Clone ID: PAT_TA_27531
agcagtttttaactttgcacaagacgggcacgagttgactcgtttgtataaaaatcaaggtgtagtcagtttccctgttacaatatacaaaaaggaccgatgatatcgcaccatgttgggctgcgcaaattgcggatacaagagatgccctgccatcggcttagtatgtgcttcctgtacagctggggcagtgcgtggtgctggtcctcaacttaagatcatcatcaacagccatcagctccatgtcatgggctataggagtcccagggatttgagctgctggacgtgctcagcagggagtggcggcggagaccaatctgcacgttcaccgtcaacatcttccacaacgtactcctttgttagcattcgtttcgcaaggatgtggtagtgtctttgccagatcctctgccctaccatagttgccaccagaacgctatagaagatgccgacaaccgtgaacagcccgagcacgattactcccatgatgaggagcaatggtaaccctgcttcccccctcccaagcaaccaccacactccccggctgtagttgcacagacttcaaagcatgtggtgcagtcagtccacatgcaaagtgtgcctgccaagatggcaatctgctcccatccctggctggcagcagcagaggcggagttctcgacgacgctgagccgccaagtcactccgtactcttcggttcataacacgttatgaagcatcctgataacccgagtaaagcaaaaaacaacaaagctccacatatataataaaaagtaacttcattatcaaaaccccaggccgtcctcagccaatattgctggtagccatcaataaaatgtaccaaataagccaatgcagagataacaaactggactagagcaaagatgaataatatatctctagtaacaaagaaacgaaactttagcgttcgccatttcctgtcggtgtggacatgaaccctcaagtaataaggagccttgcaggtggtgcaatgagaaaatgcaaacccctccttgaccgctctccagtggtcgaggcagtcgcggtgcacgtacttggatgtccccttgcacttgcagggcgcgatgaagtctctcccgtcggtctcgaggcagatccggcactggagctggtccccggcaccggcctcgaggtcgatctccggggatgtcggcgggataagcgacgaggccgccgaggacaaccccctggccttctcctcctccatcaaccaccgcagcgcaccgccggcagccctcccaacgagcgtacgcttctagaaccttccaggatagtccattcggaaccctaacctctcctctctttttttccctcgcctcgatggattcgacgggacgaggagggtgcgaggaggaggttggagtccag

SEQ ID NO: 27532 - DNA, 368 bp, Triticum aestivum
  Clone ID: PAT_TA_27532
ttttttttttttttttttttttttttttttttttggaacacgcatacaacactcatgatttgccgaaaataaaaattttacatgagagaagtgttagctggattggaagaggaaatgttgaattcgattgtaggaatggaagacttcaccattgctatagctgtcaatggggttctgcttagtaacagtgctatttacattttaaagtaaaaaaaggggaaattaccatcattattattatcattgaaaagaaatcttttccctttatcttttacttttattattctttactaagcagatccatctattgtctacttcaataaataattcttgctcttttcctaataaaaaaaaaaaaaaaaaaaagg

SEQ ID NO: 27533 - DNA, 614 bp, Triticum aestivum
  unsure (1)..(614): unsure at all n locations
  Clone ID: PAT_TA_27533
gggtgatgcagtcattaaaaaaatctattgaagtttttaaagccttatttagtaacacgcttatcttgctgttagttgccttcatgctcgcagcaggtgttttggcagacccagcatgtgataaaaatgctatattgaagataattcctcaaagaaaacttggtagaaatgtatcaggaaaatttgaaattgtggctggaaagcaagcaaacttgatatctgaaagagcccttaaaagtgcctttgaattatgcttttttgacagaggctcatgcaatgttcataagagcagtatgactttcgaatgctatacaaatactgaatggagaagtgttagctggattggaagaggaaatgttgaattcgattgtaggaatggaagacttcaccattgctatagctgtcaatggggttctgcttagtaacagtgctatttacattttaaagtaaaaaaaggggaaattaccatcattattattatcattgaaaagaaatcttttccctttatcttttacttttattattctttactaagcagatccatctattgtctacttcaataaataattcttgctcttttcctaattaagaatanaaaaaaaaaaaaagggcgg

SEQ ID NO: 27534 - DNA, 710 bp, Triticum aestivum
  Clone ID: PAT_TA_27534
accggtccgtcgtgtacgtgagcctgggaagcctcgccgtgatcacccacgagcagttcactgagttcctctctggtctggcagccaccgggtacgccttcctctgggtgctccggccgggcatggtccagatgaccagctccgcgctcctcggagcaaccgtcgaggcagtgggaggcggcagggggcgcgtcgtcgagtgggctcctcagcgggacgtgttgcgtcatcgggcggtgggttgcttcctgacacacgccggatggaactcgacgctggagtgcgccgtcgagggcgtgccgatggtgtgctggcccttcttcgccgaccagcagaccaacagccgcttcgtggacgccgtgtggaggacggggctggatatgaaggacgtctgcgacagaggcgtcgtggagaggacggtgagggaggtcatgatttccgacgagatcaaggaggcggcccaagccatggcgcaacagttgaggctggatgtcgcggaggtggggtcgtcgtcgttcgagttcgagcggctcgtccgcttcatcagggagctcaacatcagttcctcgatctctgatgaagcccagaaagaatgaagactagtacaggctggtaacaatttgccagacacttttttggactaaaataatcgcattgtttagtgccaccatcaattatggagatatatacagagcaatcatgtttttctt

SEQ ID NO: 27535 - DNA, 870 bp, Triticum aestivum
  Clone ID: PAT_TA_27535
gccccccctgcgagcccccccccccctcccctcccccccgccgatccatcagcctccattgctagccagccacccccattactctccacctagcccaacaacaaccaccgccgccgctgccatggcttccaacaacaccaccgacgcggcctccggcgacggcaacgccatcacgaccctcatcacgctcccggccaaggccaacggcgccggcgtcgaggcggaggacatcaccgtcatcacgctcgccggcgagggggaggagggcgcggaggaggaggaggtgcacgtggccgcctacaccaacagcaactaccaggcggtgaacaactcggtgctcctcgccggcagctgcgccgtcagggaccccggcgtgcacgtcgtcatcgtggagcacgtcgacgacatccgcgactgcgacggcgacgagatcttcgaggacggtgaggtggccaagtgaggccatctatcatcgagcggtgcggatgacgatgttctgcttctactcaatttggtcggtcggtcggtcggtggcttcttcgggccgtctggagatgttgcgtactaccctgagtcgtttggagtttatttaatttctatatgagcgtttgatcatgcacatgtatgcatatgtttatgtattgcatttatatgtatacgtcctcctagtgtctgcaaacatatttgtatgttatgtaagtttgcctcatgtgcggttctgaaatatttgccactcctagcttttaaggtccatgaccggacccatgtgtaatgtgtttgaagccaatctgtttcaggctcactttttatgtaactgctttcgagcatcaatttaacagcaatgctatggattaccggtgattcttatgc

SEQ ID NO: 27536 - DNA, 1121 bp, Triticum aestivum
  Clone ID: PAT_TA_27536
ttcttccgtttttttttttgttttttttttttttttttacggtgtccacgccttggaacttttttgcattgattcttcatcaaaacattaacatccgagtagaagaaagttctcaacaggaagatttatactgaccaaaggccagagttctgaacgcgctcttctcaacagaaaactttatactgtccaatgaccagagttctgaacccgctcaacattacaaagaaagaaagaacatacaggtgagcaatggtgaaaattttggacccctgattggctactttacttggtagaagtaaactcatacatggccccctcagaatcaagttgaccaaataagtattggatcatggttcttgcagtgatatgcaaagatcactctataagccagggtgtttgaactgattcccattgagcaagctcaccctctttgaaccataatccgatttctcgcttgccgttatcagggctgtcacttccgtggacgacattccttcctgtttgaactgcaagatcaccccttatggtccctggctcagcttgaagggggttagtagctccgatcagtttgcgagctgacgcaacaacaccatcaccctcccaggccatgcagactacaggaccagaagttatgtagtcgattaaattgggaaagaaaggtctctccttcagatccttgtaatgttcctgagccaagtctttggggcactgaaaaaacttcagccccttcagcaaaaagcccttcttctcgaagcgagaaataatctctccaaccagaccacgctgaacaccgtcaggtttgatcataatgtaggtctgctcaacctccgaggaggcgacgatgcggttgggggtggcgcgagctaccctggttgccctctggttgcaccccgccgtgctcagcccagtgacgccgacggccggaacgttgcggagctcctgtggccggcggcggcgagggaaggccccgttctggcgactgctgccatggcgtccatctcctcctcagctccgtacagacgcgacaaggaagcccatctcctcctcagctccgtacagacgcgacaaggaagcacgcgcacttttggattaggagagaagatgcccggaacccggccggc

SEQ ID NO: 27537 - DNA, 574 bp, Triticum aestivum
  Clone ID: PAT_TA_27537
cgtgaacactagtgatcatgctcatggaaacaatgtagaatttttcctgaagattctcacaaaaataattatccccttgtacaattccattgtattataaaaataatgtgccaagatttgcctttatgatgagtagatttcttgttggtatgtgcgtgcaaaaacaaaaactttggctgtagtgcgtgattttacatttttttattggaacgtcgaaagtttctgaaactttttgcacagtcttgctatacaaatttttttcttttgtcctaatttttcataatttttggagtactataagtatggttaatgttcatattactacagactgtcctgtttaagacagattctgtttttgatgcattgttttgcatgttttgatgaaactatcgatttttatcggtggtataagccatgtaaaagttatattacaatatctacaatgcaaaaacaaaatatgaattgctttgcaacaagtacttagagtaagtgatttgcttaatatactaaccgatcttacagagatttctgttgagttttgagtggatgaagtgatcaaagatctaagaggctt

SEQ ID NO: 27538 - DNA, 516 bp, Triticum aestivum
  Clone ID: PAT_TA_27538
cccgggtcatccacgcgtcggaaaagaaagcatatactgcggtccttgaccaaagttcaatgccaaactttaattcatcttgggtcaattacaaaggtgcatggcttactaccatctgtgttatagttgtactgaaagctttatttacacttataccttttataacaccggaagcaagctggacgttaacaaaccttgcttttaattgtggtcattatattatgtttcattgggtccagggtattccatttgaaaataatcaaggagcatatgatggactgacactatgggaacaaattgacggcggtgttcagttcacagcaactcgtaaattcttaactgctgtgcctattgttttgtttttattaagcacacattatacacactatgacgtttttctttttggtatcaattttacagcacttttagttgttttagttgcgaaattacctatgatgcatcgagttcgagtatttggaattaataaacttgactatgatatggattgatgtttgt

SEQ ID NO: 27539 - DNA, 759 bp, Triticum aestivum
  Clone ID: PAT_TA_27539
ccaccgtcgccaccgccccgccgcagatcgagaccggcccgcccgctcccggaccggacgcccccgaatccccgaattcccgatcaaatctccccgcggccggagccgattccgatagaattcgagccccgatccgcgggccccgggcaggcgctgcgtcggaatcggccgaattcgggtgatccggaggcgcatggagggaggccccgcggatccgagctagggttaccgccggcgcctgcggcagcggtgatctggtgatggtgcagcgcggcgccgggaggactcggccaggagggatcggcggctgggaagatgcgcggctatgcatgggcggcgccaaggctgcggtgaggggtgcggcgaccggcgtcctttcgtccggcacatgtggccggcaactcgcgtagaggcagctccaccaccggcaaagggaccagcctcccctcctcctcctcctccccgctcgtctcttccaccgctccggacgacctcttatccacccgcaccgacgactcccccggcggcaccccacaagcaggaggccgccgattcaccccgtccgccctcagcagactccttcctaaaggtgcctcatactttggtggatataccactttgggatttgctaagctcagccagattttagaccaaattcagtttgctgctcaagtcatcatccgatggccatcatttctgcttcgaaaacttaatctatggaaagaaactagaaatttgttgcctggttgagaggttacc

SEQ ID NO: 27540 - DNA, 798 bp, Triticum aestivum
  unsure (1)..(798): unsure at all n locations
  Clone ID: PAT_TA_27540
tccagtttggtgtaacgcccaacccacccggccttctcctaccaaccaagcagctccaaacaccaacaaatccacagaaaccgagatctctctctctctctctctcttcgacccgacggatccctggttgttgttgtagctgggcaatggcgaccgacgcgatcctggagaccatcaagcctcggcggagcccgtggctggaggacctcccggtgacgaatgggggcgcagcgaagggcggcaaggtggacctgtccgggatgcgccggcgcgtgtcgtcgtccttgtcactgagcctccagccgctgtcctcgtcgtcgtccgcggcgttccggcgcgcgcggtcgatgccgtcgatcaaggcgctggcggcggcgggcgcggtgcggcagtggtgggagtgggggctcggttgggtgacgcgcggtcaatcccgtcgatcaaggggcctgcggcggcgggcgcggtgcggcagtgttggcagtggccactggctcggcacgctccggcacggcctctacgggcacgcgcccacgggatgagcgccctcgcgggcgccctgcgcgggctccgctgccgcggcacgcgcccgcgcgtctccttcgccccacgcgccggggtgcgccgccnnnttggccgcgacggccgcccgctcggnnncgtcgccgcgcnnnncttcnnnnacgactccgtcagctacgctcagaacttcgncacggcgacgtcgacgccanntgctagctgctgcgccggcgcacgcatggantnnnacgccgccaatcgtgccganngtgannn

SEQ ID NO: 27541 - DNA, 641 bp, Triticum aestivum
  Clone ID: PAT_TA_27541
cccagcgtccggtcattgtcaacattcgagccactggcatttgcggttccgacgttcactactggacacacggtcgtatcggccactttgtgtgtgaaaagccgatggttttaggccacgaatcttcgggtgtggtggtgtcggtggccgacgatgtgacgtctctcaaggtaggggatcgtgtcgctctcgagcccggtgtgccctgtcgcgtatgtgaaatgtgcaaattgggaatgtataacctctgtccggacatggcctttgcggccacacctccttatgatggcacgctctgcaactattataaacatgctgctgatttctgctacaaattacctgatcatatttcgcttgaggaaggcgccttgatcgagccgttgtcggtcggtattcacgcgtcaagaagaggtggtgtcaaactaagtgatcgcgtgtttgtgtttggtgctggtccagtgggtctcttgacggctgctgcggccaaggcagccggtgcttctcacgtcacgatcgcagatagagatcctgcaagactggcttttgctaaagaatattgtgcggatgaaaccatccatctgacaggagcacgacgattggatcaagacagtaatgattttgctaaagaagaagccgaaaag

SEQ ID NO: 27542 - DNA, 763 bp, Triticum aestivum
  Clone ID: PAT_TA_27542
cgcaatcatcatcgtgatgtcaaacccgaagagttgaaccgttcagtgcacccaagagtaaagtatctcacttcttgcctacctccaaacgtatcgttcaattctcaaataagggtgcggagcctaagccaagtgatcgtgtggtttacgtggatggtacatttgacttgtttcatattgggcatattgaatttttgaaacgcgcaaaagaacaaggtgattttcttgtggttggtgtccatgatgatcaaactgtcaatgcgatcaaaggaattaattatcctttgatgaatttacatgaacgtgctttaagtgtgcttgcttgccgttatgtagacgaggtcattatcggggcaccctatagcgtaactgaagatatcttgaataaagaatataatgtatcagtggtcattcatggtactacgtcttctgaattagacattgatggagctgatccttatgaattgcccaagagtcgtggtatttatagagaaatttcaagtcctaatagcacattaacaactcaaggcattattgatcgtattattgaaaacagattcatgtttgaagaaagacaaaagagaaagaacgcaaaggctattttagaagctcaaaaggaagaagaagagaaaaagcagcagaatattaaaaaacaaagcttgatcactgcatagagagaaagagatagcaattttatgtatcatatgaaccactgttaaatattgtatgttttaataataataaagacttgaaatgtacctac

SEQ ID NO: 27543 - DNA, 561 bp, Triticum aestivum
  unsure (1)..(561): unsure at all n locations
  Clone ID: PAT_TA_27543
ccgggtcgacaagaagaattctgcaatgcctgtgaggatgaccgagtgttagaatgcgagattcactaaaccatatacaaggtaatgatttgggtgcgggatggattgatcaccataccgacttactcttattattcgccttgctatatgggatggtaaatctgagtgacttacctatagtagagagacgacgatcaaaaccttgtttaagccttagaatggtataggtattttttttcccttgtacaaggcagcttttgccaaccgtaggttatacggtgaggatcaacccagacccatttcctgcaggagaaaccataaatggttgaccaccatgagatatcaatagttgtttagtattgggcgccagacccatcagctaagaagaccatcctcggaaaaaccttaccaagatgaaaggacagaagtattgaggtaaagtatgccactaccggaaaaccccgagaagggttatcctgangatctgagaagaccgacacanccatgaataaggtggngtatacgatttgggtggaacctatcatgcttcnagggggnggn

SEQ ID NO: 27544 - DNA, 638 bp, Triticum aestivum
  Clone ID: PAT_TA_27544
caaacacatatgctcaatgccgtcgccgcaacgtcgagctgggagtggggacaaggttgcaatgtctggagccggaatcagcccggcaggaagctcagctctattattctgctctctggagaaggtttgccagcttgccaattacttgaaaagtgttggtgtcggcaagggggatgctgtaatcatctacctaccgatgctgctggagcttcccattgccatgcttgcatgtgcccgtatcggtgctgtccattcggttgtgtttgctggcttctctgcggattcgctggcccaaaggatcgttgattgcaagcctaagcttgtgctcacttgcaatgccgtgaaaagggggcccaagcccattcttctcaaagatatagtggatgcttctctggtggaaagtgagaagaatggattctctgtaggtatttgtttgacatacgaaaaccagtcagtaatgaagaggcaggacacaaaatggcaaacaggaagggatgtttggtggcaggatgttgtgaccaatttccctaccaagtgcgatgtggaatgggtagatgcagaggatccactgtttctgttgtacacgagtggcagcaccggaaaaccaaagggtgttatgcatacttctgggggctata

SEQ ID NO: 27545 - DNA, 437 bp, Triticum aestivum
  Clone ID: PAT_TA_27545
ccgggtcgactccttctatggatgaacgtattgctggcctagtccagtcatcgctacaaacggctgctacagcagtatgttactttcctatgatatcatgatggcttgcttatattaatgtcaacatttactggaaaaatattcatgctcataacatgctgttcttaagattgactacattaagagcccttttttatttgactccaacttgatatgatgttgtaggccgcctggtgtccctacccttactaatcccagaaactttcaaagaaaagcggcctggcagttgcaggtggttcctggctcgatgagacgatggcgaatgattgatgatcgttcgcacgtaccggacgtgttgtttcgcggaatacaatcacaatcactgcaaggtctttgagcaagattccagcttctctgggccttcaagaatttttgac

SEQ ID NO: 27546 - DNA, 448 bp, Triticum aestivum
  Clone ID: PAT_TA_27546
attccctggtcgactccttgtatggctggacatattgctagcctactccagtcatcgctacaatcggctgttacagcagtatgttactttcctatgatatcatgatggcttgcttatattactctcaacatttactgaaaaaatattcatgctcataacatgcttttcttaagattgactccaacttgatatgatgttgtaggcctcttggtgcccctacccttcctaatcccagaacctttcaaagtaaagtggcatggcagttgcaggtggttactggctcgatcagacaacggcgaacgattgatgatcgttctcacgtaccggacgtgttgtttcgcggaatacaatcatagtcactgcaaaggtctttgagcaggatcctagcttctttgggccttcaggaatttttgactggaggctggtaagtagccttggtacacgctct

SEQ ID NO: 27547 - DNA, 1098 bp, Triticum aestivum
  Clone ID: PAT_TA_27547
attataagctgtgaatgatacagtgcctttaggcccaacttctgcataaaaagatggaattccgtcatgagatttttgtgcatagcctgggtgctgctttcttttaattgattctgattggaataatccagcttgttcatcagaggaagaaaagagattggattgttcaaacaattggcttgttgaatcattcacagcggccaaagcattcattaatcttgatttttcaaagcgaggttcaacacgagaagctaaataaaagtccccaggtccttttaatttaacaaaatcgggggtaccaagtataaagttacgaattgagtgaataatataattggcatattgtaatttaggttgaagcgaaggactgtcagcaatgtttcgaatcacttcatatcttctaagctgtgatcgaggtgaaggaactaagcgatggttgatttttggttgagtagggttcgtactcttatcccacataatcaaattacgagggttggcttgatattcctctcctgctgcaagtgaaatacgatagattccaccataatgactgatggccaatgtacctggtccacttactgtatgaactagtttattcacaactcctgtttgttgatgatgaacgcctaaatctagagttactttttctgtctttgctaaaaaggcatcccgacgtaacatgtattttgcactgcttttgagttgaatgattgatatttctcctaaacgttgaggtgctaataaaatatcaccagctacatttttggtataatatttttgataaaacatggcatcacccactaattttctaccaacagcttttacagtcgttgtatcaagtgataacttggataaaatttttgtagaacaagccaaagttgaaccagtagcagcagtaatctctgaatcaggtggaagcttgactaacaaagcagaacctggtccagaagacacggtttcaaatatagcttctttttgattctcggtgctagtgtcttttccaacttgagatatggtatctgtaggtccatttacgacatgctgaaaagactttaaagaacgatcaactgtttcagtcttttgtgttggttaaaagca

SEQ ID NO: 27548 - DNA, 1458 bp, Triticum aestivum
  Clone ID: PAT_TA_27548
gcggcgcgtcgacgaacgagctaagaacaaccaccctgcacgtagcactccatggcgctcaccggcgattacaagctcatcagcaccgacgacatgctccaaggccacgccgagctctgcatccacgcctacggcttcgtcaagtccatggcgctcaaatgcgccatagagctcggcattcccggcgccatccacggccacggcggcggcgccacgctcggcgagctggccactattatcgcgctccctccctccaggctcccgcgcctgcgccgtctcatgcgcgtgctcaccgtctcgggcgtcttctccgtccaaaaccagcagccggacgaccccgcgggctgcgccgccgtcgtctacgggctcactgcagcctcccgcctccttgtcggcgacggcgaaagcatcgtcggggctgccccgcctcgttccctcatggtcgacccgaacctcaccgcgccgttctccggcatgagcgcgtggttcatggacgacgagcagccgcgctccttcttcgagatgcaccacggcgaggacatgtgggaaatggccgcgcgggacgccgccctgagcaggacgataggcgacggcatgaccgacgacagccggttcgtcgtggaggtgctcctgagggagggccgcgcgcgtgacgtcttctccggggtgcgctcgatggtcgacgtcggcggcggcaccggcaccatcgcaaaggccatcgcggcagctttcccgcacgttgagtgcagcgtcctggatctcccacacgtcgtcgcggaggcccccgccggcggagaggtgcgattcatcgagggcgatatgttcgagcacattcccccggccgacgctgttctgctcaagtcagtgatgcacgattggcgtgacgacgagtgcgtcaagatactacgaaggtgcaaagaggcaatcccttccagagaagctggagggaaggtgataatcataaacatggtggttggttctgaaaagtcgaagggtaatagtactaaaaaaggaggaggcacaagcattgtacgatcctcttcctcatggtttttgagggaggtgaacgagaagagcatgagtgggagaagatccttcttggaagccggattcagtggctacagtatcatacctatgctaggaattaggtccatcatcgaggtctatccttaactaaacaacaaacttgctatgcaaccttggtaaataatgttcaaacctcgtaagctaattattgcctgtattaatttatgctttatatatgtatgtgcacagcatgtacgccctgcttgtccttcaagtttgtgcgggtttaatttgctcaaattagctggctttcatgtttgggtcagagatgaatgtagtcatttatgtatcttggagtgtatgcaagttactccaaattgtttttcatgggtgtaataaagatgtgttgataataaaaaaaaaaaaaaaaaa

SEQ ID NO: 27549 - DNA, 871 bp, Triticum aestivum
  unsure (1)..(871): unsure at all n locations
  Clone ID: PAT_TA_27549
ggtcgacggcttccctgagtagacggggggtggaagaactaaaatagaggattctgaaaaaaaaaaggaccttcgaaatccaattttatgtgtagcgcaaaggagttgcgattccttcttattcctatagaacatctagtaacaagaatatgaaatcgtaaatagcgaaaaattcttgtcttgcgcggtctaagtctaaggaaataaaaaaaattcgcttatacaatttcatctacatcgaatttatatatcagaatagcggatagaggcatcattaaaggagtcaggtctacttactttatgcttctttccaattttatggtggatttgataagaaccctttttgctttcttgataaataatcgacaaaaaaagcgttttttttatataacctgcttgttttattataattataacaagtcctatatggaaatgcccgctaaagagaaaatctatttgattgtctctcggccaatatcgatttttagaaagaaaaaacaagaattttcttctttttttattaacattaagaaaaaagaatataactaaaatggaattggcaatataatttttatagacttttgaaagaaaaaaaaggggtttttttgcaaccattatttcttatttcttgcctatatcatatcacggaaacctttcgctttggaacgtgggagagatggctgagtgggactaaagccggcggattgctaatccgttgtacaatttttttgtaccgaagggttccgaatccctctcctttcccgctccctttggatnatttggggacttttcgaaattgggaaaagaaattctggaccccccggattttcccaaaagatnaaatgtacggaaacaaatccaataaaggaaa

SEQ ID NO: 27550 - DNA, 650 bp, Triticum aestivum
  unsure (1)..(650): unsure at all n locations
  Clone ID: PAT_TA_27550
ttttttttttttttctgcctcttttgggcgttatgggtaccgggcccccccccgggttgtctgtctgtctctgctcttgattcaggttccagaaatgcttattgatttgcatttgcaatgtgttacagaacatgtacattttgccagttcaagatccacgggctacattacattgtagggacggatgtatccaagaaaagactcggaaaaacacaagaaagaagagcggaagaaatatacatctggtccctgaacagtgcgcatcactcgctgctggatcatctgcgatcgttcagacaaaacacacacacacacacacgccgtgctatatgctgctagtatcttacaaacaattcggtttattgccgcgtccaagaagatatagttcgtagccatcgatcgagccatgtctaccttcactttcggcacgaatgtcggcgtccgaatccatgcgtgcgccggcgcagcagctagcatctggcgtcgacgtcgccgttgtcgaagttctgagcgtagctgacggagtcgtacctgaagtcctgcgccgcgacgcccccgagcgggcggccgtcgcggccgaggaggcggcgcacctcgggggcgggcttggtaaaaaacgtngccggagcgtggccncggnaaggggaacc

SEQ ID NO: 27551 - DNA, 779 bp, Triticum aestivum
  unsure (1)..(779): unsure at all n locations
  Clone ID: PAT_TA_27551
ttttttttttttgtgatatcttacaggggtnttccggtccttattgacccgccacgcgccctgttagccctcaggcctgcatcatcccgaacgtagcatgccaatattcaagaccgtgtaaggcactaaaggggtctcgctccgtaaacgctctcatgtgcgtttacagatgaagtacagaacaggcaaacgtaaaaggaaacacaaaacgtacatactgtacaacgaatgcaacacgcagatacgttgatcgctctgccagttgacccatttcaatcaaggacacatactgtaccttgtcggcaccagcatgagtggcgtcttctttcggaaagtcagcgcccctgcctcctccatgttgacatcctcacagctcaccccatcagggagctcccagttgaagcagtagagcatattggccaagatgaactcgacgttggccacgcccatggccaatcccgggcagatccgtcgtcccgacccaaacggcaaaagctcgaaatgcgccccattgaagtcaacatccttgtcctgaaacctttccgggcgaaattcctccggatcatcattccacgcgccggggtccctaccgatagcccatgcgttcacgatgatctttgtcttggctgggatgtcgtatcctgcgacctgaatccgccccgtggtctccctcgggacgagcaacgtcgccgggggatgcagccgcagcgtctccttcaccaccatcttcaggtatttgagcttgggcatgtcgtcgtgctgcaggagctctgtcttgc

SEQ ID NO: 27552 - DNA, 529 bp, Triticum aestivum
  Clone ID: PAT_TA_27552
gcggtatatcttttgggctttctttttattattagtttgataaaacaacggtaacaaaatcaatataattaatacgaccatctttaccaatttcaacttcctttaaaagttcatccaattcttcattagttaatttctcaccaaggttagtcaagacgtaacgtaattcaccagcagagatataaccatcaccttccttatcaaaaacttggaagccttgaataaattcttgagaggaacctgcgggcttgaaaccatcaggtcgcgtgaggatagataaaaatgtaccaaaatcaatatcaaattcttggctttcagggatatttttagatttagcagtttctttaatcagttcacgcacttcagcctcagtagggttttgaccaagacctcttaaaaggtcaccaaggttagcggaggaaacagtgctgttaccctttttgtcatataaagagaaggcttccttccattcatcaagttgttcctgagttggtgctttgctcccgaacggcgtgggtcgtacccggga

SEQ ID NO: 27553 - DNA, 788 bp, Triticum aestivum
  unsure (1)..(788): unsure at all n locations
  Clone ID: PAT_TA_27553
nttgnaacgcaggtttccgtagantttaacgacgncantagcggcgtatagatcatntaggcgaattggtacggccccccctttttgtgaaggtatttagattcaagatatgggtacaatcaatgtacactttccgaagtgctacaaatttagtacagtgccggccttngtttccttnatctgtcgctgatactgcaaaagagaggtaccgctcttcatcatggtctaaatggtcggcacatgctntacatcgaggagcagacagcgcgcaataatccgcaccgttatccgaacaaattgggggtaacaatcactccatatgcacagcacgacacaatcacatgagacccaagagcgccctactacacgccacctgggttggaaaatcagaggggagcccgctcctttttcccgtcgcacctcccgatttcccggcccacgcaccgccctaattcaatgtacagtccggccatttccggccccgcctaaggtacctccagcgacgacacgggcagatcgcccgccgaataaacgggcctttgggacgccgccattttcggggggatctccgccacgaccagcctcgacagcagcagcccggggacgagcgccgacgccatgagcatcgggaacaccccgctccagctcttggcggaaatgtaacccgtcaggagcggcccgacggccgcgccgatggaccccgtgccgtcgatgatcgccgtcacgggggccaacgcgcccaagttgccgttgagcgagctgtgcgtgccgaggtcggcggacacggg

SEQ ID NO: 27554 - DNA, 708 bp, Triticum aestivum
  unsure (1)..(708): unsure at all n locations
  Clone ID: PAT_TA_27554
acggtctaaaatcccgggtcgacagacagatatagagacagaaatatggggagataatgagttcgaataagaaagtgttgcacttgcttcatgggctaaaagcattccctgatgcaaatgtgagcaccaatgacatcattctgcaagaccaaactccctatgttttgaagctacacaacagaagtccagaagacagggcttgttttgagataactggccaagcaccaagttcctctggctcagattctgctggtttccctacttggctcaaggtttctccagcagctggtataatctgccctggacagacggtagaggtcactttgcagcatggagacctgcgtggaacatcatggaataatttgtctggggctaaccaagaaaaggcagcacagttatcggtgaaaataactggggcgtgttctaccgttgccaaatgttacggagtacgtgtgcaatgccagaagggcccnancacatttcctttcaaaaggttctaaatttgttgattgcttttctattgttcggtgtgacatgtgagcttaacttttagattgattgaagtgtgtatanaanatgttgttgnaaatgttcctatttgtggtaccgaagtacaanaccaaggctttgtactcttganttccaggacattttgtnaggaaattattaanttattacgnccactgagagganatccanttcttacac

SEQ ID NO: 27555 - DNA, 676 bp, Triticum aestivum
  Clone ID: PAT_TA_27555
gaaggagtttatcaacaaatatgataactttttgtttgattgcgatggtgttttgtgggaaggcaataatatgtttgaaggagtagcagaatctatgaaactcttgcgtgaaaaaggcaaacatgtttgttttgttaccaacaacagtacaaagtctcgcgcatcttatttaaagaagtttgaaggacttggtattaaagcagaattgggagaagtcttttcttctgcttttgctactgccacttatttgaagaatgtattaaagtttccaacagataagaaggtttatattattggtatgcaaggtatcaaagaagaactggctttagaaggcatcaagagctgtggtgcagaagaagacagcggattgtttgataatgatctaattcctgatgacccagaagttggagcagtaattgtcggacttgatacacaagtgaactatagaaaatacgcaaagggattcgcttatttaactagaaatcctggttgttacttccttttgacaaatgaagacagcacattccctcagcatggctccttttatcctggtgctggtgctattgctgctcctttgatcactgcccttaatagacgccctgatgctgtattgggtaaacctgctttaatatgttgaagctattcttgcagaatataaatagatcctaaaaagaca

SEQ ID NO: 27556 - DNA, 1564 bp, Triticum aestivum
  unsure (1)..(1564): unsure at all n locations
  Clone ID: PAT_TA_27556
cgcccgccgtcgatcgtttctgcaatccaaagaccaacggaactccctggaacaagaaaggcccaggagaaacgaatcgatactaaagaaacctcccgagcgagctccctagactatccacgcctcgcgatgggcaggcagtcctaggtcctcccccgtgcacaccaccaacagtgtcgtgggcgaccccggaaggaagagacgcagggagagcgaagaaactgttggaacgctcaactctattggcatgtttctctgggctagcgagaatgccgcagctgtcgtcgcgccggcaggggctggccccacccctggcggcgaaagagaggaagcaggatggtccgcagtggactgtgctgcggtcgtcggggacgctgcggggcgagggctccggtagcttggccccggggtggtctggccgcggcgagaagggcagcaaccaggactgctccctcgcccggcagggattcggatgccaggatgacaccatcttctgcgccatctttgccgggcaaagcgagaggggccactacgtctcaacgggcggccgtcactagggggggcggacgctgcccggccgatggcaggaggatgtcccgctggcggcgctcgtcgacggcgagaagaagctcggcgactgccagttcgacctctggaggcagtcctacctggccgccgccgctgccgtcgacgaagagctccgccgcagccgccgtctcgacgcggtcaacagtggctccacggcgctgtcgatcgtcaagaagggtgacacgatggtgatcgcgaacgtgggcgactcccgagccgtcctgggcaccacgtcggacgacggcagcatcgccgccgtccagctcaccgtcgacttcaaacccaacctgcctcaggagaaggcgcgcatcgtgcagtgcaagggccgcgtgcactgccacgaggacgagcccggcgtgcaccgggtgtggctgcccgaccgggaggcgccggggctggccatgtcgcgcgcgttcggcgactactgcgtcaaggactacggcgtcatctcggcgccggaggtgacgcagaggaggatcaccgcccgggaccagttcgtcatcctggccaccgacggggtttgggacgtggtctccaacgacgaggcggtgcagatcgtggctgacacgccggagagggagaaggcggcgaagcggctcgtccagtgcgccgtccgcgcctggaggcgcaagcggcggggctacgccgtcgatgattgctcggcgatctgcctcttcctccacccgccgccatcgtagacggacgcgaattgccccgtgtagcaccagggacgagaaagagccaaatgcccgatcattgctgggttgactgtgtgctggcctcgcgggctgacgtcgtcggcggacgccacgccagcccacgactccgggcggcagcgccgccggcgtgcccgacgccggcaccctggcccggcctttccgctcccgcgggcgagtccgaatcgcagggcagaangcgcgcatcatgcantgcgaagaagactagacgacagtcaanctccgtcgacctgtcatcg

SEQ ID NO: 27557 - DNA, 623 bp, Triticum aestivum
  unsure (1)..(623): unsure at all n locations
  Clone ID: PAT_TA_27557
ttccagaccgacatgatcgcactctcatgttgccacaccatgcggcgcggtggactgcagcttcttccagtccaggatcggcaccgacccgaccatggactcgggcttcgccgcgcagcgccggggcacctgcaccagcagccagagctccgccttcctcgacccgacgccgctgggattcgacaactcctactacaaaaacctgcagggcggcaggggcctcctgggctccgaccaggtgctgtacacggacccgaggtcacggggcaccgtcaactactacgcgtccaaccaaggcaccttcttctacgacttcaccgtcgccatgaccaagctcggcagggtaggggtcaagacggcggccgacggcgagatacgccgcgactgccggtacacgaattagttacagagtcgccgccggcaggttgctcagttgctcacacagttcaaaaaaaaaactgtcaatgacgcaactacaataagatcgatcatgttgttatacatgcatgtggctttgattcttggagcccatgatgtcttcaactaatcgactgtaagatgtccttgactggtcgaattgtgatgccttgccgttggaaaaaaaaaannnaaaaaanaaaaan

SEQ ID NO: 27558 - DNA, 545 bp, Triticum aestivum
  Clone ID: PAT_TA_27558
cacgcgtccgagctgttcaaacatttggtcgcaagaaaactgccactgctgttgcccactgtaagcgtggacgtggtctcatccgtatcaacggttctcctcttgaacttcttgaacccgagatcttgaaattcaaggtttatgaagttatccttctcttgggtgaagaacgttttgctaacgttgacatccgtatccgtactcacggtggtggtcacgtctctcaagtgtacgctatccgtcaagctcttgccaaggccattgttgccttttaccaaaaatacgttgatgaagctgccaagaaggaaatcaaggaaatccttgttcaatatgaccgtactcttcttgttgctgatcctcgtcgttgtgaacccaagaagtttgccggtcctggtgctcgtgctcgttaccaaaaatcttaccgttaaaaagtggaaacaaaaaggagtggagtggaaaagtgtttggttgttcaagtctttttatctgtttttatacagcctctcttctcttttgattgttaaataaaatatttttttttgatt

SEQ ID NO: 27559 - DNA, 879 bp, Triticum aestivum
  Clone ID: PAT_TA_27559
cttttaaagagacatttaaagcctcatcagcaagtagcattgacactatatccaattacagtacttgttgcatttctatattcaacactcggcaacccacccaatacttattatgctcataaacacaacgttctcaatctctattttgtaaaaatcggttgggtgtgggtgacacttgtgtatttcagctacctttactttgttcgttcgagatatctacaagatacccagcgatttataaagggatccctgcgttacctccttgtcactctgtattggtacattatgactcagtggttactgggaccgagcatgattgatcgaatctatgtgttgaccggcggtcaatgcagatcgttaacggagcaagcagatggctcagataagttgacaagtgtagtatcacaacaggtctgtcgacacttgggaggtcattgggctggtggtcatgatgtctctggccactgtgtgcttttgatccatgccagtctttttctttgggaagagctttgttggatgttttattcctttgattctttgtctctactcaaaaaacaggacaaaactcaatatcgatccgtaatggctgtcctgacgattgctgtcatttggtggtttaggctcttccagccaggtatttattttcatggccattatgaactcttgtttggcccattttttggcactttgggttgggtcattttgtatgttggggtgtttcctagaatccctgagataggtaatccttttccttccctcgtcaatcatttatagggggtatttcatcctttataagggccaaatccccagcgggataaagctgggttttatatcaccttttgtcaataaatgaaattccctctctttaaaactgcccgc

SEQ ID NO: 27560 - DNA, 806 bp, Triticum aestivum
  Clone ID: PAT_TA_27560
cactcccgccccaccccaccgacagcagcaatgaaggccctcgccggcgacggcaacgcctcagcgccgcttctgcaggcgaccaagatcagcatccccgcctcctccacgggcggggccgcggaggccgcgctcctcgggaagggccggtacaaggtgtgggccctcgccgccatcgcgctcctcgcgctctggtccatgtcggccgcctctgtctccctccgctggtcagccggtgacctagccgccgctgtctcaggggacctcgacgcgccactccgcgacgatctcgattccctcgagatggaggaaagggagaaattagttggtcggatgtgggacatgtacacacgcaccagcgatgaggtacgccttccacggttctggcaggaagcattcgaggctgcatacgaggagcttgctggtgatgatatgcaggtccgcgacacggccatctctgagattgctcgaatgtcagcccacagacttgagcttgagcagcctatgaatgcgaaccaggaagagggcaaggtgagcatcatgaataatgatcatggcagagtgaagcagtagtttcaaaactgaagatctatcacggtcgcggacaacaaatatcagcagctgaacttgaagctttgatgtaaactgaaattttctgtatgggagggccagcgctgcctgaccatgatgcactcccgtatcttccccgctggtcagcgttgtgtcatacgtgtattattcataggtcctgattagaaatgtcatgccatttgctatatgtagtaacgtggaatagaggaagtcta

SEQ ID NO: 27561 - DNA, 895 bp, Triticum aestivum
  Clone ID: PAT_TA_27561
gaaacgaggcaaaagatttgccattttcattgattaagaagaagagagttgcccggttaattaaaggaaaaccaggcgaaaacctagatacaaaccccacaaggggcacacgcggacgacctggctacaacaacgccaaacagtcgaccgcaacgtcgaggacatggcagctccgattttgctgacgagcttcagagaagaaagttgcaagcctcgcaccgacctagtctagcgcaacatccagagagcaccgcacgctgaaaaccgccctcatggagtcatcgttgccgcagcggcctcgcctcccacagcgccgacttctctgtcacagtcagaaaccagcattggcacacccattggcgcaccggaccttcgacattaaaaggacaagccgcgactcggctttgctcgccaccatcgtcgttgccacacgcgtcgcaacgccaaacaaacctcaccgccagtcgggcacctgctgaccgcgatgccgtgcacgtccagcctgcaggaagcacaaaagggaccaagatctccaaaacggcgcccccaagagggaaaccgacgttcgagacgacgacgccgcttgatccaacaaggatcctgactttcgcccagagatcttgacccgagagatgaggatgcacagatcaccacgatggcgcctccaaggaagaaagcgacgcccacgagcgccgccgccgacggccagctagcaccggccaagctttcgcccgaatcagcaacaccaccactcccacgcggtcgaccgacgccaaccagcacctccactgacccgcgcacccctgcgcagcaaccgcgccatcgccactcagggaccaccaccacgcctcgctgccgagctgcgagagacgagcctccctccaccaagcacacc

SEQ ID NO: 27562 - DNA, 584 bp, Triticum aestivum
  Clone ID: PAT_TA_27562
cggtcgcgtccgcccacgcgtccggatacagtcaagattgtacctaatgattttaaaaaggacaatctgaatgctgtgactgatgtattgaatgaaaaatatgcaaacaaggttgttcaagaagttggccattgtatatgtgttcatgatattttgaatgtgactgaaggttttattttatatttggacggttgtagttatgttagagtgacatttagacttgttgtgtttagaccctttgtaggagaaattttggttggaaaaatcaagagttcgtcaccagcaggtgtggttgtcactttgggattttttgatgacattttaattccaggaggagcgcttcaaccaggatcaaaatttgatccagcagaacaagtttgggtttggaattatgaaggcgagaagatgtttatggatattgaagaacctattcgagttagagtattgcgtgaacaatatacagataccacaccaaccaatcatccacaaaaaggaagaaataacgatgctgcagatgatcttgctgcaaattcaactaaaataccaccttattctattacttgtacaatacaagaagatggttt

SEQ ID NO: 27563 - DNA, 884 bp, Triticum aestivum
  unsure (1)..(884): unsure at all n locations
  Clone ID: PAT_TA_27563
ttttacacgacgaaaaaaaagaaaaaagaaaagattttcctaatagcaatcataggaagtttggaaatatttgctaggtgtacagcaagcagatcgatcaaaggaactaagtttgagtaaagcaagaagagaagaatatgaacagatggataaagaagatgtggagatagcgaaaaggataagaggagaggtattgagatatcaaagaagagtatcagaagtactccaagaaaaggaatatgtcaattcttttgtgaatatcatcttggcttatttgaatagtaaccgtgatgtagaatataaccctagctttgtatcactcgttgcaccttttatttatgtgatggataccgaatgtgatgcttatttctgctttgaaaggatcatgcaagcactcgaggaatacaattcaagttttagtttaaaagaacaagtagcttattttatgacactctttcgatgtagtttacctgaattatgtaattattttgaagatgaagaagtcgaaatacatgattggtcaacctcttggttacaaaacttgctatcaaaagaaatgaggtttgaaaacttggttcggctgtgggattgttattttgccatgtcggatccactgtcatttcatccgtttgtttgtctttccattttattgagtgtgaaagaagcagttgaagatttggaacagtctgaaattaggaccatgttacatcgattacctttattaaatatggaaatgattatagcagacgcatataaaatggaaagacaaacaaacggatgaaatgacagaaagacaaatgaatgaaaatggtgaagtgtagtatgaatccctctctctttttttttatacaaaataaatataaatgtagtaatagtaaaaanaa

SEQ ID NO: 27564 - DNA, 923 bp, Triticum aestivum
  Clone ID: PAT_TA_27564
atagttaaataggtattaattcacttgtatcaccttgaatcaaatatgattctaaattacgataaataccatttatattatttttttcaacaatttcaccatttaaatatcttgttttagttgtatatgtaaatggtacatccattgatgctttagaaacgattatagatacagttcctttttttcttggaggtatagaaacttccaattgcccattaatttctttttctattgttttagatcctccccattcatgagaataactagtagatatttgaacttcaaaattagcacttgctataaatggaacacctgcttcaaaactcattccaacagttaattcaacaccagcagtattgttccacgtgcctgtttctgattttttataagcatatcctattcttgatatggtgttactatcataagaattattttctacgttttgccttgcagcaatctcaggtgaggtttgtttaattaccgctttagatatatcatatttaatattaataatttcttttttaataataggctcttcaattttaaatttacaatatctatcaatactgtttctatctgcttttaaattatgcataccatttttatcatatactgctacaaaattaccattagaacttttaatagcataaatattttcaccttcattttctaattttattaattcaaaaacacttgcgttaccacctgaatgtatatattgattagaatgtgtatatacataatttccattatcaagttttaatttaattttatttgttccattaatttgttcataaacatttaaataacaatattgatctatttcatcttttgtaaattttatttcttctggtccatttcttgaagcaaattttttagaatgatttttatcataaattgttatatatttcgcggacgctggg

SEQ ID NO: 27565 - DNA, 707 bp, Triticum aestivum
  Clone ID: PAT_TA_27565
cctttttaacttttgccgagcagcttttgtctttttacgcttttgccaagcaggcaaaatatgtagccagtggagtagctgttctatttgccttcaaatttgtaacatgtcctcgtccatctctccagtgtggtggcgcccgtgcctctccagctctgcaaggagcgaaggagaggggttgagtagcaggctgcacccttcttgacgaagaaagaacgacgggcgaccgactgcgctcctcgcacgcgcctctgcacctgccgctactgggtcgagcaggttcagcacgcctccccacggccaacaataatggccggagcaaccgccgccctgccgcatccctccctcctctctgttccgtctcctcccatggctctctctcacttctttctctctcgcagagcaccacgagaacccgctgccgccgccacgagctcgccggatccgcagccacatgcggcctagcgaccggatccgcgcccggattcacccaaccaccggtctcactaacctgcacccgatccagatccaggcgccgccgacggccactggacaacgaagagaaggaaggcgaggtggaggggccagtaacctggtggcacgggagagaataggagaaggatgagcggcggcggcggccatgcgctggagatcgaggaggagaagagaaacgaagagaaagtggagttgcgtggggctcgagaacg

SEQ ID NO: 27566 - DNA, 1067 bp, Triticum aestivum
  Clone ID: PAT_TA_27566
aggatagataatttattattaaaaaaacattattttgtacgcttgtaaatcttatccataaattcaacaaagacctgtttcttaacaccaacagattcatccaatttttcaataagagcagacaactcattgtaagatttttcttcataagccttatagacaccttcaatatctaattcgatataaagctgcttgatcttggcttcagcttcagcatccttcttaccatagttttcatccaagaccttgcgttgttcgggattagccttatccaaggcttggttaatcaaccatgaacacttgttgtccatgatatcagtaccaatcttaccaatcacttcaggagcaccgtaacagtcaagatagtcatcttgtacttggaaatattcacccaaaggaatcaaaatatcatgagcgctcttgaaggcttcctcattcttaacgccaaccatatgcatagccaaagcgacaggaaggtagaaggaataataggctgtcttgtaaataacgatgaattgatgttttttaacagaaaacttgctcaaatcaacatgatcttcaggagcagtaataagatcacaaagttgaccaagttcagtttggaaagtaacctcatggaacaattcaatcaattcaacatagtaatcagtacccttaaagtactttttcaaaaagatatagatacaggattcaagaatgaatgcgtcattgatagcaaccataccaacgccagaagatttgtaccagcaaggctgtccacgacgagtgatggaggcatccatgatgtcatcagagaccaaaaagaaggcttgcaagaattcaatgagccaacccaagacagtggccttgaagatatcgtcttcagtaacagagtcacccttcaagatacgaacagtgtcaaccacagagataccacggttcaatttaccaccaggaacattgtactccaagttcctttttgtccattcataagcatcttcgggcatgttgtactttttaagttctgcaagaacttcatctcttaaagtagggaacacggaaagaaaagttttctgtttcttcttttg

SEQ ID NO: 27567 - DNA, 713 bp, Triticum aestivum
  Clone ID: PAT_TA_27567
tctgacatttctcttagcaacaaagattacatcgacaccattagcagaacaacgaccacagttacgaagcattaaacagcctacagcaacatatgcgtgtttctaagccttggtggccttcttgggggacttggcggccttcttgggagacttgggctccttgccctccttctccgccgtcttcttggggagcagcaccgggttgatcttggggatcacaccgccgtgcgcgatggtgacgccggccagcagctttccgagctcctcgtcgttccggacggcgagcagcaggtgccgcgggatgatgcggctcttcttgttgtccttggcggcgttcccggcgagctccagcagctcggcggcgaggtactctaggacggcggcgaggtagacgggggcgccggtgcccttccgtcaattcctttaagtttcagccttgcgaccatactccccccggaacccaaagactttgatttctcataaggtgccggcggagtcctataagcaacatccgccgatccctggtcggcatcgtttatggttgagactaggacggtatctgatcgtcttcgagcccccaactttcgttcttgattaatgaaaacatccttggcaaatgctttcgcagttgttcgtctttcataaatccaagaatttcacctctgactatgaaatacgaatgcccccgactgtccctattaatcattactccg

SEQ ID NO: 27568 - DNA, 569 bp, Triticum aestivum
  unsure (1)..(569): unsure at all n locations
  Clone ID: PAT_TA_27568
catcctatccttcnccctcctccttccccatttcnccagcggcgcagcccaccaaccacccccacccgccgtcatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctctttcaccctgagcagcttatcagtggctaggaggatgcagccaacaacttcgcccgtggtcatacgccacttggcaagggagatggtggatctgggccttgacccgtatcaggaaacttttcaaacaacctgccctgggtctccagggatttccttgtatttcaaccgcttgttggaaggtggaaactgggcttctggtcctttgggttcgctttttccctggaaccggcttttcttg

SEQ ID NO: 27569 - DNA, 836 bp, Triticum aestivum
  Clone ID: PAT_TA_27569
attacatcggcaccattagccgaacaacgaccactgttacaaagcattaaacagcctacagcaacctgtgcgtgtttctaagccttggttgccttcttgggggacttggtcgccttcttgggagacttgggctccttgccctccttctccgcggtcctcttggggaggagcaccgggttgatcttcgggatcacgccgccgtgcgcgatggtgacgccggccagcagctttccgagctcctcgtcgttcctgacggcgagcagcaggtggcgcgggatgatgcggctcttcttgttgtccttggcggcgttcccggcgagctccagacttgccctccaatggatcctcgttaagggatttagattgtactcattccaattaccagacactaatgcgcccggtattgttatttattgtcactacctccccgtgtcaggattgggtaatttgcgcgcctgctgccttccttggatgtggtagccgtttctcaggctccctctccggaatcgaaccctaattctccgtcacccgtcaccaccatggtaggcccctatcctaccatcgaaagttgatagggcagaaatttgaatgatgcgtcgccggcacgaaggccgtgcgatccgtcgagttatcatgaatcatcggatcagcgagcagagcccgcgtcagccttttatctaataaatgcgcccctcccagaagtcggggtttgttgcacgtattagctctagaattactacggttatccgagtagcacgtaccatcaaacaaactataactgatttaatgagccattcgcagtttcacagttcaaattggttcatacttgcacatgc

SEQ ID NO: 27570 - DNA, 596 bp, Triticum aestivum
  Clone ID: PAT_TA_27570
gaattcggcacgaggcgacgacatggcccgcaccaagcagacggcgaggaagtccaccggcggcaaggcgccgaggaagcagctggccaccaaggcggcccgcaagtccgccccggccaccggcggcgtcaagaagccccaccgcttccgccccggcaccgtcgcgctccgggagatccgcaagtaccagaagagcaccgagctgctcatccgcaagctccccttccagcgcctggtgagggagatcgcccaggacttcaagaccgacctccgcttccagagctccgccgtctccgcgctgcaggaggccgccgaggcgtacctggtggggctcttcgaggacaccaacctctgcgccatccacgccaagcgcgtcaccatcatgcccaaggacatccagctcgcccgccgcatccgtggagagagggcctaagctctgtgcgtcgtcgtcttagccagatttgttcagcgctgaaagtgtttgttcgtgccatggtggatgtagtatgtctgatctgatgtcaccatcttgctgtcatcagtaatttaaatgaaaatgttggctatctgttcaaaaaaaaaaaaaaaaaaaaaaa

SEQ ID NO: 27571 - DNA, 259 bp, Triticum aestivum
  Clone ID: PAT_TA_27571
tcgagcggccgcccgggcaggtactacaaggggctgggaaccagcacagctgaagaaggccgggattactttgaacatattgcccttcacaagaaggattttgtttgggcagatgacaaagaagatggtgaagctattgagttagcattcagcaagaaaaagatctctgagaggaaggattggctgaccaactatcagcctggaacttgccttgaccaacgggagaaacgcatcaagtacctcggccgcgaccacgcta

SEQ ID NO: 27572 - DNA, 554 bp, Triticum aestivum
  Clone ID: PAT_TA_27572
gcagcgctcccccctcctcaacaacctcccggcgcatctccgactccatggcccgtaccaagcagacggcgaggaagtccaccggcggcaaggcgccgaggaagcagctggccaccaaggcggcccgcaagtaccagaagagcaccgagctgctcatccgcaagctacccttccagcgcctggtgagggagatcgcccaggacttcaagaccgacctccgcttccagtcctccgccgtctccgccctgcaggaggccgccgagtcctacctcgtggggctcttcgaggacaccaacctctgcgccatccacgccaagcgcgtcaccatcatgcccaaggacatccagctcgcccgccgcatccgtggagagagggcctaagctctgtgcgtcgtcgtctgttagtcgtcgtcttagccagatgtgttcagcggtgaaattgtgcgtgtttgtagtgtctgttcgtgccatggtggatgtagtgttcctgatctgatgtcacctccttgctgtcatcagtaactgaaatgaaaatgtttgttatcaaaaaaaaaa

SEQ ID NO: 27573 - DNA, 596 bp, Triticum aestivum
  Clone ID: PAT_TA_27573
cccacgcgtccggcagccgccacctctcctctccccccaaatccatccgatcccatccgcccgctcgcggctccaagaaggaagccgcgtcaaccatgtccggccgcggcaagggcgggaaggggctgggcaagggcggcgccaagcgacaccggaaggtgctgcgcgacaacatccagggcatcaccaagccggcgatccggcggctggcgcgcaggggcggcgtgaagcgcatctcggggctcatctacgaggagacccgcggcgtgctcaagatcttccttgagaacgtcatccgcgacgccgtcacctacaccgagcacgcccgccgcaagaccgtcaccgccatggacgtcgtctacgcgctcaagcgccagggccgcaccctctacggattcggcggctagcccccctgctccgtccagtctctgctcccgctgctccatctgtcccagtgcgtgtgtagtgtgttgttcaatcgttggtgagggtttggtctgtgtagttagcgcaaggcgatgtgtatgaatgcaatggaatcagcgttggtattatactatcttttctgcatctctcgatgtgttaaaaaaaaaaaa

SEQ ID NO: 27574 - DNA, 766 bp, Triticum aestivum
  Clone ID: PAT_TA_27574
cacgaggaaaacatgttcgctgatactcaactaagtcagtccaggattaaggatgctctaatgcgcaaaaggatcactggtggagttctcgatagtaatagcttaaggacgctaaaagacaggagagatttgttttacccattttctcttatcttgcacaattcgaaaccagttgggcatcaggatcttgttggtttggtaatctcaatactgcttcttgcagatttcagcttagttttgcttacttttctccagctgtattcatattctatggtcgatgttctcttggttttgtttattctacctcttgggattttgtcgccttttcctgctggtatcaatgctttatttagtcatggaccgaggcggtcagcaggccttgctcgtgtatatgcattgtggaacataacttcactggtcaatgtcgttgtggctttcatatgtggttttgtacattataagtcgtcaaccaaaacacacccgagcctgcagccctggaacctgggaacggatgaaagcggttggtggctcttcccaaccggactcatggtgtttgaaatgcattcaaagcaaggcttgttgattggcacgttgctaatttaagaattcaagaccgtgcggtatatagcaacgacccaaacatcttttggcagtcatgacacctggtgtaactgaggtccttctggaaagctttttacaactcgattttttgtgagttgataaaaggaagagtgcgggcagcaaggcctttctttattgaccaggc

SEQ ID NO: 27575 - DNA, 606 bp, Triticum aestivum
  Clone ID: PAT_TA_27575
ttttctctctccatggccatctacttgctgagagaaattatccatagagtgcgactgcattagcgggaactcagacgatgatgcttgcgtactgcctcctgatgcagacttgtcatagcgacgaggggcccaaacacctcggtcaggcctatctctatttctggcatgtctttcaatcttctcaccaatgggtccagaaccatgcagatgcttgtcatcatagtggtttttctcagcattttcaacagtctgatcttttacagtggaacgcgagttcggagcccgtggtggcctcttatccttctcggcactaattatgtgaccttcttgctcatgttgagatgatgctattgcatggcgtccttccttgtttgaaagtatagtcttgataattctgacactggcctcatttcgctggtcttgtctagaagttgatgggggtgtatttctcggaggcggcagagactgctgcggggttgagctatcagatatattggaatcaaccctcgctcttcctttcagaaggacaattttgtcctttttaccgtcgataacctgagcagatccagatggcccaccgcttgtagcatctgaagcggacgcgtg

SEQ ID NO: 27576 - DNA, 567 bp, Triticum aestivum
  Clone ID: PAT_TA_27576
gcagcgctcccccctcctcaacaacctcccggcgcatctccgactccatggcccgtaccaagcagacggcgaggaagtccaccggcggcaaggcgccgaggaagcagctggccccggcaccgtcgcgctccgggagatccgcaagtaccagaagagcaccgagctgctcatccgcaagctacccttccagcgcctggtgagggagatcgcccaggacttcaagaccgacctccgcttccagtcctccgccgtctccgccctgcaggaggccgccgagtcctacctcgtggggctcttcgaggacaccaacctctgcgccatccacgccaagcgcgtcaccatcatgcccaaggacatccagctcgcccgccgcatccgtggagagagggcctaagctctgtgcgtcgtcgtctgttagtcgtcgtcttagccagatgtgttcagcggtgaaattgtgcgtgtttgtagtgtctgttcgtgccatggtggatgtagtgttcctgatctgatgtcacctccttgctgtcatcagtaactgaaatgaaaatgtttgttatctgttctaaa

SEQ ID NO: 27577 - DNA, 1177 bp, Triticum aestivum
  unsure (1)..(1177): unsure at all n locations
  Clone ID: PAT_TA_27577
catcaatcacagtgggctcgagatctacgaagacagcacgggggacgtgcttcccagccccagtctcgctgaagaaggtgttgaaagcatcatcacctcccccaacggtcttgtcaccgggcatctggccatcaggctgaatgccatgctcgaggcagtacgaatccgcatatcaaagccacaacaacattaaccagtgaagtaatgttccacaatgcatatacacgagcaaggcctgctgatcgccgtggtccatgactaaaaagagcatttattccagcagggaaaggcgacagtatcgcaagaggaagaacaaacagaactaagagaacgtcggccattgagtatgagtatagctggagaaaagtaagcaacactaagctgaaatctgccaggagcaatattgagattactaagccaacaagatnnngatggccaactggtttagagttgtgcaagataagagaaaacgggtacctcggccgccggcttcttgtctgccttgggggccatggctgctgcttcgggtggggttgggggctgcggtggtgtgggttgtgtgagtttgctacctcggccgaggtacagtaagtggctcaccaaggagatccatcactacagctttaaatataaccttcaaataaaactcacaagcaatgcatgcaatgctatccagtatatcaagacaccaagtctcaaggttggttgtctcatgagcaatctatcaccagatgcccacatcccgtcgattctgtctgatataggtcgagtaaacttcggaacaacgcgcgacatcgtcagtgacttgaaaccatgcgctttatcgtcatcttcatcatctaatggtttgtccttgtgcatctctacatcgatagcaacctggtcgttgttgacttttcgtgcccctcgaatctgagtgacagctgcagctgggcttactttgtcattcatttgctcaatctccgaagtgccaggcaagtttatagatctaggttggcccatcgtcctgtctcgacgaagcatccctatctgagaatccttttggctcaaagaagctttcagacaactgcactggtctccagggattccttgtcttcaacgctgttggaggtggaactggctctggccttggttctcttctgctggagcgcctctctgttgactatggaaagaagtc

SEQ ID NO: 27578 - DNA, 826 bp, Triticum aestivum
  unsure (1)..(826): unsure at all n locations
  Clone ID: PAT_TA_27578
cgtccgcccacgcgtccgggcaaatggagggttcgaccggcaactcgccggcgccgccgcccgccttccggaacaggtactggatcctccgccacggccgcagcgtccccaacgagcgcggcctcatcgtctcctccctggagaacggcacgaagccggagttcgggctggcccctcagggcgtcgagcaggcgcgctccgccggcgagtcgctccggaaggagcttgaggagatgggtgtgccggtggactctgtcaagatctgttactcgccgttctcgcggacgacggagacggccagggtggtcgccggcgtgctgggcgtcccatttgagggtcctagctgcaaggcaaccgtggaacttcgtgaacgttattttggaccatcatatgagttgctttcacacgagaagtatgcagaggtatgggcaatagatgaagcagatccctttttggccccagaaggtggggagagcgttgcagatgttgctagtagacttgcaggggtgctgtcttctgcagacgtggagtttcatggctctgctgttcttattgtcagccatggggatccattgcagatctttcaagcagtactcagcggagccaaggaaaacccatctttcctcgacgatgcatctggcctgagaaaggaaagcctggtaatttcgtccgtgttgtcacagcaccgtaagttcgcactcaacncagcagagctgcggcgagtagtgtgacccgatgcagatttgatcctgtactgctatgtcagtagacaattcatgtatctgtagatcattgngagagtcatgccccacgcanaagaaaactg

SEQ ID NO: 27579 - DNA, 676 bp, Triticum aestivum
  Clone ID: PAT_TA_27579
tttgttttaggatttgcttcttgtgtgtgtactggatggcggagtatttaaacaatttggttactatcggaagcactttaattctatggaatgaaactttgacaagcatgcatatatatgtgttcaaattttctggattatgtgatggcattctatgattctgtttaactacttaagtatatgtatgaatgtgcttgagtccatgatttatttttctgatttttgatttgacctcaagattatcttcttatttctcttgtccttctggagcagcatgatttgattcggtacaaggggttcgtcatgccaggctcctcttttctgctgcttccatgcaacggtggtggcggctgtgttgtttggcatcggctacaaaaacagccatgggcgaccgaggaaggcatgttgtctgttttcttgaaggccgttctatttgttcccagccctaactacggttgtctagctagtttggcatgttgttcatatcactatggtagtccaacgagtttggcatgttgtgagtttggcatgttcatgatgggagcaggtgccagtttgtgattgcttgtaaagcttgtaaagtattgtattacacttgtagtcattactgtgattgccactgtattacacttgtaaggatctggttgctcttatttgaaaaaaaaaaaaaaaaaac

SEQ ID NO: 27580 - DNA, 672 bp, Triticum aestivum
  Clone ID: PAT_TA_27580
gggcaaatcagagagatttctgagatttctcttagcaacaaagattacatcgacaccattagccgaacaacgaacactgttacatagcatttaacagcctacagcaaacctatgcatgtttctaagccttggtggccttcttcggggacttggtcgccttcttgggagacttgggctccttgccctccttctccgacgtcttcttggggagcagcacagggttgatcttggggatcacgccgccgtgcgcgatggtgacgccggccaacagctttccgagctcctcgtcgttccggacggcgagcagcaggtggcgcgggatgatgcggctcttcttgttgtccttggcggcgttcccggcgagctccagcagctcagcggcgaggtactcgaggacggcggcgaggtagacgggggcgccggtgccgacgcgctgggcgtagcggcccttcttgaggtagcgcccgatgcggccgacggggaactgcagcccggccttgacggaccgcgtcaccgacttcttcctagggccgccggccttgcgcccggccgcgcccttcttccccttcgctgcagcgcctgagacctccattgctaaacgacggcggttttggagaaaagctggaagggggcagagagatttggtgatggtggattgcggggtgagtcccg

SEQ ID NO: 27581 - DNA, 666 bp, Triticum aestivum
  Clone ID: PAT_TA_27581
tccggctaacttaaacacaacatcagtcatcagacaacatcatttagcataaaaccggacatagcataaaatacagtgcaagtacgcaaccatatcaaaattcctcaacataggtaacaagtaaaaaacataatcgagcaactacccagtagtagtcttaaaacatctgacagcacatcataccacaatatcttgccaaggtccggaactaatcatacggagtctaaaactggattgggtaatttgcgcgcctgctgccttccttggatgtggtagccgtttctcaggctccctctccggaatcgaaccctaattctccgtcacccgtcaccaccatggtaggcccctatcctaccatcgaaagttgatagggcagaaatttgaatgatgcgtcgccggcacgaaggccgtgcgatccgtcgagttatcatgaatcatcggatcagcgagcagagccccgcgtcagccttttatctaataaatgcgcccctcccagaagtcggggtttgttgcacgtattagctctagaattactacggttatccgagtagcacgtaccatcaaacaaactataactgatttaatgagccatttcgcagtttcacagttcaaattggttcatacttgcacatgcatggcttaatctttgagacaagcatatgaccc

SEQ ID NO: 27582 - DNA, 710 bp, Triticum aestivum
  Clone ID: PAT_TA_27582
gaggaattcggcacgagggaaagcctgccgccgagaagccgaaagctaccaccatcaggaagagggcgccggctcagagcaaagggatgaagcagaaagtgatggaggaaatactcaagcctactgatgacagcaacctcagcgcgccttctcctgagaagaaggtgcggaggatcaggtcctcccccttcaacaagaagagcggctcgcttctgcagagggcggcgggcgcttcaacgggggcagaggatgccgaggctcctccctccggcatgctctgccgagccagttgcaccgagaaggacagtaagggagaggaaggtggcgatagtctacgccgattccgggagcgacgacgttgaggagtctgaggatgaagatgcgtcggagccgagcgaatctgactactccgatgaggactagagtgctggactccttggctcagctgcccaaacagtgtgtggaattggagtgcagtgtgactggtttctaagacatttggttagctgatctgatgtgttggtgcatttcttgtgcgtcttatgtttatgttagatgtgtgtactgaggtcacaagaaggtttggaagctatgtgttgtttgcttacagtttctccatggcttctgttcctacttagtctgtgagcttgtatcgttgttcagtctatcaatactgagagtttattatatctgtcttaaaaaaaaagggg

SEQ ID NO: 27583 - DNA, 557 bp, Triticum aestivum
  Clone ID: PAT_TA_27583
cgttcccctccaaatccacccgatccaatctgcccgctcgcagctccaaggaaggaggaagccgtcgaccatgtccggccgcggcaagggcgggaaggggctgggcaagggcggcgccaagcgccaccggaaggtgctccgcgacaacatccagggcatcaccaagccggccatccgccgtctggcccgcaggggcggcgtgaagcgcatctccgggctcatctacgaggagacccgcggcgtgctcaagatcttcctggagaacgtcatccgcgacgccgtcacctacaccgagcacgcccgccgcaagaccgtcaccgccatggacgtcgtctacgccctcaagcgccagggccgcaccctctacggattcggcggctaggccccctgctccgtccagtctttgctctcccggctgttacatctgtccgagcgcgtgtgttgttcaatcgttggtgagtgtttggtctgtgtagttagtgcaaggcgatgtgtatgaatgcaatggaatcagcgttggtattaatactatcttttccgcatctctcgatgcgtta

SEQ ID NO: 27584 - DNA, 673 bp, Triticum aestivum
  Clone ID: PAT_TA_27584
agaagagagcggcggtcaaggaggcgcggtcggactcggagcactcgtgccgagcacaagcggcggcagcagcgacaagagcagcgtggtgcagagcttctcgccgtcgaccccgccggccacctccagcagctaccgcgccggcaacaagcgccgcaagggcatcccgcaccggtcgccgttcggcagcctcatcgtggagtactaagacagcacacatgcctgcccggccctgatcaacactctagcgtgctgtacacgtgacatagccaagaaggtaatggctgcgcgccctgaacggcgagccccgggccgccgtggaggggcacgagcagcaagcacatactcctactactatagcgtgtgactttcagtttgttgcagttcagttatactagctagttaccaccggtaaaacagtagcgttagactgtaagtaagtaacttgcaactccatgacgacgactaagttttgcaatgtactgctatgatagtagtaaactccttgcccccatatggttacggcactagatcgtaaatgtgcatagatgatagataaatgtatcaccgtagggaaccgtagtgtgtggagcaggaggccagcgtggtgttcatgtgtgtgcgcggcacgggccatgtacagtaataaaaaatactagtactaaaaaaaaaa

SEQ ID NO: 27585 - DNA, 764 bp, Triticum aestivum
  Clone ID: PAT_TA_27585
agcataaaaccggacatagcataaaatacagtgcaagtacgcaaccatatcaaaattcctcaacataggtaacaagtaaaaaacataatcgagcaactacccagtagtagtcttaaaacatctgacagcacatcataccacaatatcttgccaaggtccggaactaatcatacggagtctaaaactggggaggtaaagcagagaaaaccacccaatagacagacgatcctgcaggccaatcaacggtaagacttctggaacctcgcgcgggcgccgcgaccaccgaacttcttgggctcgcagcgacgggggtcggcgacgaggagggtacggtcgtagcgggcgaagatgtccttgacctccttcttggcggcctcgtcgacatacttctggtagtaggcgacgagcgccttggcgacggcctgacggatggcgtagatctgggaggtcttcccgccgccacggacgcggatcctcatgtcgatgtccttgaagcgggagcggccggcgagcatgatgggctcgaaggccttgaggcggagcatctccgggcggatcagctcgatgggggcgccgttcaccttgatgagcccgcgccctggcttggtgtacgcgacggccaccgccgtcttcttgcgcccgaagcactggaccgtgcccggcgtcgggcgggtgaggacggcagccatgcttgcggtggtgcctggtgagggcgcggcggcgacggcggcggcggcgggatcggggaggagcagcggcggcgt

SEQ ID NO: 27586 - DNA, 808 bp, Triticum aestivum
  unsure (1)..(808): unsure at all n locations
  Clone ID: PAT_TA_27586
gtgcggtttgtcctccaaatgaagggttcgaccggcaagtcgccggcggcggcgccgcccgccttccggaacaggtactggatcctccgccacggccgcagcgtccccaacgagcgcggcctcatcgtctcctccctggagaacggcacgaaaccggagttcgggctggccccgcagggcgtcgagcaggcgcgctccgccggcgagtcgctccggaaggagcttgaggagatgggtgtgccggtggactctgtcaagatccggtactcaccgttctcgcggacgacggagacggccagggtggtcgccggcgtgctgggcgtcccatttgagggtcctagctgtaaggttaccgtggaacttcgtgaacgttattttggaccatcatatgagttgctttcacacgagaagtatgcagaggtatgggcaatagatgaagcagatccatttctggccccagaaggtggggagagcgttgcagatgttgctagtagacttgcaggggtgctgtcttctgcagaagtggagtttcatggctctgctgttctaatgtcagccatggggatcaatgcagatctttcaagcagtactcaatggagccaaggaaaaccatctttccgatgaggagctggnctgaaaaagaaagctggtagtcatccgtgtttcacacaccgttagtccatcacacagagactcccaatttgtaccnaccaaattgtcgtntgcanacgnntaatcagtaaagtnatctgtgcatcaatgcatnatatantggaaatgtgtcagtancccgccncgtaaatcaata

SEQ ID NO: 27587 - DNA, 588 bp, Triticum aestivum
  Clone ID: PAT_TA_27587
gatgatggggggtcttccatggaagttgagaagaaaactaaaggaagaaaacctgctgccgagaagccgaagactaccatcaggaagagggcgccagctcagaccaaaggcatgaggcagaaagtgatggaagaaatattcaagcctactgatgacagcaccctcagcgctccttctcctgagaagaaggtgcgaaggatcagagactcccccttcaacaagaagagcggctcggttctgcacagaatggcgagctcttcaacagggacagaagatgctgaggctcctccctccggcagctctgctgagccagttgtaccgagaaggacaacaagggagaggaaggcagcagtagtctacgttgcttctgagagcgaagatgatgagtctgaggatgaagatgtgtcggaaccaagcgacgatgacgacttctccgaagatgactagactgccttggctcaaccgcccatacattgagtggggtgcagtgacttgtcttgagacatttgtttagctaatctgatgtattggtgctttgcagggtgcatctcttgtgcgtcatatgttatgttaggttgccgaaacatt

SEQ ID NO: 27588 - DNA, 1275 bp, Triticum aestivum
  Clone ID: PAT_TA_27588
agaaataggagcgcttgcattcttcatatatggagttgcgagctacacatctgatcacaaactatcatgagtatgtacaacaatcacatcaactcacctttctacttttgtatatgtacattataagttgggcacaaagaggatacattggtgtggtggaatagcagaaataagggcataattcttattcatctacatctaaggttcgttcaagcactatgtactaaccctgtgtgaataggaagtgactttggtatatggtacaatagctgaaatagtggctgagttgcttcaactatggtttaagcactaaaacctctgtgtgtggcactccatgggttggttgggatgctggtgcacgcctgagcggccaccttcaccatcgcttcaggaaggatgccggcattgcagatgtttgcaaaggaccgcatgtgcttcattccatactgcgccaacgagccacattgtgattcaaaagcacgcaccgtagacttgagacaactccagtcatcagcaagaggctcgccagctgggcgaatggtattcaggaccattggaccatccgcaaaaccaaacagaaggtttccaatcagctcgacgctgttgtcaatatgagatctatgacccatcatctcgagcaattgcttccgagcatcgtttttctcaggggagctctcagccaatttctggtactacatgcagaacaaaagaaagaaagaaatcagttagtttaaccatctttttttactgagtttatttatgaatactctatttttgtgcgtaaagtagcatgagagatttctcatgatataattaggaaccttgtgccagaaataaacaagatcagcatccctctgattaacagctcttgagaaggacggcagtgagttatcttcaacaaatgtagtgttgtcattagcaggatttgacccaatgtataagaagagatgttgatcattcagatccaaagaaccgtattgcatcacatgggaaccatagctgtatgagtcctgagctgccgttctcttcttgaccaggtcatactgctgcttgagagattcagttctcaggttgtgtacatcactgtcctccatccaagaaatgctgtacaggtcgcccaagcaggtgtcatattcggacggagggctagggtactcgccagggcaatacgttccccaactgctctcctccgcgttcgacgcggtggtcgcatagacaccgatgtcatttggcagaagcccctcaaagacgctcccagcttcgcaggcttcaaga

SEQ ID NO: 27589 - DNA, 1448 bp, Triticum aestivum
  Clone ID: PAT_TA_27589
gttttccttctagtgacagtgtgctgaccagtcttatgagccaggctgtgcaaccttggatatggcaccgtcttgtagctggattgaatgctcagttgcgtttggttcgacgtggaaatctcaaagcaacatttcttcctgtccttaattggcttgaaactcatgcggatcctgctttgggcgtgaatggtgtccgtgtcgatcttgcatggttccaagctacagcattagggtattgccaactgggtcttgttgtttacactgtcgagggagaaccagtgactgctgaacttgatggcagcccaagaattaaaatagagcagcattcgccagtgcaggacatgcttgctgatgctcaactaagccgctcaaggattaaggatgctcttatgcggaaaaggattactggtggcattctagatagtactaccttacggacacttaaagacaggagagattttctgtacccgttttctcttatcttgcacaactctaaaccagttgggcatcaggatcttgttggcttagtaatctcaatattgctcctggcggatttcagcttagtgttgcttacttttctccagctatactcatactcaatggccgacgttctcttagttctgtttgttcttcctcttgcgatactgtcgcctttccctgctggaataaatgctctttttagtcatggaccacggcgatcagcaggccttgctcgtgtatatgcattgtggaacattacttcactggttaatgttgttgtggctttgatatgcggattcgttcactataagtcgtcaaccaagagacatccaagcacacagccatggaaccttggaacggatgaaagcggctggtggctgtttccgactggactcatgttgttgaaatgcatccaagcaaggcttgttgattggcatgtgggtaatctagagatccaagaccaagcggtatacagcaaggacccgaacatattctggcagtcgtgacatctggttttaacagaggtgcttttgatagctttttacaactcgattttttgggagttgataaaagaaaaggagtggggggcagctcggcctttctttattgaccaggccaaagaagcaactacagtgctatatatgcatacttcctcgccccttgtttaatcatatgcaggcacacaacctgtgttctgtttgtatatataaaggtgttctcgatccattctttgtaggatttagacaccatagaattaaaaacaaatacccaagctaactgaagagaggggggggatgtcattttgttgtttgtgcttgttgttgctgttgtgttactgttatgaccttgccccttgtgttgagctgggcatggcatcagtgtgtaacttgagttgtatcttgactgtataaaacaagaactaacacgcctcaggttttcattaacaaatagtagcaagggttcatatc

SEQ ID NO: 27590 - DNA, 678 bp, Triticum aestivum
  Clone ID: PAT_TA_27590
cccccccttttttttgagcaagtcagagatttctgacgttcttccattaaacatgcacataacaagattaaccgacaccgctacaggaacataaccggaccactactaagaacactacgacatggaatgggtggatctaagccttggtggtcttcttgggggacttggtcgccttcttgggagacttgggctccttgccctccttctccgcggtcctcttggggagcagcaccgggttgatcttggggatcacgccgccgtgcgcgatggtgacgccgggccagcagctttccgagctcctcgtcgttccggacggcgagcagcaggtggcgcgggatgatgcggctcttcttgttgtccttggcggcgttcccggcgagctccagaagctcggcggcgaggtactcgaggacggcggcgaggtatacgggggcgccggtgccgacgcgctgggcgtagcggcccttcttgaggtagcgcccgatgcggccgacggggaactggagcccggccttgacggaccgcgtcaccgacttcttcctggggccgccggccttgcgcccggccgcgcccttcttccccttcgctgcagcgcctgaggcctccattgctgacgacggcgcttttgaagaagagctggaaaggggcagagagatttgatggtggtggactcgtgcc

SEQ ID NO: 27591 - DNA, 1056 bp, Triticum aestivum
  Clone ID: PAT_TA_27591
atgggaaaatggcagcttatagtagtatgaaatcactcagtcgacgtactccctccgtggggaaatacttgtcatcaaaatgaataaaacgggatgtatgtagacatatcttagttctagatacatccccttttatctattttgatgacaagtattttcggacggagggagtacaaatagcagcgattgcattcttcatatatggaattgcgagctacacatctgatcacaaactatcacgagtatgtacagtaatcacaggaaatcacctttctactacgggtatatgtacactataagttggacacaaccaaggtaatttggtgtggtggaatagctgaagtaatgccataattcttatttattcatctaaggttcgtccgttcaagcactactaaccctgtgtgaataggaaggggactttggtatatggtacaatagctgagatagggaccaagttgcttcacctctggtttaagcactaaaacccttgtgtgtggcactccaggggttggttgggatgctcgtgcatgcctgagcagcaacctttgccgtcgcttcaggaacaatgccggcattgcagatgtttgcaaagggccgcatgtgcttcattccatactgcgccagtgagccacattgtgattcaaaagtgcgcaccgtagacttgagacaactccagtcatcaacaagaggctcaccagctgggcgaacagcctttagaaccatcggaccacccgcagaaccaaacagaaggtttccaatcagctcgatgctgttgtcaatatgagatctatgacccatcatttcaagcaattgcttccgagcatcgtttttctcaggggagctctcggccaatttccggtacttctgccagaaataaacaagatcagcatccctctgattaacagctcttgagaatgatggcagtgcgttatcttcaacaaatgtagtgttctcgttagcagggtttgacccaatgtacgagaacaaatgttcagcatcaggtccaaagaaccgtattgcatcactgggaaccaagtgatcggagctgggcga

SEQ ID NO: 27592 - DNA, 1023 bp, Triticum aestivum
  unsure (1)..(1023): unsure at all n locations
  Clone ID: PAT_TA_27592
gtttttttttttttttttttaggcaaatcagagagatttctgacatttctcttagcaacgaagattacatcggcaccattagccgaacaacgaccactgttacaaagcattaaacagcctacagaaacctgtgcgtgtttctaagccttggttgccttcttgggggacttggtcgccttcttgggagacttgggctccttgccctccttctccgcggtcctcttggggaggagcaccgggttgatcttcgggatcacgccgccgtgcgcgatggtgacgccggccagcagctttccgagctcctcgtcgttcctgacggcgagcagcaggtggcgcgggatgatgcggctcttcttgttgtccttggcggcgttcccggcgagctccagcagctcggcggcgaggtactcgaggacggcggcgaggtagacgggggcgccggtgccgacgcgctgggcgtagcggcccttcttgaggtagcgcccgatgcggccgacggggaactggagcccggccttgacggaccgcgtcaccgacttcttcctggggccgccggccttgcgcccggccgaggtacagtaagtggctcaccaaggagatccatcactacagctttaaatataaccttcaaataaaactcacaagcaatgcatgcaatgctatccagtatatcaagacaccaagtctcaaggttggttgtctcatgagcaatctatcaccagatgcccacatcccgtcgattctgtctgatataggtcgagtaaacttcggaacaacgcgcgacatcgtcagtgacttgaaaccatgcgctttatcgtcatcttcatcatctaatggtttgtccttgtgcatctctacatcgatagcaacctggtcgttgttgacttttcgtgcccctcgaatctgagtgacagctgcagctgggcttactttgtcattcatttgctcaatctccgaagtgccaggcaagtttatagatctnnnnnggcccatcgtcctgtctcgacgaagcatccctatctg

SEQ ID NO: 27593 - DNA, 833 bp, Triticum aestivum
  Clone ID: PAT_TA_27593
tttttttttttttttttttaacttaaacacgacatcagtcatcagacaacatcattcagcatgaaacctgaaacatagcataaaatatagtgcaagtacgcaaccatatcaaaattccttaacataacagtaaaaaacacaaatcgagcaactacccagtagtagtcttaaaacatctcacagcacatcataccacaatatcttgccaaggtccggaactaatcatacggagtctaaaactggggaggtaaagcagagaaaaccacccaatagacgacgatcctgcaggccgatcaacggtaagacttctggaacctcgcgcgggcgccgcgaccaccgaacttcttgggctcgcagcgacgggggtcggcgacgaggagggtacggtcgtagcgggcgaagatgtccttgacctccttcttggcggcctcgtcgacatacttctggtagtaggccacgagcgccttggcgacggcctggcggatggcgtagatctgggaggtcttcccgccgccgcggacgcggatcctcatgtcgatgtccttgaagcgggagcggccggcgagcatgatgggctcgaaggccttgaggcggagcatctctgggcggattagctcgatgggggcgccgttcaccttgatgagcccgcgccctggcttggtgtacgcgacggccaccgccgtcttcttgcgcccgaagcactggaccgtgcccggcgtcgggcgggtgaggacggcagccatgcttgcggtggtgcctggtgagagcgcggcggcggcggcggcggcggcgggatcagggaggagcggcggcggcgtcccggcccggccggc

SEQ ID NO: 27594 - DNA, 583 bp, Triticum aestivum
  Clone ID: PAT_TA_27594
taggggccttttttttttttttttttcgttcaatacgcttcttcttgaaccgatggcagtacagagagatctggcaagcaagcagggattacaagcggattacatggaggggatcgattgactgagcaagagctagctagtactagtagcagattacatggcgcatctatgaatctctgggctatgggtatctagccggcgtagatgtggatgtggagggcgagggtgaggacggtgaaggcggcgaagaagaggatggtgtggacgaagatggccttgccgttggtgtggaggccgccgaagtcgacgtggcggtgcgaccccggcatctccaacagcagccccggcgagagcaggatgaagagcaccacccccaccaccaccggtgcccagtccgccatcctccgcccgctggctgatctcccctcgcttctccttcttcttcttcggtcggtcgatctgatctcacggctgcatatgagtactactcgggaaggctcgggagtggattctggagcggatatagaaaggaggaggcgagcggcggagcaggggaaagtagaggagtggagagggaacaaag

SEQ ID NO: 27595 - DNA, 824 bp, Triticum aestivum
  Clone ID: PAT_TA_27595
aagcgatactgacgtgcaaatcgttcgtctgacttgggtataggggcgaaagactaatcgaaccatctagtagctggttccctccgaagtttccctcaggatagctggagcccattacgagttctatcaggtaaagccaatgattagaggcattggggacgcaacgtcctcgacctattctcaaactttaaataggtaggatggcgcggctgcttcggtgagccgtgccatggaatcgggtgctccaagtgggccatttttggtaagcagaactggcgatgcgggatgaaccggaagccgggttacggtgcccaactgcgcgctaacctagaacccacaaagggtgttggtcgattaagacagcaggacggtggtcatggaagtcgaaatccgcaagtaccagaagagtaccgagctgctcatccgcaagctccccttccagcgcctggtgagggagatcgcccaggacttcaagaccgacctccgcttccagtcctccgccgtctccgcgctgcaggaggccgccgaggcctacctggtggggctcttcgaggacaccaacctgtgcgccatccacgccaagcgcgtcaccatcatgcccaaggacatccagctcgcacgccgcatccgtggcgagagggcctaagctgctctgtgcgcgtcgtcgtcttagccagatgtgttcagcgctgaaagtgtttgttcgtgccatggtggatgtagtgtgcctgatctgatgtcaccatcttgctgtcatcagtaatttagatgaaaatgttggctatctgttctaagatctgtgccttttgatgccaaaaaaaaaa

SEQ ID NO: 27596 - DNA, 1057 bp, Triticum aestivum
  Clone ID: PAT_TA_27596
gacacacacatgatatctcacacatgcctcaacaaagagggtctcgttaagatacactcttacatcatcgtcatcacttctccccagcagacatcaacgctctccctaaactctgagaaaacgacaccgacttcacgggagacggacatcaaaccaaccctcaccgtagaggctgtgcgaaaacacaagaagacccatgtgagccatccacaccgggagcagcgcacctccgaggctccgactctgagagagctattttctttgtatagcaaataatagcacatagtatttacagcaatcacgtacttgctgtgcagcatgtattagtatttacagcaatcacgaccgtatagatcgatcgcaccatattttgggtgactgatgcgacatggatggatcaaacagtttgctcagaacaaggaggaaggattagcagcgcacgcctgagacgcagccttgtccatggcctcctcacggacgccggcgttgcagaggttggcgagcgagcgcatgtgcttcatcccgtactgcgtcagcggcccgcaccgctgctggaacgtccacaccacagacttgaggcagtcccagtcatccaccacaggctgccccgccggccgcacggcgccgaggaccttggcaccttcctctgagccgaagaggaggccgccgatgagctccacgctgctgtccacgcgagaccgccgcgccatcgtctccaccagccgcctccgcgcctcgcctttctcggccgacccctccgccgacctccggtacttgtgccagaagtggacgaggtcggcgtcccgctggttcaccctgccgcccggcagctgcctggaggtcgaggaggagccctggaggaaggaggcgttgtcgttggcaggattggtgccgatgaagaggaagaggctctggtcgttgaggcccaggtcgccgtactgcatgacgtgggagccgaggctgtacgtgccgttggccgacgtccggtccctgacccgctcgtactgctgcttgagggactcggcgttgaggttgtgcgcgtcgccctcgtgccgaa

SEQ ID NO: 27597 - DNA, 694 bp, Triticum aestivum
  unsure (1)..(694): unsure at all n locations
  Clone ID: PAT_TA_27597
gccggccggtccgggctcccccaatccctcctcctcaagcaccagaacctcctccccccggcgcatcgccatggcccgcaccaagcagacggcgaggaagtccaccggcggcaaggcgccgaggaagcagctggcgaccaaggccgcccgcaagtccgccccggccaccggcggcgtcaagaagccccaccgcttccgccccggcaccgtcgcgctccgcgagatccgcaagtaccagaagagcaccgagctgctcatccgcaagctccccttccagcgcctcgtccgcgagatcgcccaggacttcaagaccgacctccgcttccagtcctccgccgtctccgccctgcaggaggccgccgaggcgtacctggtggggctcttcgaggacaccaacctctgcgccatccacgccaagcgcgtcaccatcatgcccaaggacatccagctcgcacgccgcatccgtggcgagagggcctaagctctgttcgtcgtcgtcttagccagatgtgttcatcggtggaaatgtagtgtgcctgatctgatgtcaccatcttgctgtcatcagtaatttaaatgaaaaatgttggctatctgttctaagatctgtgccttttgaaaaaaaaagccgaccgggagctgggacggaggtcccccanccttgcggtgcnatgttggcgtgccgtgctcaaaa

SEQ ID NO: 27598 - DNA, 566 bp, Triticum aestivum
  Clone ID: PAT_TA_27598
ttttttttttttctcatcagatcggatcagatcagataaatgaacaggcatagcgcagcacctcaacacgcttcttcttcaaccgatggcagtacagagagatccggcaagcacggattacaagcggattacatggaggggatcgatcgaccgagcaagagaagagtacgcagacaggcaggagctaggctactggtagtacatggtgtatcgatctatctagccggcgtagatgtggatgtggagggcgagggtgaggatggtgaaggcggcgaagaagagcagggtgtggacgaagatggccttgccgttggtgtggaggccgccgaagtcgacgtggcggtgcgaccccggcatctcgaacagcagccccggcgacagcagcacgaagagcaccacccccaccaccaccggcgcccagtccgccatcctccgccgcctgctctccctcgcttcttcttcttcttcttcttctttggtcgatctgatctgatctcacggctatgaacacacagaagtactcgggaagactcgggggagagagggcgagtcgaaacccggccggc

SEQ ID NO: 27599 - DNA, 678 bp, Triticum aestivum
  Clone ID: PAT_TA_27599
aaccccctccccctccctcctcagcctcccggcgcatcgagccatggcccgcaccaagcagacggcgaggaagtccaccggcggcaaggcgccgaggaagcagctggccaccaaggccgcccgcaagtccgccccggccaccggcggcgtcaagaagccccaccgcttccgccccggcaccgtcgcgctccgcgagatccgcaagtaccagaagagcacggagctgctcatccgcaagctccccttccagcgcctcgtccgcgagatcgcccaggacttcaagaccgacctccgcttccagtcctccgccgtctccgcactgcaggaggccgccgaggcctacctcgtcggcctcttcgaggacaccaacctctgcgccatccacgccaagcgcgtcaccatcatgcccaaggacatccagctcgcccgccgcatccgtggcgagagggcctaggctgctccgtgcgcgtcgtcgtgtgttagatccaccttagccgttgttcagcggtcgagatgtgcgtgctcgtagtgtttgtttgtgccatggtggatgtagtgtgcctgatctgatgtcaccatcttgctgtcatcagtaatttaaatgaaaatgttggcggtctgttctaagatctgttcaaaaaaaaaaaaaaaaaaaaaaaaaaaaaaaaaaaaactcga

SEQ ID NO: 27600 - DNA, 727 bp, Triticum aestivum
  Clone ID: PAT_TA_27600
gggcgcatctccgacgacatggcccgcaccaagcagacggcgaggaagtccaccggcggcaaggcgccgaggaagcagctggccaccaaggccgcccgcaagtccgccccggccaccggcggcgtcaagaagccccaccgcttccgccccggcaccgtcgcgctccgcgagatccgcaagtaccagaagagtaccgagctgctcatccgcaagctccccttccagcgcctggtgagggagatcgcccaggacttcaagaccgacctccgcttccagtcctccgccgtctccggcgctgcaggaggcctgccgaggcctacctggtggggctcttcgaggacaccaacctgtgcgccatccacgcccaagcgcgtcaccatcatgcccaaggacatccagctcgcacgccgcatccgtggcgagagggcctaagctgctctgtgcgcgtcgtcgtcttagccagatgtgttcagcgctgaaagtgtttgttcgtgccatggtggatgtagtgtgcctgatctgatgtcaccatcttgctgtcatcagtaatttagatgaaaatgttggctatctgttctaagatctgtgccttttgatgcctgttttcgattgcatgtgagcctgtcagtgattgtgagtcgcaaatcgtgcattctattatcccaactcgtgaaattttctgccggtttgtgctactgtgcaaacggcgcctcggctgtattaaatt

SEQ ID NO: 27601 - DNA, 1480 bp, Triticum aestivum
  unsure (1)..(1480): unsure at all n locations
  Clone ID: PAT_TA_27601
cggacgcgtgggcggactcgtggtttagacctattccaggagctgcagaagaagaactatacacctttcccaaagaaaaaacccacgtccgggccagttgctgtaggatctacagaagcagatgaagataatgatgagagtcctgctgaagctgcagcaagtgattatgagtatcttcttgcaatgtcaattggtaccttgactatggagaaggtgaaggagctcattgcgcagcagaataaggtagaggctgatcttgaaatcctgcgtaacacagagccaaaaactctttggctgagagaccttgacgctcttgagaaggaactggatgtgcttgatgcaaaacttgaagctgaacagaacgacagatcacgcaagcgcgccaaaaattctgaaaaggcgagggaccctaagccagcaaccaagaaacagcctaagaaggctacagccaaatcgcagaaggctgggagtgatgatgatgttgattataaaggagacattctgaaacctgctgcacaaaagaagaaaccaccacccaagaaggcaagtgcaccggtgaaagatgaggtgaaagatgaagaggacgaagtggctgagctgaaagaccgcctggctgcttataatattcatagtgacaactctccagaacccagtgccatggaaacagaagaacatcaggaaggaaagaaagggaggaacggaccaagcaaaagaggcgcagcaaagaaggctatgtcatccttagctgagatttctgatgaagacattgcagagccccaccatgagagcgaggatggtgggtcttccatggaagttgagaagaaaactaaaggaagaaagcctgccgctgagaagccgaagactaccatcaggaagagggcgccaactcagagcaaagggatgaggcagaaagtgatggaagaaatattcaagcctactgatgacagtaccctcagtgctccttctcctgagaagaaggtgcgaaggatcagagactcccccttcaacaagaagagcggctcggttctgcacagaatggcgagctcttcaacagggacagaagatgctgaggctcctccctccggcagctctgctgagacagttgtaccgagaaggacaacaagggagaggaaggcggcagtagtctacgtcgcttctgaaagcgaagatgatgagtctgaggatgaagatgtgtcagagccaagtgacgatgatgacttctccgaagatgactagactccttggctcaactgtccaaacattgcgtgtggtgcagtgactctagtgtcttgagacatttggttagctaatctgatatattggtgctttgctcaggtgcatctcttgtgcgtccaatgttatgttaggttgctgagacattctgtgagctaatcggtttgagacttgtgcctatcaccatttcttgttctaatatgctgagacaagtgaacgggacatccnggattttaatgtcactagt

SEQ ID NO: 27602 - DNA, 625 bp, Triticum aestivum
  Clone ID: PAT_TA_27602
aggtgccgagaaggcttaccatgagcagctctctgttgccgagatcaccaacagcgccttcgagccttcctccatgatggcaaagtgtgacccccgccacggcaagtacatggcctgctgcctcatgtactacaaggggctgggaaccagcacagctcaagaaggtcgggattactttgaagatattacccatcataagaaggattttgtctgggcagatgacaaagaagatggtgaggctattgagttagcattcagcaagaaaaagattgctgagaggaaggactggctgaccaactatcagcctggagcttgccttgaccaacgggagaaacgcatcaagtacaaggggttcgtcatgccaggctcctcttttctgctgcttccatgcaacggtggtggcggctgtgttgtttggcatcggctacaaaaacagccatgggcgaccgaggaaggcatgttgtctgttttcttgaaggccgttctatttgttcccagccctaactacggttgtctagctagtttggcatgttgttcatatcactatggtagtccaacgagtttggcatgttgtgagtttggcatgttcatgatgggagcaagtgccagtttgtgattgcttgta

SEQ ID NO: 27603 - DNA, 614 bp, Triticum aestivum
  Clone ID: PAT_TA_27603
cccaaatctcctcagcctcccggcgcatctccgacgacatggcccgcaccaagcagacggcgaggaagtccaccggcggcaaggcgccgaggaagcagctggccaccaaggccgcccgcaagtccgccccggccaccggcggggtgaagaagccccaccgcttccgccccggcaccgtcgcgctccgggagatccgcaagtaccagaagagcaccgagctgctcatccgcaagctccccttccagcgcctcgtgagggagatcgcccaggacttcaagaccgacctccgcttccagtcctccgccgtctccgccctgcaggaggccgccgaggcctacctggtggggctgttcgaggacaccaacctctgcgccatccacgccaagcgcgtcaccatcatgcccaaggacatccagctcgcccgccgcatccgtggcgagagggcctaagctctgttagtcgtcgtcttagccagatgtgctcatcggtggaaatgtgcgtgctagtgttcgttcttgccatggtggatgtagttgtgtctgttctgatgtcaccatcttgctgtcatcagtaactgaaatgaaaatgttgctatctgttctaaaaaaaaaaaa

SEQ ID NO: 27604 - DNA, 1329 bp, Triticum aestivum
  Clone ID: PAT_TA_27604
tcggcacgaggctacttttcctcccctcggcctacaagcctccgcgctcctgcgccggcgagccgctttcttgcaaagcattttctttcctcccctgctctcccgcatccacattcttccttctcgtttcgccggcgcaggatggcaatagaccacgcgtcccctcttgcgctcaagagcggcggcgccgccacgggaggagcggggcgtgacgaggaggcggggagccagcggtggccgccgtggctgaagccgctgctggcgacgagcttcttcgtgcaatgccgggcgcacgccgacgcgcacaagagcgagtgcaacatgtactgcctcgactgcatcaacggcgcgctctgctcgctctgcctcgcccaccaccgcgaccaccacgccatccagattcggaggtcgtcgtaccacgacgtgatccgggtgtcggagatacagagggtgctggacatcaccggcgtgcagacgtacatcatcaacagcgcgcgcgtggtgttcctcaacgagcgcccgcagccgaggccgggcaagggggtcaccaacacctgcgaggtctgcgagcgcagcctcctcgactcgttccgcttctgctccctcggatgcaaaatcgtaggcacgtccggcgggcaccggccgaggaagaagcacggcggcgtgggcggcggtggcaagaagaagagagcggcggtcaaggacgcgcggtcggactcggagcactcgtgcacgagcaccagcggcggcagcagcgacaggagcagcgtggtgcagagcttctcgccgtcgaccccgccggccacctccagcagctaccgcgccggcaacaagcgccgcaagggcatcccgcaccggtcgccgttcggcagcctcatcgtggagtactaggacagcgcacatgccatgcctgccctgatcaacactctagcgtactgtacacgtgacatagccaagaaggtaatggctgcgcgccgtgaacggcgagccccgtgccgccgtcgaggggcacgagcagtgagcacatactatagcgtgtgactttcagtttgttgcagactcttcagttatagctagttaccaccggtaaaaccgtagcgtccgttatactgtaagtaacttgcagctccatgacgacgactaagttttgcaatatcactgtagtaaactccatgcccatatggttatgaggcttatggcactaagtagatcgtaaatgtgcccatagatgatagataaatgtatcacgtagtgtgtggagcaggaggccagtgcggtggtgttcatgtacgtgcacgggcccatgtaataaaaataagaatgctgctc

SEQ ID NO: 27605 - DNA, 891 bp, Triticum aestivum
  Clone ID: PAT_TA_27605
taggggcctttttttttttttttttttgaaagattgaaaattcaatagcttcattacaacttgacgtactccttaagactcaaaatgtatggtagatgatgtcaattccattgtatgtgtatggtaaaacattctccaaatgtataggtaagatcatgacaatgggtgaactaagtacgggcagggacggtgccatcaacagcagaacggtatgaaccaggcaactggaagatgaatgacgttttggtgatctggacggggacggtgcaaactgtagccaggcaactcactcctggtcaccttgggggccgatatgactgggatacttgaatgaaatatcggtccaggtgctttggccttctgtcagctccttcaccacggatgccacctcgtcgatgcccaccctcacctgctgtttgctgtccctctctcggatcgtcacctctgttgcagaatccacggttactgcaaaaggaacaccgatctcgtccgttcttgcgtacctcctcccgatagaaatgccagtcgtgtcaataatgtgtgatatgcctgcagctgttaattctttagcaagcactttggcggcatcatcaaactcttgattctttaccagcgggaacacagtgcacttgataggagccacaataggagggaaccggaagacattcagctgctcctcttctgatttgctaggtcttgtgtagaaggaatgctcaaacagacaatagattatcctccctaagccaaatgagggctcaacaactgagggggtgaagactcgctggtgctccagcttcttctccataccgattgataccattttctttgtaatcaccacgtcctttccaagtgtgcaaacttggaagttcgtctcccccttagattccaatc

SEQ ID NO: 27606 - DNA, 1662 bp, Triticum aestivum
  Clone ID: PAT_TA_27606
ctttttctttgtatagaaatatagcacatatatttacagcaatacgtacttgttgtgcagcatgtagtatttactatttacagcaatcacgaccgtatatatcgatccatcacaccatattttaggtgaccgatgcgacatggatcgatcacacagtttgatcagaacaaggaggaaggattagcagcgcacgcctgagccgcagccttgtccatggcctcctcccggacgccggcgttgcagagattggcgagcgagcgcatgtgcttcatcccgtactgcgtcagcggcccgcaccgctcctggaacctccgcaccacggacttgaggcagtcccagtcatccaccacaggctgccccgccggccggacggcgccgaggaccttggcaccttgctcagagccgaagaggaggccgccgatgagctccacgctgctgtccacgcgagaccgccgcgccatcgtctccaccagccgcctccgcgcctcgcctttcttggccgacccctccgccgacctccggtacttgtgccagaagtggacgaggtcggcgtcccgctggttcactcggccgcccggcagctgcctggaggtcgaggaggagccctggacgaaggaggcgttgtcgttggcaggattggtgccgatgtagaggaagaggctctggtcgttgaggtccaggtcgccgtactgcatgacgtgggagccgaggctgtacgtgccggccgccgacgtccggtccctgacccgctcgtactgctgcttgagggactcggcgttgaggttgtggggcttcgctgtcctccatccaggcgacgctgtagaggtcgccgaggcaggtgtcgtactccggcggcggggcgccctcgtcgtcgccggggcagtaggtgccccagctgctctcctccgcgttggccgccgtggtggcgtacacgccgatgttgcccgggaggaggccctcgaagatgctcccggactcgcaggcctccaggtagaagaccaggctcttgtacccggccccgcccgcgtgcttcttctccagcgtccgcaccacagctcgttcgcgtacaggtactcctcgtcgcccggcatcccgaggatccctgggccgccgtgatcggcgtagtagacgaagatgtggtcgtccgggccgctgctgacgaccttgccgctgccgctgccggtgagcttggacttgtcgccgagcagcgcggcgaggaagttgttggcgttgacgtctgcccccgtgtagtccttggggactccggcgtagacgtcgccgcctttggggtggttgatgatgaccccgggcctggggttgtcgcggctgccggcgatgtcgtcgtacatgaagacgatgatgttctcgtccttcagcccgcccttcttcatgatctggtacgcgtggcatacgtccgcctggtggcggtagttgtagtagccgttggagccggcgatgaggacggcccatctcgtcccgacgacgtccttctcggacggcaggcggaggaactcgccggcgacgagcagggcgagctgcgacgacaagacgaggaggaggaggaggaggggtgagcaggaaaggcgagccatggtgagctgctgctctctgaaagtccggccggattgagatgtagaagacgatccttcctgtccctcttta

SEQ ID NO: 27607 - DNA, 1482 bp, Triticum aestivum
  unsure (1)..(1482): unsure at all n locations
  Clone ID: PAT_TA_27607
cccacgcgtccgctcgcgaccttttccccctcccggtctacaaagaccgcctcggctttcctccgcctccacttcttccctccaaagcacccctcaccctttctcctctttccctcccaagcaaatcctctgcgctcccctcgcatcctcctccttcctctgccgcttgccgtgtttggttcgggaccgaaatggcattccacgacgaggcgccgctgctgctcaggatcaacaccgccagaggcggccacatgggcggaggcgagtgcgacgaggccgagaaccagcggtggccgccgtggctcaagccgctgctggcgaccagcttcttcgggcaatgcaagatgcacgcggacgcccacaagtgcgagtgcaacatgtactgcctcgactgcgtcaacggcgcgctctgctcccagtgcctcgcctaccaccatggccaccacgccatccagataaggaggtcctccgtaccacgacgtgatccgcgtgtcggagatccagaaggtgctggacatcaccggcgtgcagacctacatcatcaacagcgcgcgcgtcgtcttcctcaacgagcgcccgcagcccaggcccggcaagggcgtcaccaacacctgcgacgtctgcgagcgcagcctcctcgacaccttccgcttctgctccctcggatgcaagatcgtgggcacctccggcgagttccgtggccggaagaggcacgccggcggcaagaagatgaagctgaagctgaagaaggcggcggcgtcggactcagacgactcgtccaccatcaccagcggcgggagcgacaagagcagcgtggtacagagcttctccccgtccaccccgccggccaccgccaacagctaccgctccgccaagcggcgcaagggcatcccgcaccggtcgcccttcggcagcctcatcgtggagttctagagcaagagcatcgcatcgcccgcccccgcccacctccctcgccggtacccactgtagcatacacatccatccatacctacctacctctagagttttcctgttgcgttctgttctatacaccaaggagaaggagaaggagcctaagcaaaaaataacgagccgccattgccgcacctctgcgcttctggacgaggaggccggtgcaacgcaatgcggcatcttaccactacttcgtcatagtcactactacaaaaacagttactgtgctggtaacaggaaggaagggtttgagtgttgtgtctccccggaacggcgggaggtagtagccgtagtttttactctatggtggtagctagcagtctactaagttttgcaactttctttccttgtaggcgctggttgttcttaggtgtgtttgatatggtagatgtacatatatgtatactatcacagatggggaatggtagcgagactggtgttgatattcgtcgtcctgtaataacgctcagaatgcntgctgctccgacggccttcttcaatgtcaccatg

SEQ ID NO: 27608 - DNA, 684 bp, Triticum aestivum
  Clone ID: PAT_TA_27608
ttttttttttgggcaagtcagagagatttctgacgttcttccattaaacatgcacataacaagatgaaacgacaccgctacaggaacacaaccggaccactatgaagaacactagtacagtctacgacatggaatggatcgatctaagccttggtggccttcttaggggacttggtcgtcttcttgggctccttgccctccttctccgcggtcctcttggggaggagcaccgggttgatcttggggatcacaccgccgtgcgcgatggtgacgcccgccagcagctttccgagctcctcgtcgttcctgacggcgagcagcaggtggcgcgggataatgcggctcttcttgttgtccttggcggcgtttccggcgagctccagcagctcggcggcgaggtactcgaggacggcggcgaggtagacgggggcgccggtgcccacgcgctgggcgtagcggcccttcttgaggtagcgcccgatgcggccgacggggaactggagcccagccttgacggaccgcgtcaccgacttcttcctggggccgccggccttgcgcccggccgcgcccttcttgcccttggcgccagctccggtgcccgaaacgtccattgcttgcaggtgatgctcttggggatcggggggcagaggaggattggttttgtgatggagatgggatgagact

SEQ ID NO: 27609 - DNA, 840 bp, Triticum aestivum
  Clone ID: PAT_TA_27609
tctaagcagagtggggaaaggcgtcttcgtactcgcctctctccgcgcaaccgagccttccgcccacctcctccccatttcgccagcggcgcacccaccaaccacccccacccgccgccatgagggagtgcatctcgatccacatcggccaggccggcatccaggtcgagaacgcgtgctgggagctgtactgcctcgagcatggcattcagcctgatggccagatgcccggtgacaagaccgttgggggaggtgatgatgctttcaacaccttcttcagcgagactggggctgggaagcacgtcccccgtgctgtcttcgtagatctcgagcccactgtgattgatgaggtgaggactggcgcttaccgccagctcttccaccctgagcagcttatcagtggcaaggaggatgctgccaacaacttcgcccgtggtcattacaccattggcaaggagattgttgatctgtgccttgaccgtatcaggaagctttcagacaactgcactggtctccagggattccttgtcttcaacgctgttggaggtggaactggctctggccttggttctcttctgctggagcgcctctctgttgactatggaaagaagtccaagcttgggttcacagtgtacccatcaccccaggtctccacctctgttgttgagccatacaacagtgtcctgtccacccacttcccttcctgagcacacttgaggtgtctatccttcttgacaatgaggccatttatgacttctgccgccggtcccttgacatggacgcccaacatacaccaccttaaaagggttggttcttaaggcttttcatgcttaaagcttt

SEQ ID NO: 27610 - DNA, 670 bp, Triticum aestivum
  unsure (1)..(670): unsure at all n locations
  Clone ID: PAT_TA_27610
tgagcggccgcccgggcaggtacgtttacctatttttcacaaatatttactgaaaagatgaatagtcaaaaaaatgaaaagaaaaggtcaatggcgacaaatatttcagacaaatagtcagacatattatcatttgcctgaagtcaaacatattatcctagcaaactcaaatcaactagacccacatgtcatccactagttcgttttccacaagtaaatttgtgaatgaaatcgtgggttcagaaatgaatttgacacacacagaggttgcagcgttttctgagactctattgacattttatttattggtgattacatgactcaaaggaacggccctgggagctcgatccttctcacatcccgccacgccattgtcgcgtccatccccacgacgcaggacgtgaagagcgagtccaaggccggaagctagactcggtacctcggccggcgagcatgatgggctcgaaggccttgaggcggagcatctccgggcggatcagctcgatgggggcgccgttcaccttgatgagccacatcttggcgatgatggggttgcacagggcctccagctccttcatcttgtcctcgaactcatccgcctcagcgagctggttcgtgtccagccattggatggcagcatcgatggcatcctcnnnnttcttcttgtcgt

SEQ ID NO: 27611 - DNA, 782 bp, Triticum aestivum
  Clone ID: PAT_TA_27611
agcttgaaattcaccctactaaagggaacaaaagctggagctccaccgcggtggcggccgctctagaactagtggatcccccgggctgcaggaattcggcaccagcccaaaccttctcctccttctgaacctcccggcgcatctccgactccatggcccgcaccaagcagacggcgaggaagtccaccggcggcaaggcgccgaggaagcagctggccaccaaggccgcccgcaagtccgccccggccaccggcggcgtcaagaagccccaccgcttccgccccggcaccgtcgcgctccgcgagatccgcaagtaccagaagagcaccgagctgctcatccgcaagctccccttccagcgcctcgtccgggagatcgcccaggacttcaagaccgacctccgcttccagagctccgccgtctccgccctgcaggaggccgccgaggcctacctggtggggctcttcgaggacaccaacctctgtgccatccacgccaagcgcgtcaccatcatgcccaaggacatccagctcgcacgccgcatccgtggcgagagggcctaagctctacgcgtcgtcgtcttagccagatgtgttcgtcggtggaaatgtgcgtgctagtgtttgttcttgccatggtggatgtagtgtgcctgatctgatgtcaccatcttgctgtcatcagtaatttagatgaaaatgttggctatctgttattggatctgttccttttgatgcctgtttttgcttgtatgtgagcctgtcagcgaatgtgattcaccc

SEQ ID NO: 27612 - DNA, 1329 bp, Triticum aestivum
  unsure (1)..(1329): unsure at all n locations
  Clone ID: PAT_TA_27612
ctcgtgccgaattcggcacgagcaaagcccccctccccctttctcctctttccctcccaagcaaatcctctgctctccccccgcctcctcctccttcctctgccgcttgccgtgtttggttcggcaccgaaatggcattccacgacgaggcgccgctgctgctcaggatcaacaccgccagaggcggccacatgggcggaggcgagtgcgacgaggcggagaaccagcggtggccgccgtggctcaagccgctgctggcgaccagcttcttcgggcaatgcaagatgcacgccgacgcccacaagtgcgagtgcaacatgtactgcctcgactgcgtcaacggcgcgctctgctcccagtgcctcgcctaccaccacggccaccacgccatccagataaggaggtcctcgtaccacgacgtgatccgcgtgtcggagatccagaaggtgctggacatcaccggcgtgcagacctacatcatcaacagcgcgcgcgtggtgttcctcaacgagcgcccgcagcccaggcccggcaagggcgtcaccaacacctgcgacgtctgcgagcgcagcctcctcgacaccttccgcttctgctccctcggatgcaagatcgtaggcacctccggcgagttccgcggccggaagaggcacgccggcggcaagaagatgaagctgaagctgaagaaggcggcggcgtcgtactcggacgactcgtccaccatcaccagcggcgggagcgacaagagcagcgtggtgcagagcttctccccgtcgaccccgccggccaccgccaacagctaccgctccgccaagcggcgcaagggcatcccgcaccgctcgcccttcggcagcctcatcgtggagttctagagcatcgcatcgcatcgcccgcccacacctccctcgccggtacccactgtagcatacacatccatccatacctacctctagagtttttctcttctgttctgtcctgttctatacaccaaggagaaggaaaataacgagccgccattgccgcacctctgcgcttctggacgaggaggccggtgcaacgcaatgcggcatcttactactactacgtacttcatagtcactacaaaacacagttactgtgctggtaacaggaaggaagggtttgagtgttgtgtctcccccggaacggcgggaggtagtagccgtagtttttactcttgtggtagctagcggtactaagttttgcaactttgttgttcttattaggtgtgtttgatatggtagatgtacatatatgtatactatcacaagatggggaatggtatcgacatgntgttttattcnncctgga

SEQ ID NO: 27613 - DNA, 554 bp, Triticum aestivum
  Clone ID: PAT_TA_27613
gaattgtaccggcccccctttttaataacagcatgcacagcactcaatcaacacgcttcttcaccagatttgcaggcagggattggattacaagcagattgattacatggaggggatcgatttaccgagcaagagaacagcacgcggacaggcaagagctagctagtagtattggtagtacatggcgcatctatggggtatggggtgtcagtctagccggcgtagatgtggatgtggagggcgagggtgaggatggtgaaggcggcgaagaagaggagggtgtggacgaagatggccttgccgttggtgtggaggccgccgaagtcgacgtggcggtgcgaccccggcatctcgaacagcagccccggcgagagcagcacgaacagcaccacccccaccaccaccggtgcccagtccgccatcctccgccgcttctccttcttccttggacttcggtcgatctgatctgatctgatctcacggccgcagatatggatcttggttgtgaacacgcaggagcgctcgggaagggtcggcagtggagtgggggagtg

SEQ ID NO: 27614 - DNA, 1659 bp, Triticum aestivum
  Clone ID: PAT_TA_27614
gaggctcaagagcgccctcatctgggtcgtcgcgtcagcagtcgtctgcggcctcgtcctcggcatcctatacgcacttattggtaaagtggacttcactgtcaggcacctctcttcatctgtccaggcttttccaaacccaaaccagttcggtgcattcacaagtggccaaccttgcattgctccattgacccgtcagtgttcagctaatactgcacctcctaactcccaaacaacttggacaatgcgcgctacattccccgaatacgtggttgcccttgctaccattgatggatctgtgctcttcacaatatttggtggtgttggcattgcttgccttccattgagtcttatattctcgtttgtccggcgtccaaaagctgtcatcacacgctcacaatatataaaggaagctactgaattaggtaagaaggccaaggaaattgaagaaggcagcggaagcccttcaccaagaagagagaagtgggaacaaaggcagaaaatggcgcaaaaacgtgaaggctgtcgagaaggagttgttacttttggaaaatgacatgaatgctctagaagagatgtaccctcaaggagagaaggctgaggctacctgggcttttacagtgcttgcttacattggaaaactcatattcggcattgttgggttaattgtatcgattgcttgggttgcacatattatcatatacttgttggttgatcctcctctatcttctttcctgaatgagatcttcataaagctggacagtgtttggggtctgcttgggactgctgcttttgcattcttctgcttctatctcctcattgcagtgattgctggagaaatgatgcttgggcctgaaattagttttcatcaccattcacccaatgaaatggggaggaacgttgatgaactctttcctgtttaatgttggactgatcctactttgttccatcagtgtgattcagttctgcgcgacagcttttgcgtactacgcgcaagcaactgcagctcaggagatctttggccacacgctgcagtctcttcgtggtattaagtatctctacaagtacaatgttttccagtacggctttgttgcccttgccatactcaccctcttctactatgcactttttggatggcgaaagaggaaaccgacaggaagattccagctctcaagttaattttcggtttgctctgtaagcaaagcctgacaaattcaacatcatatttgttcctgagtgatagtttggttagcgatgtatatgatcttcaaaccgctttctggaagagttggggagttttcatgggtgtaaattagcggcgacgaaaatcttggaagatggaaacacccacggacacggatgttaaagtagaagaacctagtttcctttgtaatgtacacatccctcgtcttggttcttttctgtattattgttttatgatcatcaatcggcttatgtcattattgaagtttgattggtctgcaagggagatgttctgtgtgccccttcggtgttcctttgctgttatgagttaaattagtccagttcttttcttttgtatgtaccattccgtgattaccgtgcaaccttgtagattgtataaggatggcttgtcttgatcggttattctcgtttttctgcctttcacccacgcgtccg

SEQ ID NO: 27615 - DNA, 1457 bp, Triticum aestivum
  Clone ID: PAT_TA_27615
ccacgcgtccgaagaaaaacccacgtctgggccagttgctgtaggatctacagaagcagatgaagataatgatgagagtcctgctgaagctgcagcaagtgattatgagtatcttcttgcaatgtcgattggtaccttgactatggagaaggtgaaggagctcattgcgcagcaggataaggtgaaggctgatcttgaaatcctgcgtaacacagagccaaacactctttggctgagagaccttgacgctcttgagaaggaactggatgtgcttgatgcaaaacttgaagctgaacagaacgacagatcacgcaagcgcgccaaaaattctgaaaaggcgaaggactctaggccagcacccaagaaacagcctaagaaggctacagccaaatcccagaaggctgggagtgatgatgatgttgattataaaggagacattccgaaacctgctgcacaaaagaagaaaccaccacccaagaaggcaagtgcaccggtgaaagatgaggtgaaagatgaggaggacgaagtggctgaactgaaagaccgcctggctgcttataatatcgacagtgacaactctccagaacccagtgccatggaaacagaagaacagcagaaaggaaagaaagggaggaatggaccaagcaaaagaggcgcagcaaagaaggccatgtcatccttagctgaaatttctgatgaagacatagctgagcccgaccgtgagagcgatgatggggggtcttccatggaagttgagaagaaaactaaaggaagaaaacctgctgccgagaagccgaagactaccatcaggaagagggcgccagctcagaccaaaggcatgaggcagaaagtgatggaagaaatattcaagcctactgatgacagcaccctcagtgctccttctcctgagaagaaggtgcgaaggatcagagactcccccttcaacaagaagagcggctcggttctgcacagaatggcgagcgcttcaacagggacagaagatggtgaggctcctccctccggcagctctgccgagccagttgcaccgagaaggacaacaagggagaggaaggcggcagtagtctacgtcgcttccgagagtgaagacgatgagactgaggatgaagatgtgtcggaaccaagcgatgatgacttctccgaagatgactagactccttggctcaaccgcccaaacattgcgtggagtaaagtgactagtgtcttgagacatttggttagctaatctgatgtattggtgctttgctcaggtgcatctcttgtgcgtcgaatgttatgttaggttgctgaggcattccgtgagctaacccgtttgagacttgtgcctatcaccatttctagttttaatatgctgagacgagtgaatgtggacatcctcgattttaatgtcagaagtgatgctttaaaaaaaaaaaaaaaaaaaaaaaaaaaaaaaaaaa

SEQ ID NO: 27616 - DNA, 837 bp, Triticum aestivum
  Clone ID: PAT_TA_27616
catagaagatcaaagtgattgtattagcaccattcaacacatccggctaacttaaagacaacatcagtcatcagacaacatagcataaaatatagtgcaagtacgcaaccatatcaaaattccttaacataacaagtaaataacacaatcgagcaactacccagtagtagtcttaaaacatctcacagcaaatcataccacaatatcttgccaaggtacggaactaatcatacggagtctaaaacttgggaggtaaagcagagaaaaccacccaatagtcgacgatcctgcaggccaatcaacggtaagacttctggaacctcgcgcgggcgccgcgaccaccgaacttcttgggctcgcagcgacgggggtcggcgacgaggagggtacggtcgtagcgggcgaagatgtccttgacctccttcttggcggcctcgtcgacatacttctggtagtaggcgacgagcgccttggcgacggcctgacggatggcgtagatctgggaggtcttcccgccgccgcgaacgcggatcctcatgtcgatgtccttgaagcgggagcggccggcgagcatgatgggctcgaacgccttgaggcggagcatctccgggcggatcagctcgatgggagcgccgttcaccttgatgaggccgcgccctggcttggtgtacgcgacggccaccgccgtcttcttgcgcccgaagcactggaccgtgcccggcgtcgggcgggtgaggacagcagccatgtttgcggtggtgcctggcgagagcacggcggcggcggcgggatcagggaggagcggcggcggcgtaggcaggtgatgcgaggagtggc

SEQ ID NO: 27617 - DNA, 849 bp, Triticum aestivum
  Clone ID: PAT_TA_27617
aattgaattttggtgacccttttgaaggggtttgaaattgcattcaagggtaagtaaggtttgaaccttttgagcggccccttttttttttttttttttttttttttttttcttttttttttttttttttttttttttttttttttttttttttttttttttttttttttttttttttttttttttttttaatcagagagatttctgacatttctcttagcaacaaagattacatcgacaccattagcagaacaacgaccacagttacgaagcattaaacagcctacagcaacatatgcgtgtttctaagccttggtggccttcttgggggacttggcggccttcttgggagacttgggctccttgccctccttctccgccgtcttcttggggagcagcaccgggttgatcttggggatcacaccgccgtgcgcgatggtgacgccggccagcagctttccgagctcctcgtcgttccggacggcgagcagcaggtgccgcgggatgatgcggctcttcttgttgtccttggcggcgttcccggcgagctccagcagctcggcggcgaggtactctaggacggcggcgaggtagacgggggcgccggtgcccacgcgcggggcgtagcggcccttcttgaggtagcgcccgatgcggccgacggggaactgcagcccggccttgacggaccgcgtcaccgacttcttcctggggccgccggccttgcgcccggccgcgcccttcttgcccttggctgcagcgcctgagacatccattgctaacgacggggcttttgaagaaaagctggagaggggcagagagatttggtgatggtggattgcggggtga

SEQ ID NO: 27618 - DNA, 1394 bp, Triticum aestivum
  Clone ID: PAT_TA_27618
gttgggttttcacgttcttcagtctattttttatcagcaacataatcacagtcttattcataacaatatcgtttcatttacaatgtcatgctgtctacgtagctgcagggtttcaaatggatggggaaatagcagctcatagtactatgagattactcaatctacgtagaaaatagcagcgcttgcattcttcatatatgtaattgtgagctacacatctgatcacaggctatcacgaatatgtacatcaatcacaggaaatcaccttcctactatggtgtatgtacattataagtcggggcacacggaagggtaatttggtgtggtgggaatagctgaagtaatggcataattcgtattcatctaaggttcgttcaagcactactgaccctgtgtgaataggaagggactttggtatatggtacaatagctgacatagtagccaagttgcttgacctatggtttaagcactaaaaccattgtgtgtggcactccaggggttggttgggatgctggtgcatgcctgagcagccatcttcaccatcgcttcaggaaggatgccggcattgcagatgtttgcaaaggaccgcatgtgcttcattccatactgtgccaacgagccacattgtgattcaaatgcacgcaccgtagacttgagacaactccagtcatcagcaagaggctcgccagctgggcgaacagtctttagaaccattggaccatccgcaaaaccaaacagaagatctccaatcagctcgacgctgttgtcaatatgtgatctatgacccatcatctcgagcaattgcttccgagcatcgtttttctcaggggagctctcagccaatttctggtacttgcgccagaaatagacaagatcagcatccctctgattaacagctcttgagaaggacggcagtgagttatcttcaacaaatgtagtgttgtcgttagcaggatttgacccaatgtacaagaagagatgttgatcgttcagatccaaagaaccgtattgcatcacatgggaaccatagctgtatgagtcctgagctgctgttctcttcttgaccaagtcatattgctgcttcagagattcagttctcaggttgtgcacatcactgtcttccatccaagaaatgctgtacaggtcgcccaagcaggtgtcatattccggcggagggctggggtactcgccagggcaatacgttccccaactgctctcctctgcgttcgacgcggtggtcgcgtagacaccgatgtcattcggcagaagcccctcgaagacgctcccggcttcacaggcttcaaggtaaaataccaggcttttgtagcttccagcagcatgctttttcttcaggacatctacaagatcgtcaccgtaaacgtatggattggtg

SEQ ID NO: 27619 - DNA, 1795 bp, Triticum aestivum
  Clone ID: PAT_TA_27619
ccacgcgtccggtcgtcgtgctcggcatcaccgtcgccgtcctctccatcctcatgctccccgccgacgtcgccaaccgccaggcctgcaggcgggccgtctacagcggcgcctgcgccctcaccctccccatgaagacgctctggctcgtcgtctacatcgccgacgccgtcctcgtcttcctcgtcatccccttcgccatgttctactacgagggcgaccaggacaagtccgtcgggaagaggctcaagagcgccctcatctgggtcgtcgcctccgccgtcgtctgcggcctcgtcctcggcatcctatacgcacttattggtaaagtggacttcactgtcaggcacctctcttcatctgtccaggcatttccaaacccaaaccagttcagtgcattcacaagtggccaaccttgcatcgccccattgacccgccagtgttcagctaatactgcacctcctaactcccaaacaacttggacaatgcgcgctacattccccgaatacgtggttgcccttgctaccattgttggatctgtgctcttcacaatatttggtggtgttggcattgcttgccttccattgagtcttatattctcgtttgtccggcgtccaaaggctgtcatcacacgctcacagtatataaaggaagctactgaattaggtaagaaggccaaggaattgaagaaggcagcggaagcccttcaccaagaagagagaagtgggaacaaaggcagaaaatggcgcaaaaacgtgaaggctgtcgagaaggagttgttacttttggaaaatgacatgaatgctctagaagagatgtaccctcaaggagagaaggcagaggctacctgggcttttacagtgcttgcttacattgggaaactcatattcggcattgttgggttaattgtatcgattgcttgtgttgcacatattatcatatacttgttggttgatcctcctctatcttctttcctgaatgagatcttcataaagctggacagtgtttggggtctgcttgggactgctgcttttgcattcttctgcttctatctcctcatcgcagtgattgctggggaaatgatgcttggcctgaaattagttttcatcaccattcacccaatgaaatggggaggaactttgatgaattcgttcctgtttaatgtaggactgatcctactctgttccatcagtgtgattcagttctgcgccacagcttttgcgtactacgcacaagcaactgcagctcaggagatctttggccacacgctgcagtctcttcgtggaattaagtatctctacaagtacaatgttttccagtacggctttgttgcccttgccatactcaccctcttctactatgcactttttggatggcgaaagaggaaaccgacaggaagattccagctctcaagttaattttcggtttgctctgtaagcaaagcctgacaaattcaacatcatatttgttcctgagtgatagtttggttagcgatgtatatgatcttcaaaccgctttctggaagagctggggagttttcatggttgtaaattagcggcggcgaaaatcttggaagatgggaaacacccacggacacggatgttaaagtagaagaacctagtttcctttgtaacgtacacattccccgtcttggttcttttctgtattattgttttatgatcatcgatcggctgatgttattattgaagtttgattgggtctgcgagagagatgttctgtgtgcccctttgttgttcctttgcagttatgagttaaattagccaaaaaaaaaaaa

SEQ ID NO: 27620 - DNA, 1423 bp, Triticum aestivum
  Clone ID: PAT_TA_27620
tcgttccaaagcccccctccccctttctcctctttccctcccaagcaaatcctctgcgctccccacgcctccttcttcttcctctgccgcttgccgtgtttgattcgggaccgaaatggcattccacgacgaggcgccgctgctgctcaggatcaacaccgccagaggcggccacatgggcggaggcgagtgcgacgaggccgagaaccagcggtggccgccgtggctcaagccgctgctggcgaccagcttcttcgggcaatgcaagatgcacgcggacgcccacaagtgcgagtgcaacatgtactgcctcgactgcatcaacggcggccctctgctcccagtgcctcgcctaccaccacgggccaccacggccatccagataaggaggtcctcctaccacgacgtgatccgcgtgtcggagatccagaaggtgctggacataaccggcgtgcagacctacatcatcaacagcgcgcgcgtcgtgttcctcaacgagcgcccgcagcccaggcccggcaagggcgtcaccaacacctgcgacgtctgcgagcgcagcctcctcgacaccttccgcttctgctccctcggatgcaagatcgttgggacctccggcgagttccgcggccggaagaggcacgccggcggcaagaagatgaagctgaagctgaagaaggcggcggcgtcggactcggacgactcgtccaccatcaccagcggcggcagcgacaagagcagcgtggtgcagagcttctccccgtccaccccgccggccaccgccaacagctaccgctcctccaagcggcgcaagggcatcccgcaccggtcgcccttcggcaacctcattgtggagttctgagcaagagcaaagcagagcaacgcgcgcccgcccgcctccctcgccggtaccactgtagcatacacatccatccatccatatctacctctagagtttttccgttccgttctgttctatacaccaaggagaaggaaggagcttaagcaaaaaataacgagccgccattgccgcacctctgcgcttctggacgaggaggccggtgcagggcaatgcgggatagtcaccactacttcatcatagttactacaaacagttactgtgctggtaacaggaaggaagggtttgggtgtgttcgtctccccggaacggcgggaggtagtggtcgtagtagaagtttttactccgtgatgtggtagctagctactaagttttgcaagtttctttccttataggcgttggttgttcttaggtgtgtttgatatggtagatgtacatatatgtatactatcacagatggggaatggtagcgagactggtgttgatattcgtcgtcctgtaataaccttcagaatgcttgctgctcctgacggccttcttcaatgtcactgtgcttgtttttgcttg

SEQ ID NO: 27621 - DNA, 1661 bp, Triticum aestivum
  unsure (1)..(1661): unsure at all n locations
  Clone ID: PAT_TA_27621
gttttccgaagttactggacctatatcagacgaatgaacgggatttggcatcttggtgatagattgntcattgagacaaccaacctttgagattggtgtcttgatatactggatagcattgcatgcattgcttgtgagttttatttgaaggttatatttaaagctgtagtgatggatctccttggtgagccacttactgtacagtgccatgtctatgacaagctatgcaacacaagcaatctagtcaaaatgctgtcgattctttttgaagtttgttactgaatacctgaaccaaacggtcatctgcgtatcatttttgttgtgaatctttctgtttcatcggtaccgtcggtgcaggtgtcttcggttggacccagctgaagcaggaccaattccagcagaaggggaagattcacaacaaaaatgatacgcagatgaccgtttggttcaggtattcattcagtaacaaacttcaaaaagaatcgacagcattttgactagattgcttgtgttgcatagcttgtcatagacatggcactgtacagtaggtggctcaccaaggagatccatcactacagctttaaatataaccttcaaataaaactcacaagcaatgcatgcaatgctatccagtatatcaagacaccaagtctcaaggttggttgtctcatgagcaatctatcaccagatgcccacatcccgtcgattctgtctgatataggtcgagtaaacttcggaacaacgcgcgacatcgtcagtgacttgaaaccatgcgctttatcgtcatcttcatcatctaatggtttgtccttgtgcatctctacatcgatagcaacctggtcgttgttgacttttcgtgcccctcgaatctgagtgacagctgcagctgggcttactttgtcattcatttgctcaatctccgaagtgccaggcaagtttatagatctaggttggcccatcgtcctgtctcgacgaagcatccctatctgagaatccttttggctcaaagaagcttctagagcctctgatttacgcaacaactcttccattttggtcctctcgacctgtagtgaagaatctttgctttgcacagcaaccctcaattcatctgattcagatatcaacgacactatttttttgtccaacatgtccatatatactggaacctgagtgtaatcatggtcatctgcgctctcacaatgcacaccaaactgcatcagcgcagtttctaaccacttaacaaaatcatttatctgcgatgagtactgcttgttgctatcttcagtggttaatagttcattagtactccttgtgacttcttggcgcagaaacgagatctctgagtctctctcttgcaattgtgactgaaggctttccacttctgcaagaagactttcagacaagctatgcaactcgtcaaacttctcgacagtggttgcaagtttagtcagagcttttgtcctagaatcttcaaggctcttcaaagaaaattctttttcttgcagcatctgctccaagtcattgcttttgttctccaagacttcaagctccttttcttcttcgtcaagtgcttgcatcaaaccttcaatctcttggtcttttctgctcagttcatcagtcaactcctttattcttccatgctgctcacttgccactctgcg

SEQ ID NO: 27622 - DNA, 842 bp, Triticum aestivum
  Clone ID: PAT_TA_27622
gcggccgctcgttttcctagagacggtttttttttttttttttgagcaagtcagagagatttctgacgttcttccattaaacatgcacataacaagatgaaacgaaaccgctacaggaacaccaccggaccactacgaagaacactacgacatggaacgcatcgatctaagccttggtggtcttcttgggggacttggtcgtcttcttaggagacttgggctccttgccctccttctccgcggtcctcttggggaggagcaccgggttgatcttggggatcacgccaccgtgcgcgatggtgacgccggccagcagctttccgagctcctcgtcgttcctgacagcgagcagcaggtggcgcgggatgatgcggctcttcttgttgtccttggcggcgtttccggcgagctccagcagctcggcggcgaggtactcgaggacggcggcgaggtagacgggggcgccggtgccgacgcgctgggcgtagcggcccttcttgaggtagcgcccgatgcggccgacggggaactggagcccggccttgacggagcgcgtcaccgacttcttcctggggccgccggccttgcgcccggccgcgcccttcttgcccttggcgccagctccggtgcctgagacgtccattgcttgcaggtgatgctcttggggatcggggcgcggaggaggattggttttgtgccgacaggaaggttccagctctcaaattaatttttggtttgctctgtaagcaaagcctgacaaattcaacatcacatttgttcctgagtgatagtttggttagcgatgtatatgatcttcaaaccaacccacgcgtccgcggacg

SEQ ID NO: 27623 - DNA, 3104 bp, Triticum aestivum
  unsure (1)..(3104): unsure at all n locations
  Clone ID: PAT_TA_27623
tgatggttcccacatcaaagggttgctgatcaatttcattcacaaagagtggccatctctccttaaagttccttctttcttggttgagttcatcactccaattattaaggcaaccaagggcaaagctgtcaagtcattttactctatgccagactatgaagcatggaaagagagcttagctggaaatgcaagttcgtggactataaagtactacaaggggctgggaaccagcacagctcaagaaggtcgggattactttgaagatattacccatcataagaaggattttgtctgggctgatgacaaagaagatggtgaggctattgagttagcattcagcaagaaaaagattgctgagaggaaggactggctgaccaactatcagcctggaacttgccttgaccaacgggagaaacgcatcaagtacagtgattttatcaacaaagagctgatactcttctcgatggcagaccttgaacggtcaataccttcaatggtcgacggctttaaaccaggacagaggaagattttgttttgctcgttcaagaagaatttggttaaagaatcaaaggtggcacagtttattggttatgtgtcagaacactcagcataccaccatggtgagcagagtctagcaagcacaattataggaatggctcaggattttgttggcagcaataatatcaatcttttggagccccgtggccagtttggtaccagaaatgcggggggcaaagatgctgctagtgctaggtacatcttcaccagattgcaacctatcacccgcttaatttttccaaaggatgatgatgttcttctgaactatttgaatgaagatgggcagtcaattgaacccagttggtatatgccaatcattcccatggttttggtcaatggaagtgaaggcattggcactggatggagcacctatgtcccaaactacaatccaagagacattattgctaatctgaaaaggttgctgaatggggagactattgtaccaatggttccttggtacagggggttcaagggctctttgaaggagacaagttcaaaggcaaccggtgtgacatataccatcactggtgttatagaggaagttgctgacaccaagcttaaaattactgagcttcccgtccgccgctggactacagattacaaagaatttcttgaatccatgtgtcctattcctattaaggaaaaggaaaagagcaaggacaagaacaaggaaaagaagaaggacaaggacaaggaaaaggagaaggaaaagagcaaggaaccaccattgttagaggaaataaggtcgcagtgtgatcatgcggatgtagattttgagcttatcctgacagagcaaaacatgaatatagccaagcaagaaggccttgagaagaaattcaagctgacgaccacaataggaacaacaaacatgcacttgtttgactcgaatggtaaaatccgaaaatatgacaccccagaggacgtacttaaagagttctttgatttgaggctcgacttctatgtcagacgaaagaaagtaatgttggaaaacatggggattgagttgctgaagtataagaacaaagttaggtttattctcgctgttatttctggggacatcatagtcaataacaggaagagggcagagctattccaggagctgaagcagaagaaatatgatcctttcccaaagaaaaaacccacggccgagccagttgctgtaggatctacagaagtagatgaagaaaatgatgatggtcctgctgaagctgcagcaagtgattatgagtatcttctcgcaatgtctattggtaccttgactatggagaaggtgaaggaactcatcgcgcagcaggataaggtagaagaagatctgaatatcctgagtaatacagagccaaatactctttggctgagagaccttgatgctcttgagaaggaactggatgtgcttgatgcaaaacttgaagctgaacagaatgacagatcacgtaagcgcgccaaaaacgcaaaggaatctaatgcagcacccaagagacagcctaagaaggccgcggccaagtctcagaaggcaaatttggctgggagcgacgacgaagattttgaaccaccgaaaccgaaacctgcagcgcaaaagaagaaaccaccacccaagaaggcaagtgcaccggtgaaagatgaagaggacgacgaagtggctcacctcaaagaccgtctggccgcttataatcttgacgactcctctccagaacctagtgccatggaaacagaagaacagcagaaggcaaagaaagggaggaacggaccaagcaagagaggcgcagcgaagaaggccatgtcatccctagccgagccctctgacgaagacatggcagagccccgccatgagagcgagggtggggggtcttccatggaagttgagaagaagaccaaaggaagaaagcctgctgccgagaagccgaaggctaccaccatcaggaagagggcgccagctcagagcaaagtcatgaagcagaaagtgatggaggaaatattcaagcctaccgatgacagcaacctcagcgctccttcccctgagaagaaggtccgcaggatcaggtcctcccccttcaacaagaagagcggctcgcttctgcagagagcggcgagcgcttcaacaggggcaagaagatgccgaggctcctccttccggcagctctgctgagccggttgcaccgagaaggacagtaagggagaggaaggtgacggtagtctacgcggattctgggagcgaagatgatgagtccgaggatgaagatgcgtcggagccgagcgaatctgactactccggtgaggactagagtactagactcgttggctcagctgctccaaacagtgtgtggaattggagtgcagtgtgactggtttctaagacatttggttagctgatctcatgtgttggtgctttgctcaggtgcatttcttgtgcgtcttatgtttatgttagatgtgtgtactgatgtcacaagaaggtttggaagctacgtgttgttgcttacagtttctccatggcttctgttcctacttagtnctgtgagcttgtatcgttgttcagtnctaagagtttg

SEQ ID NO: 27624 - DNA, 754 bp, Triticum aestivum
  Clone ID: PAT_TA_27624
aagggctcccgttgtaacccacgggcatttgtgctagtagtactaatatgagatgcaaaaaaaaaagcacagatgttttctgatcacagagtaatttggtgattattactctgttcttctcttggaggataaaatactctgctgtcttgatctttttgatattactactgtcagagcaacaagaggagtctattctgaatttctgatatgcgagttacgcttccgtggcggcttttctgctcttcttcctcttgaccttgcgccggatcttaccgtcgacggcatccccccgctgcagctgcgacgacgacgccatggattctgcttctgcagcggcggcttcgtcctcggcggtgggctgcatcccccgcatgaccaccgccgggaacacccagttggacacgaagtagaagagcagcatgacggcactgatcgggatgagcgaggagacgtcgcccggtatcggcgggcgagccgggcacccagcttgggcgagaggatctcgctcagctccggcggcagcgcgcggagccgccgcgcacgccgcgggagctttgctccgggacgctgcggggttgcggccgctgcaccacggcgggtgccattccaagccggagcggcggcggaggccaggcgccgggagcctatcgtcagagtagccgcctccatggagacggcacgttgcgatatcttcgagctggagaggtttaagctcaggtagctccttggtgttgggtgaggcgaggtcccgatg

SEQ ID NO: 27625 - DNA, 668 bp, Triticum aestivum
  unsure (1)..(668): unsure at all n locations
  Clone ID: PAT_TA_27625
ttttttttttttcctgaacattagtctgtgtgtgaattataggaaactgagtgctcacacagaaaatagcatatttccaacttcctgtagtagaaaaattgttggatgaaaagttacaccacgttcagattattcatggtggctgggcagcgcagctccttaaccttgccagccaacttggtctcaatttatcgtcaacaacatacttaaaacagattgtggtaagaaaataaagctctgatgaagtttaatgtgccggtgctgctgctggcgctgaccccgcctcggttttcacttcttttttcccgccaaacgccttcaatccaccatatataatagcgccccacatcgctaagctggttagcacaaagtgctcttccttccagttgccggggttcaagggctcctgccacatgttcacctttgtcgatccgtggtgatctgcggcgccggccatacggcggctggagatgaggcgagcgaggggggaggaagacgaggaagaggaggaggaggaggccgccgcaagcagacgagacgccatcgcttcgattcgacctacttgggcatttctggagaccaatctcaacctaatcctgcaatcatacaactacatactcactcagggggccgtacaatcccanatgatctatacccgcatgcctctt

SEQ ID NO: 27626 - DNA, 1558 bp, Triticum aestivum
  Clone ID: PAT_TA_27626
gcacgaggctgtggtatactccgcgggaaacgacggacccaggccgcagaccgtcgaggatacctcgccttgggtcctcactgtagcggcgagcaagatcgaccgctcgttcccgacggtgatcacgttgggaaacaagcagcaaatggtgggccagtctctctattaccaagtgaagaacatcaactcatcatcacacacggctagaaatttcacaaagcttatatgtgcacaatcttgtgtgccgagacatgaggttcttcatcatattgacgtgaaaggggctatcctggtgtgcttaaatgataatgacgcgatcaatccatcagatgatttccaccatgcggcgaagtacgtggtggaaggcgggggatccgggctgcrtcttcgcgcaatacacaacggacaccctgagttccacagtggcttactgcccgggcatcgcctgcgttatcgtcgacatctacatctccaggaggatatgccaatacgcattcgactcaagctcgcccacagcaaaaatcgaacccacgcgcaccgtcatgagcaaagatgtgctggcttcgaaagtggcgtccttctcttcgagaggcccatcggctgattacccggccttcatcaagcctgacgtagctgcgcccggagccaacatcttagcagcagtgggagattcttacgtaactaagtcaggaacgtccatggcagccccgcatgcagcgggtgtcgccgcgctgctcaaagctctgcacccggattggtctcctgctgcaataaagtcagccatcgtcaccactgcgcatgtaactgatggacacggcatgccgatcctagcggaaggactaccgcggaaggtcgccgatccattcgactatggaggcgggaacatcaacccatgcggggcagctcatcccggcctaatttatgacattgatccacacgattacaacaaattctttcaatgcgccaatgtcaaggaggggatatctgcgatcgcaagctgcaacaccacctctatgccagagtataacctcaatctgccgtccatctcggttcccgattttaggagcgcgatcaccgtctcgaggacggtaaccaatgtcggcgagctccattctgtgtaccacgttgtagtccagagcccgactggagtcaatatggaggttttcccggatgttctggtgttcgatgctgcgaacaaagtccggaaattcgaggtgaagctgtcacctatctggaactttcaagggggctacacgtttggcagcatcacttggcagaatgaccgacaagtagtgaggattccagttgcgacccggattacgattcaggatttctatgcggatgttgcataatgataaaataaaaccacatctcatgcttaaaataaaatcaagacccacatgacacctactaggaagccatatcacctgacatgtgggccctctctctctctctctctctatgtaacaagatgaggtgctttaaattgtatcaagagcagatgaattgtaaaaatcgaatggatgcttataaatttgcttttgctaaaaaaaaaaaa

SEQ ID NO: 27627 - DNA, 1842 bp, Triticum aestivum
  Clone ID: PAT_TA_27627
ttttttttttttttttttttttttttttttttttttttttttttttttgactgtccacaagagatgccacgtaggctaaagattgaaaattcaatagcttcattacaacttacgtactccttaagactcaaaacgtatggtagttgatgtcaattccattgtatgtgtatgctaaaacattctcaaaatgtataggtaagatcatgacaacgggcgtctgcagcaatgcagcatgcagagctgccatcaacagcagaccggtatgaaccgggcaactggaagatgaacgacgttttggtgatctggacggggacggtgcagactgtagccacacaactcactcctggtcaccttgggggccaatatgactgggatacttgaatgaaatatcggtccaggtgctttggccttctgtcagctccttcaccacggatgccacctcgtcgatgcccaccctcacctgctgtttgctgtccctctctcggatcgtcacctctgttgcagaatcaaccgttactgcaaaaggaacacctatctcgtccgttcttgcgtacctcctcccgatagaaatgccagtcgtgtcaataatgtgtgagatgcctgcagctgttaattctttagcaagcactttggcggcaccatcaaactcttgattctttaccagcgggaacacagtgcacttgataggagccacgataggagggaaccggaagacattcagctgctcctcttctgatttgctaggtcttgtgtagaaggaatgctcaaacagacaatagattatcctccctatgccaaatgagggctcaacaactgaaggggtgaagactcgctggtgctccagcttcttctccatactgatcgataccattttctttgtaatcaccacgtcctttccaagtgtgcaaacttggaagttcgtctcccccttagattccaatgcagtcttcatgtccattgcttccttctcactcatagcctccaatgcttcaaccaccatcttctgattgcccttgaaagcaagccctaggtctttctttgagggcacgataaaaagtttctcaacttctctaggctttgaaaacttttcatgagcaacaagtggaacgccacttttctcagaatgagcttttaaatcatatgcagatctatctgcaatgcccacacactctatccatccataagaacactcaatctctgcatcccagcagtcagcagcataatgagccatctcattgggtagatgctgtctgaagcgcaatcggctcttatcaattcccaaacgtgtcaggaaaagatagacccttccaataaagtaaccaagtgtcctcattattaacagttcccttcgaaactgcttctgcaagcttcgttaacttggctgactcccctgagagctgcagctctctcggaaacatcaagaactccaaatcagcaacatcaacaaacttgggatgtgacttatcctcaggatctacgaagtgctcaatctcggccaatgtgaattcacgcactcgtagaagaccttgacgtggagagatctcattgcggaatgcttgaccaatttgagctgctgcaaagggaagcttatcagtgatctcagcagcattcatggcatttggaagatcttgcttgttagcaaacacaagcagcacagcatcacgtaactcatcctcattcagcatcctgtggagctcatcccttgcttcaacaacacggtccctatcgttgctgtccacaacaaagatgagaccctgtgtgttctggaagtaatgcctccacagtggcctgatcttgtcctgacccccgacatcccagacagtgaagctgatgttcttgtac

SEQ ID NO: 27628 - DNA, 807 bp, Triticum aestivum
  unsure (1)..(807): unsure at all n locations
  Clone ID: PAT_TA_27628
ttttgagtcataaacgccgcaatttttgggcaagtcagagaaatttctgacattcttccattaaacatgcacacaacaagataaaacaacacaactacaggaacaccaccggaccactacgaagaacactacgacatggaacgcgtcgattaagccttggtggtcttcttgggggacttggtcgctttcttgggagacttgggctccttgccctccttctccgcggtcctcttggggaggagcaccgggttgatcttcgggatcacgccaccgtgcgcgatggtgacgccggccagcagctttccgagctcctcgtcgttcctgacggcgagcagcaggtggcgcgggatgatgcggctcttcttgttgtccttggcggcgttcccggcgagctccagcagctcggcggcgaggtactcgaggacggcggcaaggtaaacgggggcgccggtgccgacgcgctgggcgtagcggcccttcttgaggtagcgcccgatgcggccgacggggaactggagcccggccttgacggaccgcgtcaccgacttcttcctggggccgccagccttgcgtccggccgcgcctttcttgcccttagcgccagctccggtgcctgagacgtccattgcttgcaggtgatgctcttggggctcggggcgcggaggaggattggttttgtgatgggagattgggctcgtgccgaattcctgcagcccgggggatccactagttctagagcggccgccaccgcggtggagctccagcttttgttccctttagtagggttnatttcgagntagtaacaac

SEQ ID NO: 27629 - DNA, 747 bp, Triticum aestivum
  Clone ID: PAT_TA_27629
aaccctactaaagggaacaaaagctggagctccaccgcggtggcggccgctctagaactagtggatcccccgggctgcaggaattcggcacgagccctcccagcgctcccccctcctcaacaacctcccggcgcatctccgactccatggcccgtaccaagcagacggcgaggaagtccaccggcggcaaggcgccgaggaagcagctggccaccaaggcggcccgcaagtccgccccggccaccggcggcgtcaagaagccccaccgcttccgccccggcaccgtcgcgctccgggagatccgcaagtaccagaagagcaccgagctgctcatccgcaagctacccttccagcgcctggtgagggagatcgcccaggacttcaagaccgacctccgcttccagtcctccgccgtctccgccctgcaggaggccgccgagtcctacctcgtggggctcttcgaggacaccaacctctgcgccatccacgccaagcgcgtcaccatcatgcccaaggacatccagctcgcccgccgcatccgtggagagagggcctaagctctgtgcgtcgtcgtctgttagtcgtcgtcttagccagatgtgttcagcggtgaaattgtgcgtgtttgtagtgtctgttcgtgccatggtggatgtagtgttcctgatctgatgtcacctccttgctgtcatcagtaactgaaatgaaaatgtttgttatctgttctaaaaaaaaaaaaaaaaaaaa

SEQ ID NO: 27630 - DNA, 1623 bp, Triticum aestivum
  Clone ID: PAT_TA_27630
aagtacagcatcgcagagaccggcgtcttcgtactcgcctctctcgcgcgcttccgagctttgtccttcgtcctcctcccccgacctctccagcagcgtagcgtagcgcccgcttccgccgttccgacccgccgccatgagggagtgcatctcgatccacatcggccaggccggtatccaggtcgggaacgcgtgctgggagctctactgcctcgagcatggcattcagcctgatggacagatgcctggtgacaagactgttgggggaggtgatgatgctttcaacaccttcttcagtgtgactggtgctgggaagcatgtcccccgtgctgtctttgttgatcttgagcccactgtgattgatgaggtgaggactggcacttatcgccagctcttccaccctgagcagcttatcagtggcaaggaggatgcagccaacaactttgcccgtggtcactacaccattggcaaggagattgttgacctatgcctggaccgtatcaggaagcttgcagacaactgcactggtcttcagggattcctcgtcttcaacgctgttggaggtggaactggctctggccttggttctcttctcctggagcggctctctgttgactatggaaagaagtccaagcttgggttcacagtgtacccatcccctcaggtctccacctctgttgtcgagccatacaacagtgtcctgtccacccactctctccttgagcacactgatgtggctgtcctccttgacaatgaggccatctatgacatctgccgccgctcccttgacattgagcgcccaacatacaccaacctcaacaggctcgtttctcaggtcatctcatccctgactgcttccctgaggtttgatggtgctctgaatgttgatgtcaacgagttccagaccaacctggtgccctacccaagaatccacttcatgctttcctcctacgccccagtgatctcagccgagaaggcttaccatgagcagctctctgttgccgagatcaccaacagcgccttcgagccttcctccatgatgttgtgcccaaggatgtcaacgccgctgtggccaccatcaagacgaagcgcaccatccagtttgtggactggtgccccactggtttcaagtgtggtatcaactaccagccacccagcgttgtcccaggcggcgaccttgccaaggtccagagggccgtctgcatgatctccaactccaccagcgttgtcgaggtcttctcccgcattgaccacaagttcgacctgatgtacgccaagcgtgccttcgtccactggtacgtgggtgagggcatggaggagggagagttctctgaggcccgtgaggatctcgctgccctggagaaggactatgaagaagttggtgctgagttcgacgagggtgaggatggtgatgagggtgatgagtactagagcagctgagattgcgacctgatgatctgcccaagcggctttatctgttgtctgtctgtttgaatgtttgctgtgtggtgtttggtttacaacctgttgtgttgtatgaacctgtggtatgtttgaacctgcttcgcaccttggtcaatatgcatgttatctggtttgcctgaaaaaaaaaagacaacaatc

SEQ ID NO: 27631 - DNA, 674 bp, Triticum aestivum
  Clone ID: PAT_TA_27631
gaattcactagtgatttcgagcggccgcccgggcaggtttttttttgaacattagtctgcgtgtgaattataggaaactgaatgctcacacaacaaacatattcccaacatcatgtaatagaaaatttgttggatgaaaagttacaccgtgttctgattattcatggtggctggacagtgcagctccttaaccttgcctgccttacaaactcggtctcaatttatcatcaacatacttaaaacagattgcggtaagaaaataaagcttggatgcagtttaatgtgccggtgctgccgctggccctgcctctgttttcacttcttttttcccaccaaatgccttcaatccaccatatataatagcgccccacatagctaagctggctagcacaaagtgctcttccttccagttgccggggttcaagggctcctgccacatgttcaccttggtcgatccgtggtgatctgcggcgccggccatacggcggctggagatgaggcgggcgaggggggaggaggaggcggaggaggaggaggccgccgcaagcagacgagacgccatcgcttcgattcgacctagttgggcgatgtgtctggagagctggtggtggtagcgcaggtcctctgtctgaagcctaaatgccggtggtggtggatacggcccgctccccgct

SEQ ID NO: 27632 - DNA, 898 bp, Triticum aestivum
  Clone ID: PAT_TA_27632
cctagcaaactcaaatcaactaggacccacatgtcatccactagttcgttttccacaagtaaatttgtgaatgaaatcgtgggttcagaaatgaatttgacacacacagaggttgcagcgttttctgagactctattgacattttatttattggtgattacatgactcaaaggaacgaccctggggagctcgatccttctcacatcccgccgcgccattgtcgcgtccatccccacgacgcaggacgtgaagagctgagtccagggccggaagctagactcggtactgcgagctacctattctcgctaccactacttgcacgggcgtcacacaactcgtgagctcatgcacaacacgtacctgacagtacacgctaacaaactaacagactcgatacttgaacagagcttgttgatcatgagcaacaagctagggaccgaacgcagaacacgatttattatgacacagatgcgtgataagctagtaataaaatggacacgtacgtgcagttcattcctcacaccgcgtgccgtagcaaaccccggcaggatataaacaaccgcagttaccgcagcaatccataggacgaaacatgcaaaaaccgcctgctgggaggcaagccagctttgactctgccaagacgacatccatgaggcgaggcatctgcaactttcttgccgccagcatgctgggcggcgtggccgaagccggctccacagctgccatcagcagcagcgccgccaggatcgccaccaccgccatcttagtggtcgccattgcctctcctctctgcctgtgcctgtgcctgtggtgtgttctgagagagagagagagagagagagagagagagagagagagagagagagagagagagagagagagagagagagagagagag

SEQ ID NO: 27633 - DNA, 676 bp, Triticum aestivum
  Clone ID: PAT_TA_27633
tttttttttttttttttttttttttttttttttttttttttttctgaacattagtctgtgtgtaaattataggaaactgagtgctcacacagaaaatagcatatttccaacttcctgtagtagaaaaattgttggatgaaaagttacaccacgttcagattattcatggtggctgggcagcgcagctccttaaccttgccagccttacaaacttggtctcaatttatcgtcaacaacatacttaaaacagattgcggtaagaaaataaagctcggatgaagtttaatgtgccggtgctgctgctggcgctgaccccgcctcggttttcacttcttttttcccgccaaacaccttcaatccaccatatataatagcgccccacatcgctaagctggttagcacaaagtgctcttccttccagttgccggggttcaagggctcctgccacatgttcacctttgtcgatccgtggtgatctgcggcgccggccatacggcggctggagatgaggcgagcgaggggggaggaagacgaggaggaggaggaggccgccgcaagcagacgagacgccatcgcttcgattcgacctactttggggcgatgtgtctggagagcgcaaatcctctaaccctaaatggtggtggtggtggtggatatgttgcgtcctcggcccgct

SEQ ID NO: 27634 - DNA, 1743 bp, Triticum aestivum
  Clone ID: PAT_TA_27634
gcggggctaagcagagtggggaaaggcgtcttcgtactcgcctctctccgcgcaaccgagccttcgccctcctccttccccatttcgccagcggcgcagcccaccaaccacccccacccgccgccatgagggagtgcatctcgatccacatcggccaggccggcatccaggtcgggaacgcgtgctgggagctctattgcctcgagcatggcattcagcctgatggccagatgcccggtgacaagaccgttgggggaggtgatgatgctttcaacaccttcttcagcgagactggtgctgggaagcacgtcccccgtgctgtcttcgtagatctcgagcccactgtgattgatgaggtgaggactggcgcttaccgccagctcttccaccctgagcagcttatcagtggcaaggaggatgcagccaacaacttcgcccgtggtcattacaccattggcaaggagattgttgatctctgcctagatcgtatcaggaagctttcagacaactgcactggtctgcagggattccttgtcttcaacgctgttggaggtggaactggctctggccttggttcgcttctcctggagcgtctctctgttgactatggaaagaagtccaagcttgggttcacagtttacccatctccccaggtctccacttctgttgttgagccatacaacagtgtcctgtccacccactcactccttgagcacaccgatgtctctatccttcttgacaatgaggccatctatgacatctgccgccgctcccttgacattgagcgcccaacatacaccaacctcaacaggcttgtttctcaggtcatttcatcattgactgcttccctgaggtttgatggtgctctgaatgttgatgtcaacgagttccagaccaacctggtgccctacccgaggatccacttcatgctttcctcctatgccccagtgatctcagccgagaaagcctaccatgagcagctgtctgttgctgagatcaccaacagcgcctttgagccttcctccatgatggccaagtgtgacccccgccacggcaagtacatggcctgctgcctcatgtaccgtggtgatgttgtgcccaaggatgtcaacgctgctgtggccaccatcaagaccaagcgcactatccagtttgttgactggtgccccactggcttcaagtgtggtatcaactaccagccacctggtgttgtcccaggcggtgaccttgccaaggtccagagggctgtgtgcatgatctccaactccaccagtgtcgtcgaggtcttctcccgcatcgaccacaagtttgacctgatgtacgccaaagcgcgccttcgtccactggtacgtgggtgagggcatggaggagggagagttctctgaggcccgtgaggatcttgctgccctggagaaggactatgaagaagttggtgctgagtttgacgagggtgaggacggtgacgagggcgacgagtactagagcctgcctcctggtgctttcccaaggcatgctgctgcaatcctatgatctgcccgagtggctttatctgttatctgtctgtttgaacatttgctttgtggtgtttgttttacaacctgttgtgttgtaagaaccttgtatgtttgaacctgttatgcaccttggttaatatgcatgctatctggttatctacaccatagcctctactgctctgtctccatttttctgttttataatttgtgttgttgactaaaaaaaaaa

SEQ ID NO: 27635 - DNA, 1221 bp, Triticum aestivum
  Clone ID: PAT_TA_27635
ggagcgtctctctgttgactatggaaagaagtccaagcttgggttcacagtttacccatctccccaggtctccacttctgttgttgagccatacaacagtgtcctgtccacccactcactccttgagcacaccgatgtctctatccttcttgacaatgaggccatctatgacatctgccgccgctcccttgacattgagcgcccaacatacaccaacctcaacaggcttgtttctcaggtcatttcatcattgactgcttccctgaggtttgatggtgctctgaatgttgatgtcaacgagttccagaccaacctggtgccctacccgaggatccacttcatgctttcctcctatgccccagtgatctcagccgagaaggcctaccatgagcagctgtctgttgccgagatcaccaacagcgcctttgagccttcctccatgatggccaagtgcgacccccgccatggcaagtacatggcctgctgcctcatgtaccgtggtgatgttgtgcccaaggatgtcaacgctgctgtggccaccatcaagaccaagcgcactatccagtttgttgactggtgccccactggcttcaagtgtggtatcaactaccagccacctggtgtcgtcccaggcggtgaccttgccaaggtccagagggctgtgtgcatgatctccaactccaccagtgttgtcgaggtcttttcccgcatcgaccacaagtttgacctgatgtacgccaagcgtgccttcgtccactggtacgtgggtgagggcatggaggagggagagttctctgaggcccgtgaggatcttgctgccctggagaaggactacgaagaagttggtgctgagttcgacgagggtgaggacggtgacgagggcgatgagtactagagcctgcctcctggtgctttcccaaggcatgctgctgcaatcctatgatctgcccgagtggctttatctgttatctgtctgtttgaacatttgctttgtggtgtttgttttacaacctgttgtgttgtaagaaccttgtatgtttgaacctgttatgcaccttggttaatatgcatgctatctggttatctacaccatagcctctaaaaaaaaaaaaacaaaaaaaaaataaaaaaaaaaaaaataaaaaaaaaaaaaaaaaaaaaaatcaaaaaaaaaggaaaaaaaaaaaaaaatacaaaaaaaaaaaagcggccgccctaaag

SEQ ID NO: 27636 - DNA, 1692 bp, Triticum aestivum
  Clone ID: PAT_TA_27636
gcagagaccggcgtcttcgtactcgcctctctcgcgcgcttccgagctttggcctccgtcctcccctcctcccccgatctctccaccagcgcagcgtagcgccggcttccgccgctccgacccgccgccatgagggagtgcatctcgatccacatcggccaggccggtatccaggtcgggaacgcgtgctgggagctctactgcctcgagcatggcattcagcctgatggacagatgcccggtgacaagaccgttgggggaggtgatgatgctttcaacaccttcttcagtgagactggtgctgggaagcatgtcccccgcgcggtctttgttgatcttgagcccactgtgattgatgaggtgaggactggcacttaccgccagctcttccaccctgagcagcttatcagtggcaaggaggatgcagccaacaactttgcccgtggtcactacaccattggcaaggagattgttgacctatgccttgaccgtatcaggaagcttgcagacaactgcactggtctccaggggttccttgtcttcaacgctgttggaggtggaactggctctggccttggttctcttctccttgagcgtctctctgttgactatggaaagaagtccaagcttgggttcacagtgtacccatcccctcaggtctccacctctgttgttgagccatacaacagtgtcctgtccacccactctctccttgagcacactgatgtggctgtcctccttgacaatgaggccatctatgacatctgccgccgctcccttgacattgagcgcccaacatacaccaacctcaataggctcgtttctcaggtcatctcatccctgactgcttccctgaggtttgatggtgctctgaatgttgatgtgaacgagtttcagaccaacctggtgccctacccgaggatccacttcatgctttcctcctatgccccagtgatctcagctgagaaggcttaccatgagcagctctctgtcgctgagatcaccaacagcgccttcgagccttcctccatgatggccaagtgtgacccccgccacggcaagtacatggcctgctgcctcatgtaccgtggtgatgttgtgcccaaggatgtcaacgctgctgtggccaccatcaagacgaagcgcaccatccagtttgtggactggtgccccactggtttcaagtgtggtatcaactaccagccacccagcgtcgtcccaggcggcgacctcgccaaggtccagagggccgtgtgcatgatctccaactccaccagcgttgtcgaggtcttctcccgcatcgaccacaagttcgacctgatgtacgctaagcgtgccttcgtccactggtacgtgggtgagggcatggaggagggtgagttctctgaggcccgtgaggatcttgctgccctggagaaggactatgaagaagttggcgctgagttcgacgagggcgaggacggtgatgagggtgatgagtactagagcagatgagtttgcgacctgatgtacgtcaagcgtgccttcgtctactactatcctgtgatctgcccaagcggctttatctgttgtctgcctgtttgaatgtttgctgtgtggtgtttggtttacaacctgttgtgttgtatgaacctgtggtatgtttgaacctgcttcgcaccttggtcaatatgcatgttatctcgtttgcct

SEQ ID NO: 27637 - DNA, 1295 bp, Triticum aestivum
  unsure (1)..(1295): unsure at all n locations
  Clone ID: PAT_TA_27637
cagtcgggccgggctaagcagagtggggaaaggcgtcttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgttggaggtggaactggctctggccttggctcgcttctcctggagcgcctctctgttgactatggaaagaagtccaagcttgggttcacggtgtacccatctccccaggtctccacctctgttgttgagccatacaacagtgtcctgtccacccactcactccttgagcacactgatgtctctatccttcttgacaatgaggccatctatgacatctgccgccgctcccttgacattgagcgcccaacatacaccaacctcaacaggcttgtttctcaggtcatttcatcactgacagctttccttgaggtttgatggtgctctgaatgttgatgtcaatgaattccagaccaacttggtgccctacccgaggatccacttcatgctttcctcctatgccccagtgatctcagctgagaaggcttaccatgagcagctgtccgttgctgagatcaccaacagcgcctttgagccttcgtccatgatggccaagtgcgacccccgccacggcaagtacatggcctgctgtctcatgtaccgtggtgatgtttgtgccaaaggacgtcaacgctgctgtggcaccatcaaagaccaagcgcactatcatttgtttgactgggtgccccactggttccaagtgtgggtacaaacttaccaanccaccaagtgtctcccaagcggggacctttccaaggcccagaggctgttttcatatntcccactcccacaatgtcntccaggcc

SEQ ID NO: 27638 - DNA, 1916 bp, Triticum aestivum
  unsure (1)..(1916): unsure at all n locations
  Clone ID: PAT_TA_27638
cgtccgcccacgcgtccgcgcagagaccggcgtcttcgtactcgcctctctctcgcgcttccgagctttggcctccctcccctcctccccgcaatctccccaccagcgtagcgcagcgcgcgcctccgccgctccgacccgcagccatgagggagtgcatctcgatccacatcggccaggccggcatccaggtcgggaacgcgtgctgggagctctactgcctcgagcatggcattcagcctgatggacagatgcctggtgacaagaccgttgggggaggtgatgatgctttcaacaccttcttcagtgagactggtgctgggaagcatgttccccgtgctgtctttgttgatcttgagcccactgtgattgatgaggtgaggactggcacctatcgccagctcttccaccctgagcagcttatcagtggcaaggaggatgcagccaacaactttgcccgtggtcactacaccattggcaaggagattgttgacctatgccttgaccgtatcaggaagcttgcagacaactgcactggtctccagggattccttgtcttcaacgctgttggaggtggaactggctctggccttggttctctcctccttgagcgtctctctgttgactatggaaagaagtccaagcttgggttcacagtgtacccatctcctcaggtctccacctctgttgttgagccatacaacagtgtcctgtccacccactctctccttgagcacactgatgtggctgtccttcttgacaatgaggccatctatgacatctgccgccgctcccttgacattgagcgcccaacatacaccaacctcaacaggctcgtttctcaggtcatctcatccctgactgcttccctgaggtttgatggtgctctgaatgttgatgtgaacgaattccagaccaacctggtgccctacccaaggatccacttcatgctttcctcctacgccccagtcatctcagctgagaaggcttaccatgagcagctctctgtcgctgagatcaccaacagcgccttcgagccatcctccatgatggccaagtgtgacccccgccacggcaagtacatggcctgctgtctcatgtaccgtggtgatgttgtgcccaaggatgtcaacgccgctgtggccaccatcaagacgaagcgcaccatccagtttgtggactggtgccccactggtttcaagtgtggtatcaactaccagccacccagcgtcgtcccaggcggtgaccttgccaaggtccagagggctgtctgcatgatctccaactccaccagcgttgtcgaggtcttctcccgcattgaccacaagttcgacctcatgtacgccaagcgtgcctttgtccactggtacgtgggtgagggcatggaggagggagagttctctgaggcccgtgaggatctcgctgccctggagaaggactatgaagaagttggcgctgagttcgacgagggtgaggatggtgatgagggtgatgagtactagagctgctgagttcaacgacctgatgtacgccaagcgttccttcgtgtgatctgcccgagtggctttatctgctgtctgtctgtttgaatgtttgctgtgtggtgtttggtttacaacctgtggtatgtttgaacctgcttcgcaccttggtcaatatgcatgttatctggtttgcctacaccatttccctgtttcagtatttgtattgttccttggggtgatttggttggtgtcgtcgcctggatgatcccctcctttatattgtttcttcgttgtgcctccctgatctatgctgcaagggtcatagcgatcagtggtgtccttgaaatgcgtctgtgctacgcctgtaactgttgtagcttccagtcaagtgctacgcctgcatagccgtctgtagtccctgcnnaaaaaaaa

SEQ ID NO: 27639 - DNA, 1894 bp, Triticum aestivum
  Clone ID: PAT_TA_27639
ttttttttttagaagctcatagtaatatgagattactcagtcacgcacaaatagcagtgattgcattcttatatggaattgtgagctacacatctgatcacaaactatcacgagtatgtacagcaatcacaggaaatcacctttctactacgggtatatgtacattataagttggacacagccaaggtaatttggtgtggtggaatagctgaaataatggcataattcttattcatctaaggttcgttggttcaagcactactaaccctgtgtgaataggaagggactttggtatatggtacaatagctgagatagggaccaagttgcttcacctctggtttaagcactaaaacccttgtgtgtggcactccaggggttggttgggatgctcgtgcacgcctgagcagcaacctttgccatcgcttcaggaacaatgccgacattgcagatgtttgcaaaggaccgcatgtgcttcattccatactgcgccagcgagccacattgtgattcaaaagtacgcaccgtagacttgagacaactccagtcatcaacaagaggctcaccagctgggcgaacagcctttagaaccatcggaccacccacagaaccaaacagaaggtttccaatcagctcgacgctgttgtcaatatgagatctatgacccatcatttcaagcaattgcttccgagcatcctttttctcaggggagctctcagccaatttccggtacttctgccagaaataaacaagatcagcatccctctgattaacagctcttgagaatgatggcagtgcgttatcttcaacaaatgtagtgttctcgttagcagggtttgacccattgtacggagaacaaattgttcagcattcaggtccaaagaaccgtattgcatcacatgggaaccatagctgtatgagtcctgagctgccgttctcttcttgacccaggttatacttgcttgcttgagagattcagttctcaggttgtggacatcactgtcttccatcccaagaaatactgtacaggtcgcccaagcaggtgtcatattcggacggagggctagggtactcgccggggcaatacgttccccaactgctttcctctgcgttcgatgcggtggtcgcatagacaccgatgtcattcggcagaagtccctcaaagatgctcccagattcgcaggcttcaaggtaaaataccaggcttttgtaggttccagcagcgtgctttttcttcaggacatctacaagatcgtcaccgtaaaggtatggataggtaggcatcccaaggaccccaggacccccatggtcactgtaaaacacaaaaatgtgatcattagggccactgtccacgactttgccgctcccaccactcacagcggttctattaccgagcaagacagcaaagaagttcttgacattaacctcctttccagtgtagtccttagggaccccagcatagacatctccaccctgggggtggttgatgatgacgcccggcctcgggttctccgggttgtgcgcaatgtcgtcatacatgaatatgatgatgttctcatccttgagaccacccttcttcatgatctggtaggcgtggcagatatccgcctggtggcggtagttgtagtagccgttggagccggcgatgaggacggcccacctggtcccgacggagtcatcgtcctcctgcccggcggcgcgctgcgacggcagccggatggtgggctccagccgtagggtccgcgcgtgcgccacggccagcacgagcgccgagaggcacgcggcgagcaggagagcgaggggaagggggcggaaggacgccatcgccatggctggtgtttggggtttggattccgcgaagaagcgagggggaggaggaaggaggggtttaattcg

SEQ ID NO: 27640 - DNA, 840 bp, Triticum aestivum
  Clone ID: PAT_TA_27640
ctcgtgccgaattcggcacgagggatcatttgacagatcaaacaggagttgctaatagcaaactagcactcatacgatgaaaaatattccaaaacacaaccagattgaatccagtacatgagacgatcatcaaaaggtttcacaaagtatgagctagcagtatttagacgacagataataggccaaaaatttcgactcagccagaccagatgctacaaactgctctaacgaataggcagataggttatgtagagcttccttctctaggccttcctggcaatctgggactcagcctccttcttcaccggctcttccttctccgacaagatcagctcaatgtggcatgggttggacatgtaggggttgatgcgtccatgggcacggtaggtccggcgccgctgcttctgggcctggttcacttggatgtgtgaaatgtagagagcatcaacatcaagacctttcacctcagcattgctctcagcattctttagaagatccagaacgaacttagcagacttggcaggccagcgtccctgaccattgggctgacggttcttcacctgggctgtgcgtccaacaccacggcagtacctccggaaggggatggcttgcttgtgtgccaacacatcctcaaggtacctcttggccttgttgagcgacatcttcctcagggcaaacgctgtttccctagtgttcttgaaatgaacacgcaggtcccggcccatggccttggcggacttggtgggattggcgggatccgtcgagtacttcaccatggctgcggcggtgcagtagagaaggcagcggcggcggcgagcctcgtgccgaattcggcacgag

SEQ ID NO: 27641 - DNA, 925 bp, Triticum aestivum
  Clone ID: PAT_TA_27641
ttttttttttcgtcaaggacatcgcaaagttgaaaatagtataacgggcgcttaaaatcttggatgtgggcgattctttacaaggaatttatgtgtttcatcaactaagttacatactgatgcgggacagcataacgtagggatcaaacagtaatagcaaaggaaaactcatgcgatgaaaaatattccaaaacacaaccagattgaatccagtacatgagacatcatcaaaggtttcacaaagtatgagctagcagtatttagacgacagataacaggccaaaatttccactcagccaaaccagatgctacaagctgctctaacgaatagggggataggttatgtagagcttccttctctaggccttcctggcgatctgggactcagcctccttcttcaccggctcttccttctccgacaagatcagctcgatgtggcaagggttggacatgtaggggttgatgcgtccatgggcacggtaggtccggcgccgctgcttctgggcctggttcacttggatgtgtgaaatgtagagagcatcgacatcaagacctttcacctcagcattgctctctgcgttcttaagaagatccagaacgaacttagcagacttggcaggccagcgtccctgaccatttggctggcggttcttaacctgggctgtacgcccaacaccacggcagtacctccggaaggggatagcttgcttgtgtgccaacacatcctcaaggtacctcttggctttgttcaatgacatcttcctcagggcaaacgctgtttccctcgtgttcttgaaatgcacacgcaggtcccggcccatggccttggcggacttggtgggattggcgggatccgttgagtacttcaccatggctgcggcggcgcggtagacaaggcagcggcggcggcgagagcgaggggttt

SEQ ID NO: 27642 - DNA, 805 bp, Triticum aestivum
  Clone ID: PAT_TA_27642
ttttttttttttttttttgagggatcaaacaggaaaaactcatacgatgaaaaatattccaaaacacaacaatattgaatccagtacatgagacgatcatgggtttcacaaagtatgagctagcagtatttagacgacacagataacaggccaaaaatttccactcagccaaaccagatgctacaaactgctctaacgaataggcggataggttatgtagagcttccttctctaggccttcctggcgatctgggactcagcctccttcttcaccggctcttccttctccgacaagatcagctcaatgtggcatgggttggacatgtaggggttgatgcgtccatgggcacggtaggtccggcgccgctgcttctgggcctggttcacttggatgtgtgaaatgtagagagcatcaacatcaagacctttcacctcagcattgctctcagcgttctttagaagatccagaacgaacttagcagacttggcaggccagcgtccctgaccattgggctgacggttcttcacctgggctgtgcgtccaacaccacggcagtacctccggaaggggatggcttgcttgtgtgccaacacatcctcaaggtacctcttggccttgttgagcgacatcttcctcagggcaagcgctgtttccctagtgttcttgaaatgaacacgcaggtcccggcccatggccttggcggacttggtgggattggcgggatccgtcgagtacttcaccatggctgcggcggcgcgggagagaaggcagcggcggcggcgagagcgaggggatttttgattt

SEQ ID NO: 27643 - DNA, 1116 bp, Triticum aestivum
  unsure (1)..(1116): unsure at all n locations
  Clone ID: PAT_TA_27643
atcgtagcaaactcaaatcaactagacccacatgtcatccacaagttcgttttccacaagtaaatctgtgaatgaaatcgtgcgttcagaaatgaatttgacacacacagaggttgcagcgttttctgagactctattgacattttatttattggtgattacatgactcaaaggaacggccctgggagctcgatccttctcacatcccgccacgccattgtcgcgtccatccccacgacgcaggacgtgaagagcgagtccaaggccggaagctagactcggtactgcgagctacctattctcgccaccactaattgcacggcgtcacacaactcgtgagctcatgcacaacacgtacctgacagtacacgctaacaaactaacagactcgatacttgaacagagcttgttgatcatgagcaacaagctagggatcgaacgcagaacacgatttattgtgacacagatgcgtgataagctagtaataaaatggacacatacgtgcagttcattcctcacaccgcgtgccgtagcaaaccccggcaggatataaacaaccgcagttaccgcagcaatccataggacgaaacatgcaaaaaccgcctgctgggaggcaagccagctttgactctgccaagacgacatccatgaggcgaggcatctgcaactttcttgccgccagcatgctgggcggcgtggccgaagccggctccacagctgccatcagcagcagcgccgccaggatcgccaccaccgccatcttagtggtcgccattgcctctcctctctgcctgtgcctgtgcctgtgtgtgttctttcactcctcgagcattaatgcaacccttcctacagccgtagtaggttgacctgattctcttcttccttgactcgtttctagcaaatcacaaatttctttgtctaaatgtaggatcagtgcaggagcaatccttttcagaatatattgaccaacttgattttccacatggatcgcaagctttcagacaactgcactggtctccagggattccttgtcttcaacgctgttggnnntggaactggctctggccttggttctcttctgctggagcgcctctctgttgactatggaaagaagtc

SEQ ID NO: 27644 - DNA, 1084 bp, Triticum aestivum
  unsure (1)..(1084): unsure at all n locations
  Clone ID: PAT_TA_27644
tgcgttcagaaatgaatttgacacacacagaggttgcagcgttttctgagactctattgacattttatttattggtgattacatgactcaaaggaacggccctgggagctcgatccttctcacatcccgccacgccattgtcgcgtccatccccacgacgcaggacgtgaagagcgagtccagggctggaagctagactcggtactgcgagctacctattctcgccaccactaattgcacggcgtcacacaactcgtgagctcatgcacaacacgtacctgacagtacacgcaaacaaactaacagactcgatacttgaacagagcttgttgatcatgagcaacaagctagggaccgaacgcagaacgcgatttattgtgacacagatgcgtgataagctagtaataaaatggacacgtacgtgcagttcattcctcacaccgcgtgccgtagcaaaccccggcaggatataaacaaccgcagttaccgcagcaatccataggacgaaacatgcaaaaaccgcctgctgggaggcaagccagctttgactctgccaagacgacatccatgaggcgaggcatctgcaactttcttgccgccagcatgctgggcggcgtggccgaagccggctccacagctgccatcagcagcagcgccgccaggatcgccaccaccgccatcttagtggtcgccattgcctctcctctctgcctgtgcctgtgcctgtgtgtgttctttcactcctcgagcattaatgcaacccttcctacagccgtagtaggttgacctgattctcttcttccttgactcgtttctagcaaatcacaaatttctttgtctaaatgtaggatcagtgcaggagcaatccttttcagaatatattgaccaacttgattttccacatggatcgcaagcttcgttaacttggctgactcccctgagagctgcagctctctcggaaacatcaagaactccaaatcagcaacatcaacaaacttgggatgtgacttatcctcnnnatctacgaagtgctcaatctcggcnaatgtgaattcacgcactcgtagangnnnttgacgtggag

SEQ ID NO: 27645 - DNA, 1871 bp, Triticum aestivum
  Clone ID: PAT_TA_27645
attcggcacgaggcagagaccggcgtcttcgtactcgcctctctctcgcgcttccgagctttgtccttcgtcctcctcccccgacctctccagcagcgtagcgtagcgcccgcttccgccgttccgacccgccgccatgagggagtgcatctcgatccacatcggccaggctggtatccaggtcgggaacgcgtgctgggagctctactgcctcgagcatggcattcagcctgatggacagatgcccggtgacaagactgttgggggaggtgatgatgctttcaacaccttcttcagtgagactggtgctgggaagcatgtcccccgtgctgtctttgttgatcttgagcccactgtgattgatgaggtgaggactggcacttatcgccagctcttccaccctgagcagcttatcagtggcaaggaggatgcagccaacaactttgcccgtggtcactacaccattggcaaggagattgttgacctatgcctggaccgtatcaggaagcttgcagacaactgcactggtcttcagggattcctcgtcttcaacgctgttggaggtggaactggctctggccttggttctcttctcctggagcggctctctgttgactatggaaagaagtccaagcttgggttcacagtgtacccatcccctcaggtctccacctctgttgtcgagccatacaacagtgtcctgtccacccactctctccttgagcacactgatgtggctgtcctccttgacaatgaggccatctatgacatctgccgccgctcccttgacattgagcgcccaacatacaccaacctcaacaggctcgtttctcaggtcatctcatccctgactgcttccctgaggtttgatggtgctctgaatgttgatgtcaacgagttccagaccaacctggtgccctacccaagaatccacttcatgctttcctcctacgccccagtgatctcagccgagaaggcttaccatgagcagctctctgttgccgagatcaccaacagcgccttcgagccttcctccatgatggcaaagtgtgaccccccgccacggcaagtacatggcctgctgcctcatgtaccgtggtgatgttgtgcccaaggatgtcaacgccgctgtggccaccatcaagacgaagcgcaccatccagtttgtggactggtgccccactggtttcaagtgtggtatcaactaccagccacccagcgtcgtcccaggcggcgaccttgccaaggtcccagagggccgtctgcatgatctccaactccaccagcgttgtcgaggtcttctcccgcatcgaccacaagttcgacctgatgtacgccaagcgtgccttcgtccactggtacgtgggtgagggcatggaggagggagagttctctgaggcccgtgaggatctcgctgccctggagaaggactatgaagaagttggtgctgagttcgacgagggtgaggatggtgatgagggtgatgagtactagagcagctgagattgcgacctgatgatctgcccgagtggctttatctgttttctgtctgtttgaattgaatgtttgctgtggggtgtttggtttacaacctgttgtgttgtatgaacctgcttcgcaccttggtcaatatgcatgttatccggtttgcctacaccatagatctactgctccgtcaccatttcccagtttcagtatgtgtattgtttcttcgtgtgatttggtttggtgtcgtcgcctggatgatctctacttcaagggtcacagcgatcagcggtgtctttgaaatgcgtctgtgctatgcctgtaactgttgtagcttccagtctgtaacaactgagctgaactgcatagccgtctgtagtccctgc

SEQ ID NO: 27646 - DNA, 2511 bp, Triticum aestivum
  Clone ID: PAT_TA_27646
ccccatttttggcaagtcagagagatttctgacattcttccattaaacatgcacacaacaagataaaacaacacaactacaggaacaccaccggaccactacgaagaacactacgacagtctacgacatggaacgcgtcgattaagccttggtggtcttcttgggggacttggtcgctttcttgggagacttgggctccttgccctccttctccgcggtcctcttggggaggagcaccgggttgatcttggggatcacgccaccgtgcgcgatggtgacgccggccagcagctttccgagctcctcgtcgttcctgacggcgagcagcaggtggcgcgggatgatgcggctcttcttgttgtccttggcggcgttcccggcgagctccagcagctcggcggcgaggtactcgaggacggcggcaaggtaaacgggggcgccggtgccgacgcgctgggcgtagcggcccttcttgaggtagcgcccgatgcggccgacagggaactggagcccggccttgacggaccgcgtcaccgacttcttcctggggccgccagccttgcgtccggccgcgcctttcttgcccttagcgccagctccggtgcctgagacgtccattgcttgcaggtgatgctcttggggctcggggcgcggaggaggattggttttgtgacctcggccgaggtacccgttttctcttatcttgcacaactctaaaccagttggccatcaggatcttgttggcttagtaatctcaatattgctcctggcagatttcagcttagtgttgcttacttttctccagctatactcatactcaatggccgacgttctcttagttctgtttgttcttcctcttgcgatactgtcgcctttccctgctggaataaatgctctttttagtcatggaccacggcgatcagcaggccttgctcgtgtatatgcattgtggaacattacttcactggttaatgttgttgtggctttgatatgcggattcgtactgcctcgagcatggcattcagcctgatggccagatgcccggtgacaagaccgttgggggaggtgatgatgctttcaacaccttcttcagcgagactggggctgggaagcacgtcccccgtgctgtcttcgtagatctcgagcccactgtgattgatgaggtgaggactggcgcttaccgccagctcttccaccctgagcagcttatcagtggcaaggaggatgctgccaacaacttcgcccgtggtcattacaccattggcaaggagattgttgatctgtgccttgaccgtatcaggaagctttcagacaactgcactggtctccagggattccttgtcttcaacgctgttggaggtggaactggctctggccttggttctcttctgctggagcgcctctctgttgactatggaaagaagtccaagcttgggttcacagtgtacccatcaccccaggtctccacctctgttgttgagccatacaacagtgtcctgtccacccactccctccttgagcacactgatgtgtctatccttcttgacaatgaggccatctatgacatctgccgccgctcccttgacattgagcgcccaacatacaccaacctcaacaggcttgtttctcaggtcatttcatcgctgacagcttccctgaggtttgatggtgctctgaatgttgatgtcaatgaattccagaccaacttggtgccctacccgaggatccacttcatgctttcctcctatgccccagtgatctcagctgagaaggcctaccatgagcagctgtctgttgctgagatcaccaacagcgcctttgagccttcatctatgatggccaagtgtgacccccgccacggcaagtacatggcctgctgtctcatgtaccgtggtgatgttgttcccaaggatgtcaacgctgctgtggccaccatcaagaccaagcgcactatccagtttgttgactggtgccccactggcttcaagtgtggtatcaactaccagccaccaggtgttgtcccaggcggtgaccttgccaaggtccagagggctgtgtgcatgatctccaactccaccagtgtcgtcgaggtcttctcccgcattgaccacaagtttgacctcatgtacgccaagcgtgccttcgtccactggtacgtgggtgagggcatggaggagggagagttctctgaggcccgtgaggatcttgctgccctggagaacgactatgaagaagttggtgctgagttcgacgagggtgaggacggtgacgagggcgacgagtactagagcctgcctcctggtgctttcccaaggcgtgctgctgctatcccatgatctgcccgagtggctttatctgttatctgtctgtttgaatctttgctttgtggtgtttgttttataacctgttgtgttgtaagacccttgtatctttgaacctgttatgcaccttggttaatatgcatgctatctggttatctacaccatagccttaaaaaaaaaaaaaaaaaaa

SEQ ID NO: 27647 - DNA, 1830 bp, Triticum aestivum
  unsure (1)..(1830): unsure at all n locations
  Clone ID: PAT_TA_27647
ccgcgtcgacaggcgtcttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgcgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgttggaggtggaactggctctggccttggctcgcttctcctggagcgcctctctgttgactatggaaagaagtccaagcttgggttcacggtgtacccatctccccaggtctccacctctgttgttgagccatacaacagtgtcctgtccacccactcactccttgagcacactgatgtctctatccttcttgacaatgaggccatctatgacatctgccgccgctcccttgacattgagcgcccaacatacaccaacctcaacaggcttgtttctcaggtcatttcatcactgacagcttccctgaggtttgatggtgctctgaatgttgatgtcaatgaattccagaccaacttggtgccctacccgaggatccacttcatgctttcctcctatgccccagtgatctcagctgagaaggcttaccatgagcagctgtccgttgctgagatcaccaacagcgcctttgagccttcgtccatgatggccaagtgcgacccccgccacggcaagtacatggcctgctgtctcatgtaccgtggtgatgttgtgccaaaggacgtcaacgctgctgtggccaccatcaagaccaagcgcactattcagtttgttgactggtgccccactggcttcaagtgtggtatcaactaccagccaccaggtgtcgtcccaggcggtgaccttgccaaggtccagagggctgtgtgcatgatctccaactccaccagtgtcgtcgaggtcttctcccgcatcgaccacaagtttgacctgatgtacgccaagcgtgccttcgtccactggtacgtcggtgagggcatggaggagggagagttctctgaggcccgtgaggatctcgctgccctggagaaggactatgaagaagttggtgctgagttcgacgagggtgaggacggtgatgagggcgatgagtattaagcctgcctcctggtgctttcccaaggcttgctactgctatcctatgatctgcccgagtggctttatctgttatctgtctgtttgaacgtttgctttgtggtgtttgttttacaacctgttgtgttgtaagaaccttgtatctttgaacctgctttgcaccttggttaatatgcatgctatctggttatctaaaaaaaaaaaaaaaaaacgcgagactagttctcctcgtgccgaattcctgcagcccgggggatccactagttctagagcggccgccaccgcggtggagctccagcttttgttccctttagtgagggttaatntcgagctgncggatttcaaagnnnncnaacgggnttcaa

SEQ ID NO: 27648 - DNA, 448 bp, Triticum aestivum
  Clone ID: PAT_TA_27648
accggtcaaactagtccgcggcgacggggtccgggtgagcccggtgctgaacgtgacatccatcggcaccagcgtggtgaacatgctgagccacctgctctgcgactgcggcgagaaggccggcaagcagcagagcaggggcttcggagtgcgctgctgggtaaccagatagtagtactagcagttgtactacaagttaagcgcactcgttaattactgattgattgtccgcttgtcgccactgttgcttgtaagtaagtactaagatggaaagatgaatcaatccatgtgaatcgtgaccgattgatggattgctttgtgcatgcatgggatgggaggagggcccttttggttgtgtcgttggttagtggcagagcatgtggtcttgtggggaggaaagaaagaccattggtcccgacccacatgagagaccgacggagtgcatggc

SEQ ID NO: 27649 - DNA, 864 bp, Triticum aestivum
  unsure (1)..(864): unsure at all n locations
  Clone ID: PAT_TA_27649
caccagggaanttctcagnttgantgncttgactcntccggtgaggnctggccttacagtattncnacagtgggggatantcaccgtggctgtgctcagattcaagtactacatggtttgatcagttggatnatttccnggttaggtagnattgccaagtttcttgtcatatccccagttattggantttgtagntgntntatatgcacggggtgagaaacgttccccggantcttcgtgatgcntaaaggtcgcccaaggtagaaatcaaggaaaagcatcaagtgttgatggttaacaaggccactagtttcaagaaaagggcaaagggaaagaaagaggaacttcaaaaaagaatagcaagcaagttgctgctcccatgaagaagcccaaagctagacccaagcctggaactaagtgcttctactgtgaatgaaatggtcactggaagcagaactgcccaaatacttggcggataagaaggatggcaaagtgaacaaaagtatatatgatatacatgttattgatgtgtactttactagtgtttatagaaaaccctcaggtatttgatactggttcagttgctaagagtagtaactcaaaacgggagttgcaaaataaacaaagactagttgagggcgagatgatgatgtgtgttggaagtaattccaaggtttataagatcaccaacgcacactccctttaccttctggattagtgttaaacctaaaataaatgttattcggtgtttgcgttgagcataatatgattggatcatttttattgcaatatggttattcatttaagtcaagaaataattgctattctgtttacatgaataaacccttaatacgactcattata

SEQ ID NO: 27650 - DNA, 346 bp, Triticum aestivum
  Clone ID: PAT_TA_27650
gtgtatcacttatgcagggtgacctcttttaaaaaatagattcctttacacatgccctcaggcatgaggcatgaattaatctgccactgaacttgttaaatagacactccaggaccatcctgcacggacacagtggaggagatgaccgggtgatcggcaccggcgttcctcgcgtagaacgccggcttggacggggcgctgagagagactgtttcgcctccgagcatcatgaccaccgacgacatcaccggccgatccgccgggttcccctgaacgcacagaagccctacgtggacgcaccttcggacgtcgctctccgagaagctgctgctgacggacgcgtggg

SEQ ID NO: 27651 - DNA, 883 bp, Triticum aestivum
  Clone ID: PAT_TA_27651
aataaaattatgaatcctttttttttatttttttatacacacattcttcttctttactctgtcttttttgtttcaacagaaaccttttcgggtctaatacgactcttgacctgaccaacaacttctcttaacttttgattagccaaatttccatattgctcggccaataaacgagcagtgtgagagtgcttggcaacgtgagcatcaactacttccttgtgttgaagataaagtcgaggtaaagaaaaggcgaggaggataaaggtactcaagaggttctttgtagacacatgcttagccaagatccaaacaaagaaagaggcaacaaaggcagtgaaggagcgcatgctgtcttcaatcaagaccaactttgtcacatgttgtgtaacgacttcagccacgtccatcgtaaaatgggccacacgcaagacgcgttctcgagggatataggtcgtcttggcttgaagacggtgattgtgagggttcacaatttcttgaggttgtttgtttgaaatcactctttggctttgtttgtgaaggttcacataaacccagttgatacctgtagccaaactaaaaagaccagcaaggatttgcaagacagagtaatattgagtaagagccaaaacaccaagagaaccagctaaaaagatggcactctttttaggatattcccaataaataagagattggacttttgtctttacataagcagaaggatcactatcaaaatcaacatttgatgaagtatatacgttagtttgagttggcttggtagcaggagcagtggtggtattatcagaaggacgaggagtatttaatacattatcactagaaggtatggtagcagaaggaagaggagactcatctgcttttcattacc

SEQ ID NO: 27652 - DNA, 621 bp, Triticum aestivum
  Clone ID: PAT_TA_27652
ttttttttttttgctgttgtttttttttttataaaaactaactattgccatagatagagcggtggatgggcaattggagtagatgccaacattaagtgatacatgcatgtagtataaggctaagcacaggacagtagtacacgatggacgacgacactactcaccggacgtcacaggcgacgtctcaccctgctacataaggcactaatatcaaccaactccatcggtcgcagagcggctattgattcatcagctaagtacaccaacgccacgcacgcatatgatgcatcatcacacacatatatatttttcgatgtatatatggtagatcaattgatgggtcgactaaaaatgattagtcgaactggatgatggagctgtatatctcgttaggctcccagtcggcggggatgacctggtcggcgacgagcgtcttgccggactcgttggtgatgcgcagcgagaaggggccctgcatggggcgccgcgtgtccatccgccagatggacccccacgactccgtcatgggcacccactcccccgtcggcgccatcccgccctcgccggcggcggcgtccggccgcgactgcatgatgtccacctggtccacgtcgccgtcgc

SEQ ID NO: 27653 - DNA, 789 bp, Triticum aestivum
  Clone ID: PAT_TA_27653
gcgagagataattttgggaaaaagtatttattattaagagatgtaagaaagaaaaaaaattaaaaataagctttcaggaaatttcctttttaaataagagcggcgacaacagcaccggcagcagccatgataccaacagcggcgacattcttgttaccagcagaggtgctgacggaggcggcagaagatgaagcggcagcagggctggaggaagcaggcttagaagcgtgagaggaaacagcagcagcagagctggaggaagcaggcgtagaagcagcagaggaagaggcagcaactgaggagctggcagcgggggatgaagcagcggaagatgaagcagcggcagatgaagagggagcagcagatgaagaaacagcgctagatgaagatccagaagttccagaagcggcttgaatggtaaagtagggggtgtaagaaacgttaggactagaaccaaagcttaaagcgtagtcagagccagcgggaagagtggagggaactgtccaagagtaagaaccaagagaggatgcaacattgctagcgacgtggccaccagtaacgggagtaagagcagaggaagcaccttgcaaaagatcgatggtagagatagtatcgaagccagcgatgggagtccaagtgatcgtagtcgtctcaccagcagtaagaacttggttcagagtaggagcgtgaggagtaacgatgttcgtactctgggcagagaccatggtaatggcgagagcagcaatggcagcaacaatggacttcatttctataaggaaagggaagaag

SEQ ID NO: 27654 - DNA, 1884 bp, Triticum aestivum
  unsure (1)..(1884): unsure at all n locations
  Clone ID: PAT_TA_27654
atgnaccggcccccnngngttttgtgtttnnnaaaaaaatgttnnaaacaaccgaagggccgtatcaattaaacnagtagagacttggttttttgttgatcacaacacacactgttctgaattaaaatgtcaacacattagcccaactttatatggaacacagatttaagttatatggtggcattcaagcatcaacggagtgcatggtcgatgctccactcacaggcggtgaatagctagaaaactgcagcacatagtttttacacatagagacatggataatattgtcacatgtccacacaatattttgctgacgatgaccatacaacacaaagcaacaaaagaacagccatgtgttcgacaataatactatatctccgaaagaagagtcaccatagattgacggggtttatagaaggcctccaagggcactgccctcggagcagttaggccaaagccgtcggtcatgtccacaagctcctcccccactctttcccattcgaaacattggatcatagttcccagagcaaggcctaccatctgcatacccaaattctctgctgggcatcgtcgcctgcccataccaaatggcatagccatattaccttcacacttttcaccctcaaacctttctggaataaagtttgttggtttatcccatatcttagggtccctatgtattgcagatgtgttcacaagaagcattgtccccttgggaatataaaatccactgacggtgcagtcaataggaggttcttgaggaaccaggagtggtgttggtggatgtaaacgaagcgtctcccatggttatgcaacggaaagtattgcaactttagggagatcggacgcctcaattaggcgtattggtttccctatgtaggaatcaatctcatcacgaactttgaccatcaccttagggttattcagcatgagggacatcgcccactcaactgtatgaaatatttctcaaattataagtgaaatactcacgatgcacaaagctcggataagctggtcagggcaatcctctgggtccttgtgttgcagggacaacagtgccgcaatcatcgtcctccctgttgtcgtgccatcctccatcttctttctctcatcctcgataagtccctgcacgaactttgttctactctctcggagccgccacaaccgtctcccgaacccgccgatgtccagccacctcaccagtgttggtatgtagtcccacaccgttgacgcaccaataagtgtcatcgtctcctccaccatcgtcctaaaccactggacctcatctgtcacctccaatatctcctcgccatcggtacgtcccatagtatgtcctcgcgcatatcatgctcgtcattacgttcatgagcatctcgaagagccgcgacttgagctcaacccgcgcgcgaccaccggccgccgagcggtagaggcgtcgcgccatggacctcgccatccgcgtgtggacgtcggcgtactgctgcacccggtgcactgagaggagctcagtgacgccgatgcggcggatgtggcgccagtagtccccgtagctcgcggtgcccatggtgctccaatcgtaggagaggatcttgccggtcggcagctgcggccggttggcaaacacgatgtcgtgcacgccgagacactcctcggcggcttggncggatggagggggcccctgaagaggtagaggtggccgatgatggggagagcgggaggccctggcggcagcagcgggctttggttagtcctgcgccttagacaccccagagtgaatagggggagcaggagaatgatgacgaaaacgaagatgttgttcattgtgtcactggtgcacttagacacccagagaagtttaagtgccactgatcttccacatatatg

SEQ ID NO: 27655 - DNA, 587 bp, Triticum aestivum
  Clone ID: PAT_TA_27655
cagcttcataactcgtgtgcggacttattgccttacattcatttatacatactttctcgaataatatttgtccgcgaggattacaccgttcgacacaaactattttacctcgctgggaagccacaagcaagtgttcccaacctgaacacacgttcccagcaaataggctcaagggtatggaaatgaaacagatctccaaaagaagcaaaaaaacgaagaagaaaaaaaacacaagattgatcgtcaaaagaacaaacagtcgccaggatcttcagactaaacgtcagctggcagtggggaacacggaatcccgagcatcaacggcgcgattcgtctcgcgtaggtggaagatgctgagccgaggagcctacgtaggtgcatggttgtatttcctgaacaccctctcctggttctccctccaccactcctcggcctgctgctcggcgaatctcctcttgctaacaaacggacgcgtgggtactttggtgccgtctctcagctggataagtgtgacataaactcctggctcaaactgctcgatcagctgcacccggacgcggggtcgacccggaaattccggaccggta

SEQ ID NO: 27656 - DNA, 605 bp, Triticum aestivum
  Clone ID: PAT_TA_27656
ctcgcgatctagaactagaaaaaaagaatgcaagttaaattcatcggtctcggttttgtcattgccttggttgcttccgtcgcggccaatacatctggctctcgtgctgctcgtgctatttctaaagacagtttttctactacacgtcgagatgtcgccttgtcttctaaaagatttgcaactgctgttcgtcgtcgcaataacaagcatgaagtcagaagtgctgaacccgatgaagaagaacccgatgaagaagaacccaaggaagatgaacccaatgaagatgaacccaatgaagaagaacccgatgaagaagaacccaaggaagaagaacccaatgaagaagaacccgatgaagaagaacctgaagaagaaaaccctgagggaactgagaatggagagaagaaacaaaagagaggtgcattgaagcgacgtgaacatggggactcggataaaggggaagatgatgaacccgttaaagaagaacccaatgaagaagaacccaatgaagaagaacccaatgaagaagaccccaatgaagaagaacccaatgaagaagaccccaataaagaagaagaagaagaagaagaagaagaagaagaaga

SEQ ID NO: 27657 - DNA, 379 bp, Triticum aestivum
  Clone ID: PAT_TA_27657
ggcgaggagcgcgtcgcccgcgcccgccccgcagccgtcgacggccagcacgcgcacgcggccgtcgttggcgccccggaacggcgtgcccgggccggacaggcagccggcccctccggcgccgaacaggaacttgctctccagcagggcgaagatctcgtagctgagcttgtcgacgtccatgggaatcggcgacgccatggcttccatctcagctgcgaagcgcggtacctgcacgtactacctggcacgtcgtaccgtgcgctctgcctgtacaggagctaaactctggtggcaatggatgctgatagtgctgctgagaccgcgatggtgtccagtgtccaagtcgaggccatatatacacgcgggcgggggcagg

SEQ ID NO: 27658 - DNA, 456 bp, Triticum aestivum
  Clone ID: PAT_TA_27658
aaagatgtaagaaattcataacttggatttattgtgttgagaaaaaaaaaaaaaatgataaaagcataagtgtgtgtgggaatgaaaaaaaaaaaaagaaaggatgatttgttccttattttattattacacttaatccttcttttcttccttgtcttcatccttcttcaattcttcattgttctttttagcttcttcgaatttttccttgaactggttggcattatccgagttggcgaaacgaatagccaatgtttgagcctcaggggttccgtcagaaacgtcagcagtgaccttccaaacccaagaacggtcagaacccacgttgggttgaagagtcatgtaagattcaacatagtggttggcacagaccttgagagtcttgtcacgacgcatcaacaaacgaatctttttggtttgcttgtgctgcatcggacgcgtgggcggacgcgtggg

SEQ ID NO: 27659 - DNA, 964 bp, Triticum aestivum
  Clone ID: PAT_TA_27659
ctcgtgtgagcagctatggagttcattcacaagggtggggtttggtggttcctcctgctcgcaatggtgttgctggctccggcgacggtaggcgccgagcaggaggatggggccacaaccattaccaccttgcacgtggaggaggaggtcggctcgcgtgccgatgaccatggcaacgacgattgcgacatcaagtgcgcctattaccaagatctggccaggagacagttctgtgtggaccagtgccacagccagcagcatcatcatcctagcagagaagactgcgagttgaaatgtcaacactggcaagacccaacaagaaaggaactatgcgtgcaacagtgcatgagcttcggcctcaacctccatgtgggtggcagcagcagcgtccatgagcgccctcatgccttggaggaggaggtcggctcgcgtgccgatgaccatggcaacgacgattgcgacgacaagtgcgcctattaccaagatctggccaggagacagttctgtgtggaccagtgccacagccagcagcatcatcatcctagcagagaagactgcgagttgaaatgtcaacactggcaagacccaacaagaaaggaattatgcgtgcaacagtgcatgagcttcggcctcaacctccatgtgagtggcagcagcagcgtggacgagcacctccgcggctgggaagcggtggccggagccatcatcgaggaggtggtgtgacgtccgcggtgtcgcatctataatactgtactccataactattaagagtgtactcctatatgtaagttatagtgcgtacgtgtcaccggcgagtagtagctctatacggagacctacctcgaccgactatggctcgtgcgtacgtacacgcccgcgtatacgtctagctagctgtagctacgacgacaaaagcgtgagaataaaaggccaatagcgcgcggtagctgcatgcttggcgatg

SEQ ID NO: 27660 - DNA, 1060 bp, Triticum aestivum
  unsure (1)..(1060): unsure at all n locations
  Clone ID: PAT_TA_27660
ctcgagggtggggtttgggggttcctcctcctcgctggggtgtggcgggcccccccgacggtaggcgccgagcaggaggatggggccacaaccattaccaccttgcacgtggaggaggaggtcgcctcccggcccgttgaggagggggtcgactcgcgtgccatcgaccgcgcctacgaccattatcacgccaggagacagttctgtgtggaccagtgccacagccagcagcatcatcatcctagcagagaagactgcgagttgaaatgtcaacactggcaagacccaacaagaaaggaattatgcgtgcaacagtgcatgagcttcggcctcaacctccatgtgagtggcagcagcagcgtggacgagcacctccgcggctgggaagcggtggccggagccatcatcgaggaggtggtgtgacgtccgcggtgtcgcatctataatactgtactccataactattaagagtgtactcctatatgtaagttatagtgcgtacgtgtcaccggcgagtagtagctctatacggagacctacctcgaccgactatggctcgtgcgtacgtacacgcccgcgtatacgtctagctagctgtagctacgacgacaaaggcgtgagaataaaaggccaatagcgcgcggtagctgcatgcttggcgatgcctctcctagaagagagctgcatgtgtatgtgtatctatatgtcactgtatgtgttccgtgcatttgttccatccctacgtatctttctggtgaaatttactcgtataactattaagagtgtacccctatatgtaagttatagtgcgtacgtgtcaccggcgagtagtactctatacggagactactcgaccgactatggcccgtgcgtacgtacacgcccgcgtatactcaactactgtgctcgcccaaggcgtagagaaaggcatacggcgttacgcccgtacttctcccaaagacccttcccgacaacactccctcctgtgtgccccatggccccgagggtcccncattgtcctcccactacatccagggancgcttgncaaaaataccctcg

SEQ ID NO: 27661 - DNA, 636 bp, Triticum aestivum
  Clone ID: PAT_TA_27661
cccagtacgaagagtaagacagtctgcattctgagtcccatcagcttcacggcaatggagtcttccctttcagcttagaccaaagggagtgctcccagaggtcccagcaaagtagccgccctcatccagccattacgcgtcatctacgacagctcagcccgcctctccatttgaaccgtgcgccgttgcacgtactgccacctttgcctcagatgacgagttctttgaggacgctgagagtgtcgccctgatgtccgacgatggcttcatgaccgatgaggagtacgacatcctcgatgccagcgacgaggagatgcagtaagcagtctgataggtgtcggcgagagctgccaaattttgtgagcacaaaggtaggcaaagtgttcctggttggtgtctaaagcgttcaatttctgggtactgggggcgtcaaaaggaatggactggagaatttcgcgatcacacaacattccctatacaaagaaggcgctggagcgcgcttcgatacacctcgacgggacatgtgagtagggtgcttcattgcctctggctcggttatggctctcccacttggctcaatttgatttctcctttcatgtcttctatatgtgtagtaaatcaatggtagttttcttt

SEQ ID NO: 27662 - DNA, 1295 bp, Triticum aestivum
  Clone ID: PAT_TA_27662
caaaatgtagcgaatatgttcaccaaggagaagagcccgtgggcaaagctttgtgctccttcttggtatatgtgtgcgtgtgtgttctttgagttcttccatgatgagtgtccttgagagaaactctgagtaggaagagttgcgagggagagaagaagagcggcgctgcgaggagaggcggcgccatcaattggcatcagagccttgtcgatccgaggcgacggtggcggcgcggcagactccatgtgagggggacgttggcggcgcaaggtgaacgccgttggcggcgcgatgctgctagcggccggtgcgtgtctccatcatcgtcgagctgcgtcacgagcgatggagaggggtgtgcttcccggtaagttgcggcatcggcggcaaggtggtgatggccatgcgtggaggccattgccataaggagttccatgtccgagtcttcgataaggtgcgtcatcgtcgacaacatggaggcgagtcaccggcgagttgtgtcatcggtggcgagcatggaggcgagtcaccggcgagttgcggcaccggtggcaaacatgcggcagcgagcgtgccacggcggtgcgctcgtggtgaaggcgcgggaggtgtggctctcatcgaggccaacgacgacgacggcagtcggcgtgacaagatggcatttgcggccgtctgcgtgttgcatcgatgacgtgaacaatcattggcttcaagagagaaataagttaacaagattagggaggtgaatgttagaactaatcttgttattagtgcgtacgattagatatgtttatatcatgcttgtagttgagctgcggctgtgtgcacacgtcaggttgtgttcagtgcacaaggcacagctaattatgcatggtagttagatgcatgcgttaaagctccgcgagtccgttggccgggttgcgtgccgggcgtgtgggtgcctggcccggccgctgttgttcgggcctgcccctgtgcggcttgaccccggcagttgcttggaggcgcctctggctgggcccgctggctgctggtgggctggtgggttttgtccggtccgcgcccgtgtgtggcgccggccccgggcgggcctggctcgcctgtactggtgcgtgtgtgggcgtgctgcttgggagttgggtggcggggcaaagtagtggcgtgagtttagatggcatgggtgcttgccgtgtgtataaatagtcatttcactcaatgagtgaagaagagccgtgagggcagtaacaaaatgtagcgaatatgttcaccaaggagaagagcccggggcaaag

SEQ ID NO: 27663 - DNA, 593 bp, Triticum aestivum
  Clone ID: PAT_TA_27663
ctttaaaatgttttttttaataataatcctcaatttatacatctctaaatgttttggtatgaatgatgaaatacgttatgagaaaatgttattcaataacttatgttgacaatggagtatcatatgcaccatactgggaacaatattcaccatggggtagaaactggttgcactttagaaaccatgaaaaactctgggaacgacaaaaagctgtaaggatcgatttttatgataatagtagacaaggacaaattgtacaatcaagccaagatattttcatgatgcaaatggatgttagagggcaatatcataatgaattaggatatgtttgcatgtatgaacagcaatattatgattattggaataaaaaaagtggtatccatatgggaaacagtaatcaaagagatccattgatggttgttaaagataatattggtaatggatattcttatggacttgtgactaaacccaatacatattacattgcacgtgacactgatgacaacaaatcagtattaacaacccatgtgaggagatggttcagattcaatgaaatagatagtaggaattgtgaaagagaaattataaggcag

SEQ ID NO: 27664 - DNA, 564 bp, Triticum aestivum
  Clone ID: PAT_TA_27664
tttaaacaacgctcggtgtgattagaaaaaagcggctcaaaagagtgccaaggtggatgccgctggtcaatctcgtcgtgtgattcctgaattcactgcatctggtattgatgacgctcttgatcttttatccttgaacgatagttctgtcaaagccaaggatatcgaaaagcatcccgaacgtcgattcaaggctgcctatgctgcctttgaagaacgtgaattacccaacttcaagcgtgacaatcccggcttacgtttaagtcaattgaaggaattgatgtacaaggcattccaaaagtctcccgaaaatccattcaatcaagacaacattgtaaaatacaatgctagtcaagatgaagccaagtcagcaaagtctgaaagaaacaaggctattgaagatcgtcttcgtacaaactagactaaaaaaaaaaaaaaactactccctcccttattctgcacatatacatcactcatttcctatttgctttttttttttttttaattaaaacatttgttacattataaaaaagaaaaaaaaaagaaaaaaaaagggggcgtgcc

SEQ ID NO: 27665 - DNA, 851 bp, Triticum aestivum
  Clone ID: PAT_TA_27665
cccagcgtccgcccgaggccaagacccggttgctggtggagcggcacgactggaagaccctcctcgaaaacgaccagctgcggggcgaggtgtcgtcggaaggagggacgttcaaagggtggagcgagggggcgatcacgttctcgccgacgtacaagtaccaccggaactcggacgcctactacggctgcgcgcagctggggaggaagggcgacaagttgaagcggcgcgcgccggcgtggtgcgaccgcgtgctgtggcgcggcgtcggcctgaggcagacccggtacgaccggtgcgagtcgcggctgtcggaccaccgccccgtgcgcgccgccttctccgtcgaggtggacgcgccgtggaacctcaactccctccggagcttcttcctgtccgagcggttcgacgaccgggccaagagcccggccgacggcctgttcctgctccgggaggacgaccacacgaccaccagcgcgagatacgccgaggatgtttgagcctttgagacatgcaatggctgtacacaaacgaaagagagtacataaaatcattttcgtcgatagtatacgtagtaaagatccatcctctcgatctgttctgtctattctgagtgtccatacatgtctacagcacaagctaggatacggatgcaattttcccccacaccctgtccctgacttcctgtaaattacagtacagtggtacagtagatcgcactcttgttgatgcagtgagtttgtcccgacccaaaacttgtttgggccggactagtgacgaagttgtcgctgtaaaaatcctacgaggaaatatggggctttgtccccatgaacaaccttcataaaaaaaaa

SEQ ID NO: 27666 - DNA, 438 bp, Triticum aestivum
  unsure (1)..(438): unsure at all n locations
  Clone ID: PAT_TA_27666
tcgggcagagccagccttacaggacttctgtgtgttccaacctggcctgagctttgacaatcaacaagttgtttacctgttgaccagtggtgaatttagaggtgacaagacatgggttcttgcacttgatttgaagaacaaaacactggtagatgtggctgagtttgacaatgaaacaccgttattttcacctgttgtctactgccatggtagtctcagtctcttcaagcctacttctcaaggtggagcttgaggatggcagggttatactgctgctggtggtgtgaggcaatgaagcataaagatgatgcgctgaagtttgatgggttcacattggtcatgctatcttcttttatatggctgtcgaattgtaataatgttgaatgacaccttgctctacttcttgtttatattgtccttattataaccagttannnt

SEQ ID NO: 27667 - DNA, 2104 bp, Triticum aestivum
  Clone ID: PAT_TA_27667
gggtcagggtggatacagccaatagtatcaagagacagattatctcgcattgaagcagaattgtcacttttgaaagaaaggcagaagggactgactgagcagtgggagcgtgagaagtcggtgatgacaaagatccaatctattaaggaagagattgacaggttaaatgtggagatccagcaggccgagcgtgagtatgatctcaatcgtgctgctgaactgaagtatggtagtctgaatgcattgcagcgggaccttcaaaaaacagaggatgagctaaacgaatatcaaagttctgggaaatccatgctaagagaagaggtgacccaagatgatattgcagagattgtgagcaggtggacaggcatcccggtttccaagttaaagcaatccgacagagaaaagctgctgtatctccgaaggacgaactgcacaagcgtgtagtgggggcaggatcctgcagtcaaagcagttgcagaggccattcagagatccagagctggtttgtccgatccaaaccggcccattgccagcttcatgttcatgggacctacaggagtcgggcaaaacagaattggcgaaagccctcgcttcttttatgttcaacactgaggatgctgttgtcaggattgacatgagcgagtatatggagaaacactctgtctcaagactgattggtgcgccaccaggttatgttgggtacgaagaggggggtcagcttacggaggctgtccgtagaaggccatactctgtggtcttgtttgaggagattgagaaagcccattcagatgtcttcaatgttttcctgcaaatattggacgacggcagggttacggactcgcagggccggaaggtgagcttcaccaacagtatcattatcatgacatccaatgttggttcgcagtacatattgaatatggatgaagaaggtggagcgactgattcggcctacgagagtatgaagaagagggtgatggatgctgcaagatctgttttccgtcctgagttcatgaatcgtgtagacgagtacatcgtcttcaagcctcttgagaggaagcagataaacagcattgtcaaattacagttggcgagagtgcagaagaggatcgccgaccgcaagatcaaactcgacgtctcaccggcagcaatcgagttcctgggaagccttggctacgaccccaactacggcgccaggccggtgaagcgggtgcttcagcagtatgtggagaatgaactcgccaagggtatcctcagaggcgagttcaaggatgaggacagcatctccgtcgacactcaggttacggtgccgtccaatggcaagctcccgcagcagaagctcgtcttccggaagacgaacgaggaatccaagccggctgctgctcaagatgagaagttcctgccgacagtctgatgctccatatcatattttttgcagaggatctataaataagtgtagatacatataagggcggcgaactggtagtgttatatctctttgggcatgtcatagcagggttatgcagccagaattctttgctccagcagtacattattaacagtagctcaacctgaaaaaaccagcggttgcgacttgcgacgaccctgacattcctctgcttccagatgctccagcatactaaggttgtctggccatttgattttttttgttttgcctctgatgttgagccaggtacaaatgcatttactgcatttccatgttcgtcgacgacctccgatgagctgtgagcttgtgagaacatttcgagatgatttatgcagaagtttattggaaggtagtacatgagagccaaattagaagatgtgatttatgagatcgaggttgtctgagtgttgaaatttcatactatgaactgactgctcagtgtttaatgtgggaagaatgtgactagtgttaatcctcctctgaaacttttgtggccaacaccggtttcctacaaaggatgcgaagctgaattacatccttggggctcaggatgcagatgtagaaggttttgtttaagaagtggctatgtagacatgggtgtccatcgattatcatgatgggcaacatatttatttgtatacaccctgatccaatttgact

SEQ ID NO: 27668 - DNA, 749 bp, Triticum aestivum
  Clone ID: PAT_TA_27668
aaagcaccgttgacgacaagctcgttgagcctcctactgaaattgaaagcaaagaggatagttcttcaacagaagctgtcactggtggcaccgttgagcctgctacagtttctgctactgaagttgaaagcaaagaggaggacagcgcttcaacagaagctgtcactggcgccgttgagcctcctacagtttctgctactgaagttgaaagcaaagaggaggagagctcttcaacagaagctgtcactggcgctgtcgaggaaatcactcctcttgataaggccgaggagccagaagaatcagtgccggaggttcctgcaactgcaagtagcgagtctgctgtggtaactgaggaagtagcagcctcggatgagaaaaccacagaggtttctgctgctggagctgcagaagcaagcacaaccacaggtcagcagtaattttgtcgaccagatcttatctgcaaaaggccctgacatgtagtaatttgatcagtcacatcctgtctgcgaaaggctcttcaagcaactctacctaattaggaagagtattaggatagattgattgcatgtaaactgttcaagcaactccttttgccagttctttttacatttcttcttgtggtattgttccttactttggtaaatgacccaagaatcaatgcacttaattttgtttcgcaagaatcaatgcacttaattttgtttcctcgctggctcaaaggtttgagttggtcggataaaaaaaaaaaa

SEQ ID NO: 27669 - DNA, 276 bp, Triticum aestivum
  Clone ID: PAT_TA_27669
ttttgcagcaatacagatgcaccccaagggacttattgtatgtgatgaagatgctacacttgaattacacgttaagactgtaaaatatttcaagtcaattgaacacgtacatcaatcattgatcggacctgaaaacctatctcttcaaggcggagtgaaacaacttaaacaatttaattatagtgcaaggtcttcaacgcctttgaatggtccttatgatgaataacaacaagcttatttattttttttttccacataaagaaattatttttattt

SEQ ID NO: 27670 - DNA, 876 bp, Triticum aestivum
  Clone ID: PAT_TA_27670
ggcatcctccactcttcaccaccgtctagctcgctccctccactcttcactgcaccatctagctagctcttgttagatcgaccggtaatggcgtccaccaaggctctcttcgtgctcgccgttctcctcgcgtcggccgtcctcctcgccgccgcggcctccgagcaaactcatgacaaggaggggaaggtggacaccaacggtgccggcgtccaggacggctggggtggcggcggccgaggcggagggtacccgggccgcgggggcggcggctacgggccgtgtggtcggtggggctgctgccgccgtgggtaccacggcgactgcatccggtgctgccgggccgccaacgacgtcccggaggccatggaccgcactgaggtgcacaactagctagctagctggctatggcttggctagcaagcaggagccatgatctggaagctagcttcttccagggtacttctcgaataaaataaatctccggtttagttcatgtgatctttgtatgtgcgcggatgaacgtatgtagctacgtacgcacgtacgtagtcctctttgtttggttcgaataataagaaatgtgatgcgtgtttagtttgcaaaaaaaaaagaaaaaaaaaaatttactggttaacatataatcgttctatgggagtgaatcacctttatataaagatcgtgatatgcgaaacaataatgctccaactccaaagggtgacccgtaaaaaaaaaaaaaaaaaaaaaaaccttaaaggaaatccatcttcaaccaccctggtcagattggcatcggttactcttgggggccccaaatgtaataccttggacattgctgtcaaatttgctgacctggaaaaccccgtggacacccca

SEQ ID NO: 27671 - DNA, 904 bp, Triticum aestivum
  Clone ID: PAT_TA_27671
cccacgcgtccggtggttgatgaatggataaagacagaagatggaaatgatattttcacaaagacatggaaagctatttctactcctattgctactttagttttaattcatggttttggtgaacacgttgcaagatatgatagaatgtgtagttattttgcaagtcaaggtattgaatgttatgcttatgatcaacgcggatggggtgaaactggtaaaaaatctggacagtttggcaataaccagggttatgatacagctttagaagatgtgaataatgcagtaattaagatgaaacgagaaaatattccactgttcttgatgggtcatagtatgggcggtggtgttatccttaactatctttcaagaagtgataaatacaaaggagttaaattaattgatggttctatcgcaagttctcctcttgttactttatctatgcctattcctgctcctaaatattatggtcttcgtatgatttctaatcttttacccaactttactattcaagcaggtgttgatccaaatggtatatctcatgatccagaagaagtcaataaattcagacaagatccactcgttcatgattatgctactttgaatacattgaaaagcatgattgatgctggatctgacattttaaagtcaagagctaaattgatcgaatgtcccatcctttactctcacggagacgctgatccaatcaattcacatacaagctgtgttaaggcatgtgaattaacacgtagtaaagataaagaaatgaaatcatgggctggcctttatcatgaattgcacaatgaaacactatctgaaagacagcaaatattaaactattatcttgattggattaaaaatagatgtcctgctattaaacaataaagcttattttatttttattttt

SEQ ID NO: 27672 - DNA, 584 bp, Triticum aestivum
  Clone ID: PAT_TA_27672
cgcacgctcttcttactctgactgctgtcgcaatttgatgcttttcagcttaccgaaactttctcaacaccatgacttcgtatattgacttcagcaagcccagcctgtgggtgtctgcggcgagcatcgtgttcaaccctacgttctggaacatcgctgcgcagcaagaatatcacaacaaagtcatcacgaagctcttcggtggtaaccctcgccttggatgctatgcgctcgccgtaaccatcttctcgctgggtatcttccgagactacctttacaatgaagctctcgctgaacaacccacgcacccaaccctcctagctcccgccatcaagtactccgcgatccccctcttcgccatgggaaataccctcgtcctgacctccatgtgggccctcggtgtcaccggaacctacctcggagactacttcggtatcctgatggacgagcccgtgacaaccttccccttcaatgtctccagctctcccatgtaccacggctcagccatgtccttcttggccacggcgatctggtcggaaagccagctggtatcttccttaccggaatcgtccacactgcatact

SEQ ID NO: 27673 - DNA, 500 bp, Triticum aestivum
  unsure (1)..(500): unsure at all n locations
  Clone ID: PAT_TA_27673
ccgacagcaacaatcattggagtaatatttttcagatcaaggaactcaccagggagaaggagtgcagccgttgccaaaacagggaacgccgccaaacgggatngtcacccgtcttgctccatctgcctattgattttctggtcatacgtcatgcacgccatccttcggcgataagggattccagccaccgccgaatccaacatttttaccttgcctgggcccaatgagttggaagatctggcaggttggggcgccctcgggaaggactctctgcttcctcgcccctgcctctgaagctctcgcctcctcatccataccgccgcggactgagccgatgacgtctaggccctggctacatggatgagacgagaggcggcggcggtggtgggagaattgggggagaggagaggggggtggctgcggcagcagaagaatcgaggaggagaggaggcggctgcggcacgcgggttaggtcacagtgcctctgaccaatggttgac

SEQ ID NO: 27674 - DNA, 706 bp, Triticum aestivum
  Clone ID: PAT_TA_27674
cgaattcgcggccgcgtcgaccacttctccggccctcctccatattcctcacctccaccccatccacttcctgtcctttgcttctccaagactgcatcatggtgctcggcggctgcggcatcagagctgatggtgcgcgagccgaccagttcaatggaggcagtagcacggggcagcagcagcagcagcatggagggcggccacttgatcggcaaggtcctagaactgcaaataggagtggcagtggcaatcacgatgcaaatgcaagtggtgcccaaagatcttgcaaagcctaaagtacaaaggtgggggtgcaacctaaagaaaaaagagacacaaattcaagtggaaaaggacgcaccgccaagagatggcaatttggagacccgtagatctgtacggcttgtcaagaagaagaccaaggagcaaggacgtcaacagcccataccctgttgcttagaatctgcttaaatgccacatgaagaactaaggatatcaagaagcttttggatgtatgcaagcttggagctgctgttttatagaaatgggcatttgaagaataaccaaggatatcaataagcttttggatgtaggcaagcttggagcttctgtttcaatgtcatgcttcgatggttgtcttttggagctgttgtttctatgtgtaatcccttaagtatgttggctgtaccggactatttaaacccct

SEQ ID NO: 27675 - DNA, 637 bp, Triticum aestivum
  unsure (1)..(637): unsure at all n locations
  Clone ID: PAT_TA_27675
ggtcattcatcgctgatcaccaagcacagccgcgcatccaccgttgctagcaaggtcgaccaagcagcaccgagatggctgctgccttctcctccaccgtcggtgccccggcttctacgccgaccaacttccttgggaagaagctcaagaagcaggtgacctcggccgtgaactaccatggcaagagctccaaggccaacaggttcacaagtcatggcaagcggaaaacctccgacgagaagaggaacacggacaagtggaagggcttgcgttacgatatctccgacgaccagcaagacatcaccaaganggaaaggatccgtggactccctccttccaagcgcccaacnggcgaacggaccaacgagccntcctcaactcctacgattactcaaccaaggatccaagaattcactnctacaacacatgggagnttctanacgctccnccttcaatggacaacttgttgtcatctcnccaaaaatnaatgacctgcccaaatcaannccatcactgggtactggggaggaaggtcaaggaatcatcaatgcaactgntnccaaatgganaaccaatcanatatnccgaaactgaaatgaacccgaaacacaantanaggacgtacttggtganatat

SEQ ID NO: 27676 - DNA, 682 bp, Triticum aestivum
  Clone ID: PAT_TA_27676
ccacgcgtccggtgattatgtgacaacaaagaaaattgaaaaaaatttaaactggaaaagatatatgaaatcctagtagttgaataaatacaattttattgacagttgttccgaatttttgtttcagctggagctagtggcatatgacaggaactcactattgaatttgagttggtactgacttgatgtggtctgattgctcgacggaggtggcttgtgcatgcgggaggaagacaattttgaagttccactggttggaggaaagttgacctcgaagtgttgctcgccgtaggaagaatgatgtaggagttgtaccctaatatctgaggccgtggaagcattacatgggggagatattatagggatggctgagtttaccacgtttgcacgatggaaagagaggttttttggatgccatctagagagaatattcttgatccattgatcgatgggagctgatgacaatcgaggagagtcaacaaaggagatttaggatgacaatcaaggagagtcaatagaggagattgggatgacaatcgaggagagtcaatagaggagattgggggtgctagcaacagtgggaaggaaggcgatgttcaagtgtcgctcattggaggaagacgatgttgaaagggggctctgaagtcggagaggaaagctaattaaaagataagataaaggt

SEQ ID NO: 27677 - DNA, 941 bp, Triticum aestivum
  Clone ID: PAT_TA_27677
ttaccggatctaacatagattaatgattgttaagagcaaatttagagaaaatataaaacatgaaatgttaagttgtactattgagaccataccaccatatctttatttagtttctttggaaacctaaaggtctaagaggatggtacatgtaagaagccgtgaatccacaaaaaaaaactaaactaacttccagataaacatttcaagtttggaagccacaaagaagcagcccagatctctcgttgtagtgcatgtacatgtccttaatcgtctctgagaaggacttcttggcattcttgtgcagggacacagcaatcctcgttgcgagctgcagaagaaccacacaggcaccttccttcaccttgcccttgaggaggggggcaacacttgcagcgccgcgacaaggcttgctccgagtgtaatcatcagcattcttagatacctgatacctgctgaagtttgctttggtctccttctcaagggccaatccagaaacataatcagcaagcctatgtgcctccatgccaggctttccaccttccaattggcccctagatcagacacttgggcggagcacaccagcatcatgagcttggcgacgggctagtaacagtggcgtacagtcgcgctgccgacacaccacaagataagccttgtgaataaatcccccttggatgagaaataattaattatcaagctgctgtagctgccaaacatgccacaactaaatacatggattcttccaatgtagctcgcagaggcacagagaggggaaagaggcagtggaaggtgagaataccagcaggctccacaacaactacagataccatgacaccatgtcgagcatatgtagttcttgatagacaaaaccttcatcaaactcttcctcaggattcttcctctcctctttctttctcagatcggattggggacaggggacc

SEQ ID NO: 27678 - DNA, 850 bp, Triticum aestivum
  Clone ID: PAT_TA_27678
atctccggccaaggcactcacttctccggccgtcctcctcatcctccaccccatccacttcctgttctccaagactgcaacatggtgctcggcggctgcggcaacgtagctgatggagcgcgagccgaccagttcaacggaggcagtagcacggggcagcggcagcagcatggagggcgtccgcttgactgggaaggtgacggaactgcaaataggagtggcagcggcaaccatgatacaagtgcaattggttcccaaagctcttggaaagagtatttgcttggtaggttgataatgagagtgaggatgagaatgagtatgttgataatgagagtgaggatgatgatggggtgagtgaggatgatgaggatgatcaacaagatcagcaagaaacacaaatacaagtcgaaaatgagacacaagcaagtgttggcaatttggagactcgtagatctggacgactagttaggaagaaggtcaaggaagtcaacagcctctactcatagatttgctggagcctggagcatgatgctagctggagcttggagcattgaagctggagctttttcgatggaacaagacctccccgtccatgctttcatggatttcttttggagctgttgttcattgtgatgctttgatggttatcttttgctgttcggtgtgatgctttgatggctgtcttctggagctgtttctatgtgaaatcctttaaatccaattgttggttgtactgaagtatctaaactttggattgatgtgatggttgtgaactgtaagtttagaactattgtgcgtgagggttatattggactgacgctcttattttaatccctagagctaatttgct

SEQ ID NO: 27679 - DNA, 435 bp, Triticum aestivum
  Clone ID: PAT_TA_27679
ggcggcgcggaggcgacaggcgaaggcgaaatgacgaagggaacgggcagcttcggcaagcgccggaacaagacccacacgctgtgcatccgcccgcatccgcaagtacaactggagtgtgaaggccatcaggaggaagaccaccggcaccgggaggatgaggtacatgcgccatgtgcccaggaggttcaagagcaacttcagagagggaactgaggccgcaccaaggagcaagggagcctcttccagcggcaactaggcgtgacagtctccatttgttgccctaagcgaagccctgatcatcaaacttagcttttttgttgttttctactggaactcttatgtttctatgttgagaggcagactatatgatgcctggttatgttatttgcacaattgtcgtggacgttaatccttcagttttgaaaaaaaaaa

SEQ ID NO: 27680 - DNA, 575 bp, Triticum aestivum
  Clone ID: PAT_TA_27680
ggaacgcacctccgtggaatccccaaccaccaaccaaatccctactctccctcgtcccggcgagcaccagcggccggacatggacgcctcagccaccggagccggagcgaaggcgaagaagggcgcggcggggcgcaaggctggcgggcccaggaagaagtcggtgacgcggtccgttaaggccgggctccagttccccgtcctcgagtacctcgccgccgagctgctggagctcgccgggaacgccgccaaggacaacaagaagtcccgcatcgtgcccaggcacctgctgctcgccgtgaggaacgaccaggagctcgggaggctgctggccggcgtgaccatcgcgcacggcggcgtgttgcccaacatcaacccggtgctgctccccaagaggacggcggagaaggagcccaaggagggcaagtcgcccaagaagaccgcaaagtcccccaagaaggccgacaagaaggcgtagagacgcgtgctttgtagaactaatggtgtagatgtagatctgtgctcccaagaaaaagcaattcagaaatctctcttcgattggcttaaaaaaaaaa

SEQ ID NO: 27681 - DNA, 547 bp, Triticum aestivum
  unsure (1)..(547): unsure at all n locations
  Clone ID: PAT_TA_27681
gttatacgagccactatagggcgaattgggtaccgggccccccctcgagcatacatacataattccgcatatgtatagccggtgtatatagacctatgaggaattatgtatgtatgctcgagaacataggttcctacatacatacacaaatcatatagaacaaaaggtatgctctggtcggaaagcagagtggtgcaacagaggtcgtggacaaaagtgaagttcataaaagatcttcatacgagataggccattgtttcaactcatagtttaggccttgccggactcctcgcaacccggtggcctgaaggcgatgaaactggacgcactgcacctggcgcaagttgtcgaagccgatgacgcggacataggcgtcagggtactccttcttgacctcctccacctcgttgagcaacctgtgtggcgtcggtgcacccgaacataggcagcttccacaatttgtccagtatcgaccgtcgtagtaaccggggggaagtgttgtgctcaacgggaagaagnaaagccaaaccnttnctggaactccgag

SEQ ID NO: 27682 - DNA, 625 bp, Triticum aestivum
  Clone ID: PAT_TA_27682
tgtccctcctcctgtgtgcggcgccgccgctgcgcacaagccacatctcctcgccctcctccacatctccggccaaagccctcacttctccggccctcctccacatctcctcgcctccaccccatccacttcctgtccaagactgtggcaatggagctcggcggttgcggcccttctccaagactgcagcgtggtgctcggcggctgcggcaacggagctgatggagcgcgagccgaccagttcaacggaggcggtagcacggggcagcggcagcagcatggagggcgtccgcttgactggaaagagaaagtatttgttgatagtgagagtgaggataatgatggggtgagtgaggatggggaagatgctccatccatgcatgatcagcaagaggcgcaaatgcaagtggaaaaagagacacaaattcaagtggaaaaggacgcaccaccaacagatggcaatttggagacccgtagatctgtacggcttgtcaagaagaagaccaagggcgtcaacagcctatacccgctgcttagaaatctgctggcaaatatcttctttctagtgttttatgattcatgataattgcttagaaaattttagttacttggagctgctagtttc

SEQ ID NO: 27683 - DNA, 646 bp, Triticum aestivum
  unsure (1)..(646): unsure at all n locations
  Clone ID: PAT_TA_27683
ggacattcggtttgacagataacacggaatcaaatctcgaaacagcagcctggtagatttcaagtgcgaaaaagttctgactatgaactactcataaatcagagtctgggcttaggcagcgatgaaagccttcttcccgcctccggtggttccagctggaacgaccttcaggacattgaatctcacggttttcgacaggggcctgcactggccaatgatgacatggtcgccttccttgacacggaagcagggggagatgtgagctgggatgttggagtgcctcttctcatacctctgatacttcttcacaaaatgaaggtagttcctgcgaacaatgatggtccggttcatcttggcactgtggcaggttccagctatgattctgcccctgatggcaacagttccagtgaatgggggtcttgaaaccaaggccaacactcttccagaagcggttgccagccttgccaggcctctttgccttgtcagccttcttcgtgctgaggaaaacctttggctgcttgaggaaagacttctcggtctgctccgccatggctgcgaggtgggcttcgaggggctcggaggcggcggcggcggcgcggcgcggggatgcgggagcaaggntctgcctcgtgccgaattncctgca

SEQ ID NO: 27684 - DNA, 823 bp, Triticum aestivum
  Clone ID: PAT_TA_27684
actagtctcgagttttttttttttttttttttattaatgatagatagattccacaaaacatgttcagatcacgacattcggtttgacagataacacggaatcaaatctcgaaacagcagcctgggagatttcaagtgcgaaaaagttctgactatgaactactcatgaatcagagtctgggcttaagcagcgacgaaagccttcttcccgcctccggtggttccagctggaacgaccttcaagacattgaatctcacggttttcgacaggggcctgcactggccaatgatgacatggtcgccttccttgacacggaagcagggggagatgtgagctgggatgttggagtgccctttctcatacctctgatacttcttgacaaaatgaaggtagttcctgcgaacaatgatggtcctgttcatcttggcactgtggcaggttccagctatgattctgcccctgatggcaacagttccagggaatgggcacttcttgtcaatgtaggtaccatcaaacgcctcccttggggtcttggaaccaagggcaacaccttttccaaaagcgggtgccagccttgcccggcgttttctcctcagtcctgtccatggcagtcatcaagagcaataccacacaggccatgggtggtccaacctggaatggtggtatgaacatggctttcactttgatcttaccaacctattgttagaaactgaacttcatggaaaaaggcttggcttattaggttgggaataaaaagggctgccaaaattattccaacccgacgggaaccctggtttaaggccctatggaggaatggccccag

SEQ ID NO: 27685 - DNA, 575 bp, Triticum aestivum
  Clone ID: PAT_TA_27685
atttcaaaaatgttcctctcgctcctcctgtggccggcgccgccgctgcgcacaaaaacatcctcgccagcgtagcttctccggcgtccggccaacgcgctcactagcctcccgccttcctccacatctcctcgcctccaccccatccagttcgtgccattcgctgctccaagacaagggcatggcgctcggcggctgcggcaacgaagctgatggtgcacgagccaaccatgaaggcagtagcacggggcagcgacagcagcatggagggcgtcctcttgtttgggaaggtaatggaactgcaaataggagtggcagcggcgaccaggatgcaaatggaagtggttcccaaagaccttggaaaggacttaaagacaataactttgcaatgctaaatggcacgtgagcaaaggatatcaagaagcttttggatgttgggaagcttggagctgatgcttcaaataagctgatggttgtcttttggagatgtttctatgtttaatgctttaaagtcttttggctgtactggactatttaaactttgaactatgctgtgatggttgaactgatgctgc

SEQ ID NO: 27686 - DNA, 722 bp, Triticum aestivum
  unsure (1)..(722): unsure at all n locations
  Clone ID: PAT_TA_27686
aaccctactaaagggaacaaaagctggagctccaccgcggtggcggccgctctagaactagtggatcccccgggctgcaggaattcggcaccagcaccaaccaagaacaagcaacacctcggcctcggagcgccgccgaatccgccgcccggcagaagggatccgaagctccaatggctggcaagtacatcgtcgccggcctcgtcggctcctgtgtcatctcgtacgcctgcgactacattgtttctcagaagaagatcttcggtggcaccatcccagggactgtgtccgacaaggagtggttgaaggcgacggagcagaggttccaggcctggccccgcgtcgccgggccgccggtcatcatgaaccccatcagccgccagaacttcatcgtcaaggacctcaacccttgaggccctaccaagactgtaaggttcgcggtcatttggaaactttaccctgatggcgatgtctgtcgctaaacctacctatatgtgctggctgtactctgaaagctggtttgctgtctaaataattgaaacaacactgtcgtgtagggcacccgnggtttttatttcttctgaagaacagaagaaaaccaagcctgaagcatattttgctttggccttttgtcatatctcctttgcataagcattgtttactttcaaaaaaaaaaaaaaaaaaactcgaggggggggccgggcccaatttgnccnttnttg

SEQ ID NO: 27687 - DNA, 611 bp, Triticum aestivum
  Clone ID: PAT_TA_27687
ttttttttttaaagcgaaactattaatgatagatagattccacaaaacatgttcagatcacgacattcggtttgacagataacacggaatcaaatctcgaaacagcagcctggtagatttcaagtgcgaaaaagttctgactatgaactactcatgaatcagagtctgggcttaggcagcgacgaaagccttcttcccgcctccggtggttccagctggaacgaccttcaggacattgaatctcacggttttcgacagggggcgcaagcgcccctaacgtgggtcggggcgggcggcgggcgcaggcgtcgcatgctagcttggattctgacttagaggcgttcagtcataatccggcacacggtagcttcgcgccactggcttttcaaccaagcgcgatgaccaattgtgtgaatcaacggttcctctcgtactaggttgaattactatcgcgacactgaagcagggggagatgtgagctgggatgttggagtgcctcttctcatacctctgatacttcttgacaaaatgaaggtagttcctgcgaacaatgatggtcctgttcatcttggcactgtggcaggttccagctatgattctgcccctgattc

SEQ ID NO: 27688 - DNA, 784 bp, Triticum aestivum
  unsure (1)..(784): unsure at all n locations
  Clone ID: PAT_TA_27688
tccccactgcgctttctcgtcgcgctcgccactcagagaagatgagggagatcctgcacatccagggtgggcagtgtggaaaccagattggttccaagttctgggaggtggtgtgtgatgagcatggcatcgaccccaccgggcggtatgtcggcacctctgacctgcagctggagcgtgtcaacgtctactacaatgaggcctcatgtggtcgctttgtgccccgtgctgtccttatggatcttgagccgggcaccatggacagtgtccgtactggaccgtacgggcagatcttccgccctgacaactttgtgtttgggcagtctggtgctggtaacaactgggccaagggtcactacaccgagggtgctgagctgacccagcagatgtgggactccaagaacatgatgtgcgccgccgacccccggcacggccggtacctgacggcctcggccatgttccgcggcaagatgagcaccaaggaggtggacgagcagatgatcaacgtgcagaacaagaactcgtcctacttcgtggagtggatccccaacaacgtcaagtcgagcgtgtgcgacatcgcgcccaggggcctgtccatggcgtccaccttcatcggcaactcgacctccatccaggagatgttccggcgcgtgagcgagcagttnacggcncatgtnncgnngcaaggccttcctgaactggtacaccgtcaacaaccagatggtgaacgccaccctcatgaacatcgccgatgcccccaccaacgtgcagctccnaggcatgt

SEQ ID NO: 27689 - DNA, 674 bp, Triticum aestivum
  unsure (1)..(674): unsure at all n locations
  Clone ID: PAT_TA_27689
gaattcaccggtggctgtaaattgtcagcagaatccaaatactgaatctaaggtcaggcaatctattgagcaaggtaaagggaacttgcataatgtaaagagaaagaaacgccgcactgagataaaaaaaaaacagaagcttcggttgttctgttaacgctatggttccactgtttacatggaacagtgaagtccagaatgccaactgcaaaattcatcttcgtctgtaatagtttttgagtcgatcaataggtgtagacgggaaacgaagctatgaaggatgagcccaatgaaacatatatcatcatatatgcaatcttatcaaggtgtagtagggagctggtgagcaaatgatcaacctgttgcaatattgtgtgtaacctgttataccattgagattttcaggaaaaggttaagaaaacggagcaaacaagccaacaaggtatgttatgttgcctacaccatatagagtaacagatactgttattgactaaaacggctgagatagatcaagatagcacacggtaaattgctcttccatctgaattgttaatctcgtgaaacaaaagcttactagaagcatttacgagaaacatgatgccgttgtaagcttcaaacggttatcctgaatatcttgttgccggcttgttaaaaggtactgacagtttntgttc

SEQ ID NO: 27690 - DNA, 552 bp, Triticum aestivum
  Clone ID: PAT_TA_27690
aatataatatccactaaattggctgggatgttgtctgcttcctgctagcatgaaacttactttctctttggagagcaggaggaggacattctctggcagtgacacaatgtcgcggaggccatcggtctccagcatggacaacttgtggaaaccctcggactccgcagatgatctcaccacccctctctgctagtccaggctaatctcatcctcctcctccccctcgtcctcgtttctgcgaccctggaggatctgcggtttgccctcctcgaagagcagcggctcgaagacgcctaggtactcgtccaccgaggcgtagctgttcttcacctcctgcagccccttgtccttgtccgcgccctgcccgccccagcacagagaaggagaggaggagacccccccgccgtcgggcttgtccaccgacatggatttctctccgctgcggcaggggtttggggcggcgaggcggcgacagcaggagcggaggcggcggcggcggcgacaggaggaggaggcgggtaagagaagaggcaggagggggaggagagtgcc

SEQ ID NO: 27691 - DNA, 1259 bp, Triticum aestivum
  Clone ID: PAT_TA_27691
caccctgctcatctccaagatcagggaggagtacccggaccgcatgatgttgacattctctgtcttcccgtcgcccaaggtgtctgatactgtcgtggagccctacaacgccacgctctctgttcaccagctggttgagaacgctgatgagtgcatggtgctcgacaacgaggctctctatgacatctgcttccgcacgctcaagcttgctacaccaacctttggtgatctcaaccacctcatctctgcaaccatgagtggtgttacgtgctgccttcgcttccctggtcagctcaactctgacctccggaagcttgctgtgaacctgatccccttcccgcgtctccacttcttcatggttggatttgctccactgacctcgcggggctcccagcagtaccgtgccctcactgtgccagagctgacccagcagatgtgggactccaagaacatgatgtgtgctgctgaccctcgccacggccgctacctcacagcgtctgctatgttccgtgggaagatgagcaccaaggaagtggatgaacagatgctgaacgttcagaacaagaactcttcctactttgtggagtggatccccaacaatgtgaagtcgagcgtgtgcgacatcccacccattgggctgaagatgtcctcaacattcatcggcaactccacctccatccaggagatgttccgccgcgtcagtgagcagttcacagctatgttcaggaggaaggccttcttgcattggtacactggtgagggcatggatgagatggagttcaccgaggccgagagcaacatgaacgacctggtggctgagtaccagcagtaccaggatgccacggccgaggacgatgaggagtatgaggaggaagaagaggaagagcacgctgactaagccatcctctgcagtgcttggtacagagatgagagatgatatcccttgtatcgctgttagtcagtatgagtcgattgaggtgcgtgtggtggtgatgttaggtactactagatgggtggtattgcttatggatgtgatgttgctgtgacaaaactccatttccttttgtattatggttgtccccaagttgttattaccatgaggtggaaggtagcttaactgattgttgctatgccttatgcatcagttcaagtggtttatgtggtattagagaattctactgtgttaaatgatggtttatcagcagtttgtgtgaactttttgattgacgtgttatttctgtaaaaaaaaaaaaaaaaaa

SEQ ID NO: 27692 - DNA, 598 bp, Triticum aestivum
  Clone ID: PAT_TA_27692
ttcggcacgaggccgccttctccatcacgaacctcgattcagaccgcccttcacctcacccgggctcctgtttgattattccggtttgttcttgttccattgcgcccgtctcaggttagcaggagaccggccatggcgccgttgcagcccaagtcagggctcttcgtcggcatcaacaagggccacgtcgtcaccaagcgcgagctgccgcctcgcccgtccgaccgcaaggggaaaggtaccaagagggtgctgtttgtcaggaacttgattagggaggtcgctggatttgctccctatgagaagcgtatcactgagcttcttaaggttggaaaggacaagcgcgcactcaaggtcgccaagaggaagcttggtactcacaagagagcaaagaagaagagggaggagatgtcaagtgtcctcaggaagatgaggtctggtggtggtggtgctacggacaagaagaaatagattttgcatgttgatttatctcaatgctttgccctgtatttccacattatgccaagtttgtagcctgtggcaattggagacgaatgtagtacattgcacttcaagttcagagtcaaactataatttt

SEQ ID NO: 27693 - DNA, 674 bp, Triticum aestivum
  Clone ID: PAT_TA_27693
agtgtggccacactcctgcatcctctgcttggaaaccgccttttctcaccggatctaacatagatacatgattcttcaagagcaaatttcagagaaagtataaaacatgaaaggctttaagttgtactattgagaccataccaccatatcttcatttaatttctttggaaacctaaatgtctaagaggatggtacatgtgagaagctgtgaatccacaaacaagaaactaaactaactttcagacaaacatttccaagtttggaagccacaaagaagcaacccagatctctcgttgtagtgcttgtacatgtccttaatcgtcttcaagaaggacttcttggcattcttgtgcaggttggacacaacaatcctcgctgcgagctgcagaagaaccacacaggcaccttccttcaccttgccctttgggaggagaggggcaacacttgcagcgtcgcgacaaggcttgctccgagtgtagtcatcaatactttccattattcaaccggtactcagatggatagaactgaacacttgactcaagaccaacggtgcttgccttgtctgttgagtaacttgcgcttgaaggccaacctattgcataatagcatccagaagaacttttgttggaatcttaacgttttccatcgcggcgtactggtgacagacctcgtgc

SEQ ID NO: 27694 - DNA, 866 bp, Triticum aestivum
  Clone ID: PAT_TA_27694
gttgggccacagtcccctcatgaacgcggtgtggatgaacccgggatctctccacccaaccgtccgcgccggctcgccgcacatgctgccgcgggtgaaggtgagcgtcccggcgggcgtgcgcgtggggttgccgccggaggcgaccacgccccactccacgaacgggtaggcctcgccgatgtcgtagccgctggtccacgtcacggccatctcgtcgtgggtcttgccctgcgccaggcgcgggaacaccggcgccttggggttcttgaacgccacctgcttcgacaccgtcaccagcgccgggttttcgaggccgccggtgaagagggcgaaagagaagtcagagcgctggttgatgagctggaaccggatggcgcccttgcccccgtagaggtagttggccgagtagttggcgtactgatacttgatgggcgccgtgcagagcagcggctcgccggggtacctcgatgggttagggcacgaccccgagatgaaatcggcgggggagaagacggcgatccagtcatcggcggaggggttttcccagccgtatttcaccgtgacccatacggtgtcttcttcctggtcgccgagcagtgccggcgtggcccgcacgcacgcggagccgtgcaggttaacggtggccttgttcatggcgatctcccacagcggctggatcccctcggcaggcgacgcgctccccgtcgccgcggcggccaccatggccaacgccgccgccaggaggacatgcgccattcccatgcctctgcttcagctgtaactcgtgcgcgctggaagctgctcctaggctggcgagtgcccagtgtacgccatggctggccggcctatagcattcaagagag

SEQ ID NO: 27695 - DNA, 806 bp, Triticum aestivum
  Clone ID: PAT_TA_27695
tattacaactagatgatctggttgcgccaattgcgcaaagagctagttagaagcaatgtttgtagtgagtaagtaagagatgtagatggaaagataatacaatgtggattgtattgcagatagtagaatgacttaaattggtttacaaatagtagaatgacttagaccattttacaaaaatacacttatatataggctgcctcacagcttatttaggcatcttcttactctgatcgtggtcttcagagggtatgtacgaaaagcatagtgtcatcgtcggataatgcttgcatggtagattttcataggtacttgaaggcctataaaaggtgttggttccactgtcagaccatttggagtagcccatatagttattatctcccgaatatcattgctttcattggttcatatgacacacttgtagaaccaaatatcagggaaatcaccaacatgatagtttttgttctctagcatgcaacaatgactcgggacgtcttccattataggcgggccgttggtagccctgtaatccttatctcatctctccgagagaggataggagatattgcaccaatatacacgatgagaggacatcaagcaacctcaagtcttattttcaggagaaatgtcttgcatccatgcttgaacaagatgcagacgtcatgtgattgttcgtcatactcagaagcgctgcttgccaaactgtagtcccactagtccgtgcttggtatattcaatcctttgctatttccattcatttatatgaccgacaaggcgtgatgttccttttctggccaatgcaagca

SEQ ID NO: 27696 - DNA, 246 bp, Triticum aestivum
  Clone ID: PAT_TA_27696
tagcgtggtcgcggccgaggtactccaattctttagttagggttacatgtagaggaatacaagagtgcagggagaaaaacaagcacgccaattcatccacccaagttcacctttgtcacaaaataagcaccaaccaacagcggtggagacaaaaatccagcgtaagtcacaaaattggcagacaatccagcaccaacagctatccaatttgccaatcttctttacctgcccgggcggccgctcgaa

SEQ ID NO: 27697 - DNA, 494 bp, Triticum aestivum
  unsure (1)..(494): unsure at all n locations
  Clone ID: PAT_TA_27697
gaagccaatgttagtggtgagtaagtaagaaatgtagatggaaagataatgcagtgtggactgtattgcagatagtagaatgacttaaactgattnacaaatagtagantgacttaaattggtttgcagatagtagaatgacttaggtcagttcatagaaatacacttatatataggctgcctcacagcttatttaggcatcttcttagtttgaccgcggtcttaagatgatatgtacgaaaaagcagtgtcatcatcggataatgcttgcatggtagacttccacaggtacttgaaggcctataaaaggtgttggttccactgtcagaccatttggagtagcccatatagttattatctccggaatatattttctttcattggtccatatgacacacttgtagaaccaaatatcagggaaatcaccaacatgatagttgttgttctctagcatgcaaaataatgactcaggatgtcttccagaggtgagccgt

SEQ ID NO: 27698 - DNA, 592 bp, Triticum aestivum
  unsure (1)..(592): unsure at all n locations
  Clone ID: PAT_TA_27698
tcgagcggccgcccgggcaggtacatcccaataaaggacgaccatacttgttcaacttatctctttcaacttggataccatgaggcgggccttggaaagtttttgaataagtagggggaattcgtagatcctccaaacgtagagcacgtagggctttgaaaccaaatacgttacctacaatggaagtaaacatgttagtaacggaaccctcttcaaataggtctaatggataagctacataacagatccattggctgtcttccccagcaacaggctcgatgtgatagcatcgtcctttgtaacgatcaagactggtaagtccatcagtccaaacagttgtccatgtaccagtagaagacactcaaaaacgatgacatccaagggctaacagccagcctaaatcttgcacctcccggagcaatgacacataagctctttgattttgagatgtaacaagaaatagctgagcttcactggtgccacaacaccctgagcaccaggcggtttgcatggcgtcaggtgatcttgcggctcacttatttcnnnaagagttactctttcaggaactactcataaannncagagacaacat

SEQ ID NO: 27699 - DNA, 527 bp, Triticum aestivum
  Clone ID: PAT_TA_27699
gcacgagggtaacaattgtaccccaaaatacctttctcttccctcctctctcaccgtagctgctctctctcctcgccccgctccgtcatcccctcccgtccctcccgtcctagggttcgatcgcccacctcgccggccagtagcaatggcgacaaagtacatcatcggcgccctggtcggatcctttggcattgcgtacgtctgcgacacgaccgtttctgacaagaagatctttggaggcactgtttgcaagaccgcgaccgacaaggagtggtttcaggccacggatgccaagttccaggcctggcctcgcaccgctgggccgccggtcatcatgaaccccatcagccgccagaacttcatcgtcaagaacccttgaataggtggcacgagcggcatctcgctcccaccatgggatcccaagtttcttttctagggttttgaagttcctaataattgggacttgaagttggggtatcctctcttgtttcacgaatttcagtttccgtgagcaactttgaggtgtt

SEQ ID NO: 27700 - DNA, 461 bp, Triticum aestivum
  Clone ID: PAT_TA_27700
gggaaactgcaaattcatttcagagtttgagctggatacatctgacacctgaacattccagacactaaacaccaccagcgatagtacatagaacctgcctagcagaaccgaagcctaaatcagggaggatgaggcatccttttgtacagacccagagcaccaacgcacacctaaaaccacctataagatcagatcagatcagatcaagcggaggcgaccttgcgggccttcttggcggccggggagcggacggtcttcggcttcgccttggccttcgccgcgggcgacttcttggctttggcgaccagcttcttcttctcgggtgccttgcgcttcgtgccagcggcggcggccttcttgggcttcgcggaggccttcttcttgggcttggcggcgtcctttgcgggcttcgccgcagccttgggggcggcgggcttcccacgcgtccgcccacgcgtccg

SEQ ID NO: 27701 - DNA, 420 bp, Triticum aestivum
  Clone ID: PAT_TA_27701
agcggccgcccgggcaggtaccggagtggatatgatctcccccagacatacgcaatgctttagctaatacacggaaatgcataccatgatttttctgtctatcaataactgcatgcattgcacggtgaatgtgaagaagtaggccattgtcgcggcaataatgagccaaagtagtatttgcggtgaatcccccagttaagtagtcatgcattacaataggaacccctaattctcttgcaaatacagctctcttaatcatttcttcacatgtacccttcccggatgaagagatcacggaatagtctctttaggtaagaataatctggcttgtcttcaaaccgcaatgatcgacagtagtggaagtaagaaatgaattctgaagggtaagacttgcagagtacctcggccgcgaccacgcta

SEQ ID NO: 27702 - DNA, 579 bp, Triticum aestivum
  Clone ID: PAT_TA_27702
acgttgctgtcgtcgacgagcccggctgagaacccatcgacggggtgcttcgcgagatctcggagctgcttctggaggaggaggctcgcctggctggaggcggtggccatgggatcggcggcggctagggtttttggcgattgggcctggcttcgccgccctcggcctttattcgtggacgcgtgcgtgcgcgtttgactcacaagagagcaaagaagaagagagaggagatgtcaagtgtccttaggaagatgaggtctgctggtggtggtgctggtgacaagaagaaatagaacttggctagctggtgaattttatccggaagcaaagtcctgtattaccagtccgtacctgatggtgttgtcggtccgcatgcggatccagtaggggatggggcggttctggcgctgcttcttggccagcttctgcttgatgcggaaggtcttgtgggacggcatcgtcgcggcggagacgaagacgcagcggcggcttcggcgtcggcacagcatgttagtcggggtagagaaaagaaatgttaatgcaacaggataactctgacctgcccgggcggccgctcga

SEQ ID NO: 27703 - DNA, 621 bp, Triticum aestivum
  unsure (1)..(621): unsure at all n locations
  Clone ID: PAT_TA_27703
atgttgacattctcagtcttcccatcaccgaaggtgtctgacactgtggtggaaccttacaatgctacgctctctgtacaccaacttgttgagaatgctgatgagtgcatggtgcttgacaatgaggctctctacgacatctgcttccgcactctgaagcttgctacacccacatttgggtgatctgaaccatcttatatctgcaacaatgagcggtgtcacttgctgcctccgcttccccggtcagctgaactcccgacctccggaaactcgcagtcaacttgatcccgttccctcgcctccatttcttcatggttggctttgcaccactgacctcaaggggttctcagcagtaccgtgccctcactgttcctgagttgacccagcagatgtgggactcaaagaacatgatgtgtgctgctgacccgcggcacggccgctacctcacagcctctgccatgttccgtgggaagatgagcacaaggagttgacaacagatgctgaactcaagaacaagaaccatcatacttgtggagtggtaccaacatgtgaatcaagctgtgtgaatcctccaaggctgtaattctcactttcggaatccactcatcagagnntcgcgtt

SEQ ID NO: 27704 - DNA, 739 bp, Triticum aestivum
  Clone ID: PAT_TA_27704
atctgatactgtggttgagccatacaatgcaactctctcagtccatcagttggttgagaatgctgatgagtgcatggttcttgacaacgaggctctctatgacatctgtttcaggactcttaagctgaccacacctagctgtaagccacttcaactttccattgcctctagtatttctcctgtcttttttggagaacaccatgtaactcgttccatgtttgcttgttttgtgcagttggggacttgaaccatctaatctctgctaccatgagtggagtcacctgctgcctaaggttccctggtcagctgaattccgacctccggaagctggcagtgaaccttatcccgttccctcgcctccacttcttcatggtgggcttcgctccattgacatcccgtgggtctcagcagtaccgtgccctcacggtcccagagctcacacagcaaatgtgggatgccaagaacatgatgtgcgccgctgatcctcgccatggccgttacctcaccgcctctgccatgttccgtggaaagatgagcacaaaggaggtggacgagcagatgatcaacgtccagaagaagaactcgtcctactttgtggagtggatccccaacaatgtcatgtccatgtcgtgctttgctgggtgggggttctgggggcagagtttgatctgtttggtgctttgttatgaatctgtttatcatcgcaactaccgcttgtacctcggccgcgaccacgcta

SEQ ID NO: 27705 - DNA, 876 bp, Triticum aestivum
  Clone ID: PAT_TA_27705
ttgtactattgagaccataccaccatatcttcatttagtttctttggaaatctaaaggtctaagaggatggtacatgtaagaagctgtgagtccacgacagaaaactaaactaatttccaaacaaacatttcaagtttggaagccacaaagaagcagcctacatctctcgttgtagtgcaggtacatgtccttaatcctgcatccacagcccataatttttcaacacctaaatccatgaaatccaaccgaaggaaatcatggcagaaacatgcgtcgtggcttacatctccgagaaggacttcttggcattcttgtgcaggttggacacagcaatcctcgctgcgagctgcagaagaaccacacaggcaccttccttcaccttgcccttggggaggaggggggcaacacttgcagcgccgtgacaagccttgctccgagtgtaatcatcagcattcttagatacctacaataatttcgttccatatatgggttttccctagtactgatcaaaccatctttaaatagcaggtgccgaatgccaatttttgttcaacacgccaagagtaacccaacaaatacacctgcaagcaataaaagatgggttaaaagttcacccatctaagcaggtatccaacaaaaatcagaaaaaaaagatataggatggtctaattccttcaggatatcggcgaaccagattagagcagattgacaggagtatcaatacgtcagaactaaacataggtaaagtaaaaaataaaaatactttatcagcacattctttgtaccaaataattgcataaggtcatcgaattaccgctggtttaaacggggcacatggttcaaagtcagaaatgggaggggatgctcctggctac

SEQ ID NO: 27706 - DNA, 691 bp, Triticum aestivum
  Clone ID: PAT_TA_27706
caaagtatatatgcagcccaagatcagtagtgctttggatcctaattcaagagatgcacttggtctagcttggtccaagttttttcatgccaatgatattgctggacgtaaagctgattgcccatactttcgagctgctgtgaagatcactcaacaattagggcctattcctataccaaccgcgaaggagattgatgggccatatttggaggccaactatgatgaagctaattcgtttcttcaaaaattcaaacaagactggaagaactttggtgtgactcttatgtgcgattcttggactggtcctacaggaatgagcatcataaacttcatggtgtattgtaatgcacgaatgttcttcctcaataccattgatgcatccggacaaactcagaattcagaaatggcacgtgagcaaaggatatcaagaagcttttggatgttgggaagcttggagctgatgcttcaaataagctgatggttgtcttttggagatgtttctatgtttaatgctttaaagtcttttggctgtactggactatttaaactttgaactatgctgtgatggttgaactgatgctggacggttaagggtttatgtcagaggcaactttataactaatgtgtgcctgttatgttggactgttaagggttatgttggaggcaattttataactaatgtgtgtctgct

SEQ ID NO: 27707 - DNA, 498 bp, Triticum aestivum
  unsure (1)..(498): unsure at all n locations
  Clone ID: PAT_TA_27707
cggaatctttctcccctctcgctctctccaccaaccaagaacagcaacacctcggcctcggagcgccgccgaatccgccgcccggcagaagggatccgaagctcccatggctggcaagtacatcgtcgccggcctcgtcggctcctgtgtcatctcgtacgcctgcgactacattgtttctcagaagaagatcttcggtggcaccatcccagggactgtgtccgacaaggagtggttgaaggcgacggagcagaggttccaggcctggcctcgcgtcgccggcccgccggtcatcatgaaccccatcagccgccagaacttcatcgtcaaggacctcaaccctgagggccaagacttgaggtttgcggtcggttggaacctttacctgatggcgatgcctgttgctaaatctaactatattgctggctgtactctcnaagctatttgtcgtccaataattaaacaacactattgtgtagggcgccgtggctatattct

SEQ ID NO: 27708 - DNA, 1237 bp, Triticum aestivum
  Clone ID: PAT_TA_27708
aataaaaacaccgtttatcaagaaaacatggctcagatctgcatgtaaccctgggttgtatccatcggtgtcaagcataggtactggtgggtcatggtctaaaactcccctctcaaatcggaggacaaccccttttttccaaaaaaaaaaatagccttccacacttcattagcacacattagttgtgcagccgagcagttttattacacacaaaaactccatgtcagctcgatggttaggtagcaagtgtggtggggaagcaactgtcatgcacgcatccgaacacgtcgcggtagtccctatggatggtgaaggagtcatacaccttgccgtcgctgctcttcttgtactcgaacaaacgcgacgagtggttgaaggcagtgagcttggtgaacccgtattctttatccctgaacacactctacttgggggtcccgctggtgtaccccgaaaggtggctgccgccgccgcctgccacaaaaaaaatggtcccgttcatggtgcccgagtagttgctccgctccccaggtgacgcactggctctggtagagcgggcatgtgcgctcgtagttgtggacgtgaccgaagaaggccatgtcaacgcggtaccgctgccacagcttctgcaggctctcccgaccctcgggctcctcgaaggagccctcggcggcgtaccacgcgttggacgagtagcccagcacccggtgcgccgcgaagatgagccatggctggtgcttccggtccaccgtggagaggcactcctcgatgaacttgtgctgtggagtcccctctcgccagtcgtgccccgtgtccgccacgcagaaccggaacatcccgtagtccaccttgtaccagaaatttgctctgttttcagctgggtagtaatacatagtctcggccggtacgccgcactcgccgccagagtccttgacatcgaaaaatccaccggtattgggccagtccctctcatggttaccactcgcaaccatgtagggcttcctggcgctgatgggggcgacttgtgcggtgaactggtcccattgggagaggtatccgttggcatatggcatgtcgccgatgtggaagacgatgtcgtagttgtccaaatctttgaccagcgtgtccgtcgtgttcaatgaccccggctggtagttggcgaactcattcgatccgtccctctccgcctttcccatgtcaccgaagacgatgatgcgctgcagcgagtttgtccaggggt

SEQ ID NO: 27709 - DNA, 852 bp, Triticum aestivum
  Clone ID: PAT_TA_27709
tacggaaatatgagtatatgacaagttgacaactgacaagataagccataaaagaagagaacattcatactaataaacttatgttcaagcacaggcagctttgcaagcaccacaagtacactagagaaaattatggtgggcatcagattagttatgtcattaagaaccaagctgatcagagaacttcaccaaggaaatatggtggattaaaataggcgtatgtatgatatatatattagattcttattaattaacagagcaaaaaagttgcaggcatgaatcagaaaaagagaacatagttggcgatggagacaatctatcaagtgttgcgcaataattgagtcattgttaagaagattcagaatttttatgaagcttaccttcataaactttgctccaccaaaatactcttcttgcttgaggcgagaagtcttcacgtatcttgatacgtacgtagctctgccatctttaatacgcactgcagtggatcattccatctccatcaaaccaatgcatatcctgcaacagggacgaacttcggattaggccccaccatgacaaactgtccattcaaacactccgggaggtggccacggacggggaggccgacggcgggaggggtctcgtaacgaacgggggcgaagttgccgcagagccagtggacaggcttggccttgtagtggccgaggcggacggtaaggcgcgccagcagaggcctcgagcaggaccctgtgcccctggtcggaccaggcggcggcacagtcaccgccccctcatttttcagggcgtactccgccgcggccaccgcttctcccatgccgactactgctggccactgacgcggacgcgtag

SEQ ID NO: 27710 - DNA, 676 bp, Triticum aestivum
  unsure (1)..(676): unsure at all n locations
  Clone ID: PAT_TA_27710
ccgggtcgacggggtaccacaatggacaccagtctatcgggtccagagagatatccctatgccacttgttacttccggtgtcgagaaaggtaacctgcgtgagcttgctttggctcgaatggaagacttgggcttgaaatgcagagatgtcagaacacgtgaggctggaattcaggatatccatcacaagatcaggcctgatgaagtagagcttgtcaggcgtgattatgccgcaaatgacgactgggagacctttctctcgtatgaggatacacgacaggatatccttattggcctgttgcgcttgcgtaaatgtggccgcaatgttacaggctctgaactcgtagggaggtgttcaattgtccgtgaacttcatgtctatggaacagcagttcctgtgcatggtcgtgatgcggagaaacttcaacaccaggggtatgggacactcctgatggaagaagcagagagaattgctcgtaaggagcatcgatcaaaaaaactggccgtcatctcaggagttggaacccgccactactaccgcaagctgggctatgaacttgaggggccttacatggtcaaatgtctagcatagtgtatttcagtatcaaacggcacttgtattgcgactagaaaaatcaaatatnatcatgatgttaagtgnaatgtatttgtaacc

SEQ ID NO: 27711 - DNA, 897 bp, Triticum aestivum
  Clone ID: PAT_TA_27711
cgtccgggaaagccagcgaccccccctccctcctcccccgcaaccaccgtccaccggacccccggcgcccggcaccggcgaagcggcggcggcgaagatgagggagatcctgcacatccagggcgggcagtgcgggaaccagatcggggccaagttctgggaggtgatctgcgacgagcacgggatcgacgggacggggcggtacgcgggggactcggacctgcagctggagcggatcaacgtctactacaacgaggcgagcgggggacggttcgtgccccgcgccgtgctcatggacctcgagcccggcaccatggactcggtgcgctccggccccttcggccagatcttccgccccgacaacttcgtcttcggccagtccggcgccggcaacaactgggccaagggccactacaccgagggcgccgagctcatcgactccgtcctcgacgtcgtccgcaaggaggccgagaactgcgactgcctccagggattccaagtttgccattctttgggtggaggcactggatctgggatgggaacccttcttatttctaagattagggaggagtaccctgaccgaaagatgctgaccctttctggcttccgtccccaagggcttagaaaccgtggtggaccctccaatggctcacttttcgttcaccaacttgttgagaacgccggatgagtggatgggggcttgacaaagaagctttattcgacatattctttcgcacgctctaagcttgccacccctttcctttggggacccggaaccattttattctttgttacaatgagcggggtcacatgcctgcctgggggttccctgggacaaataaacttttgatttccggcaggctgggtggtaaaattcattccattttccacggctct

SEQ ID NO: 27712 - DNA, 635 bp, Triticum aestivum
  unsure (1)..(635): unsure at all n locations
  Clone ID: PAT_TA_27712
gatcatcaatggcttgcaccaccaatcaaatcttctttctttccaaatgatccattccattaccatatagtattttataatttaaggaaactgagtacaagcatccagcaaatcttacgaataccaagtacatgccgcccttatcgctagcccgaaagcttacactcgaatctggtgggcatgtcaagatcaaaggatgattcaaccttgcgaagcaagaaaatagcaaaacatcacatccgtccagcagttttgaagatcaagacacagagcgacaacataggaaagattcaaatactacaatactgcaaagctagttcatattagagcaagagacgatattgcttcctagtagcgcatcttcattcttcttcctgaatctcagccaaggtcttgagtgtcatgcgcacatgaccatcgactggactctgcctgagaatcttgaagacattcagagccgtagcatcaacatccttgacacgaagtttggggaatttcctggcagccttgagatgcccaggatcaatgtcggggaattccttggcagccttgagctcgtaaatgcccgctagccggagcgccgccatcgtcctcgccctcgctctcgccgactcgatcccctcgnccgaattcct

SEQ ID NO: 27713 - DNA, 646 bp, Triticum aestivum
  Clone ID: PAT_TA_27713
cagtctgctattgatcatttcaatttttcatcccggcagtacgccgatagcctaactagtctgctattgatcatttccattttcatcccggcagtatgccgatatctataagcgagccaatagttccaaaacgttgcttcacaattactcggcagtatttgtctatttgagcagcacacagctggcttcggtgggtagcatggcatgtccattctcaattgaagttggtctgaaaatatcgaactctgccatgaaatagaaaagataaccaccgtccatagctctcatgtgaatgtggcaaggccacaaaacaagttttccattgccggatatccaacagatcaactggtgttatggattcttcttatagatatttttttgccatttcaaacatcaaacaccaactactcacaatggagacaggaaacgtgtagcttctgatgtcaactaagtgagcctgccaattgtggcaatggaaggaggtggcatgtcgtctcattcatgaggctattagtttcataacagacattttccagttgcatgtctcttgtaaagtgttcagactgttttttgagcaaagaaatgaaatttcgaagactttatctaattttacttttttctgattgtaatactaaatcaatttttc

SEQ ID NO: 27714 - DNA, 739 bp, Triticum aestivum
  Clone ID: PAT_TA_27714
gcctcacaaacatcatgtctcaagtacacattctttgcaggtaccgagattaggtgtaatctcagccgctataccaaggtttacaaatacaggtacacaatatcatcggttgtgtattaagcacgggacaaactgcctactaacgtttaagtcagccagtacattgttacaatgctactacagatatggctgacagtggcagtaaatgacatcaacacattgagatcatagagtattatagttacacttgctcatgcaccatcgtcatcttcaacagtgttgacacgctcgcactcatcgatccattcgctgtatacatcaatagcttcagtgagcgcatttgcagtggtgctgaagctttcctggcagatttgacaattggcctcaccaatcagattcttcagatcgatccggcattcaacgctgctcccatggttgcagaatgggcaggaaaagacggtatcgagcttgtccatccgcttcggatttcttttgatgaaaacccttgttccgctctcgctcgccgctactaacggggtctcggttgattttccttcctttagctactcagatgttttcagttcgctaagtttgaaaagtccaaagagcgcagactagccacggagcttggatacggtttcccgatcggagatccatggatcacagaaaaatctctccccatggcctttcgcctcgaaagcgtccttccttctcaatgcccgcctcgtgccgaattcct

SEQ ID NO: 27715 - DNA, 533 bp, Triticum aestivum
  Clone ID: PAT_TA_27715
ttttttttttttttttttttttttagcatgaataaaagacaattatcatgaacaaggaaatataataataatacttttattattgcctctagggcatatttccaacacctccggcatccttccctgggatgtcccttagatgctaggttagcgtagtacggcctccgacgttccgcgcctgaagctgggcctcgaccgtgaggagatgggggacacaaactgactgtaatctgagtcaaagtcagccattgaggacaccgacgaggtagaatcgcatgagctactccttcgctgagccatctccattgcatgcctgctacgtggggtcgtggaacgctctgctccgatttctactgctccaaggctggatgagctgcttatataaagtagatccgagcagtttctaacactaagtatccttgcatgttttaactcattttaccaagaaactacaataatttccttccatatatgggttttccctagtactgatcaaaccaactttaaatagcagtgatgaccgccaatttttg

SEQ ID NO: 27716 - DNA, 1064 bp, Triticum aestivum
  Clone ID: PAT_TA_27716
tttttttttttttttttgagacataccaccatatcttcatttagtttctttagaaatctaaaggtctaagaggatggtacatgtgagaagctgtgaatccacaacaaaaaactaaactaactttcaaacaaatatttcaagtttggaagccacaaagaagcagcccagatctcccattgtagtggaggtacatgtccttaatcatctccgagaaggacttcttggcattcttatgtaggttggacacaacaatccttgccgcgagctgcagaagaaccacacaggcaccttccttcaccttgcccttggggagggagggggggcaacacttgcagcgctgtgacaaggctttgcgaacgccgcctgcgagagcgcgcagcagagggcgtcgagagtggaagctgcctccgccttggcgagagagtagtggccacgcgactcgaggcaacacacgaagcggtcgcgctggagcagcacgctgcacacgaattgatgaacaaaggtgaggacacgcgtagctggcaaggcaggaggaagcattggcaggtaaggaaagaactgaaagcttagttgcttcagttctctgagaattacctagtcagtcaggcacaattacagcctgtaaaagcaacaaataatgaaaaaagttagataagtaaatcacaagccacaacagagttgtaaatgtttacttcatcaaaaggttggccagtagatgtaaggttagatccacatggataaaacgtagaaaaataatactccaccggcggcatcatggccatggcctcgagcggtggtaggagtgacgcagagggggatggagtggaggcgctatgggcaggccgacaccgacctggtcacttgaatctgaagcaagatgactattttgtattgttaatgaaaaaattgaatactgaaatgtatcaagaattagagaatgtactgcatgaatcaagcttttgacccagaaaataaaaccatacaattctgtgctaacctttagttctacaaaattaacatatactgagatctgttcaagctccttcttaactcgtgccgaattc

SEQ ID NO: 27717 - DNA, 673 bp, Triticum aestivum
  unsure (1)..(673): unsure at all n locations
  Clone ID: PAT_TA_27717
ttcggcacgaggcaaaggttctttacttggcacagcacggtaacatcagtacaccagggtacaagcaatcctcataacacgaagaaattgataacagagacatcctgggatcacttcctagcttgcataacaaacactgaaacgtccataaaacaaaatgcagataactcttgagccatggctcccccacgcggcggtcggccgggccggatctagaacccgagcttggtgcggcgccagtgcctgcgcttcgcgttgtacctgatggtgttgtcggtccgcatgcggatccagtaggggatggggcggttctggcgctgcttcttggccagcttctgccacgtgcctcgcaggttcaagagcaacttcagagaaggtaccttgacatctatatcaaaagttataacactagaaacacccttttagatctgaagcacttctgatgcgttttctttctgttgcatcttgttaattcaggtaccgaggctgcccccaggaacagggccgcggccaactaggtctggattttgccccatcaagaatctcgtgaagctagaatttaaagacttttgcttggattgtaccccgcctaaactattgttgctatagaattgagtatggatctgatatgttttgttgcatgggttngaaatnacctcnaatctaagaccaa

SEQ ID NO: 27718 - DNA, 521 bp, Triticum aestivum
  Clone ID: PAT_TA_27718
ttttttttttttatactggaagttactttcatcaactttctgttgttgaacaagcagatccagaggttgcaacaaacaaagagaggagagaaaattacagcaaagtctcggaaaaaaagtttgccaagtcccagcgggaaggtaataaagaaacataaatatgttgaatcttgaccacctctaaattaatcaccacgaagctaggacttggccctaacgcgcacacgccgaccgacgacgacgacgacaacaacaaccaacagcagcagcagcagcaaattattgctatctatcaaacaatgatggtggtggtgatactaccaacaggctggaagcaccatggaaattatgggatgctccaggcgggctgttcactaatagggtggtggtggtatcctgtcatttacagagtcgcaaacggcgtcgtttccttgttccatcgttcgtgtcgggttcgggttcgggttaccttgtccccctccttcgtgttttaaaaaataacaaaacgagggacggagctc

SEQ ID NO: 27719 - DNA, 720 bp, Triticum aestivum
  Clone ID: PAT_TA_27719
ccaagatccaacacaactttccgccccgtcgcccggtcgtcgagccgtcgccgccgaacaccgcccccttccgccgaagcgcggcagctcgaaggttcgtgttctaatacgcttattcccttgaggcagcatgcctaagataaagacgagccgtgtgaagtatcctgaaggatgggagcttattgaaccaactctccgtgatttggaagccaaaatgagagaagccgagaacgacacacatgatgggaagaggaagtgtgaggctctctggccaatcttccgtatttctcaccaaaagagccgttatatatatgatctctactatcgaaggaaggagataaaaagggagctgtatgagttttgcttggaccaaggttatgcagacaaaaatctgattgctaaatggaaaaagccaggttatgagcgcctctgctgcctccgctgcatacagacacgagaccacaactttgcaaccacctgcgtctgcagggtccccaagcacctcagggaagagacggtgatagaatgcgtccactgcggatgcaagggctgtgccagcggcgattgaagtcaccactcgttgttaagaataataatctgaaactgattgttcgagatgctctgtccgatccctgataaatgaaaacaagtaacgtacaatcaggtgattcatccatatattcactgtaaactctcgagcggtggtatgtatttgcgtga

SEQ ID NO: 27720 - DNA, 527 bp, Triticum aestivum
  Clone ID: PAT_TA_27720
tgttttctctgacagctggtctgaaagtcttgcacaagaattgtttttcttgttgcagccgatagtagttataatcagcaagaaccttgttttcattgttttccatgtatgcaattgcttgatcggctgcctgatccattgctgcctctccactgacacatatatggctcaacaatttagtccggcgcgccgaagcatcataatgctctttggtacggtgaaactcaatctgtgccctatatccaccttgctcgagcatacgcacatggtaaactggccttgggagcccaagcttatcaaacattgtctcggccaaaaatggtgtgcgtagctcgaccaattccatgaggatggtttcaaaagacaggctctaggggagcttcactccggggccgtgcttctagtatctcctggccggctttgtggaacactcaaatagaccgaaaacctgggaaatagcatagcatctgcggagactcgtcggaggatgtggctatccagggatctggtgcggttggagcagcatc

SEQ ID NO: 27721 - DNA, 655 bp, Triticum aestivum
  Clone ID: PAT_TA_27721
tctccggaaacctaacaatttcatagagttacacaccacacgcgatacatagaaactgcctagcagaatcgagacctgcatcagggaggacgaggcgtcctttttgtacataccctgaacacaaacacaccaagcacaactaaaacacatcgccatcggaccagatcaagcggcggcgactttgcggcccttcttggcggccggggagcggacggtcttgggcttcgccttggccttggccgcgggcgacttcttggccttggcgaccagcgtcttcttctccggcgccttgcgcttcgtgccagcagcggcggcattgctccgtcaggctttcgcccattgcggaaaattccccactgctgcctcccgtaggagtctgggccgtgtctcagtcccagtgtggctgatcatcctctcggaccagctactgatcatcgccttggtaagctattacctcaccaactagctaatcagacgcgagcccctccttgggcggatttctccttttgctcctcagcctacggggtattagcaaccgtttccagttgttgttcccctcccaagggcaggttcttacgcgttactcacccgttcgccactggaaacaccactttcccgttcgacttgcatgtgttaagcatgccgccagcgttcc

SEQ ID NO: 27722 - DNA, 1431 bp, Triticum aestivum
  unsure (1)..(1431): unsure at all n locations
  Clone ID: PAT_TA_27722
gatgaaaagataatgtaatggggattgtattgcagatagtagaatgacttaaattggtttacagatagtagaatgactgatatcaatttacagaaatacacttatatataggcagcctcacagcatatttaggcatcttcttagtctgatcatggtcttcagaggatatgtacgaaaaagcagagtgccagtcgtcggataatgcttgcatggtagacttccacacaggtacttgaaggcctataaaaggtgttggttccactctcagaccatttggagtagcccatatagttattatctccggaatatctttgctttcattggtccatatgacacacttgtagaaccatatatcaaggaaatctcattttttcaataacttcatgtttgagcaagcccaaagaccatgtcaaacccgaagtgttttgaaataatttgacttcattagtagaagtaggttttagcaaccacttagggtactacttcaaaccctttaagatgaaaaatgaaggatctttgaaaatgtatacttgagcatgcatattttgttatcttattcatgtaacatagctagagccaagtggcgcaaggtccaaattcaaatccaatgtgttttgaaacaaattgtgtttctttaataattttaaattttagaaaccatttcaggtgcatagtaagaatcaactaaaaatgaagtattcaaacaccattttcgactatttatgcatatggtcattacatagacaaataaaagaggttagtgccataggtaaaatgtacacctaacataataaaatttcacgtttcatggaactacactccttgtgaaaataacaaagtgtagtattgctaacaagcacaatgaaggatcggagcaagcaaaaaagttggaaactcaggcaacatagaggttgacaaaaagctcaatttttgcatatacatacagtacatgtcacattcaaaattgagatatactgctgataacacattacatcgtcagtatcaatcatgtgggttctactttgcaatcacacgattcagacagttgtaaacatttgtgatcacgatagtgtggtaagtgtacatattaattatgtatcaggaaaagaatctagcattagttcccacttcattcaagaaacacataaaagggctaacagacagttatatgtccacccaccactcctagctgtgacttcctgaaactacacttacaattacttttccatgttacaagcccatnaattcctcacctttttangactggatttcagcttggtactagacaattgtgggaaatcccaagctcctcgggaccaaggcctgtgtggccaaccaaagatataactcactaactgattatgagcccctcataactccatcanacactattgtgaacgcngccnatttccgganatggccggngaaggg

SEQ ID NO: 27723 - DNA, 820 bp, Triticum aestivum
  Clone ID: PAT_TA_27723
tctccggaaacctaaaatttataaacttaaacaccacacacgatacatagaaactgcctagcagaatcgagacctaaatagggaggatgaggcatccattttgtacataccctgaacacaaacacaccaagggcaactaaaacccatcatgccatcggaacagatcaagcggcggcgaccttgcggcccttcttggcggccggggagcggacggtcttcggctttgccttggccttggccgcgggcgacttcttggccttggcgaccagcgtcttcttctccggcgccttgcgcttcgtgccggcggcggccttcttgggcttcgcggacgccttcttcttggccttggcgccgtcctttgcgggcttcgccgcagccttgggggctgcgggcttggccttgggcttgggcgcgtccttcttggcggcgtcggagagcttgtaggaggccttagctggtgatccgggctgtttccctctcgacgatgaagcttatcccccatcgtctcactggccgaccttgacccctgttatttttgggtcatatctagtattcagagtttgcctcgatttggtaccgctcgcgcagcccgcaccgaaacagtgctttacccctagatgtccagtcaactgctgcgcctcaacgcatttcggggagaaccagctagctctgggttcgagtggcatttcacccctaaccacaactcatccgctgattcttcaacatcagtcggttcggacctctgcttagtttcatccaagcttcatcctggtcatggatagatcacccaggttcgggtccataagcagtgacaatcgcc

SEQ ID NO: 27724 - DNA, 611 bp, Triticum aestivum
  unsure (1)..(611): unsure at all n locations
  Clone ID: PAT_TA_27724
cgtccgcccacgcgtccgctcgtttcctgtccctcctcctgtgtgcggcgccgccgctgcgcacaggccacatctcctcgccctcctccacatctccggccaaagcgctcacttctccggccctcctccacatctcctcgcctccaccccatccacttcctgtccaagactgtggcaacggagctcggcggttgcggcccttctccaagactgcagcgtggtgctcggcggctgccgcaacggagctgatggagcgcgagccgaccagttcaacggaggcggtagcacggggcagcggcagcagcatggagggcgtccgcttgactggaaaggtacaaatgttcttgatgcagtttcagtacgtgtatgcagttttagtcttcagcaatttgtctcgtccaagtacgtgtatgcagtttcagttcttgagcaatttcagatcgatgttgctttgtttcttggttataatctgtgtctgcttgtgctgctttagatttaggagaggtccctggtaaatggctcggcaaatgcatatatcatacggngttaagaaaaagtgagtcttgatgagttgaacgtacagcagtgagattattaatctgaatatacat

SEQ ID NO: 27725 - DNA, 672 bp, Triticum aestivum
  Clone ID: PAT_TA_27725
aaacacgtcctttttggaatatatagacaacaatggcaatgttaacactgactctaaccggcctgagactgacgagtttagttactttttacaaattaactgagttctaagacccataataccaagatgacgcataaatacaacacaaacagtagagcatgttggacgggtatcactaacatggcagtacggtttctgacaattttaggtcaatatctttaatttacaggagcccaggcctttcgcaaagtagctgcttttttttgctttttttttcagggatcgcagagtctcagtgctccatgtactggtgtgccggcggggttatctttgtcttccctccgtatgcaccacgaatctctacttcgcgccattcttgaacaagagcacagcaacagcacatcacatgtgaaaggaaatcgtcacaacaccctcccacaatatttagcctttgacgaagctttctccttacacagcaagtgtaacagcaacaagacaatatgagggagtacgccataatatcattgcaggcttctcctgaagacatgggcttgttcttggcgattgaagcaatccttgagaatgttccacatggaaaaaagaaggtcttcagacacagagctggttctgaacagcaaccaagtaaatctgcatgccactcatcactgtatg

SEQ ID NO: 27726 - DNA, 635 bp, Triticum aestivum
  Clone ID: PAT_TA_27726
ttttttttttttttttttgccgagtaaagtgaaaactgaatatcagaaaggcataaacagatcttcagaacatacagaaattgggtaataaatctgcaagttcatttcatctcccgaaacctagcaatttcatataattaaacaccacacacgatacatagaaactgcctagcagaatcgagacctaaatcagggaggatgaggcatccattttgtacataccctgaagacaaacacaccaagaacaactaaaacccatcgtgccatcggaacagatcaagcggcggcgaccttgcggcccttcttggcggccggggaccggacggtcttcggcttcgccttggccttggccttggccgcgggcgacttcttggccttggcgaccagcgtcttcttctcgggcgccttgcgcttcgtgccaacggcggcggcggccttcttgggcttcacgggcgccttcttcttgggcttggcggcgtccttggcgggcttcgccgcggccttgggggcggcgggcttggccttgggcttgggcttgggcgcgtccttcttggcggcgtctgagagcttgtaggaggccttgaccttgacgagcttgcccttggcggcggacgaccggagctgcctcgtgccga

SEQ ID NO: 27727 - DNA, 771 bp, Triticum aestivum
  Clone ID: PAT_TA_27727
cgtccgcccaaatcaccaaccaaatcccctcccttcctctccctcgtcccgacgagcaccagcggccggacatggacgcctcagccaccggagccggagcgaaggcgaagaagggcgcggccgggcgcaaggccggcggccccaggaagaagtcggtgacgcggtccgtcaaggctgggctccagttccccgtcggccgcatcgggcgctacctcaagaacggccgctacgcgaagcgcgtcggcactggagcccccgtctacctcgccgccgtcctggagtacctggccgcggagctgctggagctcgccgggaacgccgccaaggacaacaagaagtcccgcatcgtgcccaggcacctgctgctggccgtgaggaacgaccaggagctcgggaggctgctggccggcgtgaccatcgcgcacggcggcgtgctgcccaacatcaacccggtgctgctccccaagaagacggcggagaaggagcccaagtcgcccaagaaggctgccaagtcccccaagaaggccgacaagaaggcttagagagagacgcgcatcgattagcttagccgctgtagtgctctgtagtaacagtattgctgttgtcgatgtagatctgcgctgcgaagaggaaaatgtcagaaatctctctgatttgagcaaattgtttgttcttctgtttttagtattgcaaaatgttaacataggagtggtggaaaaactcagatctgttcgaacttgtcaaaaaaaagtcgacgcggccgcgaattcg

SEQ ID NO: 27728 - DNA, 757 bp, Triticum aestivum
  Clone ID: PAT_TA_27728
tcggcacgaggtaacgatttctcgacgttgtacgcccctctgatccgtgatggtcgtatggagaagttctactgggctcccacccgcgacgactttttcggtgctctgcgtgctcgggtgtacgacgacgaggtgcgcaagtgggtgacctctaccggtatcgagaacattggcaagaagctggtgaactcgcgggacggaccagtgacctttgagcagccaaagatgacagtggagaagctgctagagtacgggcacatgctcgtccaggagcaggacaatgtcaagcgtgtgcagcttgctgacacctacatgagccaggcagctctgggtgatgctaaccaggatgcgatgaagactggtaccttctacggttagaacattctccatacacacccaccatctcttgctgcataggaggaggtaaaggggcacagcaaggtactttgcctgtaccggcaggatgcaccgaccagactgccaagaacttcgacccaacggcgaggagtgacgacggcagctgcctttacaccttttaagcatgccaatttaatatctgatgttttatcctttgtacctaagtaccgcatcgcatccaagcgattgctgggcatgttttgttaatatataaagatattgagtatacctatttggtaaagacaaataggactacttaaaaaaaaaaaaaaaaaaaaaaaaaaaaaaaaaaaaaaaaaaaaaaaaaaaaaaggaaaaaaaaaaaaaaaaagggccccta

SEQ ID NO: 27729 - DNA, 759 bp, Triticum aestivum
  Clone ID: PAT_TA_27729
ccacgcgtccgcacctccgcgaaatcccaaactaccaacccgatccctcctccccctcgtcccgacgagcaccagcggccggccatggacgcctcagccaccggagccggagcgaaggcgaagaagggcgcggcggggcgcaaggccggcggccccaggaagaagtcggtggcgcggtccgtcaaggccgggctccagttccccgtcggccgcatcggccggtacctcaagaacggccggtacgcgaagcgcgtcggcacgggcgccccagtctacctcgcggccgtcctcgagtacctggccgcggagctgctggagctcgccgggaacgccgccaaggacaacaagaagtcccgcatcgtgcccaggcacctgctgctggccgtgaggaacgaccaggagctcggcaggctgctggccggcgtgaccatcgcgcacggcggcgtgctgcccaacatcaacccggtgctgctccccaagaagacggcggagaaggagcccaagtcgcccaagaaggccgccaagtcccccaagaaggccgacaagaaggcctagagagaggcgcgcatcgattagcttgccgtgctttgtagaactaatggtttcgatgtagatctgtgccgccaagaaagaacaattcagaaaacctctattcgattggtttagccgctctagtgctctgtagtaacagtgattgctgtgccgatgtagatctgtgctgcgaagaggaaaatgccagaaatctctctgatttgagcg

SEQ ID NO: 27730 - DNA, 332 bp, Triticum aestivum
  Clone ID: PAT_TA_27730
ttcgagcggccgcccgggcaggtacatagaacctgcctagcagaaccgaagcctaaatcagggaggatgaggcatccttttgtacatacatacacagaccatatagaatgaaaaatatgctctggtcgtccagcagagtcgtggacaaaagtgaagttcacaaaagaccttcatacataggccattgtttcaactcgtagtttaggccttgccagactcctcgcaacccggtggcctgaaggcaatgaagctgacgcactgcacctggcgtaggttgtcgaagccgatgacgcggacataggcgtcagggtacctcggccgcgaccacgcta

SEQ ID NO: 27731 - DNA, 570 bp, Triticum aestivum
  Clone ID: PAT_TA_27731
gcggagttcgacgcgcccccatcgcctgagcacagctacaacatggagttcccaaccgatgaggagcttaccaagcaggatccacccgctcttccacctcagcttctcatgaccgcccttggtggcaccgatcacttcgacgagcacgctctgaagccgaagccgcagcatgtcgtcctcaaccatctgttcatcgagaaagggtggggcgcgcagtctctgctcgccctcgggctcacccaccggttccagtcaaagtacgtgaacttcgtgctgtacaaaccgctggtgaggaggtgaccgatgctgctgatggaagatggaacaagcagtggtggctgattaggactgatgggagtgaataagagtgtagtttgacaatgtacataagggggattcaggaaccatctgtttctctttctttctttctgtgtttcttcagtgaactgttcttgtgatgtggggtttgaaccatctggagtccggcgaaatgaaacaagagggagtgttgtgaaaatgcctggtcttgtcttgtgatctgttgtgtcagatattaatccagtcgtcttg

SEQ ID NO: 27732 - DNA, 657 bp, Triticum aestivum
  unsure (1)..(657): unsure at all n locations
  Clone ID: PAT_TA_27732
tagcgtggtcgcggccgaggtactgggccaaacccttcagatcatagttgcctccagtagtcctggtcatgtggccgaagagggtgccgttgaagctgaaattgtcgccgttggcagtgaagaaatcattgcgagtgagcgaggaatcaccctcgaacttgttgtgtccgtcgagaccgggctcggatccagtcaaaattgggttgaatgatgtacgggcacatgcttgtccaggagcaggacaatgtcaagcgtgtgcagcttgctgacacctacatgagccaggcagctctgggtgatgctaaccaggatgcgatgaagactggttccttctacggttagaacattctccatacacacccaccatctcttgctgcataggaggaggtaaaggggcacagcaaggtactttgcctgtgccggcaggatgcaccgaccagactgccaagaacttcgacccaacggcgaggagtgacnacggcagctgcctttacaccttttaagcatgccaatttaatatctgatatttttatccctttgtacctaaggtaccgcatcgcatccaagcgaattgctggggcatgttttgttaatatataaagatattacctgcccggggcgggncggctcnaaatcgaattcccgcggncggccatg

SEQ ID NO: 27733 - DNA, 952 bp, Triticum aestivum
  Clone ID: PAT_TA_27733
atttttttgagttgcattgcaggattcgatccagtatacttctgctcacatttaatttgttccattggtttttgagatactactcgctccggttcatttataaatcggcaatcatcaatggaaattattcagagttggattacattttcgtttactcaccagctcaggcttttgatctaaaaactaattaatggtgcagctggccagttttattccacagattaagctcatgaggaccaaccttgttagccactctccggctagcaacgttgccatgatgggccgctagacggtcagagagcgagtgtggtgggaaaagcaagctgtccgtgcaacacagctgagcacgtcgcggtaagtccctatcgacggtgaaaggaatcgtagacgttgccgtcgctgctcctccttgtactcggaacaaaagcgacgagtggttgaaggccgtgagcttgacgaagccatagtcttgatccctgaagacgctccatctggggatggccgtggtgtagctggagaggtggctgccgccgccgcccgccacgacgaagatggtgccgttcatggtgcccgagtagtggctccgctcgccggtgacgcactggctctggtagagcgggcatgtgcgctcgtagttgtggacgtggccgaagaaggccatgtcgacgcggtaccgctgccacagcttctgcaggctctcccggccctcaggctcctcgaaggagccctcagcggcgtaccacgcgttgcaggagtagcccagcacccggtgcgccgcgaagatgagccatggctggtgcttccggtccaccgtggagaggcactcctcgatgaacttgtgctgcggagtcccctcccgccagtcgtgccccgtgtccaccacgcagaaccggaacatcccatagtccaccttgtaccagaagtttgctctgttttcggctgggtagtagta

SEQ ID NO: 27734 - DNA, 1337 bp, Triticum aestivum
  Clone ID: PAT_TA_27734
ggtcgtgtgtgacgaacacggcattgacactacaggtcggtacactggcacttctgaccttcagttggagcgcgtcaatgtctactacaatgaggcctcctgtggccgctttgtgccccgtgctgttctcatggacctagagcctgggacaatggacagtgtccgcactgggaccctatgggcagttcttccgccctggacaactttgtgtttggggcaatctgggtgctgggcaacaactggggcgaaaggggcattatactggagggcgctgactccattgatcctgttctccatgttgttgaggaaggaacccgagaactgtgactgctttcaaaggatccaaattatccaccccctttgtggcggtactggttctggtatggggaccctgtttgatctcaaagatcagggaagagtaccctgaccgcatgatgcttacattctcagttttcccctcaccgaaagtatctgataccgtggttgagccatacaatgccactctttctgtccaccagttgggtccgagaatgctgatgagtgcatgggttctccgataacgaaccctctatgacatctgcttcaggaccttaactgaccaccctactttggtgattctgaaccatttgatctctgcaaccatgaatggagtcacctgctgcctaaggttccctggtcagctgaactctgacctcaggaagctggcagtgaacctgatcccctttccccgtctccacttcttcatggttggctttgcgcctttgacgtcccgtggctcccagcagtacagggccctcactgtccctgagctcacacaacagatgtgggacgccaagaacatgatgtgcgctgccgaccctcgccatgggcgttacctcaccgcctcggccatgttccgtgggaagatgagcaccaaggaggttgacgagcagatgataaatgtccagaacaagaactcgtcctacttcgtggagtggatccccaacaacgtgaagtccagcgtgtgtgacatccccccgaggggcctgtccatggcgtctaccttcatcggcaactcgacttccatccaggagatgttccggagggtgagcgagcagttcactgccatgttcaggaggaaggctttcttgcactggtacactggtgagggcatggacgagatggagttcaccgaggccgagagcaacatgaatgacctcgtgtcggagtaccagcagtaccaggatgcgactgccgatgatgagggcgagtacgaggacgaggaggacgtgcaaggagatgaaatgtgagaggctgtgatagtgtgaagcctggtggttctagggcaggcagacctt

SEQ ID NO: 27735 - DNA, 562 bp, Triticum aestivum
  Clone ID: PAT_TA_27735
gctagaccgcccgctcctgccaagatccaacacaactttccgccccctcgtccggtcgtcgggccgtcgccgccgaacaccgcccccctccaccgaagcgcggcagctcgaagcatgcctaagataaagacgagccgtgtgaagtatcctgaaggatgggagcttattgaaccaactctccgtgatttggaagccaaaatgagagaagctgagaatgatacacatgatgggaagaggaagtgtgaggctctctggccaatcttccgtatttctcaccaaaagagccgttatatatatgatctctactatcgaaggaaggagataaaaaaggagctgtatgagttttgcttggaccaaggttatgcagacaaaaatctgattgctaagtggaaaaagccaggttatgagcgtctctgctgcctccgctgcatacagacacgagaccacaactttgcaaccaccctgcgtctgcagggtccccaagcacctcagggaagagacggtgatagaatgtgtccactgcggatgcaagggggtgtgccagcggcgattgaagtcgcca

SEQ ID NO: 27736 - DNA, 576 bp, Triticum aestivum
  Clone ID: PAT_TA_27736
ctctctccttcccccacaagcgcgtgcgtctcctccctccatccctctcccggcggcggcggcggcggcgggcgaacaccgaccgatcgcgagcagcaatgtcaggcaagtacatcatcggttcgctggttggatcccttggcattgcatatgtctccgacaccatcgtttccgacaagaagatcttcggaggcaccgtctgcaagacggcgacagacaaggagtggtttcaggccacggacgccaagttccaggcctggccccgtgtcgccgggccgccggtcatcatgaaccccatcagccgccagaacttcatcgtgaaggacccctgaatgggcggcggcgcgagctcgaccagcgttttgctcccaccatggagccaaagtttcttttctagggttttcaagttcctaataaaagtgactttaaagtcagggtatactattttgttttgcgaatttcagtttccgtgagcaactttggaggggctttaccgctcgctcaaacgcctttcgatgaactctgttccttggtgaaatttcccaccaggcagttaaataactgcatcgttgtttc

SEQ ID NO: 27737 - DNA, 952 bp, Triticum aestivum
  Clone ID: PAT_TA_27737
gctgaaagttgtatacaccaaaaactgaatgatacatgagatgggaatgtataggctaagctgcctccattgcaaaaccaaaacaaaacctctcaaagttgcattttcagtaacagatacacacagcaaccaggagcctttctcagctactttctgtttccagtatcctaataagctgaagaacagtggatgcttccctctattctcgaagggaagctacaggagtcccactagaagtcgagttgcgagccttgcgtcgaggaggagcaactacctgatccaccagacgagggcccgctcgacccgtccaccggggcctgattcagccgttctagcaccagcgacctcctttttcgcagcttcagagaaaatgtggacgcctctaatatcacaggaacctggctgttggtctgtgccaccttatgaacatgtagaaaaccaaccatatcctgataccctgtaaggagtttcgccaagtccttgtcctcatctgggattgcttttattgacagcagcgtgtctgctaggtgctgccatctcttgcagaaagaatctataggacttgtgtgtggaaatgttataatggcaacggcgttagatgagcgcaccatggccttcagtgatctgagaaacaagaccatgtcccagtccttcccaaaaatatccacactctggtgcacagagtgactgtatagcaatacgtcctgcactcagattcccaccctcttttctttgatgtttggacaagaaagcagaacaacgatcctggagatcatggagagtatctagatcttgagtgctcaaacattcaatatgctgtgcattaagtaaatgccgttccaggggcttccgtaaatcaaaatcatggctaaattcctgcttgttgtctctgtgttcagcactggaattcctctcgtccccaaagtacttcctgtactgccaagctatcctc

SEQ ID NO: 27738 - DNA, 1175 bp, Triticum aestivum
  Clone ID: PAT_TA_27738
cgtccggtggcaaccatgatgcaaatgcaagtgattcccaaaaatcttggaaaggaattaaagataataacttgtatgatccttggaaccatgcatggccgtattatgggggttttgattgtgtgtactgcaacctaaagcacaaaggtggaggtgcaacccgtgtcgcggagcaccttggtggtattgtaggtaatgtgaggagctgccccaatgtgccaagaaatgtgagagatgcaatgagagagtgtcgggatgaatcaaggaggaagaaaagagagaaacaaaatagcaggctgagaattgaaagaaatattatggaagggctgtatcaaaaaggaggggtgattaacatactagatgatgaagaagaagaaattcagatgaatattagagaggcattgcgtgacccgaatgtctctcgcagagttgataggaggattggcaaggggagtgtgggtgatgtgcgagttgatgttggcaaaaagagtatcaccgcatattttgacaagcaattatgcagcaacaaagtatctatgcagcccaagatcagtagtgctttggatcctaattcaagagatgcacttggcctagcttggtccaagttttttcatgccaatgatattgctggacgtaaagctgactgtccatacttccgagctgctttgaagatcactcaacaattaggacctactcctataccaaccgcgaaggagattgatggaaaatatttggatgcaaactatgatgaagcaacttcgtttcttcagaaattcaaacaagattggaaaaactttggtgtgactcttatgtgtgactcttggactggtccaacaggaatgtgtctcataaacttcatggtgtattgcaatacacgaatgttcttccttaatagtattgatgcatccggtcagactcagaattcagctggagcttggagcatgatgctagttggaggcttggagcatggaagctggagctttttcaatggaacaagacctccccgtccatgctttcatggatttcttttggagttgttgttcgttgtgatgctttgatggttgtcaaatggagctgtttctatgtgaaatcctttaaattcctagagttggttgtactgaagtatttaaactttgaactatgatgtgatggttgtggactgtaagtttagaact

SEQ ID NO: 27739 - DNA, 701 bp, Triticum aestivum
  Clone ID: PAT_TA_27739
caccaaccaaatccctactctccctcgtcccggcgagcaccagcggccggacatggacgcctcagccaccggagccggagcgaaggcgaagaagggcgcggcggggcgcaaggctggcgggcccaggaagaagtcggtgacgcggtccgttaaggccgggctccagttccccgtcggccgcatcgggcgctacctcaagaacggccggtacgcgaagcgcgtcggcacgggcgcccccgtctacctcgcggccgtcctcgagtacctcgccgccgagctgctggagctcgccgggaacgccgccaaggacaacaagaagtcccgcatcgtgcccaggcacctgctgctcgccgtgaggaacgaccaggagctcgggaggctgctggccggcgtgaccatcgcgcacggcggcgtgttgcccaacatcaacccggtgctgctccccaagaggacggcggagaaggagcccaaggagggcaagtcgcccaagaagaccgcaaagtcccccaagaaggccgacaagaaggcgtagagacgcgtgctttgtagaactaatggtgtagatgtagatctgtgctcccaagaaaaagcaattcagaaatctctcttcgattggcttagccgctgtagtgctctgtagtaacggtgattgctgtgtcgatgtagatctgtgccgcgaagaggaaaatgtcagaaatctc

SEQ ID NO: 27740 - DNA, 633 bp, Triticum aestivum
  Clone ID: PAT_TA_27740
agaaactgggaaactgcaaattcatttcagagttagagctggatacatctgatacctgaacattccagacactaaacaccaccagcgatacatagaacctgcctagcagaaccgaaacctaaatcagggaggatgaggcatccttttgtacagaccgagaacaccaacgcacacctaaaaccacctatcagatcagatcagatcaagcggcggcgaccttgcggcccttcttggcggccggggagcggacggtcttcggctttgccttggccttggccgcaggcgacttcttggccttggcgaccagcgtcttcttctcgggcgccttgcgcttcgtgccagcggcggcggcggccttcttgggcttcacggccgctttcttcttgggcttggcggcgtccttggcgggcttcgccgcggccttgggggcggcgggcttggccttgggcttgggcgcgtccttcttggcggcgtctgagagcttgtaggaggccttgaccttgacgagcttgcccttggaggcggacgcgcggagctggacggagagcatcttcttgaagttggcccggcagggccttgccgtgcttctcctcgatgtacttggcgatggcgaccgagctcgacccggcctgt

SEQ ID NO: 27741 - DNA, 227 bp, Triticum aestivum
  Clone ID: PAT_TA_27741
ttttttttttttttttttttccagttgcaaacaaagtttcttttccatcaattgatggcaagacaataatccgcggattgcatataatatatatgtgtatgtgtagccggtgctataattctgacatgcatcctcctcggcctacgttggtaggtgcttacatatgctcatatattcacatatgagtagaaccagaaataaaaccgagaaagcagagctgctgacaa

SEQ ID NO: 27742 - DNA, 506 bp, Triticum aestivum
  Clone ID: PAT_TA_27742
gagggacaacgccgcgcctccgcctcgaaccctagccgagcggagcaaggaaagaaatggggaagggtacgggcagcttcggcaagcgccggaacaagacgcacacgctctgcatccgctgcggccgccgcagcttccacctccagaagagcacctgctcctcctgcggctaccccgccgcccgcatccgcaagtataactggagtgtgaaggccatcaggcgcaagacaaccggtaccggaaggatgaggtacatgcgccacgtgcctcgccgtttcaagagcaacttcagagaagggactgaggctgctcccaaagaagagtgctgccgctgccaactaagtctggatgttgctatcaagaacctgataagctagaacattggaacattttgcttgagttgtacttctgaactatttagccaaatactctggatgtactggttatagtgctttgaattaaagtcagacacccaggtggtatgatgtaaaaaaaaaaaaaaaaaa

SEQ ID NO: 27743 - DNA, 799 bp, Triticum aestivum
  Clone ID: PAT_TA_27743
cccagctgcaaacaaagaaacatttccatcaacggggggcatgacaataatccggggatggcaaaaaaaaaatgggggtatgtatagccggggctaaaattctaaaatgcatcctcctcaacctacgggggggggggctaacaaacatatgctcatgtattcacatacgagtagtccgagaagtaaaaccgaaaaagcagagctgccgacaaatggaaacaaacaggggatgtatatgcgttacttaaacttgcactttaggccttgccaaattcctcgaagcctgggggcctgaaggcaatgaagctgacccactgcacctggcgcatgttgtcaaacccgatgacccggacataggcataagggtactcctttttgacctcctccacctcgttgagcacctgcgttgcgtcggggcacccgaacataggcagcttccacattgtccagtatcgaccgtcatagtatccgggggagctgttgtgctcacggaagacgaaccaaccttgctgaactcgaggcagggcacccacttggagcggatcaagtagtcgacctgcttcaggagggcctccgtggagaggggtggcaggtaagacagggtctcgaacttcttgatgccctcaatcggccacacctgcatgcacctgatccttccgccgttgctgacgctgctgaggccggcgctgctggagcggcggctgatgggcaggccggcggtcgacttgagaccctggaagggtgcgacggaggtggccgaggaagccatcacagtgggggccatggtgttggaggagag

SEQ ID NO: 27744 - DNA, 1241 bp, Triticum aestivum
  Clone ID: PAT_TA_27744
cggacgcgtgggccgccttctagcacaccggaaccggcctcccgcagagtcccccgcccgccctgcgtcgcgccgacagagatccgggccatcttcggactgcagatgcacaaaacatagtgtaccagctcttcctcactcaacatgtggagttttgcatcaaatgccatagctggaagcataaagaaaaaggtacaaccatcaaaaggcagcctatccaatcatgattgctctgatgacgatggttcttcatgtgcaagtcgagaggaaggccttgaatgcccaatatgctgcgaatccttcaacatcgtagagaacgttccttatgtcttgtggtgtggtcacacaatgtgcaagaactgcatcttgggccttcagtgggctgttgtcaattcccaacccttcctatccagctgcctctctttgtctccgtgtccttgggtgcaacctaatatccttccggctggtgtacaagggcaacctcaattcccacgcaagaactacttccgctgtgggatgggttgaagagcatgaatggtgacagagcaaagttccattcctctggtcatgaagagcgccaatcagtatgtccctccagtggtggcaccagttccagtcaacaccaccgaagaacccctacggcacgagcagagacctcttctgccagagatagaaatgccgctgccaacacctccaacactgccagcgtgtctctccaaaagctcatggtgtgcttcgtgcagctgactgccaagttcccgctcgtgataatgttcctcctcatagttctctacgccgtccctgccagcgccgcggttctgctcctgtacgtccttgtcacgtttttgtttgcgctgccgtcgtttctgatcctctactttgcttatcccaccttggactggctcgtgagagagatattcacttgagccgcgctgttctgaaatgtaagtacagtttatgtagctttgtgaaaggtgaaaacaaagctttggatatctgttccatccatggcaccgctttgctgttatggccactgtatagattgcccttttctgctccttgttttttcttccccttttctgctctggccttttgaggctgtggtttgctgtaactgtctgctcattgaaatgttgttcttgttcatgaagtgccccaatctttgtaattttccttttgttgtggtcaggtgttgtattccctcctatccatatttattgtcgctgctctaaaaggggggg

SEQ ID NO: 27745 - DNA, 1004 bp, Triticum aestivum
  unsure (1)..(1004): unsure at all n locations
  Clone ID: PAT_TA_27745
ttttttttttctctaaaacaaccatttcattacactaaacaccacccacgatacataaacttgccaagcagaaccgaaacctaaacaagggaggatgaggcatccttttgtacagacccttggaacatcaagcactcctaagaccagctatcggaccggatcagatcagatcaggcggcggcgaccttgcgggccttcttgggcttctcggccgccttcttcttgggcttggcggcgtccttggagggcttcgccgcggctttgggcttgggcgcgtccttcttggcggcgtcggagagcttgtaggaggccttgaccttgacgagcttgcccttggcggcggaggcgcgtagctggacggagagcatcttcttgaagttggccgggagagccttgccgtgcttctcctcgatgtacttggcgatggcgaccgagctggacccggtcctgtccttgagcgccgcgatcgcctccttgatcatctcgaagtaggtcgggtgggcggctccagcggcggacagatcgagggcaggccaacctgaagtcagcgcatcctctctggcgaccaccgaagccctcaccacttcccctgatgtaatggccgccctgaaacaaccaccaaacgcgaacgctgccgcaccgccgtcctccatcccggcggccgcacaccgctcgccaaagccaccgcagatgagtccacacggccagatgtggctagaatgggcacacgacgaagcctccactaccaccgacaacaccggagcaggcagatctggcgcgacgcgatcgtcgaccccccgcatcggctgccgccaccgccgcagatccacccacgccgctggccccaaaccctaccgcgccgagcgtcttcagctgcgagatccatggcgccccccatgaggcggagagaacggatcccaccactgcatgtaccggcgacagcaacaggagggaggagtcgagggggctacggccgggacggcctcgtgccgaattncctgcag

SEQ ID NO: 27746 - DNA, 823 bp, Triticum aestivum
  Clone ID: PAT_TA_27746
ccggagctcacacagcagatgtgggacgccaagaacatgatgtgtgcggccgacccgcgccatggccgctacctcacggcgtccgccatgttcaggggcaagatgagcacaaaggaggtggatgagcagatgatgaacgtgcagaacaagaactcctcctacttcgtggagtggatccccaacaacgtcaagtccagcgtctgcgacatcccccctgtcggcctcgccatgtcctccaccttcgtcggcaactccacctccatccaggagatgttccgcagggtcagcgagcagttcaccgccatgttccgccgcaaggccttcctccactggtacaccagcgagggcatggacgagatggagttcaccgaggccgagagcaacatgaacgacctcgtcgccgagtaccagcagtaccaggacgccaccgccgaggaggagtacgacgacgaggaggagcccgccgccgacaagcctgatccttcatgcattcgtccattcctcgcgtactgggtttgtgctgccaatcgagtttgagtagccatatatacatatatctactcttcatcatgtcgttagtacgtagtattataccgtaatatcttgtcgtcgtgttggcctgtatttgtatgtatgcttgtttcgtgctacctttatatattcgtcgtcgtcgtcgaaccttcagtcgtcatctttacttcaggttacttggaatctgtttgcttaattgagcacttgggattactcatgtcttctcttgtagcatatgttgttatggagtgaattgcaaaaaaccaccacattaaagcatagatttgcagaa

SEQ ID NO: 27747 - DNA, 1068 bp, Triticum aestivum
  Clone ID: PAT_TA_27747
tcgcgatctagaactgtctcgctcctcctgtgggcggcgccgccgctgcgcacagaacacatcctcgccagcgtagcttctccggcgtccggccaacgcgctcactagcctcccgccttcctccacatctcctcgcctccaccccatccagttcgtgccattcgctgctccaagacaagggcatggcgctcggcggctgcggcaacgaagctgatggtgcacgagccaaccatgaaggcagtagcacggggcagcgacagcagcatggagggcgtcctcttgtttgggaagattatgccacttcactaacagatgcgatagcgaagatattagacccagtgagtgctctttcagccattgatgaagtgagcaagttcagggagtgccaagggaggtttgggaccagattggcagaagaagctgcggcgagaatggggccaacccaatggtggtttcagtttggaggggatgttcctgcattgcagaaatgtgcaatgagaatttgctcacaatgtgtctcatcaagtgggtgtgagaggaattggagcgcctttgctttggtgcacacaaagcaaagaaatcgtcttttatatgacaagctccacaagctagtttctgtacgctacaacctaaagatacgtgctgaagaagatcaagagaaagatatagataatgaagttgatccaagtgcactgctgatggacacaacaatgtttgatgaagcaaatccaataatggagtggctgaatgatgatgaagaggatccaattgtggatggagctaatgaagccagtgctgtttttgagaaaataaggcgtctcaactcaagcaggaaggattcttatgttggtacaaaaggtaataagaagaaaagaaagaggaatcatgatgaggagaatgagtatgtcgaaactgagagtgaggatgacgatgaagagaatgagtatgttgataatgagagtgaggatgatgatggggtgagtgaggatgatgaggatgatcaacaagatcagcaagagacacaaatgcaagtggaagaagagacacaagtacaagctgaaaaggaga

SEQ ID NO: 27748 - DNA, 1866 bp, Triticum aestivum
  unsure (1)..(1866): unsure at all n locations
  Clone ID: PAT_TA_27748
gccgaatcccccacctccaccccctcccccgcaaccaccaccaccaccgtccaccggaccaccgtcaccggcgggggcgaaggcacgatgagggagatcctgcacatccagggcgggcagtgcgggaaccagatcggggccaagttctgggaggtgatctgcgacgagcacgggatcgacgggacggggcgctacgcgggggactcggacctgcagctggagcggatcaacgtctactacaacgaggccagcgggggccggttcgtgccccgcgccgtgctcatggacctcgagcccggcaccatggactcggtgcgctccggccccttcggccagatcttccgccccgacaacttcgtcttcggccagtccggcgccggcaacaactgggccaagggtcactacaccgagggcgccgagctcatcgactccgtcctcgacgtcgtccgcaaggaggccgagaactgcgactgcctccagggattccaagtttgccattctttgggaggaggcactggatctgggatgggcacccttcttatttctaagattagggaggagtaccctgaccgaatgatgctgaccttctctgtcttcccatcaccaaaggtctcagacaccgtcgttgagccatacaatgctacactttccgttcaccaactcgttgagaacgctgatgagtgtatggtgcttgacaatgaagctctatacgacatatgtttccgcacgctaaagcttgccaccccttcctttggtgaactgaaccatcttatctctgctaccatgagcggtgtcacatgctgcctgaggttccctggacaactcaactccgatcttcgcaagcttgctgtcaatctcatcccattcccccgtctccacttcttcatggttggcttcgcgccgctgacgtcacgtgggtcacaaatgtaccgtgctctcacagtccctgagctgactcagcaaatgtgggatgccaagaacatgatgtgtgccgcagacccccgccacggccgctacctcaccgcctcggcctgcttccgagggaagatgagcaccaaggaggtggacgagcagatgctcaacgtccagaacaagaactcgtcctactttgtggagtggatccccaacaacgtcaagtcgagcgtgtgcgacatgccgcccagggggctgaagatggcgggcaccttcgtcggcaactccacgtccatccaggagatgttccgcagggtgagcgagcagttcacggccatgttcaggaggaaggccttcttgcactggtacacgggtgagggcatggacgagatggagttcaccgaggccgagagcaacatgaacgacctcgtcgccgagtaccagcagtaccaggacgcgaccgccgacgaggagtacgacgaggaggaggaagaggaacgcgacgcggagtagtgccccgtccctgccccaacccancanatgtccnccggttcaggtctgtcgccatgtccaggtcgcgtttcctccggtgagggtttgtgtggtttcctcctgtggcttggatgagtcgaggttgcgtcttgtgctccgttttgtaatttgctacggctagtagtgcgttgcagtctgtcgtgttcagcatcatttggtcagtcggtccatagctgacgatggcctgaactgtcgagtgctctccttgagctagtcgtcgccttgtaagttctgacaagtattattgttagtcgttcgcttcagcaaccaaaaaatgagtattggtagtggtttctcattatctttgtgaatattgtacttatgtcggaatgtttttgccttgttatttgtgtatatttcgtatcttgtgttcttggtacccaaaaaaaaaaaaaaaaaaaa

SEQ ID NO: 27749 - DNA, 680 bp, Triticum aestivum
  Clone ID: PAT_TA_27749
attcggcacgagggcgaaatcccaaaccacaaccaaatccctcctccccctcgtctcgacgagcaccaccggccagccatggacgcctcagccaccggagccggagcgaaggggaagaagggcgcggcggggcgcaaggccggcgggcccaggaagaagtcggtgacgcggtccgtcaaggccgggctccagtttcccgtcggccgcatcggccggtacctcaagaacggccgctacgcgaagcgcgtcggcacgggcgcccccgtctacctggccgccgtcctcgagtacctggccgcggagctgctggagctcgccgggaacgccgccaaggacaacaagaagtcccgcatcgtgcccaggcacctgctgctggccgtgaggaacgaccaggagctcggcaggctgctggccggcgtcaccatcgcgcacggcggcgtgctgcccaacatcaaccccgtgctgctccccaagaagacggcggagaaggagcccaagtcgcccaagaaggccgccaagtcccccaagaaggccgacaagaaggcttagagacagacgagcatcgattagcttatgcttcgctgtaacagtgatcgctgttttactaatggtgtcgatgtagatctgtgctgccatgaaaaatcaagtcagaaatctctctgatttatccaaaaaaaaaa

SEQ ID NO: 27750 - DNA, 744 bp, Triticum aestivum
  Clone ID: PAT_TA_27750
tttggcaaatgctatcttatggatgtacccgctttcacatttgtgttcagactacaaacaaaggccacacagtagttgttgttgctgattgtttttcttcttctgcaaaagatgttgtttaagatttaataatgtcggagttgagagagatatgagaacaactatcaggtcaaagtaagcaccacttgccatgcaagcgatgtacggcgggtggcgagcgccactgagtgtgcacggtgcaaaagaagggggagcggctgtcggattttgttgaagcgaaaaattggtttttgatgcattcaaaaatcaataatcatcagcggcaacgaaatttacaagaccgaccagtggatgatgactatctccatacttgatctttctatttgacactgcataacatattatggcgtcataagaacagtcttctgtgacgctcgcaagagggatgtggtctacattgagcagtactacgatggcgctgacgaacagctgctcaagcaggcgatgatgaaggtgagcatcggcttagtggggacagtggagggatgtcaaagtaataagagtagtctgtaatacattttttatcccatcatggctactgacgaggccatggacctagggtagggtcatatgcctgacctatacgtcctacccaaggtcactacattagaatttagcaagagataccgactgaagtaaccatggagtgcaatccactcgactagttaccccaaaaaaaaaaaa

SEQ ID NO: 27751 - DNA, 633 bp, Triticum aestivum
  unsure (1)..(633): unsure at all n locations
  Clone ID: PAT_TA_27751
gtcattcatcactgatcaccaagcacagccgcgcatccaccgctgctagcaaggtcgagcaagcagcacagagatggctgctgccttctcctccaccgtcggtgccccggcttctacgccgaccaacttcctcgggaagaagctcaagaagcaggtgacctcggccgtgaactaccatggcaagagctccaaggccaacaggttcacggtcatggcaagcggaaaacatcgacgagaagaggaacaccgacaagtggaagggtcttgcgtacgatatctccgacgaccaacaaggacatcaccaaagggaaaggcatcgtggactccctcttccaagcgcccactgggcgacgggaaccacgaaggcgtcctcaactcatacgaatacgtncagccaaggatcaagaattcgactcnacaacacatgggagttctacatcctcctgctttaatggacaacttgttgtcatctctccaagaattaatgacctgccaactaanttcancatctggtactggggaggaaggtcaaggaatcctcaatgtaactgtctcccaaatggataaccatcatatattncgaaactgaattgaacccgaaacacaactanagaacgtnctagtgaantttaa

SEQ ID NO: 27752 - DNA, 992 bp, Triticum aestivum
  unsure (1)..(992): unsure at all n locations
  Clone ID: PAT_TA_27752
ttgaacatagatacatgattcttcaagagcaaattgccgagaaaatataaagcatgaaaggctttaagttgtacaaatgaaaccataccaccatatcttcatttagtttctttggaaatctaaaggtctaaccggatggtacatgtgagaaggtgtgaatccacaacaaaaaactaaactaacttccaaacaaacatttcaagtttggaagccacaaagaagcagcccagatctctcgttgtagtacaggtacatgtccttaatcgtctccaaggacttcttggcattcttgtgcaggttggacacagcaatcctcgctgcgagctgcagaagaaccacacaggcaccttccttcaccttgcctttgatgcttggccctactttcatatttgatgcacaccgtctaatgctaacaacaccaaatcttgaaatgttgattttccatatatcatttaccatcagtagactaagaatggaataaaacaataagctctgtccagatagcacaaaagaacaacaaaatcaactcaatctgttctgtgagccccaactttcatcacttgaatttggctggagttcaaatccattcaagataaaggaagttcatatcacctaaacaattgcaggctttaaccaaatattatgagacactttgcggatacacctgcaacgctagagaagaacatcatagcaatactctgaatttatgcttcttcatgccaccatggctgacacggatacagtaatggtggcactggcctcttcctgccaccacatcacggatacggtaggccacatacactagtccgagaaaacgccaaaagttggtgatcccagaatgtaataagttattctcttaaagtttagaccagccctcactcaatatccctcatcaatattgtattttgattcccgcagtcgttcaccccnnaagttaangtcccagtgccanntcattggcttccgcagaaccaaaatctttcacagaggat

SEQ ID NO: 27753 - DNA, 471 bp, Triticum aestivum
  Clone ID: PAT_TA_27753
ttttttttttttttttttgcacaagatttaaatctctacatatcatcagcaggattgaagtttgctacagggtacagatatgatattgcctcccagacacatggataataatctctaataatgatcgtcttgtttttagcttgatattaagccatcccaccactagtagccgtcctgataatctgaaacaaggatgatcctatgaccacaaagatgaagaatccaagcacgataggtccaacaggatagtcattccccttcttcacagtagtttcaggcactgagcccctctttgtgacgttcttctgaaacttcgcactcttcctgtcagcaagacgccttgaagtagtcatccttgcttggtgtgacggccgatgaacccaagagaggatccacaggggaagggaaatcggggtaggtgaggagagcagagggagatagacgaagacaggcgagaagggaaatcaagct

SEQ ID NO: 27754 - DNA, 573 bp, Triticum aestivum
  unsure (1)..(573): unsure at all n locations
  Clone ID: PAT_TA_27754
ctcccctctcgctctctccaccaaccaagaacagcaggaactcgacctcggagcagcaacgaatccgccgccgcccggcaaaagggatccaaagctccaatggctggcaagtacatcgtcgccggcctcgtcggctcctgtgtcatctcgtatgcctgtgactacatcgtttctcaagaagaagatcttcggtgggcaccatcccagggactgtgtcccgacaaggagtgggtttgaaggcgacggagcagaggtccaaggcctgggccccgggtcgctgggccgccggtcatcatgaacccatcaaccgcccagaacttcatcgtcaaggactcaaccctgaggtcaaattttaaagtttgcggcccgttngacttacctgatgggatcctgttgctaacctactnagttttccggtgtatcncccagtattgtcngtccnatattaaacaacatggtgtaggancctggtaattcttcggaagaacaganagactaaacagcttttggcactttggttggtaaaaaccgttaatttcnattgggctggcaaacaccgganacngctgcaat

SEQ ID NO: 27755 - DNA, 787 bp, Triticum aestivum
  unsure (1)..(787): unsure at all n locations
  Clone ID: PAT_TA_27755
agtcgcagccgcttcacttctcccaggtaaaggaaaggttcgcccatggctccgtcgcagcccaagtcgggcctcttcgtgggcatcaacaagggccacgtcgtcaccaagcgcgagctgccgccgcgcccgtccgaccgcaaggggaaaggtaccaagagggtgcatttcgtcaggaacttgatcagggaggtagctgggtttgctccgtatgagaagcgtatcactgagcttctcaaggttggcaaggacaagcgtgccctgaaggtggcgaagcgaaagttgggtacccacaagagggcgaagaagaagagagaggagatgtccagtgtcctcaggaagatgagatctgctggaactggaaccgagaagaagaaatagagcatcccaagctgatgaagttgatggcaatcttctgttctggtgtccagtttttactgcatgtagaaccaactagacttgaaactgttatccgccagctaaacattatgctatgttgaacctcctgtcttgtgagatttttgatctaacttgcaatgcatcgtttgctcctatttctgagtttgctaaaaaaaaaaaaaaaaaaatgttaacaagttgctcttctgaacctacactgtattatttaggatgaactgcaatatgccttgtattaaggtattgatggatatggttactatcaaaaatgcttatgtataggaagcatatatctgtgaatgtacttacaagcaggttgggtttcagttatagtttgagttatattaaancacatattcagtttacttaa

SEQ ID NO: 27756 - DNA, 853 bp, Triticum aestivum
  unsure (1)..(853): unsure at all n locations
  Clone ID: PAT_TA_27756
ctctcctctgttcctctcgcacaacagaagaaaaaccaactacctcctcctacgctccgatggccgcagcggtggtcgacgcagcggtgccggtggcggcgaaggcgaacggcgccggggcgaggtgctgcgcggcgaaggggcccgggtacgccacgcccagggaggccatggagaagggcccgcgggaggggctcctctacgtcacctgcgtctacaatggtactggaatcgacaagccggattacctggccacggtggacgtcgacccaaattcagcgacctactcccaggtgatccacaggctccaggcgacccacatcggcgacgagctgcatcactctggctggaacgcctgcagctcctgccacggcgatccatccacgagccggcgcttcttgattcttccttcgttgctgtctggccgtttgtatgtggtcgacactgcgaagaatccgagggcgcctgctctgcacaaggttgtccaggctgaggacattgctgagaagaccgggccttgggtttccctcacacatcccattttgccttgcaaaccggtgacataatgatttcttgtctgggagacaaggagggaaatgctgctggcaatggctttctcttgctggattcagaatttaacgtcacaggacgttgggaaaagccaggtcacagccctggttntggctatgattctggtaccanngnctcntcacagacgatgatcagctcttcatggggancccggngcttcngacangnntgactccancagtccaaaggnnccanggagccgnccnggntacacggcgcgngggaccacacanacnaggtcaggagacaggnncnccnggag

SEQ ID NO: 27757 - DNA, 759 bp, Triticum aestivum
  unsure (1)..(759): unsure at all n locations
  Clone ID: PAT_TA_27757
caaaaaccaaagtggccaacactcgcgcatcctctgcttggaagccgtcttttctcaccgaatctaacatagatacatgattcttcaagagcaaatttcaaagaaaatataaagcatgaaaagctttaagttgtattattgagaccataccacgatatctttatttgtttctttgaaaatctaaaggtctaagaggatggtacatgtgagaagctgtgaatccataacagaaaactaaactaactcccaaagaaacatttcaaatttggaagccacaaagaaggagcccagatctctcgttgtagtgcaggtacatgtccttaatcgtctccgagaaggacttcttggcattcttgtgcaggttggacacagcaatgctcgcatgtatcttgcaaaagtatgaccggtccggacgtcaggaaacattttatcaaacggtagcctgataaacaagaagttggatgaccctcgaccggttcgacaaccaggagaagtccgtgtggacgaggccgaggccgcccgccaggaccagctccagcgcgaggctgaggccgcccgccaggaccagctccagcacgaggccgcccgccaccgcgagtcccacgcctgcctcgtcgcactgcgccacaaccggggtctccagggcgcctcgccctcccctccccgtgccccatctccactctcttgtcaatcttcccagccagttgagacctccgtctatcgcttagagccggggccgtgctgccctgcgtnctcgga

SEQ ID NO: 27758 - DNA, 605 bp, Triticum aestivum
  Clone ID: PAT_TA_27758
ggtagctctctctcctctcctcgccccgctccgtcctcccctcccctcctctcctctcctagggttcgaagccacagccggccagtagcaatggcaacaaagtgcatcatcggcgcgttggttggatcccttggcgttgcatacgtctgcgacacgatcgtttctgacaagaagatctttggaggcactgtttgcaagaccgcgaccgacagggagtggtttcaggccacagacgccaagttccaggcctggcctcgcaccgctgggccgccggtcatcatgaaccccatcagccgccagaacttcatcgtcaagaacccttgataggtggcacgagcggcatctcgctcccaccatgggatcccaagtttcttttctagggttttgaagttcctaataaaagggacttgaaagttggggtatactcttttgctttatgaatttcagtttctgtgagcaactttgaggtgctttaccgctcgctcgctcatctttcgatgaactctcttcctcggtgtaattatccactaggcagtaaaaataactgcattgttgtttccgcactgtctttcatgtgctgtgtttctttctgatctgatgctcca

SEQ ID NO: 27759 - DNA, 813 bp, Triticum aestivum
  Clone ID: PAT_TA_27759
ttttttttttttttttttgcagtaataaatgtagcttcagcaaacaaagtgcataatttccgttgcaaacagtcaaaatgtaaagcaagtataccgagtttcagccctattattattggacagtaacacaaccgggggccttcgatggaaatgaccctcaaatggagttaaaatgggaaaataaacgccaaagcctgcctcggagggcaggggcttgtaaggttgtgcatctctccgagtcaacaggaacacaaagtgattcccaggtcgagagttccgtaaacttggtatatacatacacgatactcgatcgcctctgaaactgaggtttcagaactgctggtcgaggatcgagtctttctccgacttggtctggccaccactgacatagcccacaaggctccccccaacgtccgagacccacgagacactgcggcgccagccaagctttgggagtcgacgcctgcgggctctctgctgctgcccgccgccatgctcctctgttcttcctcgagcaacgcatcaagccacctctttgacatgtactctttcacagcgtctacaccttccttcacgacctccgctggtggcatggacagagggttctgctccaggttgagcttctccagcttgtcaagccggccaaaactgtcgggaagagcatggatctggttgttgctgaggtcaacctcgcgcaggttcagcaggtcaccgaatgagaaagggagctccttcatgtcgctgaagttgctgctcaggtcgaggatttcaaggctggaaagcttccctatggcagatggccggacgcgtggg

SEQ ID NO: 27760 - DNA, 680 bp, Triticum aestivum
  Clone ID: PAT_TA_27760
agaaccaaatcccaaatcaccaagcaaatcccctcccctcctctcccgcgtcccgacgagcaccagccaccagacatggacgcctcagccaccggagccggagcgaaggcgaagaagggcgcggccgggcgcaaggccggcggccccaggaagaagtcggtgacgcggtccgtcaaggccgggctccagttccccgtcggccgcatcgggcgctacctcaagaacggccgttacgcgaagcgcgtcggcacgggcgcccccgtctacctcgccgccgtccttgagtacctcgccgccgaactgctggagctcgccgggaacgccgccaaggacaacaagaagtcccgcatcgtgcccaggcacctgctgctggccgtgaggaacgaccaggagctcgggaggctgctggccggcgtcaccatcgcgcacggcggcgtgctgcccaacatcaaccccgtgctgctgcccaagaggatggcggagaaggagcccaaggagggcaagtcgcccaagaagaccgccaagtcccccaagaaggccgacaagaaggcttagagagaggcgcgcgtcgattagcttaagctttgctgtaacagtgatcgatgttttctttactaatggcgtcgatgtacatctctgctgccaaggaaaaacaactcagaaatctctctgatttttcc

SEQ ID NO: 27761 - DNA, 686 bp, Triticum aestivum
  Clone ID: PAT_TA_27761
gtgcggcggcttagggttttaactcgcatccattctcaaggtaagcgccgcctcctccacgaacctcgattcagaccgtccttcacctcacacgggctcctgtttgattattccggtttgttcttgtgccatcgcgtccgtctcaggttagcaggaggcgggccatggcgccgtcgcagcccaagtcagggctcttcgtgggcatcaacaagggccacgtcgtcaccaagcgcgagctgccgccacgcccgtccgaccgcaaggggaaaggtaccaagagggtgctgtttgtcaggaacttgattagggaggttgctggatttgctccctatgagaagcgtatcactgagcttcttaaggttggaaaggacaagcgtgcactcaaggtcgccaagaggaagcttggtactcacaagagagcaaagaagaagagggaggagatgtcaagtgtcctcaggaagatgaggtctggtggtggtggtgccgcggacaagaagaaatagattttgcatgttggtgaaattctatttatctcaacgctttgccccgtatttccatattatgccaagtttgtagcctgtggcaattggatacgaatgtagcacattgcacttcaagttcagagtaaaactatgaatttttgacactatatttgcaattggattgacatggtagtaaaaaaaaaa

SEQ ID NO: 27762 - DNA, 535 bp, Triticum aestivum
  Clone ID: PAT_TA_27762
attcaacctagtacgagaggaaccgttgattcacacaattggtcatcgcgcttggttgaaaagccagtggcgcgaagctaccgtgtgccggattatgactgaacgcctctaagtcagaatccaagctagcaaccggcgcctctgctcgccgcccgccccgacccacgttagggcgttcgcgccccaagggcccgtgccattgggctcagcccgcccggcccgacgcgccgcggcgggccgcctcgaagctcccttcccaacgggcggcgtgctgaatcctttgcagacgacttaaatacgtgacggggcattgtaagtggcagagtggccttgctgccacgatccactgagatccagctccatgtcgcacggattcgtccctcccccacaactctccttcaccaactaaggttccaaaatggtagccaaattctgcacctctaagtcatggtcaaaaggaatggcaaagtcccttgtaagacatacgcaagcacccgataaggccagcggaaacaacactcaaaactatacgtcg

SEQ ID NO: 27763 - DNA, 1125 bp, Triticum aestivum
  Clone ID: PAT_TA_27763
gaccattccactttgaccgcccaatagaaagagcagtaaaagctgacggatttcttgagcaggataaaccacacataacatttagttcctcctttaatgaatggatgacctctgcacgtaccccaggatcacttcctccaaatgtagggcatacactgacttgtatgctgggcctcaccataaggacccagaatctcttatatgcccaaggcttggagtaactcccaagtgaaagagatttgtcaggccatttgaaacataggagtgaaccttgtgcctcgcttgttcttgcaagagaagctcattcttgtttctccttgggaatttcccgtgagcttgaagcaacccaccaaacaacggaacaaaaccactcgctgttatcccttctccagcaacgtacgtctacttgcccattagggaactgtagatccataaaggagcaagctactgggttaagacacatcatcgacatcatcagccatcttctctgtttcgaccaaatagctggacagagggaatgcactccattcttgcgatcatagccataccacagcagatgttgctttgacagatgaacaggcaataggagtgtagagtcacgaacaaatagtaaaggccccagctgaacaaggtaaaggggcgaagtatcgtttccagaagttgaaccgctgcgtgatgcctctagcctccacaggtctccacgagcaacaacagaactctcaatatcattgtttctggtgctgtatgtcgctgacatatttacggtacccttggacttcttaaagtttccgagggttccgatttcgcagccatatccgtcatcgtcttcatcaaggtcgtccccgcctctaacaccactgacagtcgacgcggcagcgcttccagtcgccgcggccgcagcggcggcagccgcctcgagagggcatctatcgacggccctctcggaggagaggccgacggcccctccgcagaagggggccgcggctgcagcttgcggcggcggatctgggcgccccggaagggcacgggcagctggcgcacggcgtgctgcacggccccgccgacggacgtgccgttctcgacgccggcctggccgagcctgccgccgagtcgatgacggaggcg

SEQ ID NO: 27764 - DNA, 703 bp, Triticum aestivum
  Clone ID: PAT_TA_27764
gcacgagggagagagagagagagaactacctcatgtgactgatgaaagagggcaggtggccaacctccttgatgtccatgagtatatcccagatagtcttgacagcgtggcggagtttgacgcgcccccgtcgcctgaacacagctacaacatggagttcccaaccgacgaggagcttaccaagcaggatccgcccgctcttccacctcagcttctcatgactgcccttggcggtaccgatcactcggacgagctcgctccgaaggcgaagccgcagcatgtcgtcctcaaccatctgttcatcgagaaagggtggggggcgcagtctctgctcgccctcggactcactcaccggttccagtctaagtacgtgaacttcgtgctgtacaaaccgctggtgaggaggtgaccgatgccgctggtggaagatggaacaagtaacggtggctgattaggactgatgggagtgaataagagagcgtagtttgacaatgtacataaggggggttccggaaccatctgtttctcttttcttctttctgtgtttcttgagtgaactgttcttgtggcgtggggtttgaaccgtctgaactccggcgaaatgaagcaagagggagtgttgtgaaaatgtatggtcttgttttgtgatctgtcatgtcagatattaatccagtcgtcatgtttgtgctggataaaaaaaaaa

SEQ ID NO: 27765 - DNA, 1075 bp, Triticum aestivum
  Clone ID: PAT_TA_27765
atctaacatagatacaatgattgttcaagagcaaatttcagagaaaatataaaacatgaaatgttaagttgtactattgagaccataccaccatatctttatttagtttctttggaaacctaaaggtctaagaggatggtacatgtaagaagccgtgaatccacaaaaaaaaactaaactaacttccagataaacatttcaagtttggaagccacaaagaagcagcccagatctctcgttgtagtgcatgtacatgtccttaatcgtctctgagaaggacttcttggcattcttgtgcagggacacagcaatcctcgttgcgagctgcagaagaaccacacaggcaccttccttcaccttgcccttgaggaggggggcaacacttgcagcgccgcgacaaggcttgctccgagtgtaatcatcagcattcttagatacctgatacctgctgaagtttgctttggtctccttctcaagggccaatccagaaacataatcagcaagcctatgtgcctccatgccaggctttccacctataattgagaagcaccatttcaaacaccattgttaccatttcccctaaagaaatcccaattccttcatcaacgataaaaggagtcatcatatacacttgctagtctgctaggtagtacatttgaagtctggtaacaatttagtaaactgcaagcagatctcagctggaaaaaaaatgaagtgattagaaaatcatccagcaacgtacaaaacgaacgaccggttgactgagtgccagcatcaaaaaacacagtacggtaaaaatatcaaacggcctgaagcagcagcgcacggaagtgccctcgctgggcaggtagcccagcagggtttatatgttcgattagtctgatcagattgcacattcttcacatcttcagtagctgcagcagcagcatcttgcttagtttcatttgttttggatgcagggtcaacaacatctccagcaaaagcagtttctgcagtttgggtaggatccttaggcacagccgcagatgatgtagttcccttggtttggaaggcgaaggaacccggaccggccggc

SEQ ID NO: 27766 - DNA, 804 bp, Triticum aestivum
  Clone ID: PAT_TA_27766
ccatcgattgatggcaagacactaatccgttgattgcatataatatatatgtatatgtatagccggtgctataattctcatatgcatcctcctcgacctacattggtaggtgcttacatacatatgctcatatattcacatatatatgagtagaacgagaagtaaaactgagaaagcagagccgccgacaaatgtgactaacatgacatgtatatcggttacttcaacttgcactttaggccttgccggattcctcgcaacctggtggcctgaaggcaatgaagctgacgcattgcacctggcgcatgttgtcgaagccgatgacgcggacataggcatcagggtactccttcttaacctcctcgacctcgttgagcacctgtgtggcatcggtgcagccgaacataggcagcttccacattgtccagtatcgaccgtcgtagtacccgggggagctgttgtgctcacggaagacgaagccaaccttgctgaactcgaggcagggtacccacttggagcggatcaagtagtcgacctgctttaggagggcctccgtagagaggggtggcaagtaagacagggtctcgaacttcttgatgccctcaattggccacacctgcatgcatcttatccttccgccattgctgacgctgctgaggctggcgctgccggagcggcggctgacggggaggcccgcggtcgacttgagcccctggaagggcgcgacggtggtggcggaggaagccatcacggcgggagccatggcggagtacgtgaattgctaggtggggaggcgatagctag

SEQ ID NO: 27767 - DNA, 712 bp, Triticum aestivum
  Clone ID: PAT_TA_27767
cgtccggtcgcccattactgctccgtcgtcgttcacagcgacgccaacgctgcacccagaccccgcgagatccagagcctagcactagcacaggtcggggaaggaagaaggtccaggacccgcgaggcagggaggggatggcgggcagcggaggcggcgcgtacagggcggaggacgactacgactacctcttcaaggcggtgatcatcggcgactccggcgtcggcaagtccaacctgctctcgcgcttcaccaagaacgagttctgcctcgaatccaagtccaccatcggggtcgagttcgccacccgcagcctccaggtcgacggcaaggtcgtcaaggcccagatttgggacaccgccggccaggagagataccgtgctatcacaagtgcctattatagaggagcagtaggcgcgttgcttgtgtatgatgtcactcgccgtgctacattcgacaatgtggcacgctggctaaaagagctgagagatcacactgatgctagcattgttgtcatgttagttggcaacaaatctgatcttcgtcaccttgtggctgtttcaactgaagatgggcaggaatatgctgaggcggagtcactgtacttcatggaaacatctgcattagacgcgacaaatgtagacaacgctttctcagaagttttgactcagatataccgaattgcgagcaggaagacggttgatgcaggaaa

SEQ ID NO: 27768 - DNA, 804 bp, Triticum aestivum
  Clone ID: PAT_TA_27768
ttttttttttagactttggaaagatcttctttggatagaaccagttcacctgtgtaaaaatttccccgtgttgtccgatatttctcataagcaagatcacactattttacagtttaattcgacaattgttcgccacattcccgattcagacgacggattttcaggagggaatacaacggggactccccgatttagaggactccaaagaaagggttggtgatggcggaattgagctcggctccagcgacattcaggacggccttgtcaaccttgtcccttgccagaaacaagatctcctcgccttccggtttctcaaacccgcacagcacgaggaactctatgcccccaaggctcccaactctctcctggaatgtagcattggtaagtctgatcttcctgaatttctcctcgtcgggatttttaaccacgtttccgatgtaggtgaggagcgtctgaaaagccctctttactttagcgtcctcctccttgttctgctgcttgatatttcgtaagcaatccctcatccgctctgcctttgtggctggtctgacaggtaaaaatgcactcttcttctcttcaacaggcggtggtgcacttggcttggatgcagctggggcttctgccggcaatccaagttttcttctacgttcagccttgtcctcttcaagtttttggcgaatcttttctctggctctcttctcctcctctttctcaagccttctcaattctataatgcgtttcctttcatttaactcctccattttttggcttcaagaagctccttaccaatccttatgcgctccc

SEQ ID NO: 27769 - DNA, 1059 bp, Triticum aestivum
  unsure (1)..(1059): unsure at all n locations
  Clone ID: PAT_TA_27769
ccacgcgtccgcaagcagccaaagcagagcaagaagccgcagccagccagccagtctcctcctcctcgggcgggagggaagagagagggagacagcgaccgggcgagaggcggcggaggctccgaggaggcggccggcagcgttggcccgggaaagggacggggccggaggaggctggctgatcggttggagggaagggaaggccgggagggaggggatggcggcgcgggagcagggcggcgacgagtacgactacctgttcaaggtggtgctgatcggcgactccggcgtgggcaagtccaacctcctctcccgcttcaccaagaacaccttctccctcgactccaagtccaccatcggcgtcgagttcgccacccgcaccacacaggtggaagggaagacgataaaggcgcagatatgggacacggcggggcaggagcggtaccgggcgatcacgagcgcctactaccggggcgccgtgggggcgctgctggtctacgacgtcaccaaggccgccaccttcgacaacgtgaagcggtggctcaaggagctgcgcgaccacgccgactccaacatcgtcatcatgctcatcggcaacaagaccgacctccgccacctccgctccgtcgccaccgacaaggccgcgggcttcgccgagtgggaaggcctctccttcatcgagacctccgcgctcgacgccaccaacgtcgacaaggccttccagaccgtcctcgccgagatctaccgggtggtcggcaagaaggcgctgtcgtccacggatgattccggtgccggcgccgtcggagaggggcagtccatcctcgtgtccggcggagaacccaccagcgtttcctcgagatgctgctctttctagccgatgcatgtcaccatgtcagccatttcggttgattgcttaattaatatgtgaccatgtcctgcgaccaaaataaattcagaaggttatttattttttaggccagtactaggcgccggtgcgccggcccanntttggcaccggtcgtatcctgtacgtcnattaaaactgcttttaaccgtcag

SEQ ID NO: 27770 - DNA, 934 bp, Triticum aestivum
  Clone ID: PAT_TA_27770
gacaatgtcagcgacgagtccgtcgtcaaaatcgtcgacaccttcccaggacaatccatcggtatgttcctcacaactgcactgcagagataatattcatcagggcaatcaagttgtatagtagtattaacaaaggatcgtcgatcctacacagactttttcggtgctctgcgtgctcgggtgtacgacgacgaggtgcgcaagtgggtgacctctaccggtatcgagaacattggcaagaggctggtgaactcgcgggacggacccgtgacctttgagcagccaaagatgacagtggagaagctgctagagtacgggcacatgtttgtccaggagcaggacaatgtcaagcgtgtgcagcttgctgacacctacatgagccaggcagctctgggtgatgctaaccaggatgcgatgaagactggttccttctacggttagaacattctccatacacacccaccatctcttgctgcataggaggaggtgaactacgcacaatccttttatactttcagcacctactttacatacatacttacttctcacttgcttacttctctgaaacaaaagagtgaatcataaacaaacagtggaggcctatttcttcttacctgttcttatagcatagcaagctcatcttctcatcagatcgtccaaaacaattgaattgcaggtaaaggggcacagcaaggtactttgcctgtaccggcaggatgcaccgaccagactgccaagaacttcgacccaacggcgaggagtgacgacgggagctgcctttacaccttttaagcatgccaatttaatatctgatgttttatcctttgtacctaagtaccgcatcgcatccaagcgattgctgggcatgttttgttaatataaaaagatattgagtatacctatttggtaaagacaaatagaactacctatcatt

SEQ ID NO: 27771 - DNA, 866 bp, Triticum aestivum
  Clone ID: PAT_TA_27771
attcggcacgaggcttcccccctcccatcgtctccacccgaccgccactccccactctgccgcgaccctctcgacgcggcggccgccgccgggatgaccgccttctagcacaccacaaccgatctcccgcggagtcccccgcccgcccctgcgccgcgccgacagagatccgggacctcgttggactgcagatgcacaaaacatagtgtaccagctcttcctcactcaacatgtggagttttgcatcaaatgccatagctggaagcataaagaaaaaggtacaaccatcaaaaggcagcttatccaatcatgattgctctgatgacgatggttcttcatgtgcaagtcgagaggaaggccttgaatgcccaatttgctgtgaatccttcaacatcgtagagaacgttccttatgtcttgtggtgtggtcacacaatgtgcaagaactgcatcttaggtcttcagtgggctgttgtcaagttcccaacccttcctatccagctgcctctctttgtctcgtgtccttggtgcaacctattatctttccggctggtgtacaagggcaacctcaagttcccacgtaagaactactttctgctgtggatggttgagagcatgaatggtgacagagcaaagttccattcctctggtcatgaagagcgccaatcagtatgtccgtccagtggtggcaccagttccagtcaacaccaccgaagaaccccaaggatgagaagaaggccaagaaggcagaggtgaccaagtcccagaagtcacaggggggcaagggcgccgtgcagaagggttccaagggcccaaagattggcggtggcggtgggaagcgttgaaagtcgatgtcgacgcggccgc

SEQ ID NO: 27772 - DNA, 661 bp, Triticum aestivum
  Clone ID: PAT_TA_27772
ctcccattttctctctccctcccccacaaacgcgtgcgtctcctccctctccccggcggcggcggcggcagacgaacaccgatcagtcgcgagcagcaatgtcgggcaagtacatcatcggttcgctggttggatcccttggcattgcatatgtctgcgacgccaccgtttccgacaagaagatctttggaggcaccgtctgcaagacagcgacagacaaggagtggtttcaggccacggacgccaagttccaggcctggccccgtgtcgccgggccgccggtcatcatgaaccccatcagccgccagaacttcatcgtcaagaacccctgaatgggcggcggcgcgagctcgaccagagttttgctcccaccatgcagtcaaagtttcctttctagggttttgaactagttcctaataaaagggactttaaagtccgggtatactattttgttttacgaatttcagtttccgtgagcaactttggggggctttaccgctcgctcactcgcctttcgatgaactatgttcctcggtgaaatttcccacgaggcagtaaaataactgcattgtagtttctgcattgtatttcatgtgctgagtttcttcctgatgatgctgcacgtttatgctgtgatgatacccagcctactgtttttgtc

SEQ ID NO: 27773 - DNA, 719 bp, Triticum aestivum
  Clone ID: PAT_TA_27773
aactttgttgagtatctgaaacggaaaaatttcactgtttgcgctgtgtaccttttggattcgcagtttgtcagtgatgtcacgaaatacattagcggttgcatggcttctctttctgctatgattcaacttgagcttcctcatatcaacatcctttcaaagatggacctggtttccaataaaaaagatgtagaagattatctgaaccccgaggcacaggttcttctgtcacagctgaatcggcagatggcacctcggtttcacaagttaaacaaggctttagctgaactggttgatgattacaacatggtgaatttcataccacttgatttgaggaaggagagcagcattcagtatgtgctgtcaaacatcgacaactgcatccagtacggggaagacgccgatgtgaaggttagggacttcattcccgaggaggatggttaaccattttgatcgagcagaagcaacaaattagtcagtatcatgtagaatgggtccatgggaggaggaattcaccgcagaagcgctatttatctgtttcaattgttagtcgaaaaaacaaggcagaatgcatctgtgaagagtgtgtgggtcaccttatgcgtgtggttgactagcaagtgcttgtgtaaacaaatcatcctcctcttccagagttcttgaatcgcatcagacatgagcgtaatacgtaccaacaaaaaaaaagaaaaagaattcga

SEQ ID NO: 27774 - DNA, 779 bp, Triticum aestivum
  Clone ID: PAT_TA_27774
ttagctggtagctgcacatgatcaaatgaaataataaataatgaccagaattgtaatggatggaacccattcttttgtgatattaacttgcacaacataataaaaacattgatgtaacaaatccacatccactcagtaaaagtacccaaagtactctctgctgccagtacaagttggtttacctttgatacttcagtttgtaaatcattttgctacgaaaggatatgaaagctcttaacgaaattacctggttgatgagaaaatgcccagatgcttggagatcccactcggaaagtaggtgtaagaatgacccaggggtcttccagagccgccaaaattagccacgccttttacagccttgttcctcatatcaagagcaatcacacaggccttatccccacggggatcaggcatgtgcataaggtaaacaacatcaccgtcatgcaagctaagagcaggatagcctacacgaattttcttcaggcttggcttggcatcatctccctcctgcggattaggtagcatttgggcatacacagggctatccaagggtacatcatctgagcatctgatagtacagtcctcctcccagttgctactaccagaagtagagccaatgcttgaaatttttattttttttgttgcagccatccaaccttcacatatcagggagcttccagtgtctgagcccggtctgacgttactgtgcatctcaaaatacttgatgtaaccttggagaacagtgatgttccgaacatacaacatataacccctgactg

SEQ ID NO: 27775 - DNA, 947 bp, Triticum aestivum
  unsure (1)..(947): unsure at all n locations
  Clone ID: PAT_TA_27775
ttttttttttgacagaacactcctcgctaatataagtataaaacttgcttaacacagaatgttgatcagtttgccagtgcacacattcgatttgtttctaaaagactgatgttctaccatccaaacacacgaaaaaggaacaaattgtaacgctggtctggttacaaactctaactcaacagctttttgcaccgagaaaccaaagccactctaaaattgctcaaacgatgagatatttaggcaaatagtttcggttgggtgtgtgatatacacataccacagctcccagagaatcacaagcaaagcagggtaaaagtatcgcatatatccgtttgccaggattcagaaaatctcgccgagttataccatagagagcagcagtaccaagggcatgcaccatgaagcaccaaaacgctatacctctggctgctgacttgtaacatcttcttggttagaggcgtcatcaggaatactgacagatgggctttgtttctgacttgtaacaccttcttggttagaggcatcattaggaatactgacagatgggctttgtttcctttctgcctgtagcgaccggcacagggactcgagtttgtccttttgattcttatatttgtctagttgcttcttcatcacctcacgctcctcaatgagcttcacaagagcaatatctgaattctcacacttgttcacctcggccgcgaccacgtcgagcggccgcccgggcaggtactggtctattgaccatatcgattccaccgctccttcggcataattcacgaagaagttcaatgctgctggagcaagaacagtgtaggagaataaaatgccaaggtagaacagaactgaagaacccaaaacaatgggccctaggaatttccgctcatccnnngttaaaccagggagaacaaatgctannatctcgtacctcggccgcgaccacgcta

SEQ ID NO: 27776 - DNA, 692 bp, Triticum aestivum
  unsure (1)..(692): unsure at all n locations
  Clone ID: PAT_TA_27776
gccgtcactcctctcaacccgaccacgccgcgcctccgcttcgaaccctagccgagcggggtaaggagggaaatggggaagggtacgggcagcttcggcaagcgccggaacaaaacgcacacgctgtgcatccgctgcggccgccgcagcttccacctccagaagagtacctgctcctcctgcggctaccccgcggcccgcatccgccaagtataattggagtgtgaaggccatcaggcgcaagaccactgggtacgggaaggatgaggtacatgcgacacgtgcctcgccgtttcaagagcaacttcagagaagggactgaggctgccccaaagaagagtgctgctgctgccaactaagtgtggatgttgccatcaagaactcaagaactagacttgggtctttttgattgaattgtacttctgaacattcccgtatacatacatacggttacgttctgaatgaacaaaccatctctnggaggtgattaatataccagttttcaaaaaaaggggccgtacaatcccaatgatcttagcccnatgcgtctttnactctacggaaacctggtacactancctgaaaacccttcacgtanacaaagncccgttcctcaatncactatgaagancccgtcgatancgggtttngaccantcganttagcnaccccttttttccnttcatggtcca

SEQ ID NO: 27777 - DNA, 761 bp, Triticum aestivum
  unsure (1)..(761): unsure at all n locations
  Clone ID: PAT_TA_27777
ctcagcccagttgattttgaggaattcagcttgccatatcttaagcaaatcgtggattctgttaaggaaacacatcctgacttacctctgatattatatgcaagcggatctggtggattgctggaaaggcttccgttgacaggtgttgatgttgttagtttggactggacagttgatatggccgagggtaggaaacgattgggatccaacatagcagttcaagggaacgtggaccctggtgttctttttggatccaaagagttcataaccaagcggatttacgacaccgtgcagaaggctggtagtgaaggacatgtgttgaaccttggtcatggcattaaggtggggactcccgaggaaaatgttgcccatttctttgaggtcgcaaaagggatcagatactgaaagaccttggttgttgaatttgttcctttctcccagccggcagaagttgtagattccactacttgagcatagatgcaggaagccacatgtctagcatagggtacctgaagaacacatctttttgtgattgcttatgtgttctgcatttctgtttccatttcattgtaatactgtaagcacatactaattgngggtgtaagaaaagtgtctaatttgtttatatcatgtatactacttgaatcttatccacctagtcgaaagtatcgatttatatttgtatgaaaaaaatactctacttaaagtatgtataagctgtaagttggctttatttttctgataaaaaaaaaaaaaaaaaa

SEQ ID NO: 27778 - DNA, 1264 bp, Triticum aestivum
  Clone ID: PAT_TA_27778
aaaaatttcgtgtctcgcccgctcttttctgtgcgctggaagcgtctgttagtactgttgcattgttctttgctcccgaccttttcctcacctgttgttgttgattctgaccgtcggtgccgatggcactaaaatcgtttaatggcgactgatctttcagatgctggactacaacgtgcctggagggaagctgaaccgggggctgtctgtgatcgacagctacatgctgctgcgggagggcaccgaggtggacgaagaggacttctacctcgcctgcgtcctcggatggtgcatcgaatggctccaggcgtctgcgctggtgatggatgacatcacggacaacgcctacacgaggcgggacaacctctgctggtacaagctgcccaccgttggcctgtctgcgataaacgatggcgtgctgctgaaatgtcacgtccaggccatcatcaagcgctacttcaaggagaagttctacttcatggaactcatggagctctggaacgagattgggttgcaaactgccatggggcagatgctggacctcatcaccacacacactggcgccaaggatctcgccagatacaggatccaagggtaccgccgcattgtcaagtacaagacatcctattattccttctacctgccggttgcctgtgcattgctcttgaatggcgcgaaattgagcgactacgtcgagctcaaaaatgtactgattgagatgggagtctactttcagatacaggatgactacctggattgcttcggcgaccctcaagttattggcaaggttggaacagacatagaagactacaagtgctcctggctaattgtccaggctatggaactggctaatgagaatgagatgaaaatactatatgaaaactatggcaagtcttgcccggaatgtgttgcggcagtgaaaaatgtctataaggagcttgatcttcaagacatattcttggagtacgagtcaagagtttacaagcacctagtttcaaccattgacgccgaaccggaccgtgcgattcgggagattttgaagatctttctgaagaagatttataggagaaagaagtagatgaccctctctcgtgttttcataaccgtgattactacgggagaaaccttaaatacattacacggctggggttgtcatgcgctcctttgtacaacatgtatgatatgaactggagaagacactgccttgagataaaggccagaaataaataagaattacaatctcctgaaaaaaaaaaaaaaaaaa

SEQ ID NO: 27779 - DNA, 763 bp, Triticum aestivum
  unsure (1)..(763): unsure at all n locations
  Clone ID: PAT_TA_27779
attaacgagtaaccggtaactgcatcaataatcttcttcacgaagcactctgaacttcactaaaccattcactcttaacttgaaatttggggaactctcgagacaaaaccctagtacacacagatggaacaatatagatgatgtgacatcaaaatttcatggtgaaaaggtttcggattctgccatgacttgctcaagcaccggtgaatgccttcttcaccgcaccactctttgaccctgccgggacgaccttcaacacattgaaccgcactgtcttggacagcggcctgcactggccaatgatcacgtgatctccttctctcacacggaagcaaggggaaatgtgggcagggatgttggagtgcctcttctcatacctctggtattttttgacatagtgaaggtagttcctacgaacaatgatagtcctgttcattttagcactatgacatgttccagcaatgatgcgacctctaattgacacagtgccagtgaatgggcacttcttatcaatgtaggttccctcaatggcttccttgggagtcttgaaaccaaggccaacactcttccagaacctgttaccctccttgccaggcttattgttcccctttgtggtcttctttgagcagaggaacaccttgggctgcttcaggaaagccttctcagtctgctccgccatggctgatgctcgaaggcgatggggccgacggcggcacgtgctaggcggcgagagacgagaggacctcgtgccgaattncctgca

SEQ ID NO: 27780 - DNA, 691 bp, Triticum aestivum
  Clone ID: PAT_TA_27780
caaatgatccattccattaccatatagtattttataatttaaggaaactgagtacaagcatccagcaaatcttacgaataccaagtacatgccgcccctatcgctagcccaaaagcttacgctcgaatctggtgggcatgtcaagatcgaaggatgattcaaccttgcgaagcaagaaaatagcaaaacatcacatccatccagcagttttgaagatcgagacacagagcgacaacataggaaagattcaaatactacaatactgcaaagctagttcatattagagcaagagacgatattgcttcctagtagcgccatcttcattcttcttcctgaatctcagccaaggtcctcagagtcatgcgcacttcacgaagggttacatttttatgaccatcgactggactgtcccggagaatcttgaagacattcagagccgtagcatcagcatccttgacacgaagtttggggaatttcctggcagccttgagatgctcaggatcaatgtcggggaattccttggcagccttgagctcgtaaatgcccgctgatctcccgagcgcacggtcgcaaaatctcctcaccgctagccggagcgccgccatcgtcctcgccctcgctctcgccgactcgatccgcttcctcttcctcttcctcgctggtggggagaaaaaaaatcctcgtgccgaat

SEQ ID NO: 27781 - DNA, 549 bp, Triticum aestivum
  Clone ID: PAT_TA_27781
cccattcgctcgtctcctccaaccctaagcgatgacgaagggtaccggcagtttcggcaagcgccggaacaagacccacacgctctgcatccgctgcggccgccgcagcttccacctccagaagagcacctgctcctcctgcggctaccccgccgcccgcatccgcaagtacaactggagtgtgaaggccatcaggcgcaagaccactggcactggaaggatgaggtacatgcgccacctgcctcgcaggttcaagagcaacttcagagaaggtaccgaggctgcccccaggaacagggcctcggccaactaggtctggattttgccccatcaggaatcccgtgaagctagaatttaaacactttttgcttggattgtactccgcctaaactattgttgctatagaattgagtatggatctgatatgttttgttgcatgggtttggaagttgacgactgaatctaagaccaaatttgttacaattgtttgtgggttaagggcatatgctttccaaaaaaaaaataaaaaaaaaaaaaatacggccgctc

SEQ ID NO: 27782 - DNA, 960 bp, Triticum aestivum
  Clone ID: PAT_TA_27782
ttttgtgagaatatttagacactcaagtcgaaaatgaatgtggccaacactcccgcatcctctgctcggaagacaccttttctcaccagatctaacatagatacatgattcttcaagagaaaattcagagaaaattaaagcatagaaggctttaagttgtactattgagaccataccaccatatcttcttttagtttctttggtaatttaaaggtctaaaaggacggtacatgtgagaagctgtgagtccacaacaaaaaactaaactaacttccaaaaaaacatttcaagtttggaagccacaaagaagcaacccagatctctcgttgtagtgcaggctcaagaaaatgggtcgaatgaccatcatagcaacatgtagaagcagaaaaaatataggcttggtgtgtaactgatcatgaaagatagcttgatcagtttctccaatgttggcttatgctgagcaagaagatcaatctaggcctagcagaggtttgtggactacctctttatgccacaccatatccacatccctagcacttgacgtacttgctgctattgtcgtctctaccttatttcctccattgccggttcgtggactacctcttcaggacacgccgaatacatatcctctccttcaccagctggtagtctcgccctgtggtcgcttgaattgcccaaaggtgaatgccactcaagatacaagagctctgaatcaaccgatcattgcataatccagttcatctaatactgcatggttgacctgcttcctttctagcagaaatccaatctcggtccctttttttctcatcgttgattaccacctttgccattaggaacaccttgttcttcaccaagctcttcctcaagattcacccacttctcttttttttctcagatctagactggggacatgtgacgacggccggcaccgcctggaactctgacctcgctgctccttcc

SEQ ID NO: 27783 - DNA, 1280 bp, Triticum aestivum
  Clone ID: PAT_TA_27783
ccagtagcacgaatgtgggaacagagacgccaatccttccagcagatttgctgatgacagcacattccttcagagtatcatagattccctcgatgctatcatctttcatgcagataaggaaacagctgctcaactgaggtctcggggtgccagcattgaaaagggttggcgaagcatgagtaaaccagcgctgggacatgagatggtaagttctgatggcagagtcaatgtcatccttgtggatccctactgaaactctcattaacatgtgctgcggcctttcaacaacaactccaccgagcttcaggaggtaagacctctccagagtcttgaacccgaagtagtcataatcaaagtccctgtcgtaaattatctcgctgtccaagcgagcagcgttcttcatgatgacttcgtagatatcctcggcaatcagcggagacagcagcccagatctctcgttgtagtgcaggtacatgtccttaatcgtctccgagaaggacttcttggcattcttgtgcaggttggacacagcaatcctcgctgcgagctgcagaagaaccacacaggcaccttccttcaccttgcccttggggagggaggggggcaacacttgcagcgccgtgacaaggcttgctccgagtgtaatcatcagcattcttagatacctacaataatttccttccatatatgggttttccctagtactgatcaaaccatctttaaatagcagtgttgaacgccaatttttgttcaacacgccaagaggaacccaacaaatacaccagtatcatgtatccctcggcttcctctgcaaacacctgctaaagaagagtagagaggtaccaggtagcttactttttgcaagagacacacaagcaagtgtgaagctgcacaagaagataccttcgagaagccgtcaatggagctagtctaagcgagccaaagaagtgcgtgaccttccagcggccatcatacgggtcggggtcctcctcacggcagcgaatcctcgtggcgccgttatcgcctgctaggcctggggtgcaaaaaagttagggcggtggaaaagaagggcgatgctgcagcagacgatgagactgggtctaaatattaattccagtaggccttcataaacctctccccaccaaacttccttccgtgtgtatattcataatgagaagctacaactactacttactgcacacatttcccccaaagcactaacccgaacatgtactgcggtgcacccaaaacaggggacacacatgtttccctcgtgccga

SEQ ID NO: 27784 - DNA, 1461 bp, Triticum aestivum
  Clone ID: PAT_TA_27784
agactgtagcgattggagaccatgtgctgagcgaaggtgagtggctatcgctgaatggatcaactggtgaagtgatccttggaaagcagccgctttccccaccagccctcagtggtgatttgggaactttcatgtcctgggtggatgatgttagaaagctcaaggttctggctaatgcggatacccctgaggatgcattggctgcacggaacaatggggcacaaggaattggactatgccggacagagcacatgttctttgcttcagatgagaggattaaggctgtaaggcagatgattatggctcccacagttgaactgaggcagcaggcactagatcgtcttttgccttaccagaggtctgactttgagggcattttccgtgctatggatggactttcggtgactattagacttctggaccctcctctccacgagttccttccagaagggaatgttgaggaaattgtgcgtgaattatgtgctgaaacgggagccaatgaggaagaagcccttgaacgagttgaaaagcttgcagaagtaaatcccatgcttggtttccgtgggtgcaggcttggtatctcgtaccctgaattaacagaaatgcaagcccgtgccatctttgaagctgctatagcaatgtccaaccagggtgttgaagttttcccagagatcatggttcctcttgttggaacaccacaggaattgggacatcaagtgaatgttatcaaacaaactgctgagaaagttttcgccaatgcgggtaaaactattggctacaaaattggaactatgattgaaattcccagggcagctctagtggctgatcagatagcagagcaggctgagttcttctcttttggaacgaacgacctcacacagatgacttttggctacagcagggatgatgtgggaaagtttattcccatttacctggctcagggtatcctccaacatgacccctttgaggttctcgaccagagaggagtgggcgaactggttaagtttgctacagagaggggccgccaaactaggcctaacttgaaggtgggcatttgtggagaacatggtggagagccttcatcagttgctttcttcgccaaggttgggctggattacgtttcttgctcccctttcagggttcccattgctaggctagctgcagctcaggtgcttgtctgagggtgctgagggtgcctcctcattcgcaaccggatgatcgcctgctgttggcgcatctggtgattaataatattgttacagagccatgatctgtgaagataattagtagcagggctcataaaagctacaattccatccctttttgcagttatgtaaaactttcaaactgtttatgctcaaaaactctgttcttcaatggatcatcaattatcgattatatatgtgtcaaaaaaaaaaaaaaaaaaactcgagactagttctctctctctccctcgtgccg

SEQ ID NO: 27785 - DNA, 1013 bp, Triticum aestivum
  Clone ID: PAT_TA_27785
gagccccgtttaggcatgtacctcttaagattttcaacacgatgctcgacagtctcggccagtccacggcagggcctccctcagcatctctgcacgctttgtttcatcttgtgaaagacaacattttcctataaggttctagaatccatagcaatacggataaatcatgactataaaatcttgccgaaattgctgagagcatcgcgtaatgcatcctctgtaaggtaccaaacatcatggatatcttttcttaatcttatgttccttcatgatgactttgtagatatcctcggcaatcagcggggacagcagcccagatctctcgttgtagtgcaggtacatgtccttaatcctgcatccacaacccataatttttcaacacctaaatattaaatccagccgaaggaaatcatggcagaaatatgcgccgtggcttacgtctccaaggatttcttggcattcttgtccaggttggacacaacaatcctcgctgcgagctgcagaagaaccacacaggcaccttccttcaccttgcctttgatacttggccctactttcatatttgatgcacaccgtctaatgctaacaacaccaaatcttgtgtaatccagaagtatattatatcttctctagaatcataggttcagatacgtaaggcataatggactcatgagatttatgtagaaaaaatccatgtactgctgcaaaggaggagctcgtaatgtcgtgtctaacaaataattcaccatatcacaatctacctaatactccacagccagttccaccaaataccatgattaaatgttagctaaagagaatgattctccttatacaaatgttagctttttctatataatactatcataaagagaattgtttttatgaatgatactcttcatgaatggtttttatgaagtgatatcattctctttaggtaaccttgattcaatgttagctaaagaggatcattcgtataatactatcgataccatggaatagttttttaccggacg

SEQ ID NO: 27786 - DNA, 913 bp, Triticum aestivum
  Clone ID: PAT_TA_27786
tagcgtggtcgcggccgaggtaccgtgccctcacggtcccagagctcacacagcaaatgtgggatgccaagaacatgatgtgcgccgccgatcctcgtcatggccgttacctcacagcctctgccatgttccgtgggaagatgagcacaaaggaagttgatgagcagatgctgaacgtccagaacaagaactcgtcatactttgttgagtggatacccaacaatgtgaagtcaagcgtgtgtgacatccctcccacaggcctgtcaatgtcgtccacctttgttggcaactccacctccatccaggagatgttccgccgtgtgagcgagcagttcactgccatgttcaggaggaaggctttcttgcactggtactcttgcacggcagaattatcttcttacatgtttggtcacaatatagctttcctgaaatctattttgctttcagtttgaatttgtcatgacctggatagatatactctagaccttgatatatgactacgtaattgaagaagtggacatcttggtcattgcaaattttctctgttcatttttaaaagagcggattacaattctccaggagcaacgctgctgtggtagctatccatccatcttgctttttagaaaacttgcgaccacaaaggccgaagtcgccaccctgtaatgtcgcgctgatggtagcccatactgctttgcgatgaataatatcataacagctaatgtttgaattttccatattgcttcagctaacctgtgaataggtctgcactctgcgcatacatatttgttcaattccttatttctataaggtttatgtaattatgtttatgttagaaggtttagatgccatactttgcatggactgttactaagagaaatttatgttgttcttaggtacctgcccgggcggccgc

SEQ ID NO: 27787 - DNA, 779 bp, Triticum aestivum
  Clone ID: PAT_TA_27787
cttcctccaccgccgccaacgtcgcctggcggccgtctgcagctccgcgcctctgctcggaagttggtgaaggtttcttgaagctgagaagatggtgctgaagacagaactctgccgcttcagcggccagaagatttatcctgggaaaggcatccgatttatccgtgctgattctcaggttttcctttttgccaactccgaaatgcaagcgctacttccacaaccgcctgaagcctgcaaagcttacctggacagcaatgtacaggaagcagcacaagaaggatatccatgctgaggctgtcaagaagaggcgcccgcgccaccaagaagccatactcgaggtccattgtgggtgcttcccttgggaagtgatccagaagaagagagctgagaagcccgaggtccgcgatgctgctagagaagctgctcttcgtgagatcaaggagcgcatcaagaagaccaaggatgagaagaaggcgaaaaaggcggaggtgaccaagtcccagaagtcgcagtcgaagggcgcggttcagaagggttccaagggccccaagctgggcggcggcggcggcaagcgctgaaagaactgaagatgtcatttgctgctgaccttgcaatcgctcctcattagcctacctaccttgtttctccagagccagttttgtagtacctgtacctgggttaaatttgcagttcctttcaccgttgctttgtgggtgttaaataccgtgacgagaaaatggatttatctttgtgttgcaaaaaaaaaaaaaaaaaaa

SEQ ID NO: 27788 - DNA, 953 bp, Triticum aestivum
  Clone ID: PAT_TA_27788
actcccttgtctcttctcactccagtaacagagagagcagagctcttgcttaccggagaagagatcccagaggggaggaggaagcagaggtgattgagaaatggcgggcggcggcggtcgtggtcgcggggaggaggagtacgactacctgttcaaggtggtgctgatcggcgactccggggtggggaaatccaacctgctctcccgcttcacccgcaacgagttctgcctcgagtccaagtccaccatcggcgtcgagttcgccacccgcaccctccacgtggagggcaagataatcaaggcgcagatctgggacacggcggggcaggagcggtaccgggccatcacgagcgcctactaccggggcgcgctcggggcggtgctcgtctacgacgtcaccaagcccaccaccttcgagaacatcgcccggtggctcaaggagctgcgcgaccacgccgacgcaaacatccggatcatgctcgtcggcaacaagaccgacctcaaggacctccgggccgtccccaccgatgacgcggggggatacgccgaggccgaggggctgtcctacatcgagacttccgcgctcgaggccatgaacgtcgaaggagggccttccagctcatcctcggcgacatctaccgcaccgttagcaagaaggccgtggcctccgaggaggacagggcaggggctgctggggtcaaggaaggtaagaccatcaatgtcgctgccaccgccgacaatggcggcgaaaagaagcaatgctgctcagcttaggaaggatgatgcccaccgaatgtatgttatgtgctggttgttttttgagttttacaagccttgttgattcattttgtcagatatcctcctaccttgctagacctgaaactcacatatattcagttactatatgatatatcaagtcattggtttacatgtcaacaaaaaaaaaaaaaaaa

SEQ ID NO: 27789 - DNA, 660 bp, Triticum aestivum
  Clone ID: PAT_TA_27789
ttttttttttttttttttttaatctctactcaacacacaaccgatagggtaccaattactgatattctgaacattgtctaagtgtcatcacaaataaagaaaaacaaattattaccttggatatttgaagttttatataattttaaagtttcaacttgcaccatttagtttctagtttagactaggtccttagtaacaggaggtaaacatgactgaacaagatttaaatctctacataacatcatcagggtcgaagtttgatacagggtacagatatgatattgcctcccaatcacatggataataaatctctgataatgatagtcttgtttttagctcgatattaagccatcccaccactagtagctgtcctgataatctgaaacaaggatgatcctatgaccacaaagatgaagaatccaagcacgataggtccaacaggatagtcattccccttcttcacagtagtttcaggcactgagcccctctttgtgatgttcttctgaaacttcgcactcttcctgtcagcaagacgccttgaagtagtcatccttgcttggcggggcaggggagctcgccggagacgatgtaggcagccgcggggtcgcagcagatgccggaggagaagtgggagatgccggatgccccaacccggccggc

SEQ ID NO: 27790 - DNA, 876 bp, Triticum aestivum
  Clone ID: PAT_TA_27790
gacgaccgccccaggaagcgctgccgcggcctccccacccgcctccgccaggaaggaagggggccgtcgtcgggtcgggtcgggtcggccatggcctacagggcggaggacgactacgactacctcttcaaggtcgtgctcatcggcgactccggggtcggcaagtccaacctcctctcccgcttcacccgcaacgagttcagcctcgagtccaagtccaccatcggcgtcgagttcgccaccaggagcatccgggtcgacgacaaggtcgtcaaggcccagatctgggacacggcaggacaggagaggtatcgggcaattacaagtgcatactatcgaggggctgttggtgcgcttgtcgtgtacgatgtgacacgccatgtgacctttgagaatgtggagaggtggttgaaggagctccgggatcacacagatgcaaacattgtcatcatgcttgtcggcaacaaagctgatctacgccaccttagggctgtatcagtggacgatgccaaggccttcgctgagagggaaatcaccttctttatggaaacatctgcactggaggccatgaacgtcgagaccgccttcactgaggttctgactcagatctatcgtgtggtcagcaagaaggccctcgacataggcgatgaccctgctgctccaccgagaggacaaaccatcaacgttggtggcaaggatgatgtctctgctgtgaaaaaggcagggtgctgttcatcctaaattcgttttgcttgtgaagagggaccatatgctcacctgattatatgggtgactgcaaatatgacatcatttttgtctcctaacctggttgtttgcgagattataccggtgcaccaagaatttcgtttagatatc

SEQ ID NO: 27791 - DNA, 1222 bp, Triticum aestivum
  Clone ID: PAT_TA_27791
tagcgtggtcgcggccgaggtaccgtgccctcactgtgcccgagctcacccagcagatgtaggactcaaagaacatgatgtgcgccgctgacccaaggcacggtactttcgtccggaatagaactttccacggttctagtaactccaagcaggtgatgaataacctcgcactgggccatatccatgttgctttgtgatctttgaagctccacctggagcttctcactttcctttcgaagggcttcgttaaatggcaagtttggataagaacaggacagagtcttcttgagcactatcgaaggatttgtgctagggtcagggtttaacagagcttcatggacctctttgtcttcctcgtcaagagagtattcacattgatccctttcaatgtactcaattcgctcccgcacgcgggcgttgtcgacgagcgtgatgagcggcacgaggcggaggtagttgtcgatctcggtctgcgcggtgcggaaccggtagacgatgttccagcccatggcgaggaggtagaggtaggagcggtcctggcaggagttgacgagcaggtagccccggcggagcgcgtcctcgagctgctccagcggctcccgcgtctccgggtacttcttgagctccgacacccggagctgctccagcaggccgccgatgagcttgaggtgctgcgcgaagcggcggcagttgctcttgtgcatccgcgccgtggccgccgccttgacgatgaggccgatgaggcgcaccgcgtccagccccgtgagctgcgcgatgttggccaggtcccccacgttcgccatcgctgcggcaccggtttctcccttccccccgacgaatcacccgatctccttggtggcgcggagaagcggaatgcggccgggctcgttaatccgcgcgcggagcgaagatcgtactatccatcggcggccccagacgatccggctggagattctgggagagcagacgctgtgcggcggcgggcgtagatctgcgagatcgctcactcgcgccggcgcgccagcattccccgccttgccatggtcggtgggttttccccttttcgtcgcctgccacagcggctctttctttagctacctcctccggcgagcaattaagcgggcaggagtggcagagctgcacgcgacgctatctccctcgagcggcgcgactgaggggaggggcgaggactggagtgagagcggaggctcgtgccgaattc

SEQ ID NO: 27792 - DNA, 1235 bp, Triticum aestivum
  Clone ID: PAT_TA_27792
cgccaggaaggaagggggccgtcgtcgggtcgggtcgggccggccatggcctacagggcggaggacgactacgactacctcttcaaggtcgtgctcatcggcgactccggcgtcggcaagtccaacctcctctcccgcttcacccgcaacgagttcagcctcgagtccaagtccaccatcggcgtcgagttcgccaccaggagcatccgggtcgacgacaaggtcgtcaaggcccagatctgggacacggcaggccaggagaggtatcgggcaattacaagtgcgtactatcgaggggccgtcggtgcgcttgtcgtgtacgatgtgacacgccatgtgacctttgagaacgtggagaggtggttgaaggagctccgggatcacacagatgcaaacattgtcatcatgcttgtcggcaacaaagctgatctccgccatcttagggctgtatcagtggaggatgccaaggccttcgctgagagggaaagcaccttctttatggaaacatctgcgctggaggccatgaatgttgagaacgccttcactgaggttctgactcagatctaccgtgtagtcagcaagaaggccctcgacataggcgatgaccctgctgctccaccgagaggacaaaccatcaatgttggtggcaaggatgatgtctctgctgtgaaaaaggcagggtgctgttcatcctaaattcgttttgcttgtgaagagggaccatatgctcacctgattatatgggtaactgcaaatatgacatcctttttgtctcctaacctggttgtttgtgagattataccggtgcaccaagaatttcgtttagatatcaagatttaaccccaggttgataaggggggccatgctaactttggaatgtcagtgattttgtggttgccttttatggtttctttgctgctgtattgtcccacctcaattgacacaagaatcctctcaacatttcactgcgcagcctaacctgataaaggttgtaatgggagctatggttcattacttctcttggctttcctgctgaatggatgtgtactatgtagccctcagagattatactgtatcttctgtatcacaataggttatgtctacttggtaaatgtcatctgtaactggtagccagttttacactgttatattgtgtatcttccttcccagatgtacagaatttgcattgaagatccaaaaaaaaaaaagaaaaaaaaaaaaaaaaaaggccccta

SEQ ID NO: 27793 - DNA, 589 bp, Triticum aestivum
  unsure (1)..(589): unsure at all n locations
  Clone ID: PAT_TA_27793
cagagaatataaagcatggaaggctttaagttgtactattgagaccataccaccatatcttcatttagtttctttggaaatctgaaggtctaagaggacggtaaatgtgagaagctatgaatctacaacaaaaaactaaactaacttccaaacaaacatttcaagtttggaagccacaaagaagcagccaagatctctcgttgtagtgcaggtacatgtccttaatcatctccgagaaagacttcttggcatttttgtgcaggttggacacagcaatcctcgctgcgagctgcagaagaaccacacaggcaccttccttcaccttgcccttggggaggagggggcaacacttgcagcgccgcgacaaggcctcattagataaacctttactcttgtaatctacgttggtgaatccactgataccttcctttaccatatgctcattgaacctagcagaagcaaaggttgctattctccttccggaattaactgcagtctttgtctcctggagaaacatgcatttaatcttggcgatatactggtatgcagatttctcggnactcactcagtagcactatccatccataca

SEQ ID NO: 27794 - DNA, 742 bp, Triticum aestivum
  Clone ID: PAT_TA_27794
ttttttttttttttttttttttcaaagaaaaataaagcatcgtaaagctttaagttgtactattaagaccataccacacatttagtttctttgaaaatctaaaggtctaagaggatggtacatatgagaagctgtgaatccacaacaaaaaactaaactaaattcaaaacaaacatttcaagtttggaagccacaaagaagcagcccaaatctctcattgtagtgcaggtacatatccttaatcctgcatccacaacccagaatttttcaacacctaaatccacgaaatccaaccgaaggaaatcatggcagaaacatgcgccgtggcttacgtctccgagaaggaattcttggcattcttgtgtaggttggacacaacaatcgcttacgtctcctagaaggaattcttggcattcttgtgcaggttggacacaacaatcctcgctgtgagcccataatttcagtcttctttaatctctaactcgaccgaagcaacggttgatcaacaacaggaacctgaacctcgtgatgctagaccatatatctatggttaccctttttatttctcccgcctaacctaagtagttatctgaaacctgacggagtttgcttcggcctccctctcaatggccaacccagaacataatcatcaactatgcgcgcctcccccatgtacttcacaagcatcaagaacttgtttcagcgatttaacccgcctccttaacaatgataaacactggaa

SEQ ID NO: 27795 - DNA, 1239 bp, Triticum aestivum
  Clone ID: PAT_TA_27795
aatcgctctttccctgtccgtcctcctgtgtgcggcgccgccgctgcgcacaggccacatctcctcgccctcctcgacatctccggccaaggcgctcacttctccggccctcctccacatctcctcgcctccaccccatccacttcctgtcgaagactgcggcaacggagctcggcggctgcggcccttctccaagactgcagcatggtgctcggcggctgcggcaacggagctgatggagcgcgagccgaccagttcaacggaggcagtagcacggggcagcggcagcaacatggagggcgtccgcttgactaaaaagagaatgtatttgttgatagtgagagtgaggataatgatggggtgagtgaggatggggaagatgctccatccatgcatgatgagcaagaggcgcaaatgcaagtggaaaaagagacacaaattcaagtggaaaaggacgcacctccaagagatggcaatttggagacccgtagatctgtacggcttgtcaagaagaagaccaagggcgtcaacagcctataccctgttgcttagaaatctgttggcaagtctcttctttctagtgttttatgattcatgataattgcttagaaaattttagttacttggagctgctagtttcttagatgtatacactttctatccatgcctagccttcgttgtcatgttaagcaatgtatttatgttatcctgaaatgttaccacttgactattgttgcactagacacctccatgttagtccattttatttcattatgcacaaagtggaagaagaaaattctgatgttgaactacatctatcctgatcctttctttgttttctctatatgaactagaaatgccacataaagaactaaggatatcaagaagcttttggatgtatgcaagcttggagctgctgttttatagaaatgacacttgacgaataaccaaggatatcaagaagcttttggatgtaggcaagcttggagctgctgtttcaatgtcatgctttgatagttgtcttttggagctgttgtttctatgtgtaatactttaagtctgttggctgtaccggactatttaaactctgaactatgttgtgatggttgaactgatgttggactgttaagggttatgttggaggccactttataactaatgtgtgcctgttatgttggacagatgcagttttattaatccctagggcttatttgttgaaaaacccccacaacccccccc

SEQ ID NO: 27796 - DNA, 1297 bp, Triticum aestivum
  Clone ID: PAT_TA_27796
tttcctgtccctcctcctgtgtgcggcgccgccgctgcgcacaggccacatctcctcgccctcctccacatctccggccaaagcgctcacttctccggccctcctccacatctcctcgcctccaccccatccacttcctgtccaagactgtggcaacggagctcggcggttgcggcccttctccaagactgcagcgtggtgctcggcggctgcggcaacggagctgatggagcgcgagccgaccagttcaatggaggcggtagcacggggcagcggcagcagcatggagggcgtccgcttgactggaaagagaaagtatttgttgatagtgagagtgaggataatgatggggtgagtgaggatggggaagatgctccatccatgcatgatcagcaagaggcgcaaatgcaagtggaaaaagagacacaaattcaagtggaaaaggacgcaccaccaacagatggcaatttggagacccgtagatctgtacggcttgtcaagaagaagaccaagggcgtcaacagcctatacccgctgcttagaaatctgctgaaatgccacatgaagaactaaggatatcaagaagcttttggatgtatgcaagcttggagctgctgttttatagaaatgacacttgaagaataaccaaggatatcaagaagcttttggatgtaggcaagcttggagctgctgtttcaatgtcatgctttgatagttgtcttttggagctgttgtttctatgtgtaatactttaagtctattggctgtaccgaactatttaaactctgaactatgctgtgatggttgaactgatgttggactgttaagggttatgttggaggccactttataactaatgtgtgcctgttatgttggacagatgcagttttattaatcctttgagcttatttgctgaagtttatatgatcaatcctgatggttgttgcgctgctatgtttaggctttgttttatttcaaattttgtttgaatttttgccgaatttcggccaaatttcggttgaattttggtcaaaatttcaaattttgattttgcaatttcgcccgagattttgccgaaaaatttaaaattcctgaaattcgtccatttcggccaaggacgaaaaaaaacacaagcagaaattcaaaacacaggtggtgccttgggtgatcttttttgtatagacaagctagccattcagcttcagttgttatgcacatagatgataagagatagccagctagctagctacaaaatgcaacaaaaatagtgttcaaagtcgacgcggccgcgaattcg

SEQ ID NO: 27797 - DNA, 915 bp, Triticum aestivum
  unsure (1)..(915): unsure at all n locations
  Clone ID: PAT_TA_27797
ctcgagttttttttttttttttttttttttttttttttttttttttttttttttatgaaaatccatgtttattaagtaataccatanatagtatgaaatttacagtctcgttccacggtgccgattaattcactgtacaaataatcctatatatattgtaccaatgtactatgtactgctttctttcctttatttctgcagcatgcagaccacgcagagtcttttttatcactgttcttcacacctctgcttgctgatgtaccagttgttcctcgttgacaaagaaggcgtggaacccgtaaggaacccggttcggcagctcgacaaccgccaccggatcaggagacatggtcttggcatcaatcacattcacttcagatttccctgtgttctcatcgtgcacaaagaatatcagatagccatcgtcttcttccccagaaacaccgggctccttgggcacaaagacagcctctgaaccaaacctaccaggtcccaggtcatatatgcccatcacattccccccaacttcaagctgcttcttgccgctctctggctcggcgtgcaggtcaaatttgatgatgccagtcacctttgctatgctgtcgagtatcgtgcagtacacgtacctctgctttctgccggtatagctctcgttgactcgaggaaagtctacagcagagaccgacagttgcttctgtgaagcagcgccggttttcatgttgaatctcatctcatacagctcattcccgaagttctcgagcttctcgttttgggtgccgttcaccttgtccagatctgggttctcaaggcggcaggtaatcagaacaacttcgtcgccctcttcccaggcgttagcattgtggaaaatgaagcaattggggagttcaaaccatctgatggttttttcatcctttt

SEQ ID NO: 27798 - DNA, 595 bp, Triticum aestivum
  Clone ID: PAT_TA_27798
gtgctctcttcttcctcctctcctcttccctcggcggcggcgcaggcggcgcggaggcgacaggcgaaggcgaaatgacgaagggaacgggcagcttcggcaagcgccggaacaagacccacacgctgtgcatccgctgcggccgccgcagcttccacctgcagaagagcacctgctcctcgtgcggctaccccgccgcccgcatccgcaagtacaactggagtgtgaaggccatcaggaggaagaccaccggcaccggaaggatgaggtacatgcgccatgtgcccaggaggttcaagagcaacttcagagagggaactgaggccgcaccaaggagcaagggagcctcttccagcggcaactaggcgcggcggccttaacttgttacgctaggcggagccctgatcatcaaacttagcttttttgttgctttctactggaactctatgtttctatgttgagaggcggacgatatgatgcctggttatgttatttgcacaattatcgtggacgttaatccttcagttttgaatgttaattgtgtcgatgtcctgtgttagatgctctgcatctcttgttcaatgcgctatttgtg

SEQ ID NO: 27799 - DNA, 871 bp, Triticum aestivum
  Clone ID: PAT_TA_27799
cccacgcgtccgcggacgcgtgggcggccacgctagaccgcccgctcctgccaagatccaacgcaactttccgccccctcgtctggtcgtcgggccgtcgccgccggacaccgcccccttccaccgaagcgcggcagctcgaaggttcgtgttctaataagcttattcccttgaggcagcatgcctaagataaagacgagccgtgtgaagtatcctgaaggatgggagcttattgaaccaactctccgtgatttggaagccaaaatgagagaagccgagaacgatacacatgatgggaagaggaagtgtgaggctctctggccaatcttccgtatttctcaccaaaagagccgttatatatatgatctctactatcgaaggaaggagataaaaagggagctgtatgagttttgcttggaccaaggttatgcagacaaaaatctgattgctaaatggaaaaagccaggttatgagcgcctctgctgcctccgctgcatacagacacgagaccacaacttcgcgaccacctgcgtctgcagggtccccaagcacctcagggaagagatggtgatagaatgtgtccactgcgggtgcaaggggtgtgccagcggtgactgaagccgccactcgttgttaagaataaactgaaactgattgctcaagatgctctgttcgatccctgatgaatgaaaacaagcaacgcacaatcaggtgattcgtccatatattcactgtaaactcttgagccgtggtatgtatttgcgtgagaagactcggttttccgccgtggaagttgactactgtttcgctgaatgttatgttaaccccctccatgatggattacagtaaaaaaaaaaaaaaaaaaaaaaaa

SEQ ID NO: 27800 - DNA, 1483 bp, Triticum aestivum
  Clone ID: PAT_TA_27800
ggagaaccctcgtgtgcccatcgtcgtcactggtaacgatttctcacgttgtacgcccctctcatccgtgatggtcgtatggagaagttctactgggctcccacccgcgacgaccgtgtcggtgtctgcaagggtatcttccagaccgacaatgtcagcgacgagtccgtcgtcaagatcgtcgacaccttcccaggacaatccatcggtatgttcctcacaactgcaccgcagagataatatatattcatcagggcaatcaagttgtatagtattaacaaaggatggtcaatcctacacagactttttcggtgctctgcgtgctcgggtgtacgacgacgaggtgcgcaagtgggtgacctctaccggtatcgagaacattggcaagaagcttgtgaactcgcgggacggaccagtgacctttgagcagccaaagatgacagtcgagaagctgctagagtacgggcacatgctcgtccaggagcaggacaatgtcaagcgtgtgcagcttgctgacacctacatgagccaggcagctctgggtgatgctaaccaggatgcgatgaagactggttccttctacggttagaacattctccatacacacccaccatctcttgctgcataggaggaggtgaactacgcacaatccttttatactttcagcacctactttacatacatacttacttctcacttgcttacttctgaaacaaaagagagtgaatcataaacaaacagtggaggcctattcttcttacctgttcatccggcatatcaagctcatcttctcatcagatcgtccaaaacaattaaattgcaggtaaaggggcacagcaaggtactttgcctgtgccggcaggatgcaccgaccagactgccaagaacttcgacccaacggcgaggagtgacgacggcagctgcctttacaccttttaagcatgccaatttaatatctgatatttttatcctttgtacctaagtaccgcatcgcatccaagcgattgctgggcatgttttgttaatatataaagatattgagtatacctatttggtaaagacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaaagaaccaaatttaacgaccgggggctgggaaggtaaaagtttttttttggggcccccaaaattaaattcctgggccgggttttaaaaagggggggaggggaaaaacccgggggtacccaaattaaatgccttggaaaaaaatccccttttccccagtgggggaaaaagaaaaaaggccccaccgaatcccctttccaaaaattggcccaccctaaaggggaaagggaaccccccttgtacgggccattaaagccgggggggggggggggttaccccaaggggacccgt

SEQ ID NO: 27801 - DNA, 893 bp, Triticum aestivum
  Clone ID: PAT_TA_27801
gcagaagcctcgggcagatctcagggtgtcgttttttcgaagattctttggataggaccagttcccctgtgtgaaaattttcctgtgttgtcttgtacatatttctcataagcaagattgaacttttttacagtttaattggacaattcttcgctacattgcccgattcagactacggatttccaggaagggatacaacggggatttcccgattcagaggactccaaagaaaggattggtgatggcggagttgagctcggctccagctacattcaggacagccttgtcaaccttgtcccttgccagaaacaagatctcctcgccttccggtttctcaaacccgcacagctcgagaaactctatgcctccaaggctcccaactctctcctggaatgtagcattggtaagtctgatctttctgaatttctcctcgtcagggtttttaaccacgtttccgatgtaggtgaggagtgtctgaaaagccctctttactttagcatcctcctccttgttctgctgcttgatatttcgtaagcaatccctcatccgctctgcctttgtggctggtctgacaggtaaaaatgcactcttcttctcttcaacagggcggtggcgcacttggcttggatgcagctggggcttctgccggcaatccaagttttcttctacgttcagccttgtcctcttcaagtttctggcgaatcttttctctggctcttttctcctcctctttctcaagccttctcaattctatgatgcgtttcctttcatttaactcctccatttttttggcttcaagaagctccttaccaatccttatgcgctccttttccctttctctctccatccttttttcttcttcttctttctttttacgagcacggtcccggacg

SEQ ID NO: 27802 - DNA, 710 bp, Triticum aestivum
  Clone ID: PAT_TA_27802
tcgcggacgcgtgggcaaatcccaaatcaccaaccaaatcccccctcccgcgtcccgacgagcaccagccgccagacatggacgcctcagccaccggagcgggagcgaaggcgaagaagggcgcggccgggcgcaaggccggcggccccaggaagaagtcggtgacgcggtccgtcaaggccgggctccagttccccgtcggccgcatcgggcgctacctcaagaacggccggtacgcgaagcgcgtcggcacgggcgcccccgtctacctcgcggccgtcctcgagtacctggccgcggagctgctggagctcgccgggaacgccgccaaggacaacaagaagtcgcgcatcgtgcccaggcacctgctgctggccgtgaggaacgaccaggagctcgggaggctgctggccggcgtgaccatcgcgcacggcggcgtgctgcccaacatcaacccggtgctgctccccaagaagacggcggagaaggagcccaagtcgaccaagaaggccgccaagtcccccaagaaggccgacaagaaggcttagagagagccgcgcgtcgattagcctaggcgttgtagtgctctgtagtgacagtgatcgctgtttcgatgtagatctgtgttgaaaatgtcagaaatctctctgatttgagcaaattgtttgttcttcttctgttcttggtaatgcaatgttaacacttaacgc

SEQ ID NO: 27803 - DNA, 548 bp, Triticum aestivum
  Clone ID: PAT_TA_27803
tttttttttttttttttttttttttttttaccagggaaattgcaaatttttatactgggaagttactttcatcaactttctgttgctgaacaggcagatccagaggttgcaacaaacaggaagagaaaatacaacaaagtctcggaaaaaagtttgccaagtcccagcgggaaggtaataaagaaacataaatatgttgaatcttgaccacctctaaattaatcaccacaaagctaggacttggccctaacacgcacacgccgacgaggacgacaacaacaaccaacagcagcagcagcagcaaattattgctatctatcaaacaatgatggtggtggtgatactaccaacaggctggagcaccatggaaattatgggatgctccaggcgggctgttgacgaatagggtggtggtatcctgtcatttacagagtcgcaaacggcgtcgttccttctttcatcgttcgttctcaggttcgggttcccttgtccccctccttcctgttatttcctctttgccggtgccgagggacaggagctcgagctgc

SEQ ID NO: 27804 - DNA, 889 bp, Triticum aestivum
  Clone ID: PAT_TA_27804
gcacgagggcgacgaacacccgccgcgaaatcccaaatcaccaaccaaatcccctcctcccgcgtcccgacgagcaccagccgccggacatggacgcctcagccaccggagccggagcgaagtccaagaagggcgcggcggggcgcaaggccggcggccccaggaagaagtcggtgacgcggtccgtcaaggccgggctccagttccccgtcggccgcatcgggcgctacctcaagaacggccgctacgcgaagcgcgtcggcacgggcgcccccgtctacctcgccgccgtcctcgagtacctggccgccgagctgctggagctcgccgggaacgccgccaaagacaaacaggatgtcccgcatcgttcccaggcacctgctgctcgccgtgaggaacgaccaggagctcgggaggctgctggccggcgtgaccatcgcgcacggcggcgtgctgcccaacatcaacccggtgctgctccccaagaagacggcggagaaggagcccaagtcgcccaagaaggctgccaagtcccccaagaagggccgaaaagaaggcttagacagagacgcgcatcgatcgattagcttgtcgtgctctgtagaactaatggtgtagatgtagatctgtgcttccaagaaaaaccaattcagaaatctctcttcgattggcttagccgctgtagtgctctgtagtaacagtgattgctgtgtcgatgtagatctgtgctgcgaagaggaaaatgtcagaaatctctctgatttgagcaggcatcatcttgtttgggaaggtaatgggactgcaaataagagtggcagcggcgaccaagatgcaaatggaagtggttcccaaagaccttggaaataaatggcacgtgaacaaaagatat

SEQ ID NO: 27805 - DNA, 1334 bp, Triticum aestivum
  unsure (1)..(1334): unsure at all n locations
  Clone ID: PAT_TA_27805
ttttttttttttttttttttataagagacttagacttctcaaagttctatatgtgcgatagtcagacggcatacaactaggcaaggcaaaatagatttgtcagtttcgccagacaaaagtatatgccaagtctttagtaagggttacatgtagaggaatacaagagtgcaggaaaaaaataagcacgccaattcatccacccaagttcacctttgtcacaaaataagcaccaatcaacagcggtggagacaaaaatccagcgtaggtcacaaaattggcagacaatccagcaccaacaactatccaatttgccaatcttctttgcatgacacataagcagtccacaagcatttcctttgccaccttacaaacagcgaactaggcttgagcttattttatctctacttcccttaggaagtgcttgaactcgtgattgcttcaccagtctctttgggaaatatggtcgtcactgcctacatatgtaatagaccggttgatttgctaagtcaagacctatggccacaagaacaagctgcatctcacttccgcatacatgtaacaggccgggccgatgcgctaccccagcaggggtggaacatcaagattagtggtggtgttatgtacaatgggtatgtacaactcctgcgcaggacttcaaatctcgaaaccgccatttaattgcacagataaagatggccttccaatgttatttagaggtgtttccaacgtgactactactccagaactgcccacttgaccattccactttgaccgcccaatagaaagagcagtaaaagctgacggatttcttgagcaggataaaccacacatcacatttagttcctcttttaatgaatggatgacctctgctcgtacatacatacacaaatcatatagaacaaaaggtatgctccggtccgaaagcagagtcgtgcagcagagttgtggacaaaagtgaagttcacaaaagaccttcatacgagataggccattgtttcaactcgtagtttaggccttgccggactccccgcaacccggtggcctaaaggcgatgaagctgacgcactgcacctggcgcaggttgtcgaagccgatgacacggacataggcgtcagggtacgggcacatgcttgtccaggagcaggacaatgtcaagcgtgtgcagcttgctgacacctacatgagccaggcagctctgggtgatgctaaccaggatgcgatgaagactggttccttctacggttagaacattctccatacacacccaccatctcttgctgcatgggaggaggtaaaggggcgcagcaaggtacctgcccgggcgnncgctcgaa

SEQ ID NO: 27806 - DNA, 1192 bp, Triticum aestivum
  Clone ID: PAT_TA_27806
tttttttttttttttttttaagtaagatatgtagaatgaaagataatgcaatgtggattgtattgctgataatacaatgacttagacgggtttacaaatagtagaataacttaaattggtttacagatagtagaatgacttagatcagtttatagaaaaaacacttatatataggcagcctcatgccttatttaggcatcttcttagtctgaccatggtcttaagatgatatgtacgaaaaagcagtgtcatcgtcggataatgcttgcatggtagacttccacaggtacttgagggcctataaaagttggttccactgtcagaccatttggagtagcccatatagttattatctccgaaatatcttttctttcattggtccatatgacacacttgtagaaccagatatcagggaaatcaccaacgtgatagttgttgttatctagcatgcaaaacaatgactcgggatgtcttccattataggtgaggtgaggatgtcttccattattggtgaggtgagctgtagaactcagttggtagtcctttaatccttatctcatctcttcgagagaggatatgagatactgcaccaatagacacgatgagaggatagcaagctacctgtccagacggatgggttggagacagcgaggtcgccggcaaggacacacatccaagcatgtttatgtttttgtgaaacctgggaaggatgtgaaaactgagctgcaagtaaaaccatagtttaggttctgccgaaaagtcccatagcatgatatcttcagaacaacatgtggtgtgccggtggcatccaaacaaaaagatttggaacagggagaatagaaatacaccaaaagagatcgtcgtctttgaattttttttctcacgcctggcctaattgcaaagatatttttaaatgcccacatatttatttagctgattgctataagcaagaaaagccgccatcatacacaaagcggaagacattgagtatgctcctatactctgtcaaaattaaactacacaaactcactttcagttcgaaaatgtattttcattgccatcatgtcatcatacacatcaaagagccaataccctagacccttctcccgtcggcagcaccgggtgtcatcgccgtcatccccggattagaatccgagcttgctgcggcgccagtgcctgcgcttggcgttgt

SEQ ID NO: 27807 - DNA, 1328 bp, Triticum aestivum
  Clone ID: PAT_TA_27807
ttttttttttttttttttgcagtaacacatgtagcttcagcaaacaaaatgcataatttctgttgcaaacagtctaataataaagcgagtataccgagtttcagccctattattattatacagtaacacaaccagggccttcgatggaaatgaccctcaaatggagttaaaatgggaaaataaacgcccaaagcctgcagagggcaggtgcttgtaaggttgtgcatctctccagagtcaacaggaacgcaaaatgattcccaggtcgagagttccgtaaacttggtatatacatacgcgatactcgatcgcctctgaaactgaggtttcagaactgctggtcgaggatcgagtctttctccgacttggtctggccaccactgacatagcccacaaggctccccccaacgtccgagacccatgagacgctgcgcgccagccaagccttgggagtcgacgcctgcgggctctctgctgctgctgctgccgccatgctcctctgttcttcctcgagcaacgcatcaagccacctctttgacatgtactctttcacagcgtctacaccttccttcacgacctccgctggtggcatggacagagggttctgctccaggttaagcttctccagcttgtcaagccggccaaaactgtcgggaagagcatggatctggttgttgctgaggtcaacctcccgcaggttcagcaggtcaccgaatgagaaagggagctccttcatgtcgctgaagttgctgctcaggtcgaggatttcaaggctggaaagcttccctatggcagatggcagaccgcatagttcattgaaatgagcatccaggacgtatagtgaccgcatctcacagatagatgatggaagagatcgcaacttgttcatgtgaacccagagctttcgcagattaatcagttcatagccaatatttgttggcagatatgtgagcccattgtagcttgcatcaagctcaactagcgacctgcactttgagatgctgtctggcagtgttctcagcttgttagtcgacacattcagaatcttcagattggacaaaaatccaacagtatcaggaagagaaaccaaggcattagaagcaagacggagctcttcaagatgttcaagccctcctatagcatctggaataacctggagctggttgtgtgatacgtcaagcacgcggagtcccaggatccttccgaacgcctcgggcaggtagcgcagctgccgatccacgaggagcacgctctccaccggcttgccctcctgggcctgcttcagcacggcgacgacttcctcctgcaccgccacctatcagcgcatg
